United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 17

SEQ ID NO: 67840 - DNA, 2640 bp, Glycine max
  Peptide Sequence Number=SeqID_184618
atgagtcgtgtacactggtgcaatgcaatcagcgatgtggcgtttctcgtagtctttcttctttgtttgtttcactgtcttagtattactattactatcactattggaggagaaaggagctatatggataaccaccaagatcaaggacacgagggtcgtgcatgtagatgtagcgaatgtcgatggccttcccctaatccaaatccatgtcccaaaaaaagtctttctcacaagaacaaatgtggaaccattgaaggttacgaactgtcaacttcagagcgccaaacccattccaatgcttcagagtcggatgatgatgaacacctttctgatgatgatccccactcacaaggtccaaactccttagaccctggcaacaatgagaaactcaatgttggaaccagaaaatttttatctagttcaggtgatgagttgtttctagatgcaattgcaaacttttcagatggtgcaccaagtccaggaagtaaggaacctttgcgagatagccatgagtgggctcgtgatgtggaaataggcaatataaaatatcaagaattttcttcagggtcttctgattttaatgatataaatcagttcaatgtcaaaggccaaatgcaggaacatagtattttgcaaagggaaagggtcaaggaaggaaacatgctggagatgcaaggtcaactgtcaggttctcatgttcatccaccatcatcaagttccatcacagatttgaggaccattgagcgtattgatgattgttttggtttgtcaagtgactcaaatcccagcaaagctgaagccacaccagatatgatgctagaaaataagatccatactggtgaaaatgtgaggccatgcagtttggcatctgttgcaaaggagactaatttgaaagaaaatgacgagactaaatcagactcggacatgtttgacatttcgatcttttctgacaatgctgttagtgacagaatagcacttagtgatgtggttaactcggattctcaagtggctagaggagcttttaatctggaagaaaagaacaatgctgatctcctttctttgatgctccaagaggaactttctcttgaagtaaattctaccatttcaagcacaaacacttccacaaacagtgttcaagtaaattctgcacatacgatacagtttgctacttctggcgatgccaagacgttgcaggaaatgggagaagaaaatgttaacatgtttacaagtcctgtgtgtgatgatagtgctgatgtggcacatccccaaaatgagtgtgctgattttaaagatcataaaggagtgttaccacagaatcccttaagcccaccctcatctgaagcagggaagccaaagcaagatgacttgaaggattctgatgatgaggaaaattattttcatataaaccaaaatcatttgagtggaaaaagacaggtccttcctccagatggacgtgttctggatagcagcatgaaggagcaggaaagctgggagattgtggctgaagaaatgcatgctgaagagagcattggagtttcttctgtgaatttcatgacagaaaatgataaagcatcagatgaaattggaatctctatgaatcgtatgaaattagagatgtatgaaaattatatgggtgctactcacttttctgacaagccatcaagtggtgtatataaaagtgatgacgtggttgaaatggataaatttgaaaaatgcgatataactgatgctcagtacaccgaaaggctcattgtgaaagattcttcattgcctaaacctgctggcagtaattttgaacgttccattctttcagaagctgcaatggatttctatgcaaggacaccgaaagatattgagtgtgcaaataaaagttcactatcaggtgctcaagaagacaatgaagacaatgaaatcaaaagcagttgcagagtaaacaaagaatgtaatagattcattagtacttctactgattcacgtcaaacacaaaatgcagaacttctagtgaaggctgcagaagagcctggtaggaattcttcgctttattctttagatgttgagccttctgctcaatgtgtttctgttgttggagaaactcaaggagagcatggcagggaagtgtatggaattactgatgtgcctgttcaagatcaaagtggtaataataatagcaatgctcaactaccttcatctgcaattcacacttatattgattatggtttaccatccaacttgaatgacccaaaggctgcatctgaaggccaacaacatcccagttccacctcttcacaggctggttggtttcccactctaactcaagctattaatgagtctcaagggagaaagaagaatgaagaaatagtagctgagataacaaaccgaaacagtgaacagaaaacacctccacagagtccattgagtgaagctgccaacagcaacaagcttgagtctccaaaactggaagaaagttcaatatttggaaaaaatggtgaatcagctgctgcagctaaagctgtgaaaggagagggtgaaaaaggttcgaactcctctgctgacatcaggcgaaaaaataagaaagtcaagagcaaactctattgcacgccatgtatgtgctgctcatctgtagattctccaccaagatag

SEQ ID NO: 67841 - DNA, 279 bp, Glycine max
  Peptide Sequence Number=SeqID_184619
atgacagcaataggtacctcagggccctacactggggcaatgagaggcaccatgcatgaacctcaagcaaacctaggggtagatcagaagttcttacccgagaatcctcgaggtttcacacttgcacatttgagaagaaagctcattcgaccaagagctcctggaaaatgcccaaagacaattgtgatagtagggattagcccatgtcataaagttttagcaggatcgacagacccttggcatcactctatgaccttaaatcaggaaagattcacttag

SEQ ID NO: 67842 - DNA, 401 bp, Glycine max
  Peptide Sequence Number=SeqID_184620
atgggttcgtcgggatttgatcccattccgttcagaagcgttctgctcattgagttttgtaaaaggttccggtctttcttcggtgaatctcgaggtctttctgatggctgcgctcagcctaatgttatctacgttgacccttctcagactagtttacaactaagaggacgggcttttgggcgaaaaggaggaaagcattggtttatgcccacccggctgaaaggaggctttctggccggtgaaaaagaggagagaaggggagaaggagctcagagcactctcaattatcctttcttgcgtcatcagcttgatatcagaatcgttgaacgtatagcttgtggtacggacttcacgcgggatgtttccgagctagattgcaaaaccgaaagccagggggaggg

SEQ ID NO: 67843 - DNA, 213 bp, Glycine max
  Peptide Sequence Number=SeqID_184621
atggaggggcagaacaaaattgagggagtaaaactcaatgtaccttctttcaaaggcaggagtgacccagacacctacctagactgggagatgaaaattgagcatctacagcagaaccatgcgatagaaactccagaggttgtcccagggaagtttgactgtggaggagtactacaaagagatggagatggcactagatggagccaacattaa

SEQ ID NO: 67844 - DNA, 1131 bp, Glycine max
  Peptide Sequence Number=SeqID_184622
atgacgcagcagaatgtggtagtgtctgatactaaatccggagtttccttaacggtttttccaacaacaacacaaaagccaccggcggcgccaggagggtacatttccattccgaggaggagggttttgaagaaccttgaaatcaatggaggccaaagaatcaatgcatgggttgagtccatgagagcctcctctcctacccatcataaatccacacctttgtcgcaggagcataactcttggattcttcaccatccatcagcattagacatgtttgaccaaattattgacgcgtcaaagggaaaacaaattgtcatgtttctggactatgatggcacgctgtctcctatagtcgacgaccctgaccgtgctttcatgtctgattcgatgagaaaaacagtgaggaaacttgctaggtgtttccctactgctatagtgaccggcagatgcaaagacaaggtttacaattttgttcgattggcagagctatattatgcaggaagccatggcatggatattaaaggaccaacaagaagttccaaatacaacaaagatagcaaagctgaggcaatcctttgtcaacctgccagtgattttcttcccttgatagatgaggtgtatcaacaattagttgaaaagacaaaatcaactcctggagctctggttgagaacaacaagttctgtctttcagtccattttcgttgcgttgatgaaaagaaatggagtgaactggcacgccaagtgaaatcagttttaaaggagtacccgaagcttcgacttacccaaggaagaaaggtgctagagattcgtcccactattaaatgggacaaagggaaagccttggaatttttattagagtcactaggtttggccaattgtagtgatgtctttcctgtttatattggcgatgatcgatccgatgaagatgctttcaagaaattaagagacagaggacaaggttttggcattcttgtctccaaatttccgaaagacacaagtgatgaactttcttcaacgcttggtggagtggaaacatgtgtccctgggagcacgttcccgagtgtaaacgagaaagatgaaatgacatgcacatccctaccctgccatgaaaaagaagctcaacttgggtag

SEQ ID NO: 67845 - DNA, 141 bp, Glycine max
  Peptide Sequence Number=SeqID_184623
atggcgaattcatcactccctatcaagcatagcactctgtttatgaagaagacctatcaacgtattcatgactctgatggcaaccaaaacgcttctcctctttctgctctccctatgcttcttcggaagtgcatgaaataa

SEQ ID NO: 67846 - DNA, 405 bp, Glycine max
  Peptide Sequence Number=SeqID_184624
atggggacgatgctgaagttggagatgaaagggtttttgagggagataatgaagtttgatgctgactaccctgtacaagtttatgttgacattgaaattcaaggaaatttaccttactactccaagcttccctactctgacatcaatggcggaaacagaggacagtggcgcttacctcgacggtcgacgctgacgacgctacctcgacggtggttcgtggctcctcttcacggcaacaagaagaacaaaaatcaaacacaagctcctcttcatggcaataggttcgtggctgaggaagaagaagaatcaaacgaggaagacagagaaggtagcgggagagagacaggtccaagaggtcaccaacaaaatacgaaaatggctctaaggaagaatcaaacgctttga

SEQ ID NO: 67847 - DNA, 198 bp, Glycine max
  Peptide Sequence Number=SeqID_184625
atgacgacacaaacgactgaaacaaggtggaagaggatggtcggggcaatcgacggtggctcatgtggtggaggtgccgccagatcaatttttgcaattcgcactatcagggatttaggaagtagcgttgagctcaccaaatcttggttatatgggacagagtgtatgttgccactagagttagtagatgccaagtag

SEQ ID NO: 67848 - DNA, 1503 bp, Glycine max
  Peptide Sequence Number=SeqID_184626
atggcaaactaccaccgcaacaacgtagaaaacgtcgtcctcggccaccaccaccgttccaagtccgcctccgtcgccggccacaccttccgcctatgtaccgccgcctccttccgccgcctcatctttgacgccgtcagctgcggcgccagctctcgctacgccgcgagatccaacacctcctccgacggcgagaaacagcaaaagcaaaaacctaagacgtcgtcgaggaagccgaacaatgcgaagtcggagaagctctcggatctgctgagcattgcggaggctgaagccgacgtggaaacgaagaagaaggaagaaaagctggaagaactgaagctcctcgtgaaggagcttcagcagcacgaagaagtagatgattcaacgaagaaaaaaagagaagctgcggcgaaagtgaggttgttggcgaaagaggatttggaagtaagaggaacgctcgctatgctaggagccattcctcctctcgtcgcaatgctcgatgaaaccgaactaaacgacgtcgattcgctcatcgcgtcgctctacgcgctgcttaacctcggcatcggaaacgacgcgaacaaagcggctattgtgaaaattgggtctgttgagaagatgctcaagtttattgaatctccagatgatctagattcttcggtttctgaagcaattgttgcaaatttccttggattgagtgctttggattcgaacaagcccatgattgggtcttcggcttcaatttcattcttagttagaacccttcagagtttagatgataagagcagttcccaagccaagcaagatgctctccgagcattgtacaatctttcaatcttcccaggcaatgtttcattcattttggaaaccgatttggtagtgtttctggtgaactcaataggggacatggaggttactgaaagatcccttgcaactctcagcaatatagtgtccacccgagagggtagaaaggcgatcagcacggtgccggattctatcccaattttggtggatgtgttgaattggactgattcgccggaatgccaggagaaggcatcatacattttgatggttatggcacacaagtcctatggtgacaagcaggccatgattgaggcaggggttgcatcatccctgcttgagttgtcccttttgggttccacattggctcagaaaagggcctcaagaatattggagattttgagggtggacaaagggaagcaagtttctgggagctatggcttgggtgcagctgtctctgcccctatttgcggctcttcgtcggcgaggccagacggaggaggaggaggaagagagtgttttgaggaggacgaagagatgatgagtgaggagaagaaagcagtgaagcaattagtccagcagagtttgcagaacaacatgaggaaaattgtaaagagggccaacttgcctcacgatatcgcgccatcagatcattttatgtcactcacttcaagttctacttcaaagagcctgccattttga

SEQ ID NO: 67849 - DNA, 453 bp, Glycine max
  Peptide Sequence Number=SeqID_184627
atggtgatgcagtgggaaaagacggtgttgttgataggtaagagaggagagaggataaagaaacggagagaaaatagtttaagcagcttaaattctagcacatttccgtgtgcaggcgcattgcattcagctactgtaactgaatgggtccaactgattgaacaacaaatagacacttgggcaaaggagcaccaaagcaatggacaggaattcaattcctcaaaagggtttctgataaaggtgttcttttggtacgtgaacgtcatgcatggcgccaccaccactggcgcttccgcgaaggagctgccacgtggagagggacacgctagtagcagtagcggcttcgccttctgcttacgtggagtgggacgcgcaacctccactgacgcgttgtgcatggaggccagaaacgccagtcaaactggcgttttagctttgcagcaagcacagtag

SEQ ID NO: 67850 - DNA, 1311 bp, Glycine max
  Peptide Sequence Number=SeqID_184628
atgtccagtgtaggagtaatcccagcgagtactgagtatggccaaaggagtgatgacaggttggttatccttgtccgcgacaggactgtaataacatttggcaagcttagagtatggtgccccggtaacagagacttaacggtgaggtcgcagcttaaccataacccagcctccagttgcaaaatttacttcccggtgatggttatcggcaaaatgaacccgctatgtattgaagaaacgttggcggcttctttccaaaggttacctcaaacagtgaggttccagtgcttgaatttcgtgaggatcctaatcgaagaccaagcttttaggcataccatggtgttttgcaatgatgtccaggaagagaggtgtaacagtataggcggaataccaacgatgaagtctaagaacaaatcctcccaaggcttggcgggaattggtaatggatctagtaatcctacgaattttttaggctcatacttggttcctggaggagcaattgtaattcatgatagcgcgccagccactacattcgatcttcctgatctttattggatggtcaatgcatgcaagagtttgggacaaaactgcttgctgaagaaagcaatggggtggcccttttgcgacaagactgctctcatccctactcctgaagcatcgatctccaaggtgaaaggacattctcttgaactggttctatacctagttccaacaccacatgacctaaatactcaatctagcgttgagcaaaagagcatttggataactaaaggaaaaactagtcgttctatagcaactagaatgtttgttcaagatgaattcacacagaaacgtcatgatccatcacctttcctaaccaaaaagacaggggatgagaatggactggaagttgatagcatgattagtgttgcgaggtggggggaactcaacgggcatgactcgaatgtggaagaaggcattcgccccatcggtcctggccaatcagccacacggcctgaaatcgtgtggaagcttatttgggcttgggactggtctccttgctctatctccaggatattggtggtttcggtggtgtggagtagcaagggtggaggtggcagcaagggtggaggtgggatctaccctaaaggatttaccatcaaagtgcagtactttgagtttcatgcgatacgggtttacaggcagggaaagggaggtgagattgagttaggtggaggtgagtttggctatgacgtcttcaaggcgatccatgttggacttggagcgcatcgattcgaccactggagctcaatgaaagcaccaaattgttag

SEQ ID NO: 67851 - DNA, 951 bp, Glycine max
  Peptide Sequence Number=SeqID_184629
atggatgataatggaagtgacttttgtgaagaaccctgcatgattgctggaagtcattcgtgcacccttgacagattgtatgcatgggagagaaaactttatgatgaagtaaaggctggtgagttcatcaagaaggattttgatcgaaaatgtgaccagctaaggcatcaatttgcaaaagatgaaggcaataaagtgattgacaaaacccgaacagtagtgaaggatctgcattcacggataatagtggctatttattctgttgatttaatatctaaacgaatcgagaggatgagagatgaagaattgttcccacaacttttggaattaactcaagggttgatgaggatgtggaaggctatgcttgaatgtcatcatgcacaatacattactatctctttggcttatcattcaaggaactcaatgagaaccttggaaggagatacccgaagagagataatgactcagctactagaagaatttgagtgctttggtctaagcttttctaactgtatcgacagccacacctcatacattgaagctctcaatgtatggctacaaaattgtatactacaaccaagggaacgttccaagagcagaaaaccattctcctctcgccgtgctttggccccacctatatttgttctttgtcgagattggtgtgctggaattaaagctttgccttctgaggaactaagtcgtgcaataaagaactttgtgtctgatcttcgtcgcatgatagagcagcaagatcaagagcttcatgaaaaacagaattcaactgttgcaagcattggtggagaaaccgagagcaaaactaatgaagaaagtgaagacgattcttcacatttgtgttgcatacatgcaagtttaaccaaacttgttcaccaactcactaaatttgctgaggcatcattgaagttgtatggaagatatcagacaaaaaagtga

SEQ ID NO: 67852 - DNA, 930 bp, Glycine max
  Peptide Sequence Number=SeqID_184630
atggcaacagttatggacatgtacaatactagtagcatcatgataccagatttcttagaccagtgtagtgatcaagagctgatgaaagcacttgagccttttatgaaaagtgattcatctagcattacatacccttcattctcttccttttcttcttctcccaatttctcttcaacaacaagctacgagcaaaaggtttcaataactccaaaccatgctagttccatcaaactgaaccaactcaccccatcacagatgtttcaaattcaagcccgaatccaggttccacgaggccagtttctgagcccaaagcccattcccatgaagcacgtgcgggcttctccttcttcaaagcccacgaagctttaccgtggggtgaggcagagacactggggcaagtgggtcgctgagatcagactccccaagaaccgaacacgtctctggctaggtacatttgacaccgcagaggaagcagcgttggcttacgacaacgcagcgtttaagctaagaggagaaaacgcgaggctcaacttccctcacctgcgtcaccatggagcacgcgcgtacggtgagtttgggaactacaagcctctcccctctgcggtcgatgcgaagcttcaagccatttgtcaaagcttggggaccaattcgcagaaactcaaaactcaaaaccctattgttctagatacacacaaggcagagacagagacatcggagtttcaggattttaataaggttgagaattaccaaacatcatcgtcctcggccttctccgatgaatattcttcttcttcttcttcttcttcacctgaatccgatattaccctcttggatttctcggattcttgtgaaacaatggacaatcttgggttggacttggagaagtacccttccgtggagattgattgggcagctttatctgactcatga

SEQ ID NO: 67853 - DNA, 1395 bp, Glycine max
  Peptide Sequence Number=SeqID_184631
atggtgttgatcagagaagaagagatagtggaggagatgagtgaagcggagtgcaatatcgactacgagaagctgaagaaacgcatgtggaaggaccgagtccttctgcagaagctgaaggagaagcggcagaaacaggaaccagacgtggaagcgaaacaagaggcatcgaagaggaagaagatgtcacgagcacaagactcggttctcaagtacatggtgaagatcatggaggtctgcaacgcccaaggcttcgtctacggcatcatccccgagaagggaaaacccatgtccggttcctccggtagcctccgcaagtggtggaaggaccaaatccgctttgaccaaaacgcccccgtcgcagtctcaaagtacctcccactcctctcaaaagacattgaccttgacattgcttcctacatacacctcctccaagacttgcaagactcaaccctagggtctcttctttccgctctcatgcaacactgtgcccctccacagagaaggttccctttggagggagggctttcccctccttggtggcccaacggggaggaaatctggtggggcgaacagggccttctggcccaagaaaacggcccacctccttacagaaagccccatgacttgaaaaaggcttggaaagtttctgtcctcgccgcagttatcaaacacatatctccagattttgataaactcagaaggctggtgactcagtccaagaccttgcaagataagatgactgccagggacagtgccacgtggtcgaaagtcatgaaccatgaagaggctttgctagatctaaccgagaagtgcctcaaaatatctaatgatgatgacaaccttgaagaagaagaagaagaagaagaagaagaagaagaagaagggttttctggttctcatgaacctcaacttttgaagaggaagggcgcgtttggctttggtagtactgatgctttagtggataagctgtatgcttgtcaaaacgcagggtgtccacagagtgagccttctatggagtttgcggataagaacttgaggctggaccatgaggctctgcgtgctttccgaacagtggatagcgatgttcttccatttcaccgttatctctccaatgatgcaccaccaatcacaagtttggatgatttgatgaacgtggcttttcagaatgatgtgaaccttggtgaggctgctggtgggagtggcacattggaagatgacccttgttactggcttaacgccattgaaaatcttgagttgcaggctgcgttagagttgttggtgagagataacatggactttgctcaaaatgttccggtgcagattccgcagggacagggacaagaggatgcagcctcagtttggggcttgggaacccatccaacgcaaggatag

SEQ ID NO: 67854 - DNA, 831 bp, Glycine max
  Peptide Sequence Number=SeqID_184632
atggctacaccacccagctaccctcctactcctcctaagtcatcagcaccttcgtcatctacgtcgaagaagacaagaaaagaaacacatctcagatcattggctactagacctatggcgaagagaccaacggttcatgtggatcctaccactgggaaagcagatggtccccaccgaaagaaattaaggacgtacttggggatcatcactcgagacaaggttgaattttatattctagaagtgcccgatcaaaggacaagaaaaaaatcttcagaccataggaaagattccctagaagagcaggccacacagggaagctttgtcgcctatagacgtcaggatgtactgactgttgcccttggaggaccagagcaccctgctcgtgtccgggctactagagtcggtgtcatgaccaaacaatactttggactggcttcaaaaagctctcacacatctacttccatggcttttgaagacctggagcagctgacaaaaaatcagggactagttggaggaggactcgtaccacctcctgagcctgaggttagtccttctgctgcctgtgtcgatccctcgaggaaggacccaaacactggtgcatcagataggcgcgggttgtatgtcaatgagaattctccctgcttggttgccattgcaagagtttatgtggggtcgacgactgttcacaatgtccctttaggcaatgatcaagtgaaggataaacaagaacctaatggaccgtcgaaacctgtagataagtcagatcctgatgttgatcccttatacctgatgacattgaccatcccacagtttttcctcaagtctttgcag

SEQ ID NO: 67855 - DNA, 411 bp, Glycine max
  Peptide Sequence Number=SeqID_184633
atggaggaatatatgaagacaaaggaggcattaccgagatgtaggcgagtgatgcagtgtggccactggtttttgaccaaggtggttcatggtgtgatggccaacgtaatgaaccttttggctatggataggactgaacgtttagttatgttaatgactaatgaacaccgcacaggactgtcacagagaaggaggaggaagaaaagaaaagagaagggagaaggagccacttacccttcacagaaggaggaaggagaatgggggagcatgagaatgagggggtgggggaatgaggagttgccatgggaaggaggcgtgttgtcgaagaaggaatgccatcatgagcgtgtgccatcgcgggttaagagaagagagaagggaggtgttggtgttgagaaatgggaggaatag

SEQ ID NO: 67856 - DNA, 762 bp, Glycine max
  Peptide Sequence Number=SeqID_184634
atgaataaaaaaccaggtgacatgcgtcacaacccatatcatgatctagaggctgcatacgttgcacaaacatgcttaacatgggaagccctcaattggaactacaagaattttcaatcaaaaagagattcacgaggccatgatgttgatgtgggttgtccagccaccattgcacagagattccaacaatttcaagtgttgttgcaaagatacgttgagaatgaaccttatgagcatggtagaagacctgagatctatgctagagtgaggcatttggctccaaaattactcctcgtaccagaatatcgagaatcggatgatgatcagagggacgataatggcattcactcaaaaatatcatcagcatcatttcttgtgataatggaagatgggatcagaacgttcatgagttttctgaaggctgataaagagaaaccatgtcagattctggcagcttgctttaggagaaaccgaaaacccttggttgatccaacactcctccgccttatcaagaaaaagaagatgaaagtgaaagatcttcggcgttcccgcaaatgcttgaggaagagaaagttgaagggagaagaagagatggagattttgatggcactcatagacctcaaagtggtgtcaagggttttgagaatgagtgagttaagtgaggaacagttgcattggtgtgaagagaagatgagcaaagtgagggtaatggatggaaaactacaaagagattccactccactttttttcccagcacattga

SEQ ID NO: 67857 - DNA, 1071 bp, Glycine max
  Peptide Sequence Number=SeqID_184635
atggtttcttttacaagttatttcatttatagaagagcagagaacccattgcaaatcctcaaatttcgttgcaccttctttttctcaccggaaactacaagttggcaaacatatggtgccttgagatattgtcattctgggtcagaatgcggtaaaaacccgaaattgacaccaaacgagaagccaaacagggtggggcttttctgggacttggacaataaaccacccaattcaatcccaccttatgaagttgccaataagctgagaatagctgcatcttcctttggggttgttcgttatatggctgcttatgcaaatagccacacttttagccatgtccctcaaggtgtccgggagattaggaaagagaaggaactgttgtatcgtttagagaataagggtgtcatcaagccaaatcaaccttatcgttgtaaggtttgtgggagaaagtttcatactaatgacaagcttgttaaccatttcaagcaactgcatgagcgtgagcacgcgaaaaggatgaaccagatagagtcttccagggggagcaggagggtgaagttggtggccaagtattctatgaaaatggagaagtataagaaggctgcaagtgatattctcactcccaaagtggggtatggtttggcggatgagctcagacgggctggtttttgggttcaaactgtgtcagataagccacaagctgcagatcaagcattgcaaagccacatcgtggatataatggatcataggcgggttgagtgtgtggtccttgtgtctgatgattctgattttgttgacgtgataaatgaagcgaagatgcgatgtctgaagacggttgtcattggggatattgatgatggtttcttgaagaggactgctgatactgcattttcttgggaggaaattctgatggggaaagctaaaaagcaggctgtttcagttgtgaaaaactggaaggatcgagatatcttaaaaaggttggagtggacatacaaccctgatgaggataaaaataatttcagtctggatgatgccattactgaagcatctgaagatgataatattgattga

SEQ ID NO: 67858 - DNA, 3603 bp, Glycine max
  Peptide Sequence Number=SeqID_184636
atgaagcgcttcatgctcccaagaaaccctctcagggacgcagcagagcttccttcttcgccaagcccaaccccaactaccagctccgccaaaccccgtccctcttctcgcaaacacaaaccctccaaagagaacgaccctccctccgatcccaatctcgttactccctcccctgccaaattgaagagccccttgcccccgagacccccttcttccaaccctctcaagcgcaagctcaccgccgccgatgccctaaccgacaattccctccccgcaccctccgattccggcgtcaaggttattgtcaggatgaggccgctgtcttcggacaaggacgaaggagatcccacagttcagaagctggatattttcgaacacgttggggtgcctctggtggagcattgtttggccgggttcaatagttcggtttttgcttatggacagacggggagtgggaagacttatacaatgtggggtcctgccaattgtttgtcggatgaaaatgatcagcaaggacttgccccccgtgtttttcagcaactctttgaacgcataagtgaaatatacaatgagcaaatcatggatctgttggatccaagtcagaaaaacctacagattagagaagatgtcaagtctggtgtctatgttgaaaatcttacagaggaggatgtgtcttcaatgaaggatgtaactcagcttttaataaagggactatcgaacaggagaactggtgcaaccagtataaattctgagagttcccgctcccatactgtttttatttgtgttgttgaatctcgatgcaagagtgcatcagatggcatgagcagatttaaaacaagtaggatcaatcttgttgacctagctgggtcagaacggcaaaaatcaacaggtgccgcaggagagcgattgaaggaagctggcaatattaatagatcactctcacagcttgggaatctgattaatattcttgcggaagtctctcaaacaggaaagcagcggcatataccgtatagagattctaggttgacatttttgttgcaggagtctcttggaggaaatgcaaaattagcaatgatttgtgctatttcaccagcacaaagttgtaggagtgaaacattcagtacactgagatttgcacaacgtgccaaagctatcaagaacaaggcagttgttaatgaagttatggaagataatgtgaagcacttgcgacaagtgattcggcaactaagggatgaacttcatcgaattaaagcaaatggttacaacccaatggagtcaagtggaggtcattcagcagcttggatccgacgaagcttgactttattacaatccagcctcaaccggccaccaccattatcccgtcttgatgaagatggtgatgaggagatggagattgatgaggaaggtcttgaggaccatgatggagtttcctacaatgccaatatgccgagtaattgtaatattatagccgataatgacaatgaaatgaacactaatgatcaggatttggctcaacctagcgaggaggaaaatatagctagttgttctgttagtaaaggtttgaatgaagaaccatcctgtgcaatggtccgaagcagtttctcttgtcctgtgggtgaatctgattctcctagtgcagcaatgaattgtgtctcgcctgccggcctcagcatagttcactgcgatttatccccaatcctttccccaactcctagtgtttcacctagaatcagcaccagcaggaaaagtctgaggacatcaacagggctgtctccttctgagaatgatcttcatgttgaaaaagatttggacatgaaaaccagcaataagaaaagctcaacttctgccttttctagtcagacagctccaaatttccttaataaaacagaaaatttagcagcaagcatacagcatggtcttgaaattatcgatagttaccaacgtaattcagctttgaggcagtcaccatataggttttcattacaaccaagaaaatctaaattaacttttccagctagcaaagttgatgtgggcctacagacttctcttgatgatattgttggagaagattctgttttattcacctgtagtaattgtaacagcagaacgcaacttcatgtcaatgagactgacaatgattcaaacctacagttggtacctgttgattgccatgagtctgctgataagacaaagaagcaagttatcaaagcagtagagaaggttttggcaggatctataaggagagaaatggcccttgaagagttctgtgccaagcagacctctgagataatgcagcttaatcgcctggtgcaacagtacaagcatgagagggaatgcaatgccataattgcacagacaagggaagataaaattcttcgccttgagagccttatggatggtgttttacccactgaagagttcatggaggaagagctagtggttcttacccatgagcataagattttaaaggaaaagtatgagaatcatccagaagttttgaagatggagatagagttgaaaaaagtgcaagaggaactagagaagtatcaaaatttctacaaattgggggagagagaagtgttgatggaagagatacaaagtttaagaagtcagcttcaattttatgttgactcttcatccacatcagcaaggaagcagtatccattattgcaattgacttacttgtctgagcccagtatggcagcaaccctcaccgccattccagtgtcgacagaggagagagtagagacaaatgaaactcttgcatcatccaggaatgatattgaagtacaatttgaacaagaaagaattaaatggacagaggcagaaagcaggtggatttctctttctgaagaactgagagctgagcttgaaagtagcaggttgctagctgaaaagagaaagcaggaattagatgctgagagacagtgtactcaggagcttcaggaagccatgcacatggctatagaaggccatgcaagacttttagagcaatatgcagatttggaagagaagcacatccatttgcttgcaaggcatagacagatccaggatggaattgaggatgtcaagaaagcggcttccagagcaggagtacgaggtgcggagtctaagttcataaatgcccttgctgctgaaatttcagctttaaaagcagaaagagaaaaagaacagcgaatcttaagagatgaaaataaagggcttcagtctcagttgaaggacactgcagaagcagtgcaagctgctggtgaactgcttttgcggcttaaagaggctgaagaagctgtcactactgcacagaaacaggctatggatgcagaacaggaagctgccaaggcctacaaacaaattgataagttgaagaataaacacgaaaaggagattatcacacttaatgagcttcttgcagaagcacgtttgccaaaggaatctgtactaccgacttatgatgacgatggtgtcatgcccagttatgacaactcaaaggagccaaacagtgttaatgatcagtttgagccctttactaataatgcagagtatggtgagcttgccaaactagcagaaccatcgtggttctctggttacgacagatgtaatatataa

SEQ ID NO: 67859 - DNA, 3006 bp, Glycine max
  Peptide Sequence Number=SeqID_184637
atggctttggaggatctccaatacttgtcgctcctttctaaggtttgcaccgagttggagtcccacaccggcaccgccgacaaggtcctcgccgaattcatcaccgatttggccagctcatcggagaaccttcaggaattcaacgccaagctcaacgacaacggtgccgacatgcctgattaccttgtccgaactctcttcaccattattcgctccgttcttttccccaaccctacaagcaaccacctcaaacactgcgccaacttcgtccacgatggcgagagctcccagttgaggatcattccgcaggatgcaacggctctttcgggcatcagtattgttgaaaaagatgacgtttcttcttcgctgaagaagacaatgaactctccggaaatatgggaggcaaaacagttgattgcttccggtttcttgaatgtagaggagagagatgaattcatatatcaagaagaagaagatgctgaagaggatcttgagatcgagttgaatcaggatgaacctgcattcttgcaaggccagactaaatactcagtggatatgtctcctgttaggattttcaagaatccagaaggttctctgagtcgtgccgctgcactccagtctgcacttacaaaggagcgcagggaagtgcgagaacaacaacaccgtacagtgtttgattcaattccaaaggatctcaatcgcccttgggaagaccctatgccggagacaggcgaaagataccttgctcatgagcttcggggtgttggcttatccgcctatgatatgccggaatggaagaaagaggcctatgggaaaaccattacctttgggcggaagtcaaagctttctattcaggagcagaggcagagtttgccgatttacaagttaaagaaggaattgattcaggctgtgcatgataatcaggtgttggtagtgattggagaaaccggttctgggaagactactcaggttacccaatatctcgctgaagcggggtacaccacaaagggcaaaattggatgtactcaaccccgcagggtggctgcgacgtcggttgcaaagagggttgcagaagagtttggttgtcgattgggagaggaagttggttattccattcagtttgagaattgcactggaccggataccgtcatcaagtacatgacagatggtatgctccttagggaaatattggttgatgagaatctgtcacagtattctgttataatgcttgatgaagcccacgagagaactatttatactgatcttctttttggactgctgaagcagcttgtgaagcgtagacctgagctgagattgattgtcacgtctgctactctaaatgctgaaaaattttcagaatatttctttgactgtaacatcttcaccattcctggtagaatgtttcctgtggagatactttatgctaaacagcctgaaagtgattacttggatgcagccttaatcactgttctacagatacatttgacagaacctgaaggagacattctcctcttcttgactggtcaagaagagattgattttgcttgccaatcactccatgagagaatgaagggattaggtaagaatgttccggagctgatcattttaccggtttatagtgcccttccaagtgaaatgcagtctaggatatttgaacctgctcctcctgggaaaaggaaagtggttgtggctactaacattgctgaggcttctttgactatcgatggtatattttatgtaattgatcctggatttgctaagcaaaatgtttataacccaaagcaaggtcttgattctttggtgataactccaatttcacaagcatcagccaaacaaagagcgggacgtgcagggcgtactggacctgggaagtgttatcgcctctatactgagagtgcatataggaatgagatgtctcccactacaattccagagattcaaagggtaaatatggcaacaactactctcaatatgaaagctatgggcataaacgatctactgtcctttgattttatggattcaccatcaacccaagcacttatttctgccatggggcagctttacagtcttggagcattggatgaagagggccttttaaccaaattggggaggaaaatggcagaatttcctttggatccgccattgtccaagatgctgcttgccagtgtggaacttggctgcagtgatgagattttaaccataatttccatgatccaaactggcaatatttttcacaggcctagggaaaaacaagcccaagcagatcagaagagggcaaagtttttccagcctgaaggtgaccatcttacactacttgctatttatgaggcttggaaagctaagaatttttctgggccgtggtgttttgagaactttgttcaatcccgatcgttaagaagagcacaggatgtcaggaaacagcttctcaccatcatggataagtacaaattggaggttgtaagtgctggaaataacctcaccaaagtcaggaaggctatcactgcaggattctttttccatgttgctagaaaggaccctcgggaaggttacaggactctagttgagaaccagcctgtatatatccatccaagttcagctttgttccagagacagccagactgggtcatctaccacgagcttgtgatgacaagtaaggaatatatgcgtgaggtcactgtcatagaccccaaatggcttgttgaattggctccaaaattcttcaaagtggcagatcctacgaagatgagcaagcgaaagcgccaagagtgtttagaaccactttacgatagataccatgagccaaattcatggcgtttgacatgtgagagtgtacggaaccttgtgaaaaccatccagataagaatggctaaagactcagaagatcgtcacctatatcggttcatacgaagaaagaaaggttcagctcatcgtcaactatgtgcactaagctatagtgatcaaatgaaatgcgtcaatattttagtgcgaccaacacctgaaaagtga

SEQ ID NO: 67860 - DNA, 1419 bp, Glycine max
  Peptide Sequence Number=SeqID_184638
atgtggggcaagatattgaaatccataaggaaaagtctcataagccttcaacagaagtgtatgaattctcgaaagagtgaagttgatagtagtgtgtcagtgcatggtgtgcagtgggcaaattgcaagtgttgcatagaggaaagcaattgtgaccacattaatgccgcagaaggcgcaagtaatgtcgacgcccagcgtgatgctaacgccaacagttctttcactcatgctgtcattaacatggtggggatgctcataggtttggggcaactgtcaactccatatgctgtagaaaatggagggtggtcatctgcattcttgcttatgggactagggatgatgtgtgcttatagttctcacatacttggaatatgccttagaaagaatcccaagttaacaagtttcgtggatattgggaagcatgcatttggatcaaaaggaagaaacgtggctgcaacaatcatctacatggaaatcttcatggccctcgtttcctacaccatctcactacatgataatttgaccacagtctttttggggacaaatttgaatctgcacttgcctaacttttcttcatcccagctcctaaccgtggtggcagtcttgattgccatgcctagtttgtggatcagagacctttcttccatatctttcctttcaagtgttggcattctcatgtctctgctcattttcctgtgtgtagcagccactgcactcttaggatatgtccaatctaatcataccatacctgtcctccacctccataatattccatccgtatctggcctttacgttttcggctatggaggacatattgttttccctgaattatatacagccatgaaagacccctccaaatttaccaaggtttctatagtgagcttcgcggtagttacagcaatttacacgacattggggttcatgggtgcgaagatgtttggtaaggatgtgaagtctcagatcacacttagcatggcaccggagcacatcgtaacaaagattgctctgtgggcaaccgtggtggcacccatgaccaaatatgcgctagaattcaccccatttgcaattcaactagagcatgcacttccaagttccatgagtgccaggaccaaaacgataattagaggctgcataggttcattttcacttttggtcatactaacccttgctctctcggttccatattttgagcatgtactaagtctcactggttcccttgttagtgttgccgtttgtttaattttgccttgtgctttctacgttaagatatgttggggtcagatatcaaagcctctcttactcctaaacctctttctcatcatattcggctttgttcttgccgtgatgggcaccatttcctcctcacagttactactcaaaaatcttcaatcacataacttgaggcacaaggaatga

SEQ ID NO: 67861 - DNA, 1107 bp, Glycine max
  Peptide Sequence Number=SeqID_184639
atggcggcccctgttgtagtgtctacctctgtatctgtgtgttccaactatggctatcatcgtcgtccatccctttccgctctctcttattattcgaactcaatctccaacgcaaacctaaaactgagttcgcaatgtttctccaacttgcttcgttcgaattcaaaagccccgatttattgtcgcaagtttgttgctcgcacttcaattggagagaatgagagtgagagtgagagtgagaaggatttagggttagtaggggaggactctgcggcgtttgaattgggcaaacagaaaatatcttcgtggatttatttcaccgctattttaggagtcgttctctgcgttctcaacgtcgcatggattgataattcaactggctacggcaaagcttttattgacgccgtttctaccctttccgattctcacgaggtggtaatgttgattctaattcttatatttgctggtgttcatagtggcttagctagcttccggaacactggcgagaaactcattggagaaagacctttccgtgtaatttttgcagggatatcactacctttggctgtcagtactgttgatgctcctgggcttcatcaacttctgtggctttcgaatttcatttctttctttttcctatatccttcaactttcaatcttttagaggttgcagctgttgacaagcctaaattacatctatgggaaactgggatcataagaataacccggcatccacagacatatttcttgcacttgacatttgctcttcagatggttggccaggttatctggtgtcttgctcatacgatttggatcggaaattccgtggctgttgcagcttcaattggcttaattgcacatcatctatttggtgtctggaatggagacaggcgactggctataagatatggggaggattttgaattagtcaagagtcgaacaagtgttgtcccttttgcagcaatccttgatggccgacaaaagctacctaaagatttctacaaggagtttattcgactgccatacttgacagttactgcactaactttaggtgcttactttgcacacccgcttatgcagactgctagtttcaatcttcattggtag

SEQ ID NO: 67862 - DNA, 1365 bp, Glycine max
  Peptide Sequence Number=SeqID_184640
atgtatcgctcatatccatccaatgaccaatctaatccgaacgaatgctgtggaggaagcgaccttaacttagttgagttgaagttgaaagataacaaacaacaaacaagaatgcccatcttctctgcaacgttgggctccttcacttccatctcctcctccttcctctcacagtcacacctttctcctttcgtgaagacaccttgccaatggcagcatcactatcacactgctaaagtcttggtctctgcctctggcaatacccaaattgaccaaaatcccgactctggacttcttcaacgccctactcctccagacccactcgatgacgctcgtcaggctcggagatcgtcagattggaaggctgcaaagacatatcaagatagtaaagtcatttataatggtagggttgaaggttttaattctggaggcctgctggttcggttttattctgttatgggctttctcccattcccacaattgagtccagtgcatgcttctaaagaaccagagaaatctatccaagaaattgcacaaggcttaattggttcaatcatgtcggtgaaggtaattctagcagatgaggataacaagaaattgatcttctctgaaaaggaagctgcctggtccaaatattcaaaacaggtcaatgtaggggacatttttgaagtaagagttggttatgttgaggactatggtgcttttgttcatttgcgcttccctgacggtctttatcaccttactggactaatacacgtctcagaagtgtcatgggatctaattcaggatgtcagagatatcttaaaagtaggtgatgaagtgagggccaaagttgttggtattgattggggaaaatcaaggattaacctatcaattagacagctagaagaagatccactcttagaaactctggacaaagtaatacctcaggatggttcagctgatcctgattctatgagtggtggtgatagcggtagcattgagcctcttccagggcttgaaacaatccttgaagagctactacaggaagatggaatatatgacgtaagaatcagccgtcaagggtttgaaaaaagagtggtctcgcaagacttgcagctttggctttctaatgtgaggcagctagctttcacaatttttctttttggtctcagttttgatttctccgaatttctgaatctttcaacttggcaacgcaggcacctcccacgaaccaaaggtttactctacttgcccgggctggaagacaggtgcaggagatacatctcactacatcccttgatcaggaaggtatcaggagggcattacaacgagtattggagcgtgtcccctgaatttcattcactcagacctttcttccgataa

SEQ ID NO: 67863 - DNA, 990 bp, Glycine max
  Peptide Sequence Number=SeqID_184641
atgccatgttccaaagaagaagctcttgttagactcttttacaatgcctctagctccttccaccttctcttcctcttcctcttctcctcttcggttctccttatcaagttcataaacttcattggcagcttcaacatattccaaagagatcactatgaatatgtgtcttctgagtatgatgaagaagaagaagaagcagaagaagaaattcaagaaagcttctcttatgtccatgattctattgagtcagatcatctagtagcagacatcatttgtggtggagagacccttttgtttgtgcacaacaacaagcctcagaggattctttcttcttctgaagaattctcaagcccccgggatagccttatagaagactcagaagaaaactgttcaacggaatctttgtcttttcacaagtcacctttggtttcagactttgaaaatgaacaagatgcagaagaatttccagcagaagatgctgattctgttccaaattctgtcccagctgaaagcaggcccacatcgtccatcaccctgaacctctacaaaagtgacttagtaggcagtgacaacaactatgacgaagatcatgttgaaattggagttattgaaaataagaaggtgcaagaggaaagcctcgcacgagatgagagattctttgcctatgctcctacccaattggaggctaagaagctcattgttgaggaaaaagattatgaagaaatatatggtgactcatgcactgttgggtccacatctaagagctcctctgagtggaggagttccattaattgcagggattctggaactgaagaccctttttcttcttcgtcaagaagaagttgtcccaagtgggaatcatatacagttttccaaaaatatgatgaagagatgtcattcctagacaggattagcgcacagaaacttcacgaaactggtaacacaacacaatcaagtttcccattttttttgtccattattcactcttaa

SEQ ID NO: 67864 - DNA, 570 bp, Glycine max
  Peptide Sequence Number=SeqID_184642
atgcccttgcggggtaggattgcatctaaaagcctcatgaacacttgggaggacttggataattcattgtctgataaggacaatgaggaagaaaccaacctatgtctaatggtaatattcaaatctagagaagatttaattaaagggtacaatcaacttctttctacttccactagcacctctaaagcttatagaaaactaaacaaacgttttcaacatcttgaaagagagtatgaggatctcaagaaaatccatcaagttcatttagttgattttgtcctagaaaccagttcacctggtgatgtacatgacacctgtatttgtgaggagttcaaatcattactggacgaagagcttaaaggacatgaggtcttgaaggaactacctcctaagattgtaaaactctatgaggagacaaaaaccttgagggataagctaggcaatttttttggtggtcatgaagtgtttaataaaattattaaggtgggtcatggaactcataagtgcaaggacctccctaaaaagggcaacccatcaaagggttcgtccaatgcttaccaacacccataa

SEQ ID NO: 67865 - DNA, 549 bp, Glycine max
  Peptide Sequence Number=SeqID_184643
atggaagaaggatttgttttgaacaagccttgcatgttcaagggagccaactatgactattgcaaggaaaagatgattgccttctttgagtccactcacattgatataaacgccctactatgcgctctatcagaagaatattccaaggttcacggctttagaagcgccaaacaaatatgggacaccttggttattacctacgaagggtcatctaaggtaaaacataacaagttgatccttctaacacgtaagtatggaagagggagaagacatccaaaccatgtttggatgcttccaaaccattctgaacgagcttcgctctctagaaagtggagaccacaaattatagctttaagatccatcaagaatcttgattcaatgactcttgaagaaatcgttgggattctcaaactttatgagcaagatcttgctcaagatgaaggaacaaagaaagggaagtcgctagcccttacagctcaaagaccaaagcgcaactctgcgtccaaagagaaattgtccaaagcccttgctgttgatgatactttttaa

SEQ ID NO: 67866 - DNA, 213 bp, Glycine max
  Peptide Sequence Number=SeqID_184644
atgctatctcatgaactgctcattatccattaccaatactttaagacccctattgaggtatggtctaacaaaacacctgaatactcaatgttgaaagtgtttggatgtctggcattctatcacgtaagtgaaggtttgggcaaggctaaggatgtcactaagcaagtagactttaagagctctataataagaaacattagtgatcgagagtag

SEQ ID NO: 67867 - DNA, 237 bp, Glycine max
  Peptide Sequence Number=SeqID_184645
atgcacgttgatcaaggatcgaagcactttgacgtgtggtcacaaagatggagtggatcatgttggatgtcagatcacatgagtcaaatcagcaatctcgacatagtatgtgaaccatcatcagttggtgaaagcttatcagtataccatggtatgggtgtacttcgaataatcattgagtttaaaagcatgagtctgcttagttgtgggagttctagttgtaacgggcttgtgtga

SEQ ID NO: 67868 - DNA, 330 bp, Glycine max
  Peptide Sequence Number=SeqID_184646
atggaagaaacttcagagtttcttgtgttatttggtggtgaaaattcaaaccctcctaatgatggtagcgaagacaagattttggggctggaacttattgcaagacttcaaaataatggtctcaaagataggatatttgtaaggttggaacttaatgcaagacttcaacatcgcaccataggtcctttaatggtgattttccactgtggagatgcagtggaagacaaaggagaagaggatgcttcaatggaggaaaagaaagagggagagaaagagagaggggggagcacgaaattgaaggaagaaaaagggagagaagttgaactttga

SEQ ID NO: 67869 - DNA, 435 bp, Glycine max
  Peptide Sequence Number=SeqID_184647
atgtttatgtctcagggcaaaaacttggttccatgcgctaccaaggactccaacaaccaccccttaaccgatgtcatttttgaaccctttgaagaggtcaagaaggagctcaaccttgttcccaccgtcccacaagcttcccttgctcgtaaaaaatacaccaatgactacaaggctaccataaaagaacaaatcagcgtggagtacaatgtttcgtatgtttatcatgtgatatttgcctactttgatagggataatgtcgcgctcaagggtcttgccaaggttttcaaggagtcaagcgaagaggaaagggtgcatgctgagaaattaatggaatatcaaaacaaacgaggtggaaaagtgaagttgcaatccatagtgatgcctctttctgagtttggccatgagaaaaaaggagatgcactatatggttag

SEQ ID NO: 67870 - DNA, 201 bp, Glycine max
  Peptide Sequence Number=SeqID_184648
atggaaaatggtatgactcaagattcggatgttgaagatggggggagcatagaggaagatgaccataaccaaatagacatctcagaattggccctaagtgaggatgaagattccgatggttttgataatgaggacaacagtgattgggatgatgacgaggactctgagttttcagaattcataaatgatgagcatccttga

SEQ ID NO: 67871 - DNA, 408 bp, Glycine max
  Peptide Sequence Number=SeqID_184649
atgaggggaagaaggagacatcaagatgagcaatctcgtgctttgtacgacctctcctctctcgttctcaacctccttcgctcgcctctgacgttctccgacgaggttccgccagcgtcacggcgtccgggccaggctcagatatccccggcgggattcgcgtcgttgctgctgggaatatccctggcgttgatgctgtgtggatctgtgacgttcttcatcgggttcgtgttgatgccgtgggttctgggattggtcatgctcttctacgtcgccggaatcctctccaccctctccgtcttcggccgctccattctctgctacgccacctccccaccctcgccgcgtaaggacattcccgttgggctggctgtccgcatatggggcccaccatttgttggaggttag

SEQ ID NO: 67872 - DNA, 813 bp, Glycine max
  Peptide Sequence Number=SeqID_184650
atgggaaggggaagagtggagttgaagagaattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcagcggttcaagcatgctcaaaacgctggagaggtaccagaaatgcaactatggagcgcctgaggacaatgtggcaacaaaggaagccttggagttaagcagtcaacaagaatacttgaggctgaaagcacgttatgaagctctacaacgttctcaaaggaaccttatgggagaagatcttggccctctaagcagcaaagagcttgaatcacttgaaaggcagctagattcgtctttgaagcaaatcagatcaataaggttggaagagtttcaaataaatccactccaactgaatcccagtgctgaagatatggggtatggacgccatccaggtcagccccaaggccatgctctctttcaaccattggagtgtgagccaaccttgcaaattggagtatgtggttccacacggttaaaagtgattgttgctgttgatataagaggaggaggaagaagaaagcgagccgaggattgcgataatgtacttcttttggagcgtgaagctcacgcagcagaagctcgaagaaagttctttgacgtagaatgtggcagtagggggaggggacgatggcttgcggtggtcgttgtcgacgaggttgtggtgatcgtcttcctcgtcggaggaagagtccatttgtaa

SEQ ID NO: 67873 - DNA, 1410 bp, Glycine max
  Peptide Sequence Number=SeqID_184651
atggtgtatcgcggtattgattaccaagggcctgactcgcagaaggaagttaatgagaagaaaggtgatggctttttcgtgccagatgtctcaaaaagggaagacagtagtactgcaacctcaacctctgagaagagtgaggtggttgtgagggagcgagaacatccagagaatatgtcagaggcagaagcagagtacaatgccctccttgatggtttaggtcctcggtttgttggatggtggggtacagggattcttcctgttgatgctgatttgcttccccggacagttccaggttacaaaacaccttttaggcttcttcctactgggatgcgttctcggctaacaaatgcagagatgaccaatttaaggaagcttgcaaaatcacttccttgtcattttgccttagggagaaatagaaatcaccaaggtctggcatgtgctattcttaagctttgggagaaaagtttagttgcaaagattgctgtcaaacgtgggatccagaacacaaacaatgaactgatggctgaggagctgaagatgttaactggagggaccttgctgctaaggaataaatatttcattgttatataccgtgggaaagactttgttccaacaagtgtggctgcagttttagctgaaagagaggaattgacaaaacaggtacaggatgttgaagacaaggtgcggtgcagagcagttgatgcaattccattggggcaaggtgaagcaacggcacaggctgggactttagcagagttctatgaggcccaggctcgatggggaagggaaatatctcctgaagaacgtgagaagatggtggaagaagctgccaaaaccaagactgctaagcttgtcagacaaattgaacataaaatatttatagcccagactaaaaagcttagagcagaaaagctcttagccaaaatagaagcatctatggttccagctggtcctgattatgatcaggaaacaatcacagatgaagaacgtgttatgtttcgtaaagttggtttaagaatgaagccatacttaccacttggtgagaaattttcaactgtacaaaagttgctctattctagcaatgcaaagctgacgcctttctatgataatctccagaatatgcatttgcattggaaacaccgagaactagtaaaattgatgacaaaacaaaagactgttgcttttgttgaagacacagcaaggttacttgaatatgagagtgggggaatactggtggcaatagagaaagtttccaaagaatttgctcttatttactatcgtggaaagaattataaacgtccaattactcttaggcctaggaacctgctaacaaagggaaaggcattaaagcgtcatgtagccatgcaacgtcatgaggttcttttctccccatgtgacaattactga

SEQ ID NO: 67874 - DNA, 2007 bp, Glycine max
  Peptide Sequence Number=SeqID_184652
atgagggtggagccttggattttgactactacggtggaagatgaagtcaaggtttgtgtttgtggagaagctagtgctatttctccaattttagttcccctatcctctccgcgattaattactatgccacctggtttggagtacaatatcgatgatctgtttcaagaagctaagaggagatggctcaagcctgtggaagtgctttacattttacggaatcacgaccagtgcgagttcacccaccagccccctcatcagccagctggtggatccctgcttctgtttaatcgaagaatcatgcgtttcttccgtaaagatggtcataactggcggaagaaaaaagatggcaaaactgtgggagaagcgcatgaacggcttaaggttggcaatgttgaaatcctaaactgttactatgcacatggagaggagaaccgtacttttcagagacggagctattggatgttggagccggaatatgaccatattgttcttgtgcattatagagaaactagtgaggggaaatccaaatctgaacatgtcacacaattgtcatcaggttcctctcctgtttttagtcagagtcatagctcgtatactactcacaacccaggaacagcatccatgtttggtgattcatgtgaacctaatcagaaattttctagttctgggtctttagaagatacatccgaagcacaagccttgcgccaattggaagaacagctgagtttgaatgaggacattttcaatgaaattgcacttgatttaatcccaggtcaagatcaaagggtggtttataagcaagataactctgtagctttgtctggaccaaatgatccaggacaaccttgtgatggatataatggaagagaagatgacagtggtacatattatcatgactttcttgatgattgtcctggtggaaatgaaaaaactatatactggactgaagtgctggaatcgtgtaagcccttatctgtgaccaaattaccagatcaacatgcatatgacgcgattgaaaatggaaagtcattattttcttcaggaagaggaatgattgccaaccgggaaaaaaatcagtggctaaactccaacagtaataatgttgaaaactctgttttcttgtttcctcaagacattggagtcaaatttcctccatattctatggtagaaactccaggaactaactatgactactatgaaacctgttttgatcaattccaaaatcaagaacctctgggtgtagattcaagcttcactgttgtgcagaaacagaaatttacaattagggcagtttccccagaatactgttatgccactgagactacaaaggtgatcattattgggtcatttctatgccatgactcggattctacctgggcctgtatgtttggtgatgttgaagttcctgcagagataattcaggatggtgtaatctgttgtgaagctccatcttatcttcttgggaaggttaatttgtgtgttacttcaggaaatagggtgccatgcagtgaagtgagggggtttgagtttcgaaataagactactagttgcactcgctgtaattcattggaaacagaaggcagcaaaagtctagaagatctgttattacttgttcgatttgcagagatgctcctttctgcttcaactacaaaggatgacagaatagaatctggaagttatctttcaacagaacagaaagatgatgatgattcatggagccatattattatagacactcttctagatggcaccagaacatcatctgatactgttaactggcttcttgaagagctgctgaaggataagttgcagctctggctttctaaccgaagagatgaagggacaggctgttctttttccaggaaagaacaggggataatacacatgatttctgggttgggttttgagtgggccttgagccccattcttagttgtggtgtgaatataaatttccgtgacatcaatgggtggaccgctcttcattgggctgctaggtttgggaggtaa

SEQ ID NO: 67875 - DNA, 330 bp, Glycine max
  Peptide Sequence Number=SeqID_184653
atgattatatttgattttcctacttctattaccattgcttctaagagatttctgcaactgggttttgattgggatacaaatgaaatgagcattttgttgcttgctaagcttgcaaagccattgattggaactgctcgaattgtgattaacagtcttcatatcaagggtgatcttcttgcctcaccaattctagatggaaaagcactcctgtattcttttgtatcaactcctgaggtgagaataggagttgcctttggaagcggtggaagccaatcacttcctgccactgaatggcctggtgtttcttcttggctggtgtgtttccactaa

SEQ ID NO: 67876 - DNA, 1377 bp, Glycine max
  Peptide Sequence Number=SeqID_184654
atggagtggaatgcaaaatctctcgggcaatgggactgggagcacttattcttcaatacaaaagcagctgagaatccaaggttacaaccaactgattgtagcagtgaagcagatccagaaatcaatgttggactgttgtatccatcaggtggtagtgcttgttctggctctgaactaatacatgcttcttcatcaaggagctcaaaatcagcttccaacaattcatcatcaaatggggatagcagggaatctatattgactctggaaggttctcaggatgattccactgggaagaaagaattgtgcaatggagagccggttgaaacttctccagcagcagtgccctctcctgtctctggtgaaccattgctcactctaaagcttggtaaacgattgtactttgaggatgtctgcaccggaagtgattccaagaaaccatcttcctttgaggttcccattttatcagggaagaaatataaaacaagtagtcagactgtacagcatccaagctgccaggtggaaggctgtggccttgacctctcatctgctaaagattaccatcgcaaacacagagtttgtgaagctcattccaaatcccctaaggtggttatagctggtttggaacgtcgattttgccagcaatgtagcaggttccatgctctgtcagagtttgatgacaaaaaaagaagctgtaggcaacgactttcagatcacaatgcaaggcgccgcaaaactcagcctgactcaatccaattaaatccatcagctttgtcttcatctccctatggcatagacacagtagagtgcccaagtcataggaaactggatagcacacacataattgaagcaaagcatgtgcttgatgggaggcaaataatgagcccatttgcattttcaaggactgctacaaatttagcttggcaagatatgcacagcagcaagcacccccaaacaaaagaattcctcccgaagcctgccaaagccttcaataagataccgagtatagtctctatgctttctgatgattccagtggccttctaacatctagaggcatagcaacgaagagtattgttccaggtatggaagttccaaatggtacacaagatgttaaccgtgctctctctcttctgtcaacgaattcatcatggtgtccatatgagaccaagtccctttctctggaacactccactcggacaacacactcaatcactcagcatcgtttaccacttccttcctcggagtattggcacactgatcaacaaaattcaagcatgtgtatctcattctcggattgcgatagcagcaatcgctttcaagactttcagctcttgagctcaccctatgaatcaggttttccgtgcaaccaactggattaa

SEQ ID NO: 67877 - DNA, 348 bp, Glycine max
  Peptide Sequence Number=SeqID_184655
atgatcggaggagagacgttgtccacgtggcaggcattgatgaggtcttggatggcggcaatcttcaggctgctggaggaagcggagctgccaagtggacagcgcggcgaggacggagcgcaggcagctgccgaagctaccgcgatggtggtaggagaattcctcatggatctcggcctaaaaaatgataaagtttccgccaaagtttgtgacgaaggcgttgccacagtgttcgacagcgacgtcattggcgacatcaatctcttcggaggggagggaggagaggaagaggcggcggcgggggcagaggtcataggcaacggcggcagcaaaggtcgtaggaagtga

SEQ ID NO: 67878 - DNA, 360 bp, Glycine max
  Peptide Sequence Number=SeqID_184656
atgacgccgatgactaaccatgaaggtgctggtgaagtcgaggccggaggttggtttgttgaggaagagcgtgatggggtcatggatgatgtcggtgccaatggagatgcggtggcgttcgccgccagagacgtcgcggtggtcctcgtcgccgatgaccaaaggagggagaagctcaagcatagtgttgttaatccagttggttgcacggaaaacctgattcatagggtgagctcaagagctgaaagtcttgaaagcgattgctgctatcgcaatccgagaatgagatacacatgcttgaattttgttgatcagtgtgccaatactccgaggaaggaagtggtaaacgatgctgagtga

SEQ ID NO: 67879 - DNA, 630 bp, Glycine max
  Peptide Sequence Number=SeqID_184657
atggatcatctgttcctccctatgatggttccattttctggaggatcagcatatcactacaactatggtagtcgcctttctgctgggagtccttatagaccgttgcatttatctggaccaacaccctacactggtggaccagtgatgggaaatggtgggatatatggaatgccccaactgttggatcgatatggcctgggcgtgcctattggacctgggacaatgggtgctaggccaggatttttccatgatgacaagtcacagaaaaaaggtacagatgcaacacgtgacaatgactggacatgtccaaaatgtggcaatgtcaatttttcattcagaactatctgcaacatgagaaagtgcaacacacccaaacctggatcccaggcctcaaagtcggacaaaaattctaagcaaaagatgcctgagggaagctggaagtgcgaaaagtgtaacaacataaactatcctttcagaaccaagtgcaacagacagaattgtggtgctgacaagccagccgagtctgaaaaatctccttcaccagctgcagatcaaaatgatcaggtttttgggggtggtctttatagggtcattaccttgagtgctaatcttgagttttctggtatctaa

SEQ ID NO: 67880 - DNA, 856 bp, Glycine max
  Peptide Sequence Number=SeqID_184658
cctacgttatggtgtctccctcaaagtcaatactgatatggctgctagaagttgtccagtgtttgctgcttacggtggcattttccgggagtcctctaatgcttccatgggttgctttgccaagaatctgggaatttctaaagctttattgctgagctgttgggcgttgtattggctgttgagattgttgttgataaagttaacagatggaacaaatgtcttcaactggttacaaatattaagtttggagtttctcacattctcagagaagcacaccattgggaacgctggtggtaccaaggctgcaagatggaagcgctggtgggtagccctcacatggaccatatggcatcacagaaataagacagtatttgacaaccagaccttcatcacaagtaaagtgttggatgatgcacttctcctactatgggtagttgctaggattctctgtagtagacgcatgtctggtgtaatcctaggattgggcttagctgatttcttggttgtgcaacatgctggatcttgtgaaatggaaacaatagtagaggagctagaaagcttggtggagcttctaaagaagacaacttgtgataatggcctcaggactgaggccattgtggaggaaagctggacatgggcaagaaagcatgaattgataagcttcaattgcagttacccattagagtggattgcttgggcagagcaattctttgaccagcagcagacgaaaccattggcaaaggtgcaactcacgtttgtgaacatggaatggcttcaggttcttcgaagagaaaaaatagaacttgacacaggaaggtctgccaacaaggcaactagtaataagagtgggacttaa

SEQ ID NO: 67881 - DNA, 336 bp, Glycine max
  Peptide Sequence Number=SeqID_184659
atggtgaaggagaccgaatactatgacgtgctgggtgtcagccctacggcatccgaagccgagattaagaaagcttattacattaaggttttaggtgaggcttaccaagttctgagtgacccagctcaaagacaagcttatgatgctcatggaaaatcaggaatttcaactgaagcaattattgatcctgcagcaatctttgccatgctttttggtagtgagctttttgaggaatatataggtcagttagccatggcatcaatggcttcaatggacatctttactgaaggagaacaatttgatagtaaaaagttgcaagagaaaatgagggtataa

SEQ ID NO: 67882 - DNA, 225 bp, Glycine max
  Peptide Sequence Number=SeqID_184660
atggagttggcacaggcgatttcgccgttgaagcgctttgcgagttccaatgtgaggcggctcttgctgaaaccaataggtccagaaatcacaatcaccttctttttctttttcgtttccaacacagtcaccagaaatcgccagcgacagctgaacaagtgcgaagattctcagaatagtgcggatggagaaactgttgcaagagagagagagagagaagagtga

SEQ ID NO: 67883 - DNA, 225 bp, Glycine max
  Peptide Sequence Number=SeqID_184661
atggaggaaagaaggaggaatggagaaggtcccaaagatacagaacgaagaccacgcttcaaaagatctagtccatttgtcagagcctcaagaagaccttctagtctctccaaacaaccaaagtcacttgactatagacaagtgatatgcgagttttatccaacctatgtgcagattaagttgataaagattggaggagtccgaccaacatcgtctttcatttga

SEQ ID NO: 67884 - DNA, 849 bp, Glycine max
  Peptide Sequence Number=SeqID_184662
atggacaggactgagagatcctccacgccgttcaccgacggaaaatcacgcttgctgtggaggacgtgcgtgacggcagctgttgccggattgttcgtcaccaggccgctatcgacgacaacgcacgaggtttttccgttgacagaggagaagtggaagggagtgaagaggccaggggtcactgatgaaaccctaacctcttctgtgagttcggatccttttccgatgtacggaaccgagaatgaccgagatgattcggaacgaacggcgttcagaagagcagagaagaagtacaagctctactacgacaacaatgcttcttccaagaacaaaaggaaaaagctacctaaacccgtggatttaacggaggtccttgacttcagatctattctagaatgctatctccaaaacgatgtgcttcctccgggtgttatcgttcttcacgacaacttcacttctccagttttttctttgcaaaatcgcccaggcttttattttattcctggggcattaagcatagagagacaatgtagtttgatcagggagagtttgactgattttccgcagccaccgaacagaacaaatcacaatgccatgtatggtcctattcaggatgtgtttgttgcggctaaagaagggaaagttttggttgaagacaactctccaattacttcatctgaaactgatactgatatagatcataaagatggtaaggaatggaagtttactactgaaaaggacgcgctgtcaagaaagtgcagatcagcttctgcttctgtgttacttcgaaagttgcgatggagcacccttggcctacaatttgattggtccaagctttgtgtctactga

SEQ ID NO: 67885 - DNA, 159 bp, Glycine max
  Peptide Sequence Number=SeqID_184663
atggctaagcgcgtagaagatcctagaagcagagtttctggctgtggagagaccaggagagaactgagcttgaagaggaagctatcttgcatagcattggacgagattttgagtgattgtgaggtttttgaggatgatgcttggctaggattaggctaa

SEQ ID NO: 67886 - DNA, 393 bp, Glycine max
  Peptide Sequence Number=SeqID_184664
atgccaatctccccctgcagatgtatcggttgggatcgcgcccacaagtcgcccagcgggcccgaagtagtcctacagggtgcccgtttcccccggcaaggtcacgtcatcatagggatcgcgcctgcaaaacacccagtggacccgaagaagtccaacagggtcttggaattgtcaactctaattacgggtctctgtcagttctacggagtgcctgtcacctccagcaagggcattaggccccctactaatcgagctttcatcaagaagtactgcgtctccaggcaggcgcagggtgaaacaccacagcagcctggggatggccggcagcgggcaacagacgcaccgccatcacctctagagttcacctcagctcatccacaaaaaggttag

SEQ ID NO: 67887 - DNA, 1125 bp, Glycine max
  Peptide Sequence Number=SeqID_184665
gagttctctggtctttgctccttggctccttcactatctgagagcattttgtgcactactgggttgaaaatgtatatgctggagagcaaaggaggtgccatagcatgcatgttcttgtctcttttcttcttggggacatggcctgctcttttgactatgttagagaggcgtggtcgtcttcctcagcatacctaccttgattactcaatcaccaatttcttggctgctttactcattgcttttacacttggtgggataggcaagggcacacatgatcagccaaatttcttagttcaacttgctcaggataactggccctccgttcttttcgcaatggggggtggtttgttccttagccttgggaatctgtcctgccaatatgcatttgcttttgttgggctatcggttactgaagtgatcacggcaagcataactgttgtcataggcacaaccttgaattactttttggatgacaaaatcaacaaagctgagatccttttcccaggagttggttgctttctgattgcagtttttctaggttctgctgttcattcatctaatgctgctgataataaagcaaagctcaacaatttcaccggtgattataaaaatggagacacctctttgaaggatggagatatagttaaatcaaaagacctcgagggtggaagtagttctgcagacaatgttgaagcaggaactgcagttttcctcatggagcttgaggaaaaaagagctattaaggcagtctcttgttttgttattgccatgattctaaacatcaccttcctctaccaccctgtcctaaacctacccaagtcatcatttaaggcttatttggcggactcagatggcagagtctgggccatgttggctggtttgctttgtgggtttgggaatggtctccaatttatgggtggtcaagctgcaggatatgcagcagcagatgcagtccaggcacttccacttgtaagcactttttggggcgtggttctgtttggggagtacagaaaatcatcaagaagaacatatatactgctagggagtatgttgtttatgtttattgtggctgttgctgtgctaatggcatcatcagggcaaagaaccagcactgccaaggaataa

SEQ ID NO: 67888 - DNA, 315 bp, Glycine max
  Peptide Sequence Number=SeqID_184666
atggcaaccaccaagcttatggattcttcaaggcaaatcgctaaccttctgggttgtggaaatcccaaacctaagcaagagtgtaatcctatttgggtgttagaggtggtggttgaaagacatggtcatcgcctgaagcatgtcgtcgtcaatgtcgttcccatggaaaggagttcctcgtcgtacacctcgaatcctcaaagtcacgtgatgtgtttgtgtaatgtagaggctccactggtgacatcatggattgaggataatccaaggaggcgtttttatggttgtggtctatacaaggcatgtaggttatag

SEQ ID NO: 67889 - DNA, 117 bp, Glycine max
  Peptide Sequence Number=SeqID_184667
atggaaagtgtggtggaggggcattgtttcttctacaagttcttcgaatctcttgatccaaagggactagatcttcttaagaaactctacctcacatacatggaacaaagcaactaa

SEQ ID NO: 67890 - DNA, 1170 bp, Glycine max
  Peptide Sequence Number=SeqID_184668
atgtttgggaatcgggcgatccttgtggataatgaagatgtagtagaagaggcaagtgagacaaaaactctcaatgggaaagaaaaactactgaaacatgatgaggttgttcttaaggttttcttgtatgatttaccaccagaattccattttggactcctagatgggaaaccaagtggaaatagtgtgtggcctgatgttagaactaatatacctggttaccctgggggcttgaatttgcaacatagtatagagttatggctttcattggatattcttgcttcagaatttcctcaagcctctaaggctaggactgtaatccgagttcgaaactctagtgaagccaatattatatttgtgccattcttttcatctttgagctataaccgctactccaaaggtagccctcatgtaaagaagagcagaaacaagatactgcaagaaaagttagtgaagtatttgacaacgcaagaggaacggaagagatcgggaggaaatgatcatttgattttagcacaccatcccaaaagtatgttggatgcaagaatgaagttgtggcctgctactttcattctttcagactttggaaggtatcctccaaatatagctaatgttgaaaaggatgtgattgcaccatataaacatttaatcaatttctatgtcaatgacaactccaacttcgatagccgaccaacattgttgtacttccaaggggcaatatatagaaaagattgtttaagggggctaatggggtccctattctataagagtcacttgataggtatcttaaaggagcaatctttgacgattttgcatcctttcatgaagggaggtttagcgcgacaagagttgttctatcttctgaaaaatgaaaaggatatgcatttttcctttggaagtattgggaaagatggaatcaagaaagcaatagaaggcatgcatgcttccaagttctacctcaacatagccggtgacaccccttcattgaaccgcttattcgatgccatcgctagttattgtggccctgtcatcatcgatgataaaattgagctaccatatgaagatgtcattgattactccgagttctgcatatttgtttatactagtgatgctatcaaagaaaattttctaataaacttcatcagggttattgccaaagaagagtggtga

SEQ ID NO: 67891 - DNA, 153 bp, Glycine max
  Peptide Sequence Number=SeqID_184669
atgaaaggcatttttaccctttcacccacattgctaagtgccccagcaaaaatgctggatgccccaagcaactaccaccagaagaacgtcagagatgtaggccaaagtcaccaaacttgtgcagcaactcatataagtgctacatcagagtga

SEQ ID NO: 67892 - DNA, 210 bp, Glycine max
  Peptide Sequence Number=SeqID_184670
atgagaagagttgaagcagttttggagaatggagatttctggacaagagggtggtggcggcattgtgaacgagaaatggacaagtgcccctgtgggcctaggtacgagggagattctcatagatcttttgttctgttgtgcgttggcactagaaccatccaacagctaccagtccctttggggatggaacttgtggcagctgtagattag

SEQ ID NO: 67893 - DNA, 1851 bp, Glycine max
  Peptide Sequence Number=SeqID_184671
atgccatttggcctgtgtaatgctccttcttcctttcagaccaccatgaattcacttttccgaccttacctccgatgcttcattatcgttttcttcgatgatatcctcatttacagcgcttcgtttgaaaaacatcttactcatttggaggtcgcgttccagacccaggttgaataccttggccatttggtatcctacgaaggtgtgcaacctgtcacttctaaggtcgaggccatccaacaatggtcggttcctcaatctatcagggcagtgcgcaattttttgggcctcatcggattctatcggcaattcattaaaggatatgcctccatagtagctcttttggtgcaaattgccactctggatcgatttcactggtcaacacaagcccaaacatccttcgagcacttgaagcaggcattgtcggaggcaccagtactcgcctttttggattttgccctgcctttcaccatagagactaacgcttccggggttggtatgggagcagtcctatctcagcaaggtcaccccatagcctttttcagtaagcctttcaccgcaaagctctttagtgcgtccacctacgtgcgagaattattcgaaataaccatggcggtcaaacggtggcgtcaatacttactaggacacccttttctaatcatcattgatcatcggagccttaaggagttgctcactctggcaattcagtcaccggagcaacacacttatctagcgcgactgatgggctatgattatcaaatcatttattgctccggaacccacaatcaagtcatggacgcactatcccgtctccctgagcagcctcgctcttcactaatgacgctctcagtgccatgtcttaccttcattttggagctccatcagcaactagaagcctgtcctgtttatgtcgaccacaagaacgcaattctgcaatcaccaactgcacatcccaatttcaccattactaataatttggttcttcacaagaggcatatttggctaccgcgaggatttctgatgatccccaccctactcacaaagtatcactccactccgataggagtgttgcatcgtccatgggaagacctctccctggacttcatctccgtccttcccccttatcatgacaacacggttatcctggtcgtggttgaccctttttctaaaggaattcatttgggaatgttgcccacttcgcacactgctcacaccatggcctctttattcgtggatacgccttcacgcatagtaaaccatgaacgtggggcaaactactcctctgggttgagtggtcccacaatacctcttggaatgcagcaacagggctcatcaaagcttgacgcagtggaggacatacttacagatagagatgaaactttcagaatcgtcaagaagaagctccttaaagctcagaccactatgaaagattgggttcttcttaaacttcggccacgccacccactctcgaccaaggattcctcagaagtaaaaggcaatttggcaaagcacttctatgaacccttcaagggctcccctaaactcgatgaagctgttcaattgcctagccaattctttcagaaccaacctcgcatctctcctctagccatcttgaactatcgaaggttatcaccgtcgggaccatgggaggataaggtgattctgcaagggccaccggttgatagcataacaaacacatgggaaaacacaacaagcagaggcaaagacgcaacaaacacaaaggtgccattagcaaatgatcacgcacaacaagcagaaatagaggtgcaaacaggaagcaagaccaaaagaaagatttcaaggcctgcttaccttaaggatttcgtctga

SEQ ID NO: 67894 - DNA, 117 bp, Glycine max
  Peptide Sequence Number=SeqID_184672
atggtgggtgctcgtcacagcggaagcgaggacgaggtcccaggtgcttgtcaccacaaagcgagggctagcggaagcatgatcctaggatcagaactaactctgataccatattag

SEQ ID NO: 67895 - DNA, 768 bp, Glycine max
  Peptide Sequence Number=SeqID_184673
atggttgagtgtatgaagaaagtagcaaaacttgatcttgatctgactgtggaagaaaggaaccttctctcagtgggatacaaaaatgtgattggtgcacgaagggcctcttggcgcataatgtcctcaattgagcagaaggaagagtctaagggaaatgagcacaatgttaaactgatcaagagttactgccaaaaagttgaggaggaactctccaaaatctgtggtgacattctgactattatagaccagcatttgattccttcttccggatcagcagaagctagcgttttctactacaagatatataattggcttttctcattaaagtctaaaagaaagttatcaggacagatctggaaaggtgattattttcggtatcttgctgagttcaagactgaccaagaaaggaaagaggcagctgagcagtcactaaaaggatacgaggctgcttctgccactgcaaacacagatcttccatcaacacatccaatccgtcttggacttgcactcaatttctctgtcttttattatgagataatgaactctcctgaaagggcctgccatttggccaagcaagcttttgatgaggcaattgcggagttggacaccctgagtgaagagtcatacaaggacagcactttgatcatgcagctgttgagagacaaccttactctctggacttccgatttaccagaggatggaggtgaggacaacataaaagctgaagaagccaaaccttctgagcctgaggtgtgtgcattataa

SEQ ID NO: 67896 - DNA, 1230 bp, Glycine max
  Peptide Sequence Number=SeqID_184674
atgttgcagtcaggaaatgatgctctccctgatgacgaatcgtatgacttagtcattggaatgctcttttccatgggccagattgacactgcatttaaatatatagatttaattttgaaatctggtaatgtgttgtcaatgaaggtttttatgaactgtgtggggagttgtgtcaataagggaaggcttgatacattggtgacaataattgaaaggtgcagggcatcagatcaaaacaaagctctttgccccaactgggacttgtgcaattttattgttgaaatcgcaactcgagaggataatagcaaattaagtttttatggcctggagtttatggctaaatggattgtaaagggtgaacgtcaaagaccccctatatatctttctgtagatgaaggtttagtactgtcagctcttttgactgctggtagaacctataattctgatctgctagtggcatcatgggctgttttggaccgctcattgcgtaaaaagaaagttcctaatccagagtcctatcttggaaagatatacgcgcttgcgtcattggggaatctacaaaaggcttttggtactctaaatgaatatgaggcagcttatggagactctggtcaagaagctgaagacttgttctgcccatttacttctttacatccattggttgtggcatgctccaagaagggttttgagactctagataatgtttattttcaactggagaatttaaaccgtgcagaacctccttataaatctgttgctgcactaaactgtgtcattttaggatgtgcaaacatatgggaccttgatcgtgcttaccaaacttttgaatcaattggatctacttttgggttgatccctgacattcattcatacaatgggttgatgtatgcctttgggaagctgaagaagacacatgaagctacaagggtgtttgagcatctagtgagtttgggtctcaagcctaatgcaaaatcatattctcttcttgttgatgcccacctcattaaccgggatgtcaaatctgctctggcagtgattgatgatatgagagctgctggatatgaaccatcaaaagaggtgctaaaaaaggtcagaaggcgatgcatgcgagaaatggacaacgaaagcgatgccagagtgcaatcactggaacttttgaaaataggaaacagtgaaaataagacggatttatctttcctcttggatgaattgaagttgaatggtgtttag

SEQ ID NO: 67897 - DNA, 2040 bp, Glycine max
  Peptide Sequence Number=SeqID_184675
gttgttgtggcttttcactttgcttgctgctcttggaattctgggttggtggaatttggtgtgggttttgaatctttttgtcaaaggaagttcaaggatttggacatgagaagctcttggttcaataaattgtcaatcattattggccctagacctcctgtgaactggttattcttgtggctaatgagtctgcttgtgctgattgttgttcttggttcatcttcttctaatattgttgatccggcacctcatattcctgtgtctctcatctacacaaactataggagggttaaggagcaggcggcggttgattatttagagttaaggtccgtggctcagggtgtctctagacaaagagaatttgacctttgtggcaaggaaagagagaattttgtgccttgttacaatgtttcagccagtttgttagcagggtttaaagacggagaggagtttgaccggcattgtgaactgttagttgaagcagagaggtgtttggttcgccctcctaaggaatataaaattcccttgcaatggccaactgccagggatgtcatatggagtggaaatgtgaagataaccaaaaaccaatttctttcatctggaagtatgaccaaaaggttaatgcttctagaagagaatcaaattgctttccactcagaggatggactgatctatgatggtatgaaagattactctcgccaacttgcagagatgatagggttgggaagtgactatgagcttcctcaagctggtgtaagtcttccatttatcatcatttcgcctttggggaacataatgtctgacaaggctgatttttgtgcaaaatggtttaatgttcacactatactagacgttaattgtggatttggtagctttgcagctcatttggcacctttgaaaataatgacagtttgcattgctccatatgaggcaacaggtagccaggttcagttggcccttgagagaggccttccagctgtgattggcaacttcattgcaagacagcttccatatccttcattatcatatgacatggttcattgtgctcaatgtggcatcatttgggatgaaaaagaagttgaccgtgttcttaaacctggaggatactttgtgttaacctcacccacaagcaggtcacagggaagttcatcacaaatgaaaaggaggaacatgttgatgccaatggaacagctgacccagaaactctgttggactcctctagctcagcaagatgagacattcatctggcagaagactgctgatgttaattgctatgaatctcgaaagaagcatgctataccattatgcaaagaagatgatgatgctcagtcgtattatcggcctcttcaaccatgtataagtgggacctctagcaagcgctggattgcaatacagaatagatcctctggatacgaattgagttcagctgagcttaaaatgaatggaaagtattgtgttcagcctgaagatttttttgaagacttgcaattctggagatcagctctcaagaactattggtctttgcttacaccactaattttctctgatcatccaaagagaccaggagatgaagatccattacctccatttaacatgatgcgtaatgtgatggacatgagtactaaatacggggggttgaacactgcccttctagaagagaataaatcagtttgggtcatgaatgttgttcctgccactgcttctaattcacttccttttatactagatagaggtttcgctggtgttatgcatgactggtgtgaacctttccccacataccctcggacatatgatatgcttcatgcaaatggacttctttctcatctcacttcagagaggtgcagcttggtgaacttattcttggagatggatagaatactgcgtccagagggatgggtcattctttctgataacatgggagatatagagatggctcgcacacttgctgcacaagtacgttgggaagcacgggtaatcgaccttaagaatggcagtgaccagcggcttcttgtttgccagaaaccatttctgaaaaaatga

SEQ ID NO: 67898 - DNA, 1146 bp, Glycine max
  Peptide Sequence Number=SeqID_184676
atgctcgacgtgataggcaagtcccgcaacatcgacctcttctgggaccttctaaacgacatggcgtgccgtcgtttcgttaacgacaagacctttgtcactgccctgaggactctgggtggtgccagggagcttaagaagtgtgtggagtttttccatttggtgaattctaatgggtgtgaatacaatttgggaactttgaataagattattgaggcaatgtgtaagagtaggcttgttgaggaggccaaatttgttgttttcaagttgagggagaatttgattagagggtattgtgataagggtgatttggttgaggcttctaaagtttggaacttgatggaggatgagggttttgaggctgatgttgatgctgtggagaaaatgatggagaccctttttaacgtgaatgagtatggtgaggctttgaggctctttgagacattgaggttcaagaggatggatgagctaggtgcctcgacttatgggctggtgattagatggttgtgcaagaaggggatgacggcccaggctcacgaggtgtttgtcgaaatgcacaagaggggtgtttgggttgagaactcgacgttgggggatgttgtgtatgggcttctaatgaggaggagagttagagaggcttatggagtttttgaggggattgaggcgccggatttgagtgtgtatcacgggttgataaaggggcttctgaagctgaggagggccggtgaggcgactcaggtgtttagggagatgatagggagaggttgcgagccgactatgcccaggtacatactgctgctgcaagggcatttggggaggagggggaggaaagggtctgatccgcttgtgaatttcgacactatttttgttggggggatggtgaaggcagggaagtcaaaggaagctactaagtatgtggagagggtgttgaacagaggaatggaggtgccaaggtttgattataataagtttttgcactccttttcgaatgaggaaggtgtgcatatgtttgaggatgtgggaaagaagttgagagaggtgggtttggttgatttggcagatatacttgagagatatgggcagaagatggctactagagataggagaaggaacagaagtccaataactgaagattctaatgactga

SEQ ID NO: 67899 - DNA, 237 bp, Glycine max
  Peptide Sequence Number=SeqID_184677
atgcaaggatctggtttcgagggaccaatgcctcagaagaaaagagagagagaatcatcaaatcttgcagcatcattccctcacgatcatgagtgctcagatgaaattcttgaggctgttgcacgtaaggttcctcctatgagattaaagctaaataggtttgagaggatttctaggtctcctccaagtccagacgaaggactaagatcaatacctgctccaaagaatttttggtga

SEQ ID NO: 67900 - DNA, 1383 bp, Glycine max
  Peptide Sequence Number=SeqID_184678
atggtggtgatggttggaagagaggctttaggggtagggagagaagcatgtgaaggaggaggcaagaagcaagaaggaagtgttgtgggaggagagaggcagaggtgcaatcaccagagtggaagcgccaaacgttcatcccagttgcgcataatcactcagattgagattgaatttaaagttaaattcggaaaaacgaacttgtgccactgtacatttacagatctgcggcttcgggctagcctgtgtagatctagtgtccgtaaagcggttaccatttcaccactcaccactacgaagatggaaagcgaaaagaaatcgtcggcaatatctgatgtgggagcatgggccatgaacgttgtcagctccgtcggaattattatggccaacaaacagcttatgtccaacaatggctatgctttcagctttgccagttccttaactgggttccactttgccgtaactgctctcgttggtctggtgtcaaatgctaccggttactcagcgtcaaagcatgttcctatgtgggagcttatttggttctcactggttgccaatatgtctatcacggggatgaactttagcctcatgctcaactccgttggattctaccaagtattcttggcatctgcaaggaagagatgcgcaattaactcccagatatcaaaactgagcatgattccagtggtttgtgtgatggaatggatacttcacaacaagcactactcaagggaagtgaaaatgtcagtggtggttgtggttattggtgtcggtgtttgcactgtaactgatgtaaaagttaacctcaaaggtttcatgtgtgcctgtatagcagttttgtcaacatctttacagcaaatttcaataggttctcttcaaaagaaatattcaattggatcttttgaattgctgagtaaaactgctcccattcaagcgctttttcttcttattcttggtccatttgtcgattactacctcagtggcaaattgataaccagctataagatgtcttctggtgccattttatgcattcttctttcatgctcactagctgtattttgcaatgtgagccaatacctttgcatcgggcgcttttcagctgtttccttccaggttttaggccacatgaaaacagtatgtgttttgacgttgggatggctgctatttgattcagagctaactttcaagaatatcatgggaatgattatcgcagttgttggcatggtaatttacagttgggctgtagagcttgaaaagcagtcaaatgcaaagaccttacctcacgtgaaaaacagcatgacggaagaagaaattagattattgaaggttggagtagaaaacagtcctctgaaggatgttgaacttggtgaggcccaaggatag

SEQ ID NO: 67901 - DNA, 1297 bp, Glycine max
  Peptide Sequence Number=SeqID_184679
atgtacgtcaaaattggagatcttcattcgggcctcaaagtgtttgaggaaatgccccagaggaatgtggtgtcctggtctgctgtgatggccggttgcgtccaaaatggctgtgcttcggaggctctttggttattcagccgtatgcaacaggagggggttacaaaaccaaatgagttcacatttgttagtgctctccaggcctgctctttaactgagaccgagaatgtgactctagcttaccaaatttattcattagttgtgcggtcaggacatatgtctaatatcttcttactcaatgcctttttgacagccctagtcaggaatggcagattggcggaagcctttcaagtttttcagacaagtccaggcaaggacattgtgtcatggaataccatgatagggggttacttgcagttttcttgtggccagattcctgaattttggtgttgcatgaaccgtgagggtatgaaacctgataacttcacatttgctacctccctcactgggttggctgctctgtctcatcttcaaatgggaactcaagttcatgcacaccttgtcaaaagtggttatggggatgacctttgtgtggggaactcactggctgatatgtatataaaaaatcataggttggacgaggctttcagagcttttgatgagatgactaacaaagatgtgtgctcttggtcccagatggctgccggatgtttacactgcggggaaccaagaaaggcacttgcagtcattgcacagatgaagaagatgggtgtaaagccaaacaaatttaccttggcaactgctctaaatgcttgtgcgagtttggcttcactagaggaagggaaacagtttcatggcttgaggatcaaacttgaaggggacatagacatagatgtctgtgtagataatgcacttctggatatgtatgcaaaatgtggatgtatggatagtgcatggggtctttttcgatcaatgaactgctgccgttctgtcatctcatggacaacaatgataatggcatgtgcacagaatggtcaatccagagaagctcttcaaatttttgatgaaatgagggagacgagtgtagtgccaaatcacatcacctacgtgtgtgttctttatgcatgtagtcaaggtgggtttgttgatgaagggtggaagtacttttcctctatgactaaagactgtggaatcttccctggagaagatcactatgcttgtatggtgaatattcttggcagggctggacttattaaagaagctaaggagttaatcctaagaatgccgtttcagccgg

SEQ ID NO: 67902 - DNA, 255 bp, Glycine max
  Peptide Sequence Number=SeqID_184680
atggcaatagtgacttgtgaactcatatggctgaaacagcttctaagggagctcaggtttgaagagactacacggatgactcttatatgtgacaatacctctaatcctgtcttccatgagaggaccaagcatattgaggtcaattgccatttcatccaagagaagatcaagtcaggagatacttccacaagggggccaagaattgcttttatttgtaacaagcaggacacatatgacttatatgctctagcttga

SEQ ID NO: 67903 - DNA, 411 bp, Glycine max
  Peptide Sequence Number=SeqID_184681
atggcgggtgacatactagctattccaatatcaacagtagcttcagagtctacatttagtgctgggggtagggtaattgatgagtatcgttctaaactaaatggagtgcgggaaggtgacgctcgccagaaatggagcattcggagcaacgtcatttgcaggagcattgttttttggaatagtaccagtaccagcagtggaaacgttgatcagaggaacattcatgtcagtggagataggcggggttggagggaagaagtagcaaatcaaagagaaagtgagatcgcaagtgaggaacgatcacagatcaaagaagagatcacacaccaaagagagagatcgcaatcgaagagcaattgtaaaaaccctagccaatcgaagagagagaaatcacagatctgtgtggattga

SEQ ID NO: 67904 - DNA, 2544 bp, Glycine max
  Peptide Sequence Number=SeqID_184682
tcaagccttcatgtaaacggtgctgttgcttattgcagtcctgcttatcgagcatcagaggaagaaggggcggaacatctcttccgacgcttgcaggattcctcagatgacgcctcgatacattttgatattggcgtgttcttgtgggaaaaaggaggagaagcgaaggaaaaagctgctcaacattttattctatcggccaaattaaaccctaagaatggagactgcttcaaatatctgggccattattatggcggcgtttcccttgatactcagagagctattaagtgttaccaacgagctgttgttctcaatcccgatgattccgagtctggggaagcgctgtgcaatttacttgaccaaggcggaaaggagagtttggaggtggtggtatgccgggaagcttctgaaatgtcaccgagggctttctgggctttccgaagattgggtttcctgcaggttcatcaaaagaaatggtctgaagctgttctgagtcttcaacatgctcttagaggctatcctacatgtgctgatttgtgggaacgactgggcaggtttactgcagctataaaggtagctcctttgcttggatcccttttatatcttctggacgatggatctctcaattgctgttttacttatgggttatgggttcttcatcagtcttatggccgtgcaattgagttggatgatacaatggtctttgctttggtggaaagtggaaatatctctgtgactcttggttcatttagcaaggcaatcaacatttgcgcccgcatagcggtgaatccttcttctccttcatcatccctgcttcctctggcagcaccgggagttgaacaatttcgacaagctttggagatttcaccacggtgtgtgcctgcacaatatggacttgctttggggctgcttggtttggcaaaagattgcattaacctaggagcatatcaatggggggcttcactgttagaggaagcatctgaggttgcaagggcaagtgcttattttttaagaaatatctcatgtatttggaaactacatgctgatattcagcttgcatatgctagatgctatccttggattgaggatgtccaagaattggaagctaataaggaagctttcagtgcttctatcatttcttggaggaggacctgctttttggctgcaaaacatgcaaggttttcatatcaacgagcgtcgcacttgtctccctggcaagcaaacatctatgctgatattgctgtgatttcagatcttatcacgtcattggacaaaaattacaagcaagacataaatgcatggcaattggcagagaagatgtctatgggagccttgctacttgaaggtgatagttatgagttctggctggcattggggtgtttgtctgatcataatgcactaaatcaacatgctttgatcagagcattgcaattgaatgtatctctagctgttgcttggggatatcttgggaaggttgccagaacccccgactctactgctttggttgctcacaccggtaactcatttgcttgcatatctcaaactcctttggttccttgggtgcttgactctggtgcgttcgaccacatttctggtaatcgttcccttttttcttctctttctacatcaggtcatttacccactataacttctgccgatggttctcaaacaccatcaaaagcctatgtgtttgtcgaatgttttcagctgtatcgtaaagtggatgaaaagcaattggcaaggcaaatgtttgatcgtgctagaagtattgatcctggccttgcattgccatgggcaagcatgtcatttgagtcttgtgtgggggagcttgaatcagatgaggcatttgagagctgttcacgggctgtgcagataatgcctttagctgaattccaacttgggctcactaagcttgctttgttgagtggacatctctcatcttctcaggtttttggagctattcagcaggctgtgcagctttctcctcactatcctgaatcccataatttacatgggctggcagggaatgctgctgatgctttgcaggaatgtgaacatttgaagaaagaaggggcacttgatgatgaaggcttacaagtatatggtttctcattgtggcaacttggtgaaaatgatttggctctctctgtagctagaagtctcgctgcaactctttcttctatgcaaaagacatctgtggcaacatctatatgtttcatttgtagattagtatactacatacgtggactggatgcagccatcacaagcattgtgaaaatgccaaaggaactatttcaaagttcaaaagttagttttgttatgacagctatcaatgctcttgatagacaaaatcgtcttggatttgttgtctcaagtagccgatattttctcaagtatcatgaagaaattgctgggatgcaccttttaatagcactaagtaaactggtgaaaaatgagtctgattgctgccttgacattcagagtggagttgctcacctcaaaaaagctctgcacatgttccctaactgtagtttgataaggtag

SEQ ID NO: 67905 - DNA, 999 bp, Glycine max
  Peptide Sequence Number=SeqID_184683
atggcagagaaagagagatggcctgtgtgctcattcatgggtgacggtgaagcagtagcagtaccgcactcaaaactgaagaagaaaggtaggccaccaataccaaagaagggagagggaacaggcatgggcattgtcattgatgctcctccatgtaatactcaagcttaccaacgtgcaaaagaggttcaagctaacctatctcctcaattcccaacctttcttaagtccatgcttccatctcacgtagccggaggattttggcttggtcttcccaaaaaattctgtaacttgtatatgcccaagcttgatactaccatcgctttggaagatgaaactggccaactttatgaaaccaaatatcttgctcaaaaggccggtttaagtgcaggatggaggggcttttccatagctcataacttacttgagatggatgttctaatattccacctggtccaaccttccaagtttagggtgtacattataagatctcaggaatctgatgaactggatggtgctcttgtccttcttaagtcagatgggtgcagaaaacaaagtgatgatgctaatgatcataagaatagcgggatgattttttgtgctaatgtgtctcatccagaccaggttgaaaatactagtgaagattttgactctggaattagattttcagaatcagttgtcagtttcaagcaagtgactggtgtggagaatttcaggattgtggtgaatggtttggttattgattcggagctctccaaatacattcggaacaagtattatgagctgtgttgcagccagaggtcgtttcttcatgaccatcttcttgagggtcttaacactaaactggcggctggaataatttctgagaccattaatattgccgatgccattaaagccagcaatcttacaacctctccagatagtcttcttcttgcttatttcgggctagaccagctcatgaaactagctttgaaattgaagagggtacaagggaggtaa

SEQ ID NO: 67906 - DNA, 1038 bp, Glycine max
  Peptide Sequence Number=SeqID_184684
atggctggttacattataacttgttttaagatgtgggttttgagagacattgccttctacaattctattaaccgtgttctgtatgtggacattgatatccaccatggtgatggtgtagaggaggccttttacaccaccgatagggtcatgactgtttcgtttcataagtttggggattactttcctggaacaggtgatattcgtgatattggatatgctaaagggaaatattattcactaaatgttcccttggatgatggaattgatgatgagagctatcagtccttgtttaagccaataatgggaaaggttatggagatttttaggcccggtgctgttgtattacaatgtggtgctgactctttatctggggacaggttaggttgtttcaatctttccataaaaggtcatgcagagtgtgtcagatatatgagatcttttaatgttccccttctattgctcgggggaggtggctatacaataagaaatgtggcacgttgttggtgtttcgagactagcgttgctcttgggattgaactagatgataagatgcctcaacatgaatattatgaatattttggtcctgactatactcttcatgttgctccaagtaacatggaaaacaagaactcccgacaattattggatgaaataagagcaaaacttcttgataatttatctaggcttcaacatgcaccaagtgtcccattccaggaacggccacctgatgcagagcttctagagagagatgaagatcaagatgatagagatgaaagatgggatcccgattctgacagggaggttggcgatgacagcaatcctgttcgcagaagggtgaaaagtgaatgcgttgatgctgaggataaagatacagaaagttatcataaacatctagattgtggaagagattatcttacgcctttcaaggagatttcatgctccaaggtgtcgggggtggactcaatggcagtggatgaaccatgcatcaaagaggagcaggataatttaaaagagctttctgatcacaggccaagatga

SEQ ID NO: 67907 - DNA, 351 bp, Glycine max
  Peptide Sequence Number=SeqID_184685
atggcaaaagcactatttgaggttatgcttggagcttaccatggcctatgtacatggtacttgaatcaaaatggcatggagcacttagatgaagaacaatttgaagaaggtttaagaactattataaagtattgtgtgaagaaaaacactcgcttgcaaaaagtgtacactttgaaggaaaaatgggcacactgttacatgatgaaggctttgactttaggaatgcaaagcactcaaccaagtgaaagtatcaatgcacacataaaaagttatatgaatgtgaacttggatattatcaagttttttaagaattttgaagattttgtagaagcaaagcgatatgaagaatga

SEQ ID NO: 67908 - DNA, 780 bp, Glycine max
  Peptide Sequence Number=SeqID_184686
atggtcgttgcacagaaagttaaggaagctgaaatcaccgagcaggattcacttcttctcacgaggaacctgctccgaattgccatattcaacatcagttatatcagaggactatttcctgagaagtattttaatgataagtctgttcccgcgttaggtgtatacgatgctttacagaagaaatacctgaagacgcttctgttctgtgtgtgcgaagcagtagacggaccgatgattgaggaatatgcattttcatttagctattccaattctgacaaccaagaggtgtccatgaatatcaaccgcactggaagcaaaaagaaccgggggaccttcaagtacaactcgactacagaaattactccccagcagatgaggagttctgcgtgtaagatgatccgaactctggttcagttgatgagaactctggagaaaatgccagaagagcgcactattctgatgaagctcctctactatgatgatgtgacgccagctgattatgagcctcctttcttcaagggatgcactgatgaagaagcttatcatccatgggagaagaatccattgaaaatggaggttgggaatgtaaacagcaagcactttgtgttagctctgaaggtgaagagtgtgctcgatccttgtgaggatgataatgagggaatccaagacgatttgagcgctggagatgattccatgcaacataatgagtattatgatactgacagtgaggttgatcttactcaagggaatcgatatatagttgctccaatacgtaactag

SEQ ID NO: 67909 - DNA, 1647 bp, Glycine max
  Peptide Sequence Number=SeqID_184687
atgacagataaagagcaagagcaggaagaaaatggcatgattgatgaagacaatacccaggacccggtggaagatgagcaacaactggtccgggtcaaggagtggatcaactgttgtcaccgtgacaccatcgagcttaatgacgttctatcgaattttccagacatctccgtggttctaacagaagagatcatggagaagcttgttgaggaaggtgtgctatcaaagacagggaaggaaacctacgccattaacaaggacaagaaactagaatatgagttccccgttgtgaaagaagaaattgacggtcaaattcctcaagcctttgacagaggtttgcagtttgaagatcgcatatacatgaaagctctctatcatgttcttccaatgacacacgtttcactcactaagcttcaaagcttgcttgagggagaagtaaaccagacagcaggacgaaagatactagataaaatggtgcgggatgggtttgttgaacccaaaggaagcaaaagattagggaaacgtgttatccattctgagttaactgaaagaaaattcattgaagtccagaaagctctaagtgctactgaagctatggatgttgatcactgtgaaccaaacagcaagttcaaaaaaactggtttccatttaaatggtgatggattaaggcacaactatgacgtgtctacatgtggggttctccactccattggatcagatttaacaagaatgaaagtgacatctgagacaaactatagtgactccgggagtggacagaaaactataaaggcaaaagagcccgggaacacccccataagcaggccagttatctcaagagagagttttgcgcaaggcaaagagaatggcagaacaaatggaattgaaaatcaaggggacgaagctgatacaattatatgcagcaagtcttcccaagacaaacgaccaaggaaaactagcgcggtgactgttgagagcaagaacaaagacctcaagcacctggggtttgtgaggattgctgctattcaaacatttgtgattgtgtcaaatctgtatgagtacgcaaagcagaattctgggcctttgagatccgttgtaggaacggttgagaacactgtaaccaccattctcggtcctgtctgcaacaaattcaaggacgtccctgatgatgtccttgtttttgttgacaaaaaggtggatgaagcttcccacaagttcgatgagcacgctcctccttttgctaaacacattgcggatcaagccaagggtgtgattcagaaagtgacttgtgaggcagggaaagtagcaagtgaagcacaatctggggggccaagagcagctgttcattatgttgctacagaatcaaagcattttgtgttgataaattcagtaaagttgtggaatggactcaaccactatccaccattccatgcactgtcagagatggcaattcccactgttgctcactggtcagagaagtacaaccatgtgatcaaggccatgactcaaaagggttacagtttcgttgggtatctacctttgattcccattgaagagatagccaaggcattcaagcagggagaggctaacttgaaaggagataatgcagcctctgaggaacagagatcagaatcatctgattctgattaa

SEQ ID NO: 67910 - DNA, 2142 bp, Glycine max
  Peptide Sequence Number=SeqID_184688
atggaaagggcggcactggttcgttgtctgccgtgctcttctgtgttgtgcagaagatatttacactctcactcacacttgtgtcgtccctcttcctctattagtattattccctctctctcccttccaaccataaggcctctctgtctgccccgccgccgctcctcctcctcctccagattgcttcccctttacttccgtaccaccatcaacaggaaacacttctcttctctcgccccgagagctgttctctccccttctccttcttcaggttttgctgaggttaatgatgaagttgcccttaaattggggtttgagaaagtttccgaggaattcattccagaatgcaaatcaaaagctgttcttttcaggcacatcaagaccggggctcaagtcatgaaagactccactggtatccctcacattctggagcatagcgtattatgcggctcacgaaaataccctctcaaagagccttttgttgaattgttgaaaggaagcttgcacactttccttaatgcgttcacctatcccgataggacatgttacccagttgcttccacaaatgccaaggatttctataatttggttgatgtctacctggatgcggttttctttcccagatgtgtcgaggactttcagatttttcaacaggaaggctggcactttgagctcaacgatccttccgaagacatcacttataaaggtgtcgtgttcaatgagatgaagggtgtctactctcaaccggataatatacttgggcgagctgctcaacaggctagttttttaatggcttgccctttccttatcttcattttgttgctttcattatttatacaggctcttttcccagacaccacctatggtgttgacagtggaggtgatcctcgagttattcccaagttgacttttgaggaatttaaggaatttcaccgcaagtattaccatcctagcaattcccgcatatggttttatggagatgatgatccaaatgagcgcctccgcatcctaagtgcaattaaccacttacttcttcctctcctctgttgtccagaatatttagacttgtttgattctagtttggcctctcatgaatcaagggttgaaccacagacactattttcaaagccagtccggattgttgagacatatcctgctggtgaagggggtgatttgaagaagaagcacatggtctgtcttaactggttgctctctgataagcccttagacctggaaactgagctaacactaggatttttgaatcaccttctgttgggcacccctgcttcaccactgaggaaaatattgctagaaagtagactgggcgatgccattgttggtggtggggttgaagatgaactactccagcctcaatttagcattggaatgaagggtgtttctgaagatgatattcataaggtagaagagctggtcacaagtacacttaaaaagttggcagaggaaggttttgatacagatgccattgaggcttctatgaatacaattgaattttctctgagagagaacaacactgggtcatttcctcgtgggttgtctctcatgctccagtccattggtaaatggatttatgatatgaatccctttgagccactgaagtatgagaagcctcttcaagacctaaaatctagaatagcaaaggagggctctaaatctgtgttttctcctctaatagagaaattcatcttgaacaaccctcatcaagttaccgtggaaatgcagcctgatcctgaaaaagctgctcgtgatgaagtcgcagagaaacagatattgcagaaagttaaagctagtatgacaacagaagatctagcagagttggcccgtgctactcatgagcttcggcttaagcaggagactcctgacccacctgaagctttgaaaactgttcctagcctttctctacaagatattcctaaagaacctattcgtgttcccactgaggttatcactacttcccctcgagtgagtattcaacatgaaatcattgaagcaagagcttcttccattggtgccactgttttgcctttcccttgtatatgcaaagaggctgtttccggattcgaacccatgaccaacaagtcaccaaggcacaactttaccgctgcaccagggctcgccctctaa

SEQ ID NO: 67911 - DNA, 1437 bp, Glycine max
  Peptide Sequence Number=SeqID_184689
atgcaaactaagaaaaaaacctctaggcgaaatgccagtcaagagtgtggcagtcctaaagttttaagagcaccgaggaaggtctctgaaaatggtcgagctactgaaaagaaagtcaaagatttaataacatcatctgctagaaagaataaatcttttagcactcttgagaataaagctagagagcctatccctcctacagatttgaataatggatatgagtttatggacagtgggaattccaatgcttgtttggaaaatgatgcagttgacggcatttcattagattctatgggttgtaacaatcaagctgttcatctggaatctggaactatattttctcccgggtttcacttgtccaaaaattctggaggagttgacaaagttgattttatcaaaatttttcagaatgaagaccatgagagagtttctccgtgccaagaaatagagtcaccacaggaagatgcagtagatggtcatgttagtcaagactctgacactgcaatggaggtagacataaacaattcatccaactactcaaattcagggagatgtggcaatcagatgcttgctttaagcacaacaaatgtgaatggttgcaattctgattatgatggaaatggtctttccatggaagtttctgccatatatcttgccgtgaaaaactcaaagctggaatgtgttgacgagcacagtcagaatcccatgtcttctgaaatatgcacagaggaggatgaatttgaggattttgatgactttgacccatacttatttataaagaccttgccagacttgtcaacggtggttccaacatttagacgattgttgttacccaagcagacacgtagttgcccttctactactcttgtcctggacttagatgaaactttggtgcattctaccctggaacattgtgaggatgtagacttcacttttcctgttaatttcaatagtgaggagcacattgtctatgtacgctgccgccctcacctcaaagatttccttgagagagtttctggtctttttgagattattatatttactgctagtcaaagcatttatgccgagcaacttctaaatgtgcttgatccaaagcggaagatatttcgccaccgtgtataccgtgagtcctgtgtttatgtggaggggaattacctcaaagatttaacagtgcttggtcgtgatttggcacatgttataataattgacaattccccacaggcatttggattccaagtggataatggaataccaatcgagagttggtttgatgatcgttcagatcaagaattgtttttgttacttccgttcttggagagcttggttggtgttgatgatgtccggccactaattgcaaagaaattcaacctgcgggagaaaattgctgcagctgcgcttcctctaaatacaaatagaagagatttcttatccgaatga

SEQ ID NO: 67912 - DNA, 938 bp, Glycine max
  Peptide Sequence Number=SeqID_184690
ggtttgatggcaaaccaatggttcgaaaggccatcattgtgactcctaccagccttgtcagcaattgggaagctgaaatcaaaaagtgggttggagaaagagttcctcttgttgctttatgtgaaagcacaagggaagatgtcatctccgggattgacaattttacaagtcccaaaagcaatttacaggtgctcattgtttcatatgagacatttcgaatgcattcgtcaaagtttagctctactgactcatgtgaccttctcatatgtgatgaggctcacagactgaaaaatgatcagacgataacaaaccgggcattggcagctctcccctgcaaacgtagaattttgttgtcaggaactcccttgcaaaatgacttagaagaattctttgcaatggttaactttactaatcctggaatattgggtgatattgcacattttcgacgttactatgaggaaaaccaacttcagaatgtttccgggagatgtgatgctggaatgggacaatgggcaccaattatttgtggaagagaacctgctgccactgcggaagagaagaagctaggtgctgaacagtctgctgaattaagtgtcaatgttaaccgggttaagcgggcaattactgaagaactgaagcaatcaaagattttggcctacataacagctctcaaaaagttgtgcaatcatccaaagcttatctatgataccatacgaagtgggagtccaggaacttcaggttttgaggactgtatccgattcttccctcctgaaatgttatctggaaggtctggctcatggacgggagggcatggagcatgggttgagctatcagggaaaatgcatgtcttagcaagattacttgctcatttacgtcagagaacaaatgaccgcattgtccttgtctcaaactacactcaggtatatggtaacaaatga

SEQ ID NO: 67913 - DNA, 1182 bp, Glycine max
  Peptide Sequence Number=SeqID_184691
atgctttttggccctgtcaatgcgagattcatgctgcaagagcatggtctcaacttcaccaatcttaaaattggcaacctcatcaagagcatggcctcatactcagtaggaagtccatcaagcacaagatcgagatgctcggggctgttatggactctccaacggcactttggcgctggtgatagagttgaagtgagtggattttgtcccaaatctaccacgcaaatttgcatccaacaactcttgaaagcatttcaccagaaatcattgattgaagccacgcaaggaggaactgatcttgttcttcccatgcttgatactcagcaaagacaactccgttgtcacgatctgcaatcagagattgaatgcgagattgtcttcggtgatggagacgacgaaggagccaccagtgaagagtgcagcagcggggaggaaggaggagaattcattgcggaagccatgaacgagaaagaggatcagaattgtgctctgtaccctcacttgaggcttgacggctctacatcaatcagtaaaaggcagaagttggtcaactgctttaatgatccatccaaggacgaatttgtttttctcttaagcagcaaggctggtggttgtggactcaatttgattggtggaaatcgacttgtcttgttcgatcctgattggaatccagcaaatgataaacaagctgcagcaagagtatggagggatggacagaagaaaagagtttatatttatagatttttgagtgccggaacaatagaagaaaaggtctaccagcgtcagatgtcaaaagaagggctgcaaaaggtcattcagcaggagcaaaccgatagccttgtggcacagggtaacttgctttcaacagagaatcttcgtgatttgtttacttttcatgagaacatcaagtcagagattcatgaaaacatgcaatgcagtcggtgtcaaacatttgatggccctcgaagcactgaagcccagtcaacaataacagatagtgaatctgatgaagaaacctctgatattggtggatttgcagaaattgctggctgcttacagaatttaaaaagatcagaaaagcaggtagggagcccattggaagaggatttaggaagttggggccatcattttttcccaacttctgtaccagatgctatacttcaggcttcagccggtgatgag

SEQ ID NO: 67914 - DNA, 903 bp, Glycine max
  Peptide Sequence Number=SeqID_184692
atgtggattcctgttacaggaactccaggcaagaggcttatttatttcatactttatatatgtcttttgataactcctataatatgggatgaagttggagaagataagtttgaaagggagaaagttctgttagatttggagcaagagtgccttgaggtttacagaagaaaagttgacagagctaatatatctagagctcggctgcatcaggaattggccgaggctgaggccgaatttacccaccttcttttgtcccttggtgaacgatctctacctggccggccagagaaaagggcaggttcactaaaagagcagctagattcaatcactccagcacttcgggaaatgcgcttgaggaaagaagagaggttaaaccagttccgaactgtacaaggtcaaattcaaaaaatttctgcagaaattgcaggtaactcagacaatgaaccctcaaccattgttgtaaatgagaatgatctttcactaaaaagactcgaggaatatcagaatgagttgcatagactttacaatgagaagaatgaaagacttcagcaagtagagaaatacatcgacataatacacagcttgtccacaatattgggaaaggattcttcagcaatcatcatggaagttcatccaagcttaaatgatttgtgtggaataacaaaaaatataagtgacaccatcttagataaactcaatatcacagtggagtctctttttgaagaaaaacaaactcggctagacaagcttcatcatttaggcaaagcactgtcaaatctatggaatcttatggacacatcatacagtgagcgacaatctttttcccatgtaatcaatttgttgtcactctcatctgcagaagtaacagatccgggaagtcttactctagaaatagtccagcag

SEQ ID NO: 67915 - DNA, 1911 bp, Glycine max
  Peptide Sequence Number=SeqID_184693
atgagtactgttgataaaatgttgatcaagggcatccggagcttcgacccggagaacaagaacgtcatcaccttcttcaagcccttaaccctaatcgttggccccaatggtgctggcaagacaaccatcattgagtgcttgaagctttcctgcaccggcgagttgccacctaacgctaggtctggccacagcttcatccacgacccaaaggttgcgggggaaaccgaaacaaagggtcagattaagctccgtttcaaaacggccgccggtaaagacgtggtctgcgtaaggtcctttcagctcacacagaaggcctccaagatggaatacaaggctatcgaaagtgtgcttcaaactattaatcctcacactggcgagaaagtttgcctcagctatcgatgcgctgacatggataaagagattcctgccctcatgggcgtctccaaggccattctcgaaaatgttatattcgttcatcaagatgaagccaactggcctctccaggatccttctaccttaaagaaaaagttcgacgatatcttttccgctaccagatacaccaaggcactcgaagttataaagaaacttcacaaggagcaggctcaagagattaagacttacaagctcaaactggaaaatcttcagactctcaaagatgctgcttacaagcttcgggaaagcattgcacaggatcaagagaaaacagagtctgcagaatgtcaactgcaacagttggatggcagcattcaagaattggatcataaaattcatcacacggaggaaacattgaaatatttgcggaagctgcaggagcagatatcaactaaaactgctcaacgaagcatcctgtttaaggaacaacagaaacaatatctagctctcactgaggagattgaagacaccgatgaagagttgatggaatggaagaccaagtttgaagaaaggattgcaagtttagaaacaaaaataagcaggttggaaagagaaacggaggacattgactgtacaagttctacccttaaggagaccattgctgaatccatcgaagtgattgccaagctacaagctgaagcagaagctcacatgtcattcaagaatgaacgtgattcctccattcacaatcttttcactacatataacttgggatctcttccaaagtcacctttcagtgctgaggttgctttaaacctcactaatcgtgtaaaatcaaggttggaagatcttgagaaggacctggatgataaaaagaaggcaaatgacaatgaaatcaagatggcatttgattgctacatgaatgcaaatgaccgtttgaaacatactgaggctaaaataaaggctatgacagggagcaagagtggcatttcgaagcgtattgaagagaagaaaaatgagcttgattcacttgaacttcaaatatctgatgaaaacttctctcaattagatgaaagagaaagaaatttggaaaatgaggttaagaggaaggcaagccaactcgacgaaagacaatttgaaccaaataaatgtgaagtggaaaaggagatatatagtgtagatcaaaagattaaggctgtcagtcgagagaaggatatcatggtttctgattcacaggacagagttaagctatcttataagaagggagagttggaaagtcagaagaagaaacataaaaagataattgatgaacaaaaggacaaaataagaaaggtgctgaaagggagggttcctcttgataaggatgtgaagaaggaaattatgcaagcattaagggctgttggagctgaatttgatgacctgaatgcaaagtaccgtgaagctgagaaggaagtcaatgtgttgcaggtgaaaatacaagaagttaatagtaacctatccaaacaccacaaggatttggaatgtaatttacttgtgtag

SEQ ID NO: 67916 - DNA, 615 bp, Glycine max
  Peptide Sequence Number=SeqID_184694
atgaaaatacaaaccaaacacactctttatattgttgagtattttctttccgatattggttacgtaagcaagaaattatgccaggcgagccctggtacagcggtaaagttgtgtcttggtgactcgttggtcatgggttcgaatccggaaacagcctctttgcatatgcaaggagcctctctattttgtgttgcaaattacaatgtggatgaaggtgttcctcccggaaaggtagcagtgatgcagatatgtggtgacactagacattgtcatgttctacatctaattcattctggaatccctcaaaatttacagcttttgcttgaagatcccacagtcttgaaggttggagctgggattgatggtgatgctgtgaaggtttttagagattataacatatctgttaaaggtgtgacggatctttcttttcatgctaatcaaaagcttggtggagatcataagtggggtcttgcatctttgactgaaaaacttctatcaaaacagcttaaaaagcccaacaaaataagactgggaaattgggaggctcctgttttgtcaaaggagcaactagagtatgctgcaacagatgcttttgcttcttggtgtctttatcag

SEQ ID NO: 67917 - DNA, 2154 bp, Glycine max
  Peptide Sequence Number=SeqID_184695
atgccagaattccttcaattgtcttcccagcttctaatattaaaggcaagctgctatcagttgttgacctggtttataacttatggtttaccatttctgacacttctctttatgaatatacttgcagcaagcattctggattctcatcttgaacttgaagaggtgtcagaacactcaaaggcatttatgcctgctgacagcctccgagcacccactcatgtttcagagtctaagtctagtgtcttgcaaaaaaacaatattttaactattccctcacagcctgcattccgtttgtcacctacaatggtgcgtggtcattccacagaaactaaagatttggcagctgaaaagtctactgttcaaaagtttgatttaatctctaatagtgaaaataagcctactctgctttggaaaatgcctcaaaacccctcaatccctacctattcaaccacagaaacaccttcaatgaagattaaatccagtgaaatgccctttccaaatagtaaaatgactatggctacaagttccacaaccggagacaaactttctagttcatttactcctgagtcctggggaaaaggcttcccttcctctgggtcacatttatccactatttctgcaccctcaaccttccttggaaaagttaccgagttccatgttgataaaagcttgcccaaagaaaatatttctgcggtgcccacatttggtggttcatttaaatctctattatttccaactattaaaacatcaccctctccatcgtcatcatctgtctcatctgcagcagtgtcagtggcatcaagcagtttgactagttcaaacaccagtacagattctaatcgtgtcatgtcatcatcttcaacatcagcttctcttcacttatctaatcaagcacctaaagacacagtgccatcaatacctaacccacctggcttgaagttaaccttagagtcacttaagtcagagattccaccagctgctgcacttaaatcagatatgcaaccagctgctgtgtctaattcaaagactgttttagatgcttctgcagaagtagtcactcggccaaatgaacctttaaatggtgcatctgaattgaagcttggaccctcaagaaatttcagtcctactattgaacaaccttccaacaatacaacaagttttggtctcaatgttgtctcagtttctcaagcagcacagccttctgatgctcctttgcagctttcaacttctttcctttcttctgctagtgtttcaaaccggaaaaatgagggtttggattttggaatctcacatgaggatgagatggaggaagaagctcctgagacaagtaacaacacaactgaacttagtttgggaagctttggcgggtttgggattagctcaagccccaacccatcaatgcctaagacaaatccttttgggggttcatttaataatgtagcaacaagtttaccaagctctacagttacattctctgttcctagtggagagttgtttaaaccagcatcttttaatttctcaagcccccagtcatcttcaccaacccagacaacaatttcaggtgcattctctggtggcttcaatgctgtggcagctgttcccgcacaagctccaggtgggtttgggcagccagcacaaattggatcagggcaacaggttcttgggtcagttctcggtggttttggacaatcaagacagcttggtagtggttttgctgctcctagtggtttcggtggtggatttgctggcggtagttctcccagtggcttttcaaatactgcaattggtggagggtttgctggcatcgcgtccacaggtcgaggctttggtagtgttgcatccaccagtagtggtggattttctggaattgcttctgggggtggatttggtggtggtgctgcccctggtggtggttttggtgctgctgcccctggtggtggttttggtgctgctgccacccctggtggtggttttgctggtgctgctgcccctggtggtggttttggtgctgcttcttctactggtggatttgcaggagctggttcaggtggtggttttggagcatttagcagccaaggaagtggtggttttggtgcttttggttcaggtggaggcagtaaaccacctgagctgttcacacagatgagaaagtag

SEQ ID NO: 67918 - DNA, 426 bp, Glycine max
  Peptide Sequence Number=SeqID_184696
atggcaagaaaaatatacatggaaggcatatataagcaagcttctgatagccgatattgggacctatggaacaggcaaaagttgaattcagaacttgagctaaagcgacagcatatattgagtctgaatcaggacttaacctatcagttaattgaattggagaggcatttcaatgcccttgaactaaataaattcagtcaatatggtggtcggtgcttaggtcatggaccttcccaaaatagatatggaccttcaagggtagtcacacatcttgcaactgaaacaaagatgtacagtgttgttcaactaatgccttacccttgcatatgcaaagaggctgtttccggattcgaacccatgaccaacaagtcaccaaggcacaactttaccgctgcaccagggctcgccctcaatttatttaaataa

SEQ ID NO: 67919 - DNA, 492 bp, Glycine max
  Peptide Sequence Number=SeqID_184697
atgaaggtatcagtcagtattgaaagccgaacggcgcggtgtggaggtgaagcagagaagggaggaaggtcacgaacggctagcgaggatggatgctgtgccgtgaaggtaagcgggggcggagatgcgcaatccatttcatctttacaaagatttgatgcacgttatgtaccacattatgtccttcaaagtaaacatcatcattggtcaccatttgacatcttagaggcaatttttgacaatgatgctttttttctcgtcaccttcaccattttctcctcttatctagctctgttctcaagctctccaacccaccaccaagatccgccgaaaaccactatcatcacaaaattcgccaaaacacattgcactactagatctgctccaatagtcacgcaagccaccactgtagttctatttccaaaacgaagaccactctttaaacccatgacgaatgatggtgacatcaatgaagatcctaaagaggcgtga

SEQ ID NO: 67920 - DNA, 285 bp, Glycine max
  Peptide Sequence Number=SeqID_184698
atggaagctttgagtttaaagtctcaaactgaggaaagaaagaatgtgaaggagctatttgaaacaataggaattccatatgaagcagcttttggctctccagacatgaaaggttttatgaagactcctcccagtaagaagaccttattttctgatttgactgctaataaagatcagtctaggagaaatcaagccagtgcaatgaagtgttttgaaccagaaacggctaggaggaggagagactcacttgaccagttttgctcatacaatatgccaaagaattga

SEQ ID NO: 67921 - DNA, 2103 bp, Glycine max
  Peptide Sequence Number=SeqID_184699
atgaagaatacagatcagcacattatgttgcttggttggtctgcagatgaagacaagagtgaagctgtagttattgatattgagcgagaaaattgtgctccaagaattgaacttcaagggtccctagcaaagtggtggacaagctggttagattacagagacgattcttggattaagtgggaaacggtgtgccgttctaaggaagaagggggactgggcatcaaagatatcagaaacttcaatcttgcgctgttgggaaaatggaaatggagcctattctaccacaatggagatttatgggcaaaggtgctagagtcaaaatatggaggttggaggagcttgaatgtagcatcttcggaccatactgattccatttggtggcgggacctaaaacaggccctccaccatcaacagcttgcaagcgcttttcagaatggattatcgtggagggttggctgcggtgataagataaaattctgggaggataattggattaatgatgacatatctttagtagcaaagtatccaagactatactccatttccaatcagcacaaccaggtcatacaacaactgggagctcacacagattccggcgaggttaccattgctgacagttttttaaatgatattgagggcaagacagtacacccatgtaaaagagatgagtgggtttggaaagcggagccaagtggcatttattcgacacaaagcgcgtataatctgctgcagggggaaatcacagaggctagcgatgatggagtttttgcagagctatggaaattaaagattccaaagaaaatttcagtatttgcttggagattaattcgtgatagattgccaacaaagaaatttgagaagacgacagtaaaattattcatatctggtgggagtccttatcttgggttgacaccgttgtggctctaccagaaaatcccagaaaatggtgatgacaatttgctcttggggctatgcattgataatgtttcaatctatcaaaaagttggggttcaaattgatgtggaggaaaggacagagctcttaccacattgtgttcttatatgccttacattagagggaaaactcgtcatgttccatgttgctagccttgcaggatgtaaaacttcacctgaggttgattctgttctgcacaatgatgaagatacttctgtaaaccttccagaggatgaaggttgcactcttcctcagcgattgcagaaacaggaatcagataaggttagtgggaatctgacagccaagccctctggtaatcctcaacaaataacacgtactgacaccaactacccagaagtggaattagtgggaaattcagagagtctaaagtctaatgtacagcaagttgttccagacgtagatgcattccaaaatacaggtaatcaaaatccatttcttccaggcgaacagcaaaaaaacttgggacaaaagaccgcaacacttggaactagcattggtcctttaatggtaaacagtcattctgtttcttctgggttgtcaagttataacaatttacaatcaactactaagactagggagctgtggactgcaaatagctcaagggattcacagagagcttctttgccgggtgaaacattttcattcccaaaaaagtatgatgtttcttcaatttcagcttcaagctatgctgatggtgttggttttcaaaataaaaaatataccatgggtgctacaaatgttcctgggagcatgggtggaaaacccgttcttgtacaggatgtgaatgacgtatctccagccattgattccgccagtaggcttgttcagagtgggggacaactatctaccttaggagctggtaatatgcaaccaatcttgaatagcagctcacatttttcatctgatggaaatactgcagctataaagtcatctgctcgaaagttccttccttctaatgagcagcatggtactccatccaagcttgggatattcagttctgatttatcaaagcagtttggcaataagaggctggtggctttagagatgcttgcacaaggtcactacgaagttcaattgaagcagtggagcaaggcatggatgctctgtctaaaaaatgcaaaatactga

SEQ ID NO: 67922 - DNA, 819 bp, Glycine max
  Peptide Sequence Number=SeqID_184700
atgagtccctcgaagaagatcgaacccgaagaggtcgaaggagaaatgatcagcacctccgattacttcttcgtgaaagttggcgaggcccttccgttgaagtcctccgactccgttttcgacgccgaaaccctcccctcgcagcctcttgcgctctcggaacgctttcgcctcactttcgttgctcattcttcaggttttttcgttgcaaagacaaaggaccttattgattccgcgaaggagcttaaggacaagggaagtggctctccggtggagcaactgagtctcgtcgatgttcctgttgggagggttcgcgcattggctctttccaccgataattcgacgcttgcggcttctgtctctggcgacattcggttttactcggttgagagctttctcaataaggaagtgaagcaatccttttcctgttcactcaacgattcaacctttgtcaaggacatgcgctggataacaacaccaaaacattgttatgttgttctgtcaaacattgggaaactatattatggagacattggttttccacttaaacatgtgatggacaatgttgatgctgttgattggggtttgaaaggttcatttgttgctgtggcgagtaagagtgttctaagcattctatcgactaagtttgaagaaagagtttcaatttcactatcctttagatcatggattggtgatttttcagcagatggtagcataaaagcagtcttggaccaaggtggaagatacgaagtgaatgatttccttgaatattcaagagatttggactctactccactctctaaccttgtatttggataa

SEQ ID NO: 67923 - DNA, 819 bp, Glycine max
  Peptide Sequence Number=SeqID_184701
atggggaagtctcctgattggttgtatatagatcatgcaacgtgtggctcccctgcatggattggtaaaggactcacctgtgtttgcttcaagcgtaagggaaactgtcaacgaatctgcattagtttgacccctttacaggaggaaagactgagaagactaaagcgccggatgaaagtttattttgatgcttccaagcttgaacaccagtgtttagccttcttttgcaagttactcatccagaaattctttcaaggacaggaagcgttgagagctctgtggtctgcttcgtttcctgatcaggagctccaaagcttgatttctgatcaatggaaagaaatgggatggcagggtagagatccatctactgatttcagaggagctggtttcatttcgttggagaacctactattctttgcgaagacattctccacttcttttcagcgcctattgaagaaacaaggaggaaaaggagctgtttgggagtatccctttgctgttgctggcgttaatatcacatttatgattatgcaaatgctggaccttgatgccaccaaacccaggacttttgtaagagctgtttttctgcagatgctttcagaaaatgaatgggcatttgacttgctctactgtgcggcattcgtggttatggacaaactgtggctggagagaaatgctacatacatggaatttaatgtgcttcttttaaagggattgagggatgtcttgaaatccacgcgagttcagctagagaaagagttgttgatggatgatgttctacggattgaagacatgccttcttacagtcttctttgttga

SEQ ID NO: 67924 - DNA, 990 bp, Glycine max
  Peptide Sequence Number=SeqID_184702
atggccaaaggtttaagcctagctaggatgcacacatggaataacttgagtttgggacagtcattttcgaacttagtcgctttcagcaaaggcaaagcagatggatacaaattgatggagttcatcaaacagaaaccaaccatagtggaagattcatctgaaggaaagtgcttagctgagatagcaagttttgattcttggatgagctacaatgctgatcattttgaaatgcccaagcagacactacaactaaaatggttaggctatcaaattggattggtgaatcaagaacctgcactctttgcaactactattcttgagaatatactctatggaaaacctgttgcaacaatggctgaagtggaagctgctacttctgctgcaaatgctcatagctttatcaccttgcttcctaatggctataacactcagtggattttgcacgacgaagacgaagtgccacctcttgctgttcagattcaagggaatgatgattccgtttatcagcgatcttcttctgttggggtcactctcatcaccggttatcttggtgcgggcaagtccactctagtgaatcatattttgaacacgcagtatgggaagaggattgctgtcattttgaatgagtttggtgaggaaaaaggcgtggaaagagcgatgatcaatgaagggggtaagggtgcactggttgaagaatgggttgagcttgccaatgggtgtatatgttgcactgtcaagcatagtttggttcaagcacttgagcagcttgttcagagaaaggaaaggcttgaccatatattgctggaaaccactggattggcaaatccggctcctttggcatctgttctatggttggatgaacagttggaatcagaagtgaggcttgattctattgtcacagtggtggatgctaaaaatttgcgcttccagcttgaagagcatcgtgggtcatcttcatttcctgaagcatattttcagataacatttgcg

SEQ ID NO: 67925 - DNA, 1485 bp, Glycine max
  Peptide Sequence Number=SeqID_184703
atggaggagacgaggaagtttgtgtgcaagtattgcagcaagaggttcccttgtggtaagtctctgggtggccacatcagaactcacatgatgagtagtgagcatcatcattcagctttagccaacaatgaagagaggaacaacaacaacaacaatgctgctaatgctatgttcaagtttgatggtgggagaaagaagaagagggatttggggtctgaagaaaatgggaacaacaacaattatggtctcagagagaaccccaagaagaccactaggtttgtgcactccaatgccactttgcaacttgacaagttctgcaaagaatgtgggaagggtttcccatcactgaaggctctttgtggccacatggcttgtcactctgaaaaggacaagggaggttttgctactgagaagcagaaattggttatggatagtcaatctgacaccgaaacttcttctgctcctaggaggtccaagagaatgaagtccaaaacccttagcagcagcaacaacaacaacaacaaccaacctcaatcttcttctgtgtcagaggttgagcaggagcaagaagagctggctaggtgcttgatgatgttgtctaaagattctagctacaagggtcgttttgctttgcttacagagtcttctgacaacaactcggttgtaattacaaagtcaccttctcttgaaaccaaggttactactatgatgaatgtttatggcaagaattctatggagaggaagctggagttggagcagcacaaggacttgaagtttaagtctgttgaagttggctatgattcagacaattcagattctgggtatttcagatatggtcctaagtcggatgaatcaaatgatgagtttttcaggaatgaggtaaagtcttcgaaagttgggtacttgaatggttttgatcaggagtatgatgttgttgaatcgaggaaggtgctgagcaggggaagaagcaggagcagtgaatttaagaaatttgttttggaggattgggagagttatgatagagaggatggtgatgtggctgcaaggaaatttggttcaaagaaattcaagaagtccaactacgatgatgattctcttggtcaaaacttaggtggggtttctactaggaagtatgagtgcttgactagtgaaaggtacaatggttgttctgatgattctgcttatgagagtgatgagaacagcacagacactgattcttatcctgctccaaaggctcatcatagcaacaggaacaacctcagtggcaataaggggaagaagaagttgaagtcaaagaaaagcaaggcacatgagtgtccaatttgcaacaagattttcaggtcaggccaagctttggggggtcacaaaagatcccattttattggaggttctgaggaaaacacacttgtgataaggccaagtgctcctcctgctgctgtgccttgcctcattgatctcaatctaccagcacctgttgatgaatag

SEQ ID NO: 67926 - DNA, 657 bp, Glycine max
  Peptide Sequence Number=SeqID_184704
atgctattaatctgcaatgtggtgacatcttctttatggttatgggagaactggaaaaacttttacgtggaagacattagtctttgcattgcgttcaaagggacatattgttttaacagttggatcaagtggcatagcatccttattgttgcctggggtagaactgcacattcttcaaagtttgcaatccctgttcctaccttgcaaaactcaacttgcaatgttcttcaaggtagtgaacttgctgagcttttgaaggtcacaaaacttataatttgggatgaggctccaatggctcataagttttgttttgaggcattagacaaaagccttagagacctcatgagttcctctaataatggagattcgccatatggtggaaaggttgttgtatttggtggtgactttaggcaaattcaccctgtcattccaagagatgatgacaaaaagctcaaaattcaagatcacttcatgataacaaagatgatgacattcaagaatgagttcaagattgagtcaagaacacttcaaggatcaagaggaaatttgatttcaagaatcaagattcaagattcaagaagaatcaagatcaagattcaagactcaaagattcaagaatcaagaatcaagagaagacttaatcaagataagtattaa

SEQ ID NO: 67927 - DNA, 357 bp, Glycine max
  Peptide Sequence Number=SeqID_184705
aagctcctggctgagaaaaccaagaagaagttggaggaagctgcacattcaggaagcgttgatggcgtcatcgaccctccatccccggtcagacgtcacgtgaagtggaagatggcccgcacgaagaaaataggggagatgacaactgaggctgcaaaggaaatcgctgagaagatcgcgacacagggatccttcgttccccatgggcgtcaggatgttctcaccactgttattgggcgtccaaagcaccctagacgtgtccgtgctgctggagctggtgtcaccatcaagaaatactttggatcggctccacagatgtcccgcagctcttcctccctgcctcttgaagaattgtag

SEQ ID NO: 67928 - DNA, 297 bp, Glycine max
  Peptide Sequence Number=SeqID_184706
atggtgacagccttgagaactgtgaagaacctagactccaagtccactgaagagctgattggaaccttaatggttcatgagtacgaacttcaacaagatgaaggattcaaaaagggaaaatccttggctctaacaacacaaaaagccaaaacatcttcaacatgcaaggaatcttcatccagacctgcgtctagaagatcatccaaagttttcaacattgatacaccttctgatgatgagtccaatgatgaaaaaggctcagataaagatgatcaattagctttcatctcaaggtag

SEQ ID NO: 67929 - DNA, 441 bp, Glycine max
  Peptide Sequence Number=SeqID_184707
atgacttacagaggtatgctctttgatccagcaaggaatttaaggaatcacctaggtgtaggtggtttaactgctaaagacagaatgctcgtgcacctcataacctacattctcacactaaggtctagtattcaaatgaattgggtacttctgattgaagacatcatgttgaagagttttcgattagtggattatgagttttcgtatgttgtgctagcctctagattcattgaatatttcaatattgatgtttctaatgagattgtagacttcaccaaagcatctagtgagataaccgaaaggcatcttaagaagcttgggatgaggtttgtagaacatgaacgaatcatggttggagagccaccaacagcggcaaagatggaccagatggaagaagcggaaggctcaacaagagcctgtgaactaatggagtccttttga

SEQ ID NO: 67930 - DNA, 417 bp, Glycine max
  Peptide Sequence Number=SeqID_184708
atggaagacaaagacagagcagcctccgatccagctgagttcgccggcgacacgagttggacactcgccaccgatgactccgacggtgcgtacctgttccccggcgaccgggagcggagcatactcagggaattcgggtggaacctcgaaccggaccagccaaaccggatcggcaccgacgacggatcgtggaggccggttcagtcctctctgaccggttcgatcgaaccggccgccgccatgtcgtctaggtcgaataaccaatcggtgtcgtccagctccagcgaggacccgccggagaaatccaccgtctccgacgagaaaccgcctgagatacccccacgggcacgccgctattgcggcggcaatggcttgcttctgagtcatccatggcttggcagagtgataataatttag

SEQ ID NO: 67931 - DNA, 819 bp, Glycine max
  Peptide Sequence Number=SeqID_184709
atgacccgttctcacaacgacaaactgatcgcgctgctgggtaaactgctggtgatcgccattctgacgtttgtcatgttgcccaccgtcgtggtgtttatctcgtcgttcagcagcacctccgtgctgttcttcccgccgaaaggctggtcgctgcgctggtttgagcgggcgctgagctacgacgattttcgtcacggcttctggtccggactgattgtcacagcatgggcgtcaacgctggcggtgatcatcggtgccacgctggcgattgccattgagcgctatcgctttccctgcaaacaggtgctggagagcattctgctgtcaccgctgtttattccgcatttcaccattggcctcggcctgctgatgctggtgtcgcagctcaacctgggacgcggctacgcgctggtgattttctgccacgtggtgctggtgctgccgttcgtgctgcgcagcgtctatgtatcgctgaaaaatctcgagcagcggatagaactggcggcggccagcctcggcgcatcgccgctgcgcgtggtatggaccattaccgtgccgctgattctgccgggcctgtttggtggctggctgttcgccgcgattctctcattcaatgaatttaccgcctcgctgtttattaccacccaggcgacgcagacgctgccggtggcgatgtacaactacgtgcgtgaatttgccgacccgacgctggcggcgctgtcggttatttatattgtggtgaccgccgcgatgttaattatcgccaataagtttttcgggctgggaaaaatattaaacgttgaggccgggcattaa

SEQ ID NO: 67932 - DNA, 318 bp, Glycine max
  Peptide Sequence Number=SeqID_184710
atgcaggaagcgcgtcatgcgcttcagcgccagcagcagcagaatggtcagcagcaggccagcaatgctcagcgctgcggcaaacgggaagttcatcgaggagaagcccagctgatacaccagcgtagccacggtactgacgcgcccgccgccaatcagttgtggcgtcgcgaaagcgctgaaggtccaggcaaacgcggtggtcaggctggcgatgatgccgggaatcgacagcggaatggtcaccgtcagcagcgcgcgtaccggcccggcaccaaggctggtggcggctttttcgtagtccggattgatgtgtga

SEQ ID NO: 67933 - DNA, 303 bp, Glycine max
  Peptide Sequence Number=SeqID_184711
atgcagccatgttgcaagatcgagaattcaatacttgagttgaccgatcctacagagcttgaatctcaatctgtgtctgttaccgctgatcatgaccgctcaatgcttgactcaagtgagcctacagagcttgaatctcaatctgtgtttgttaccggagatcatgaccctcttctcaggattccattgacaccaactaagcgcgtatcttttgatgagttggattatgagcgaaaaaactttcagatttcacctgccgaagtttcctccaacaaattagccaagcattctcaggctgaatga

SEQ ID NO: 67934 - DNA, 375 bp, Glycine max
  Peptide Sequence Number=SeqID_184712
atggttaaggaggagtgtaaggaggtaagtgtctcctccaagaggttagctaagaaggaaattcattttgcaataaagacaaacattaaagaaacttcccttcttagacaacctccacatcttctcctttgtaaaaggacacttcttagcactgtcacacctcttaaacttaaggttattcctcaagtaaaggagttgttggatgaggatttggttcgtaagagcttaaatccttgtgctttgttggtgcccaaaatatgtattatgaggcaccaaatccctaagataggtgcaccactcattgagttggtgaggaacatgttccctcatgggaagatgtccaggaaaggggtttcagaccttaccctactctaa

SEQ ID NO: 67935 - DNA, 264 bp, Glycine max
  Peptide Sequence Number=SeqID_184713
atggcgatccaagcggaggaaagtagagttgatcagaaggtggaaggagttaaacaacagttggctgatgaactggtgctcgaaccagttgatgatttagttgaacttgtagaaattgttgaggaagtagaagagaaggttgttgagattgaaaagaagaagggcaagagtgaggctaacatagaaaagatgaaagaggctactcctattgaatgcaaggaggtaccttatccattggcaccctcccgaaaagataaagagtga

SEQ ID NO: 67936 - DNA, 183 bp, Glycine max
  Peptide Sequence Number=SeqID_184714
atggttaaagcatgccgaaagggggtacgaaaagcaaacgaaataaaaataaaagcacgcgaaacaatgaaaggggaaaagagggaggtggttgccgcccagctcgccaaggcgagttgggttgcttccaccagaaggcaccaccttctgttagaacatcctgaaaggcccaagtgggcctga

SEQ ID NO: 67937 - DNA, 546 bp, Glycine max
  Peptide Sequence Number=SeqID_184715
atgcttacggatcaagtgatccataaacaacccagcaacttcccgacagcgttttccgccaacgtcggcaaaaaccaaaatgcgaacgacaaacttacctcgaagaagaagcagaaacgcgaagaagaagcagaaatgcgaagaagaagcccaaacgtgaagaaccacaccacaaacgcgaagatccacaccttcctcctaaacatggcaacaatggcggcgaagaagaagagaagaatgaagaagctacgcgggaggaagaagaaaactgaagaagcagaaaaagcaagaagcagaaccgttggaggaagaagaagaacgtgcgtgggagagagagaggcgagagagagagagcaattgctgggtgcaccagcaaaactgctgggtgcacctagcagcactcagatagctattgagctcgaacgggctaaggttagattcttgtgggccttgcgggaacctccgaaggcccaattggaagacccaagagattgggagttgctacgtgcacccagcattattgttggggcacccagcaaacagtga

SEQ ID NO: 67938 - DNA, 183 bp, Glycine max
  Peptide Sequence Number=SeqID_184716
atgagaaatggccaccctccattgtctcagggcactggcacacccacgcaaaaaaatcccgaacatgggtacttgaacatgaaaaaagggttctttgacgtccaaacattagaaatgtccgccctccattgtctcagggcactggcacacccacgcaaaaaaatcccgaacatgggtacttga

SEQ ID NO: 67939 - DNA, 249 bp, Glycine max
  Peptide Sequence Number=SeqID_184717
atgacttgtcgatttttagttgcagatgatgattctgacgatgatgattacatgatatctaattcatatgttgaggactcgttggatgaggaggaagatatcgacgatatatcagacacagatgaagaagtaacattaattggagtcatccggatgaagaagacatctgtggtttcaatatgggatcaaccttcaatattggccaagaattatttgttggcatggaatttgaaagcaaaaatgcagtaa

SEQ ID NO: 67940 - DNA, 492 bp, Glycine max
  Peptide Sequence Number=SeqID_184718
acacttgttagcattgccacacctcttaggcttgagtttattcctcaagtaaaggagttgttggatgagggtttggttcgcaagagcttaaatccttgtgcattgttcgtgcccaaaataggtattattaggcatcaaatccctaaaataggtggtatgatgaatgttttgagtggtgcaaccctcttttgtaaaatcactcgtgcacccaacatcttcatgatttgtgtacatagggactcattaggtagtgatcaaggggttcccatgaaccctaagagaataaaggtcattcctgagtggcccactccaccaacaccactcattgagttggatgttccttcatgggaagattctcaagaaatgtgttttcagaccttaccttacttcaacatacaaaacccagagtttgaaaaacctcaggatttgaggtcaaatccttttcaagggggagggaatgatgcaatcctaccccgcaagggcattggatag

SEQ ID NO: 67941 - DNA, 513 bp, Glycine max
  Peptide Sequence Number=SeqID_184719
atgaaggggaacggggcaagaatcatcctcgaaggacctgacaatgtcactctagagaaatcccccaagctcaacttcaaagcctcaaacaatcaggccgagtacgaagcactcattataggtctaaaactaacaagagaagtcacagctaagaagctacgatgctacacagactcgcatcttgtccaagggcaagttgccaacagataccaaacaaaggaaataatgttgctcaagtactatcaaatttccaaaactttcattgacaacttcgaatgctttgatatgttctacatacccagggagagcaacaccagagcagacttgctctccaagctggctaacaccaaaaagaccgagtacctccagcctatcattaaggagacactccaaactcccaccatagacactgaggaagttatggcaggagaagacgaggaaccagactacataaccccttacaagaatttcctaatccgagggatgttgccgtcaaatgagaatgaagcctga

SEQ ID NO: 67942 - DNA, 2250 bp, Glycine max
  Peptide Sequence Number=SeqID_184720
atgtcttcattcctttctgactttgccaatggcttgggtagtagcaactctgggggttcgattcatcaacccctgatggaccgaaaggtcatttccattgatggtttctccttgaaggacactcgccatggtgcttctgataatgagcactcccttggagaggttgagggtttcacgttgtactggtggatgcatttctcgcctgcacatgagggagaagtggtggtggggacgttaaggcatttccccgtgtgtgacgtagccataacattgggtcaccatcgtccctccctgttgttgctggctatgaatgagtgcctatttgaggtcttgggtctcattatccccttgaccgcattctacagtgctctgcttgagcacttgaacgtggccttttcccaaatccacccagtagttgggccatgcatgtccaagaagttgttcgagtttgactcgaacgtctttcggcgtttcaaggatcgttttctcaaggtcctggctactgatgttgtggttgatggatcttttgacccttgtggagagggtcaacaaggctatcttggagcaattgccgacctcgctagacgcacatgccattttttctcttcccttggtgagcgatcccctcactaccttgggcggccacttgtgaagcaaggcggacctgttggcgggactatgccaccatctgttagccctattgctggtgttgctaaggtctccctcgatgttccttcctcttttttggctaagaagaagcgaaatgacaacattggggagtccaggccccttttaagtcttcgtgcattgaggcaagctgcagggttcccacccggttcgggtcgcccttcaagtttgcaagatgtgcctcaggctccatcgaccgttgagggtcttgctcctattgttgagattgctttggctactgaagttgatgtgccaaccgctttagctggtcctatcgtggctccactatctgccatcactgcacccttgttgagtgtcgatgtggcgaccacaagtgctcccgagatgccgcctcctccttctttagttcctcgggttccttcctcggtcatgttggcatcgacatcaccttcctcctcctctcacccatatgtttccttggaccacatctacaccttcaacaatgttaattccctatggggtatgggtctagtaatccttgaagaaaatgggctaaagcaccaagaggcgctaagcaaagtggcgttcttggaggtggaggtcatcaaatggagggctactactcgcacagtttggagagtggagcgatctaaggtagctagtgccatcgttgcttttgctcaagctgtgaagtcaaaccacgaactgtcttccaaggctggcagtgttttggccaagttgtttcgcaccagggagagaaaaaaagacttggctagcaaggtgaagggcattgcagcagagaagaatgagcttgccaaagtggcggcggaccttgaggcccggctgaaggagtcggagtccaggctggagaagtccaagctgtggacggctagggagagggaggccagcaaagagcttgaagaggagttgctaatgtacaagaaggaagttgagttcttcgccaaggaccttgactttggtctttttgaccttttcaaggacatgaaggacagtgttctgattgatgagaaagatattgctgctaagaaggaggatgccaaggaacaggatgttttatcaaccagtccagtgataggtcacttgacctatggagcttctcctctgatggttgtgaggagagtgcgtaccaagggtggaccttgggtttttgtaccaaaggagaaccttggggtagaccttgtgtaccttgatatggagatggaacttagcaacagaagatgtgtttgccttggggaggaccttgggtttgacaagcctttggagaaaaaagactcatcaagggcggatcttggggcgaaccataggtttgacaagcctatgagactcactaagggcggaccttgggttttacgagcctttggagaaccgagactcaccaagggcaaactatgggttcgacgagtctgtgagactcgccaagggcgaaccttgggttttgtgagcctttggagaagcgaccaaggaatagtttgtcataggttttggagagacttaccaagggtggaccttgggtttgacgagcctttggagaaaagagactcaccaagggtggaccttgggtttgacaagctccggatgtag

SEQ ID NO: 67943 - DNA, 114 bp, Glycine max
  Peptide Sequence Number=SeqID_184721
atggacaagtatttttttggtatcgagagtggtatcctcgacaggtatgtgcggtgcatgtgcaatactcttgcatacatgtcactcgtggagcgggcacatactgagacgtaa

SEQ ID NO: 67944 - DNA, 1239 bp, Glycine max
  Peptide Sequence Number=SeqID_184722
atgacatgtctaataaccaaagcccattaccagctaatcatgctccgcccacaagcagttcaaaatccacgccatccttatctcaatcgtcgacgtcaccaccagaaccccagcccacccaccgctcaactcgccctcaccaccgtcccacttaccttgctgactacaagtgcaatgcgtgccctcgcattcccatccatggctcattacaatcaaaccaatcttttccaaagatatctcgttgtccaatatgttgttaattattcaagtatatctcgctctcgcactcgtttttttatgagtctgtctcctgagcaagaacccaccacttttcgcgaagccgcaaagcaccgtttttggcaagaggccatgaaatatgagattcaagctcttgttcgtaatcagacctgggacattgtccagatgccaccacatgtgagaccaattggttgtaagtgggtgtataagattaagcgtggtccggatgggtcaattgagcgctgcaaggcgtgtttggtggataaaggctattcccagatcgaagacattgactaccttgatatcttctctccgatagtcaagatgagcatgattcatgttgttttggtgatagcttccattcatcattggcacttgcagcaacttgatggtgtctctggctatcaaccatctcaatgttgcaaactgaaacggtcactctatggcttaaaacaagccagccgccaatggattgccaagctatccaatttgttgaagcattatagattcatgcaggctcacgttgatcacagccttttcacgaaggcggttagttggatgtttgatatacctaaccagtacccgtccggacatcgtttatgcaacccaacaactcagttaattcatgattgctcctactcaaactcattttcaagctgccttgagagttgttcgctatttgaaggctactcctgggaagggattattcttccgcagaaatacttctttccaactatctgccaaagcccactctacattgctgcaaatccagtgtttcataaatggactaaacacttggaaattgactaccatctagttcgagaaaagcttctttctggactaatgaacctcttttcggtttcctcttcccaccaactcgcaaatatgttcactaaagcactttccccaaaactgtttcagtcaaatctttccaagcttgagcttcatgatatctttgaacctccaacttgtgggggctaa

SEQ ID NO: 67945 - DNA, 546 bp, Glycine max
  Peptide Sequence Number=SeqID_184723
atggatttgggaacaatgatctcctctcagatcacccagatagaccatattccgaggggccaagaaggctcgagggcaagccacataggaggtccctccagcaccacaaccaattcctatgtctgcatccactcctccttcatcgctaccaccagctcaggagctttcgtaacccatgttgtagagcattcatcatggctagttcttgatcatgcaagcattgtagtagatcgacacaacactctacctacccattatgacgccaaaggaattcttctagggggtgagcctgctgctgctgctattgaggagcctactattgttgttgttactgaggatcccactaccgttgttgctgaggagtctcctgatgttgctgctactgaggaggagcctaccactgccgccactgctaatcccgatgagcctattcctgctgaggaccctactgctgatgatgtggagcctgaacttgatgaggactatatttttgatatctcagcggctcagactccagtttgggatccatcatctacacaggattag

SEQ ID NO: 67946 - DNA, 1803 bp, Glycine max
  Peptide Sequence Number=SeqID_184724
atggcacctttgaacaaagttcttttgctcctcaccttattgttccttgcggtggatgccaaatacaaaaacaagaaagacaagaagaacagtgtttttcataagattcccaaatttccaaaatttccagttcctatcattggaggtgaccagaaagttgttgtggatggtggtaataatgccattgccaagcccgattttgaaacaaacaacctagggcattgggagttgattaataagcagtcgggtgtatccgccatgcaaatcaatttgatgcccaataacaagatgcttgtatatgatgccaccgtttaccgtacctctagactcccatatccaaaagggatgccatgtgttcaatgggttgatgacaaccttaagcaaagcaaagaagattgttttgctcattcaatggaatacgatattgagactaatcaagttcgagcactcacggtaaagacagatccatggtgctcatgtggaggacttacacctgatggtaccctagttgttgctggtggttttgcagacggagggaaaacctccagatactatggcggtcaacctgattgccaagactgtgactggagggaataccccaataaattgcaagagcctagatggtatgctactcaagcaattcttgccaatggagagtatattgtgataggaggtcgtagatctttcagctatgagttctttccaaaggaagggcaacctagtgacaaacccatatttttcccattcctctatgaaacctcagacattgatgaaaacaatctttacccttttgtccacctttctagtgatggcaatctcttcatctttgccaacaaccgttccctcctcctcaaccctaccaccaacaaagtggtccgcacctaccccgtcctccccggtggttcccggaactacccggcttccggcatgtcttccatcctccctataaaactcgatggcactgagctaagtagtgcctccatcaaggtagaggtccttgtatgtggtggcaacagccatgatagtttcatcttagccgagactgaaaaaattttcaaaccagccatcaaagattgtagtagaatggtgatcacagaccctgaccctaaatgggacagtgaagagatgccttcagggagaaccatgggggattctcttgtcctccccaatggacaaatcttgttcatcaatggtgcacaaaagggtacagctgcatggtgggatgctgatgaacctaacttcacaccagtattgtatttctctgaaaaacctaagggtcaaaggtttaaggtgttgaaacctagccaaatagctagaatgtaccactcaacctcagcagtgcttcctagtggcaaaatttgggttggtggtagcaacacccatgatacttacaaggacaaggataggtttccaactgagactaggattgaggctttctctcctccttacttggacccaaaactagataaataccgaccccaaattgttgaggaatcttcagagaagaagctgatgtatggaaaaaactttgagacacaattcaaattgcaagacacgaaccagaaattgaccaagcaagacattaaggtctccatgtattttccacctttcaccactcatggctactctatgaaccaaaggttgttgtttcttaagactttcattgctcaaaactctgaagggacttacaaggttacgtccaaggcaccaactttccgagaggtggctcccccaggatattacttgctcttcattgtccatcgtggagttcctagcaagggaatgtgggtgcaaattgggtag

SEQ ID NO: 67947 - DNA, 231 bp, Glycine max
  Peptide Sequence Number=SeqID_184725
atgttgagttcaaaggtgtgggaagtaggggcaatgttgaagtgtggagaaactaggagaaggcagggtacctctcgccctcctataagaccacaggcatctccaggaaggcgagctgtcatggggatcataaatgttggagtagaactccttcaccaatgctacatcaatgttcttctcaggaagactggtgagcttcttgtgccatcgtcttctctccaactcctctag

SEQ ID NO: 67948 - DNA, 435 bp, Glycine max
  Peptide Sequence Number=SeqID_184726
atggaggttggagggatcttgagagaaggaagagatttctcgaaatgcttcctttttggtggaggggtttgtgtaaaacttgtggaggtagtagtgactcaaagtggtttgataagatggtggcatggaaggtggggagaggagaaaaaaaataaaattttggagtggtgtgtgggggtatggaggtggaatttagcttggcatagagagtggtttgtttcggaagaggaggttgtggataggcttttattggaattgaggggagtttccttacgaaggaatgagtcaaattcatggaagtgggtgctcaatcaaatcgggacatattcggttaaagctacttatgtggttctctgtgatcaccactttgcttccaccaaggatgatgttttggctcatacctggaatctaaaagtacctccaaagataaaataa

SEQ ID NO: 67949 - DNA, 753 bp, Glycine max
  Peptide Sequence Number=SeqID_184727
atgaaaggctacccggtgaccatccgcaccttggacatcggcgctgataaacaactcaatccggacgaagtggtcacggcgaccaatccggcattgggcttgcgcgctgtgcgctattgcctggctgaaccacatattttccatacccagttccgcgccctcttgcgcgcatcgcattatggccaggtcaaaatcctgatccccatgctgtccaacctggctgaactacgccaagccaggttattgctggaacgcgccaaagaatcgctacgcaaacaaagtatcccattcgacgaaaaaatccagatgggtggcatggtagaagtcccagccgcggccattaatgccgacgcgtttgcccaggagctagactttttatcgataggcactaacgacctgatccagtacacattggcgattgaccgcgcagatgatgccgtcgcacacttgtataaccccttgcatccggcggtactgcgcctgatccagctcaccatacaggcggcagagaaattccagaaaccggtctcagtttgcggcgagatggcgggtgacatcaagctgacccgcctgctggtcggcatgggtatgcgccagctgtccatgcatccctcccatatcctgagcgtgaaatcacagattttgcaaagtgaggaaagcgtattggccaaacaggccaaaaagatcctctcgttcagtgatctggaaaagattgaaccactgatcaaaaaatataacggcgagatgctctaa

SEQ ID NO: 67950 - DNA, 367 bp, Glycine max
  Peptide Sequence Number=SeqID_184728
tagagatggaaaaggaagtcatggataagaggcggtgtagttctatttggggtgatgatgatatgaatgagtggcttctccatctattggcggcgtggaaggagaatgggagagaagttgttattgttaatatatatgcaccatgtgataagggggcatgtgaaagagtaggggttggtggggaggacgtaggggttggcgagagtgaagaacttaatgattttttcatgagaaaaattgaaggcatgaagaaagagctaaagatatggaatgtagagcactttggaaacttggagagaagacaaactcaagttgaaaaagaattgaagttggaattaaaagaagaaggtgatcttgaagagaagga

SEQ ID NO: 67951 - DNA, 543 bp, Glycine max
  Peptide Sequence Number=SeqID_184729
atggtggaatctgaaagacttagctatatcagaaacaaccaaaagaagcttagagttgataagtattctagcttacaaacttcattggatactggaacagctaaaggcttaaccaagggaaaaagggtcatcttaccctcaacgtttgttgggagcccacgttatatggatcaactttactttgacggtatggcaatatgcaatcatgttggttttccaaatctttttattactctaacctgtaatccaaattggcctgaaattcgtagattactttcacctttgaatctcaaaccgacagacaggctagatattgtatcacgaattttcagattaaaatatgaacacatgctgtcagacttaacaaagggtcaattacttggaaaagtggttgcatatatgcatactatagagtttcaaaagcgaggactccctcacgtgcatttactactatttctacatccagacaataaatatccatcttcaactgacattgataagataatatcaactgaaataccttcccatgaagatgacccataa

SEQ ID NO: 67952 - DNA, 147 bp, Glycine max
  Peptide Sequence Number=SeqID_184730
atggccgaccagcaggcgaccaagtccaaagcaaagaagttccccgtgaagcggtccaggaagggcaccattgaagaggattccaatgtggccccacaatccgacacaggctttgacaaacaccgattccatagcgtggaacattaa

SEQ ID NO: 67953 - DNA, 240 bp, Glycine max
  Peptide Sequence Number=SeqID_184731
atggctccgaaaaagctttctgcgaagaaatctaggagggacaccgcagctgaagggaccagcgccgctcccaagtttgatagccaccgtttcaggagcaccgaacatcagcagcgttttgaggccatcaaaggatggtcgttccaccgagaaagacgcgttcagctcagggacaatgagtacaccgactttcaggaagagatagctcgccggcgctggacgtcgctggtcactctcatg

SEQ ID NO: 67954 - DNA, 350 bp, Glycine max
  Peptide Sequence Number=SeqID_184732
tcttggaagtcaacactcaggagcgcaggtcgcttgagcaaactgaccaatggcttgcacttgaaaatcctgatgagtcattagagacatctaacaacagatttacacgcgattctcctcaaatttcagccagcctgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccatttgaattatcaagtggtcttcgtcattggaagtgcggtagacagactttgtggttgatttag

SEQ ID NO: 67955 - DNA, 135 bp, Glycine max
  Peptide Sequence Number=SeqID_184733
atggctggtacattcttccttttgaaacagcaaaatagtttagagattatgagcgagtctttagacgaagatgatagtgttgacggtatatctgatacagacgatgaagtcaccgacatgattcaaccagtgtag

SEQ ID NO: 67956 - DNA, 718 bp, Glycine max
  Peptide Sequence Number=SeqID_184734
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacg

SEQ ID NO: 67957 - DNA, 555 bp, Glycine max
  Peptide Sequence Number=SeqID_184735
atgactaacgctgcgaccataaaagaggaagagcgtacagagattgaaacacatcaagaaagcatttgtcaagttacctcaatcaatcatcaattgaccaacaaagaggaaacacctgaagtctccagtactccagaatatccctacttggatactgttggctatgtaggagggaaagataaaggtaggttggaactcagcataaaggttgaaaagatcttttttgatctctttgaggccatgaaacacccagatatgggtgatgcctattttgaagaagaagaggtggagcaggaaataacattatcaaccgcaaccatggtactacaatctcccttggaaaaagaacctggctatgggagagattgcttagcttgtgatgaagagcttgatgattcaaaagacagttgtgttgatcaggtggtttttgaagaattggaaaaactaagaccagcagaaaagcccaaagcagaattaaagacccttccggcacatttaaaatatgtatttttggaagaagatgagaccaacctgttatcattagcaactctttga

SEQ ID NO: 67958 - DNA, 351 bp, Glycine max
  Peptide Sequence Number=SeqID_184736
atggggctcttggctgttttttgcacaaattccatcaatatacatgctggaataaatggccttgaagttgggcagacagtggttattgcatcagctatcctgatacacaatattatgcaaattggagcatcaacagatcctgaatataagcaagcacatgcattttctatttacttagctcagcccttgctagctacctctttggctttactttcttacaactggtatccctcttcagtttttgttggtgatacatatacatactttgctgggatgactatggctgtgattggtattttaggccattttaggcatagaatcatagatatactggggactctaaatttgtga

SEQ ID NO: 67959 - DNA, 762 bp, Glycine max
  Peptide Sequence Number=SeqID_184737
gtagccgcgacgctggttgttgtcacccacggtgacgctggcgcgtccaccgaattcggtggacgggtccatcgagaagtactggatggtgccgcccaggttgctcgtcgacgccacgcccagcgagccgatgccctgcgacaactctgcgccggccaggttctcggcgatgatcgcgcgggcaatgctcaggccgttgtagttgccgtagctgttgtcacccagcggaatgccgtccagcgtatagccgaggcggctcttgtcgaagccgcgcaggctgatggtctgcgattcttcgttggcaccgaaggcgtcgttggactgcaccgacacgcccggcaggcggtcgaggatcttctggccgctggtgcccggcggcagcacctgcttgtcgacggtggtgatgcgctgcacttggcgggtctcgccctggccgatcacggagacggtatccagcgtctgcgcgctcagcgcggcatcggtgctggcgccggtatcggcggcggtggcggcatgggcgctggcggcggcggagagcgcgatcgccacggcgatcgtcaggtgtcgggtctgcatggtggtccgttgcattgggggtggtcaccggcacgcgtgcgcggtgcatggccactatgcgaacggaacatgaaaccttctttacgaaaaaccaacgaacgatgcagggcagtggtgcgtgtcctgcaacatgttcgtcatggtggtaggccggtgggaatcagaagcgctccccaggccagctaa

SEQ ID NO: 67960 - DNA, 240 bp, Glycine max
  Peptide Sequence Number=SeqID_184738
atgggccggggcgacagcgccaccatcgatctggcgccattcgtggtcgctgggaggatcaaggggccctctggccagatctacaccgacgcgtcggggcgaatcatcaaaggcattacgctgcggctgagcggcgcctgcatctcgcgaaagcagatgggtcgtcgctaccccgacttcaatgtcctttccgtgcctcagggcatagcctggacgagtcgacggtgttcggcacagtag

SEQ ID NO: 67961 - DNA, 243 bp, Glycine max
  Peptide Sequence Number=SeqID_184739
atgggttttcaccctactaaactcaatttcgtgcctagcgatgcggatgaggcgccactcgatgtttccatttgcctgcatgcctttggtattgtggggtgtggttcgtttagtggtgtcaagtcttgcgaactgaacgtgggtggtctagtgcccccacattgttccttaaaatcggttgtctcggatgacgcttgccctggcgcttgctttgttcaacgcgatgctactactcttagttag

SEQ ID NO: 67962 - DNA, 682 bp, Glycine max
  Peptide Sequence Number=SeqID_184740
ggaaattgagaggaggaattggcataaggagctcactaacttctcagagggaagcattgatgttgctattgttaaagagttttatgctaacctctatgaccttgaagaccaatcgcctaagcaggtgagggtgcgagggcacctaattaaatttgatgttgacgccctcaacaccttcttgaagacaccaatggtcatagaggaaggggaaagcttgcccgcctactcctggtttgctaatctgaggcttgttcctcaagagcttgcatcccgtctatgtatctctgggaggggatttgagctaaatgcagatgggctgcctttgaagatcttgaggaagaacctgactactctcgcctacccagccattaatttggcttatattaaaaagaattgttggaacctgaatgacccttcggtcacttttcggggaacgcagaaatccagggctaggagatccgaggtcccaccatcttctgctcttgcccctgcttatgcttctacctcagctccctctgcatctacccccatctacttctacagctccagttcctccaattcttacacgttttcccgctcagagttcagaggcttccttaaggtggccaggccaggagtccatccttctcctttgggagggggtgaggcctccgtagctcaggagcctcagcaggatcagtag

SEQ ID NO: 67963 - DNA, 483 bp, Glycine max
  Peptide Sequence Number=SeqID_184741
atgaattatgtcatccgcaccctttttgctatccagagacaattgagtctgatggcacgtggagatgaattacggtcatccgcaccctttttgctatctagagacaatcaatctccccttcgtcaaccagaggcaagcgagcttgttgacacacaaagacaaatatggtcatctgctctattggtcgaggactcaatgtctatcgaccaagactactttagtctccttttaccatccagagacaaatttgatggcatgcgaagaaaaaatatggtcatccgccacgctcgtcaaccagaggcatgcgagctcgttgatacacagagacaacgttacagatccagcagcgagtcctgtgaaggtactaatatcgaggaccttgacgttgattttgagcgaatggaaaaccaagttgaggatgaagaagatgaagattcggggttttccccggagctagaaaggatggtcacacaagaagactga

SEQ ID NO: 67964 - DNA, 270 bp, Glycine max
  Peptide Sequence Number=SeqID_184742
atgctcaatggaatgccccggggctcctccatgataagcacacgttgtgttcgagtcgtatcctcagagaaatggaggttgaggaaatctagcaggggttatggctaccattgcagtattaagtggtgtttagcattggttgtgtggaaggtgggttttgtggttgatttagggatggcctttgtggataactgggtggtaggtaaggagaagggttgttattggctaagtaatgacattgttgggttggtgggaaacttggccgtatag

SEQ ID NO: 67965 - DNA, 375 bp, Glycine max
  Peptide Sequence Number=SeqID_184743
atgagtgaaatagaggaggtacaaaagcggatgaaggccgacataaagaccttgaaagagaaaatggccacaatgatggaggccatgatgagcatgaagaggatgatggaggtcaatgcggctgcagttgccgctaccagcgccgctgctgaggtggacccaactcccccatctagcctcaaccaaataaatcatccaacctcaaatatggtaggcaaagaattgggaagtacgggcggcccccattttatgcaagttcagaaccagcatgccttcccgtcatatggcttgcctcccaactatgcaccacccaatgtggcgcacgctcccgatgagaatgtcaataactccactcccatactcattgagagctaa

SEQ ID NO: 67966 - DNA, 237 bp, Glycine max
  Peptide Sequence Number=SeqID_184744
atgttgattgatgttggaaatgctttggcatgtgcacgttgtgtatgttcatggggggcgaagtgcactaaccttccagggtctttggcacttgctttgggccacgttcatacgttggatgttgtgtatgtttgtggggggcaaagtgcactgatcttccagggtctttggcacttgctttgggccacgttcatacgccgtatgttgtgtatgttcatagggggtggagtgcattga

SEQ ID NO: 67967 - DNA, 927 bp, Glycine max
  Peptide Sequence Number=SeqID_184745
aggactacaggtcgtcggcttcagaggactgcatatccccaccttcaggggactacacgtcctccccttcagaggaatacacgtcctcaccttcagaggattggaggtcctcaccttcagagggccacacgccctcgccttcagaggactacatgtcctcgccataaagggccacaagccctcacctttgtagggaaacacaccctcacctttagaggacttcatgtcctcgccttcatacggctgcacgccctcgccttcagaggactacacgtcctccccttcagaggactacgtgtccttaccttcagaggactacatgtccttaccttaagagggctacacgtcctcagcctcagaggactagacgtcctcaccttcagaggactacaggtcctcggcttcagagaactacacgtcctcacctttagaggactgcacgccctcgccttctgtgggctacacgccctagccttcagaggactccacgtcctccccttcagaggactgcatgtcctcgcctttagagaacgacacgtcctcaccttcgaagggctatatgtcgtgaccttcatagggccacatgccctcacctttagagaactagaggtcctcgcctttagaggactagacgtccttgccttgaggactaaaggcgctcaccttaagagggcgacacgtcctcaccttgggtactcatacccttaccttcagaggactacacgtcctcgccttcatagggctacacgccctcgccttcagaggacaacacgtcctcaccttgggtactcgtaccctaaccttcagaggactacacgtcgtcgccttcagagggctagatgccctcgcattcagaggacaacacgtcctcacctttggaggactacacctcctcgccttctaaggggtacacgccctcgcctttag

SEQ ID NO: 67968 - DNA, 387 bp, Glycine max
  Peptide Sequence Number=SeqID_184746
atgaaatttgttttgtataccagcgtgcttaatcaagagcattacgatgtcttggctgtgcctgagattgttagaacggcacgtgtggagaacagtatccacggcattactggggtgttgttatttgatggtttaaatttcacgcaatattttgaaggcgatgaagccactgtagatagattgctggctaatattctgcgcgacaaacggcacaaaaatattgttcttgtactaaccggacatcaggaaagccggttgtatcacgattggggaatgggctacattgatatcagcgacaatgccattgatatcgggagatgtattgcggctgcagatttttcagtggacgtgtttaaacaaaaaatcagccgcctggatgtcgagtaa

SEQ ID NO: 67969 - DNA, 369 bp, Glycine max
  Peptide Sequence Number=SeqID_184747
atgaagttgggaggggggaacattgaggattcagagcatgctcatggtgcaatcgtcaaaggatatctctacatgaagatcgtgaaaaatgcaatcatacgcatagaaataatccctcaaaggaaccaccttagcaacctcttcggcacgaagatgaaaatgactaaaatcgtcatcaacaaaggggtcccagtggaagctgatccagctcaaacccttatggattacctcactcctactttgagggaatctaataccatcacacttcctaatctacctaaggaagtcacatttgacttgaagcatggattcctacagatgttggagaacaacccattcaatggtgttgctcatgaaaatcctatgtag

SEQ ID NO: 67970 - DNA, 645 bp, Glycine max
  Peptide Sequence Number=SeqID_184748
atggctagaaccatcctcaatgataattcaacccctaagcacttctgggttgaaacaatgaatactgcatgttatcttcaaaacagaatttacataagacctatccttaaaaagacaccttatgaattgtggatgggacgaaaacccaacatatcatattttcacccatttggattaaaatgttttattcttaacacaaaggataacttgggaaaaattgatttgaaaagtgaaaatggaatatttcttggatactttgaaacatcaaatgcatttagagtgtataactcaagaaccttggtagttgaagaagctattcatataagattttacgaaaataattctatagcaactagcttgtccaaacagaatccagagacaaaagtgttcactcaacatgaagttcaagaagaggtaagagaacccattggaggcatcatgagaagaaatcatccagaaagtcaaattattggtgatccagcaaatcatgttcaaacaagatcgtcactcataacacaagggcatactgcactaatttctgaaatggaacctaaacacattgatggtgcaatgcaagatgacaactgggtaaagcaatgcaagaagagcttgatcattttcagaagaatgatgtttgaaatttag

SEQ ID NO: 67971 - DNA, 351 bp, Glycine max
  Peptide Sequence Number=SeqID_184749
atggagaacctcccctttgaccttccacacaccatctacatcaatataccgaggaacttgaagggcttaggtgttttgaatgacatctattatgttgctttcatcaacaagtttctatgggatcaaggagcgtactacgtcttcaacaagattgacgaagactctaagcacaccctaatagccaagggcttagttgttgctaaacatcaaaactttagaaagactaacctaaaagctatgaaggctaccttagaacaaagtttgatgaaggctaccttagaacaaagtttggtggacttggatgctatcaacagaaagaaagcagaagaggctagccaaagccattgctga

SEQ ID NO: 67972 - DNA, 168 bp, Glycine max
  Peptide Sequence Number=SeqID_184750
atggcggctcatagtggccaccggtggtcgtgggtggtgaaggaggagcgagctagtctcactaagcggaaatccacttttgtcgctaaacgcgactttttgcgcttagtgcaattcctctcggttggaattgcacttagtgcacttttcgagctaagcgagagataa

SEQ ID NO: 67973 - DNA, 492 bp, Glycine max
  Peptide Sequence Number=SeqID_184751
atggagtatctcgagggcacttcaaactctctacctgactatcttacccttgaattcttacaaacaaaaacaaatttatgttgcctaaggcatccgagaagtagcgggaaaggtttcaaattggctctactagagccatccccaaaacgggtttcaccctccaaaatcgggtcatcaacccaagctgggtcatctacccaaaaatcaaaacagcaagatgggtcatttacccaacttgttgaaattaaatctgagtcatccactcagggtccttcaaaaatccaaacctcaaaacaaaccaaggccgactatgcctttccaatcgaaacactttttgcccttcaagaaattggcctaaccaaacttcctaagaaaacatggagctcttttagagcaccaaatttcgcgctcttctcttcctctcccatcattcatctccttcttcctccaatctctaatccatggcctcctatggtggtgagcttcttctag

SEQ ID NO: 67974 - DNA, 459 bp, Glycine max
  Peptide Sequence Number=SeqID_184752
atggcttctccccctgcctcgcctcctcctcctcctccttctccctctcctcctcccactcctccttctcctcctccttccgactcatcggcttcgtcgtctatcgcgaagaagacacgcaaagactcacgtctacgatccttgtctactagaccacctggtgctgagagaccagtggtccacgttcatcctgctatcggcaaggccgacggtccccacaggaagaaattaagaacatatttgggaatgatggcgcgtgataaggtggatgacacgtacgagaactggaaggaggcggaatttgaaatcccagaggcttctgacagtaagacgaaaaagaagttacttcagactatcgatgagagattgatgcagtttaaatcagacctcacgagaaaaggggcccttgtagccaatcaagacagtgtggacgacactgtctgtgagaatacggcataa

SEQ ID NO: 67975 - DNA, 240 bp, Glycine max
  Peptide Sequence Number=SeqID_184753
atgtcgcgggggtcaggagaccttggggacgtcaggtggggtgctattgcccaaaaccaagcttggtcaatcccgacccaactcgggcatattcagccatgtgatagggcactggtaatcgattaccagttgtgtgtaatcgattacatagtgttacctgctactggtaatcgattaccatttatgtgtaatcgattacacagtgtaacttttagattccaatgtgcaaaggttgtgtaa

SEQ ID NO: 67976 - DNA, 276 bp, Glycine max
  Peptide Sequence Number=SeqID_184754
atgcgtaggtccaaccgcgttgcgcccgagcgccagtcagggaatcttgaactgactagaagatcagcaacgagggcattgtggaggtctagcgggaacataaacccgaactcagcctcgacacgtgcaaactccgcatcggagagagcatgctacacgtgtatgcctaagtcgcaaaggtggtttatgaccttgtttgctaaggaagcaaatgagatgatgttgttatggaattggatggatagggctgcagctgctgctcaggttgataaatag

SEQ ID NO: 67977 - DNA, 201 bp, Glycine max
  Peptide Sequence Number=SeqID_184755
atgtgggatgctaccttgtttggcatgtttaatgaagacttccccttgtacataaagcatgaagatccgtctgaaatagcacatggtggtcaatgtctcaacatctctgttatacagttgtggattatgcatatgactgagacaagtatgcgagcggggaatgccaatgtgtatggattcctcgagccacagtctatctag

SEQ ID NO: 67978 - DNA, 343 bp, Glycine max
  Peptide Sequence Number=SeqID_184756
atgttcatgactagtatatgtctctctcttgccaatacaatattttcattcagttttgagacttggatggtcactcaacatgaaaagcaagggcacaggcttgattcacttaatgacacatattggttaatgactttctttgagtctgcatgttttattgccagccagatgtttgcaaattggctgattggtaataatacagaaaaaattactgctccttcgtctgcagttatcttctttgctgccatatgcttcacttttatcaccagaggatggacagaaaatccaggatcagcatctcttaaggagtatagtcgctccctctatgcatacattttaggtg

SEQ ID NO: 67979 - DNA, 945 bp, Glycine max
  Peptide Sequence Number=SeqID_184757
atgtcctaccagttcaagaccgagcattatgacatggtgctcaaggcgggggacatggaacgcatcatgccggccatggcttggcatctcgaagaaccccgggtcggccaaagctatcccaattattacgcggccaagctggccagcaagttcaacaaggtcgtgctggctggcacagggggtgatgagattttcggcggctatccgtggcgttattaccgcgcagtggtcaacgatgatttcgagcattacatcgacaaatactacgcctattggcagcgcctgattccgaacacgcagattcgcgaagtgtttgccccggtctggggggatgtcaagcaggtctggacgcgggatattttccgtgacgtgtttgcctcgcatgccagtacgctgacccgaccggaagactacgtcaaccactcgctgtatatggaggccaagactttcctgcacggtctgctggtggtcgaggacaagctctccatggcgcacggcctggaatcgcgcgtgccgttccttgataacgacctggtcgactttgccatgaagttgccgacccgcctgaagctgggacatcttgaagatgtggtgcagctcaacgaaaacgagccgggcagcaaaaccgcgcgctactttcagaaaacgcgcgatggcaaactgttactgcgcaaaatgatggcccggcacgtgccacaggatatcgtcgaacgcgagaagcagggtttttcagcgccggacgccagctggttcaagggcgagagcatggactatgtgcgtcgacagctcttttccagcaatgcgcgtatttatgattttctcgatcgtggcacggtgcagaagctggtggatcagcatttgaacggtgagcaaaatcgccgtttgttgatctggtcgttgttgaacgtcaagagtttctgtcaagcttatctgggcaaatattaa

SEQ ID NO: 67980 - DNA, 520 bp, Glycine max
  Peptide Sequence Number=SeqID_184758
atgagcatcagagtcaaagaagatcttcttttaaataacttcaacctaaacggaccacgaagcacacagcaacttcccgagaggaaaacccctattgcccacggtggggtcctcatgtcctcgtccttcttgtacggaagtgacactgaccgaaagggtcttattgtctttttgagggcaaagagaaacgatgagagtggattgcttccgtatgtgatcgctgtcaagcactattttgtggctgcatgctgttctcatggtgtctctgttgtggcgaagattcgtcgcggcggccacggaggtttgagtgttgagctagagaaacctagtaaggagcacaaacatgacttgttgtccatgtttgatgatgtccaaggaaaagggtggtgccctgatcccagcagttctgattgtcccattgagataattcccagccaaaacaagaatcctgcaaatgctaatcctggccaccaaaaccctaccgttgccattggcaatggtggatactttgaaggcaatg

SEQ ID NO: 67981 - DNA, 990 bp, Glycine max
  Peptide Sequence Number=SeqID_184759
atggaaagtccattcaaggactacagtaattctctctttgaaagcagatccaatgctaaaaagaagggaaataacgccctatcttttgtatataaattactaatgaactcattatatggtagatttggcatcaatcctcaaagcacaaaaaccgagatgtgcaataaatctaaacgtgaccgtatatttagacgccctgagtttatagacgatgtctttattagagaggatctatacatggtatcttatctaaccaatccgggtaaggggccttcttattgggaccccccgaagaactccgcggtacaactagccgcagcgatcactgccggctcaaggatctatatgtacaagtatatttcaagagaagactgcttatatacagacaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccgaagtctgataaagaaggtaacttatcaatttcgacccgattggaaagaactctcggttaaaaagaaagagagtacaaccactcttagaactctcagtaactccaagagatacctttctttaatgaaaaaggtaaatataaagttgaaaaggaaaacagctattttagaaaaagagaattcggctctttctcagaaattacagaagctggaacaggaaagaggtataatagcccagcggagagtagaagaaggaaataataccgaagataataatacattagagcaaaataatgctaaaagggctgaagataatatcaatggagatctattggatccagatacgatgccgcgggataaaaagcccccctga

SEQ ID NO: 67982 - DNA, 195 bp, Glycine max
  Peptide Sequence Number=SeqID_184760
atgtttcgattggcttcatccggtgattcttttcgggatactgcgaccggtcggctatatttttctttgcctcttttatcagcgcaggccaatgtcgaccgaaacacaacggcggttgagttcccgcgaaaaaccacaggcaagctcgatggtaaacctattattgagcgaaatcaacaaggaaaatttgcttga

SEQ ID NO: 67983 - DNA, 210 bp, Glycine max
  Peptide Sequence Number=SeqID_184761
atgcgtctaccggggaaggagagtctgctgatgaaatctcccataaccataaatgagattttggatgttagcatttcgtttctaaatgatcatttagaggaaacactgggttcgacaaaaatagaagaaatccactcaaagtgtatcaatctcgcacagatattgtccggtccaaagacctctttgcatattccttctgtttttccttag

SEQ ID NO: 67984 - DNA, 558 bp, Glycine max
  Peptide Sequence Number=SeqID_184762
atggctttattctttgaagtgctgagactgagatttgttcttaatgctgaaggagcgccctggatgctcctgaggaaggacttgactaccttggcccaaacatggagtgtgctctcatactccaacctcgcccccacctctcacacgtccgatcttaatatggacagggcgaggttagtctatgggctggttatgaagatggacatggacgtgggcttcctcatctcgcatcagatttctcagatggcccagtccaactccttgcggcttggcttcccagccttgatttctacactttgcgtgggccgaggagtagtctcagattctctgaccttcaagtccctcgaccctgctattaatttggcatacataaagaagaactgctggaacttggacgatcccacgatcgtatttctagggacccgcaaggcacgggctcgaggatctgagggtctatcttcctctgctacccctgctcctgcttcctctgcacctactccttctccaactccagctccttctactttagcaccaccacttccatcagctccagtttag

SEQ ID NO: 67985 - DNA, 333 bp, Glycine max
  Peptide Sequence Number=SeqID_184763
atggtgcagcttatctgcgttaggttatggagaatcatagactatcaactacatgatctggtatacacaaggatttcttttatagtactgcaaaatggagaagtgtttggtgttcaggatcagaaaaacgctaaaagtaaaatcatatgtgaaaaacactcatatgcaagggtaaagttgtgccttggtgacttgttggtcatgggttcgaatccggaaacagcctctttgcatatgcaagggtgctacaattctgtcaaactcagtttgaattatatcacactattgaccccactttatgatacctttcgagaaaggttcttcataccataa

SEQ ID NO: 67986 - DNA, 288 bp, Glycine max
  Peptide Sequence Number=SeqID_184764
atgagatatgatgcatttggtagaaggggtctttcacttttacagaagtgcactacaacaattcgtatattggcatacggttcccctttcgatagtgtggatgagtatgtcagaattggtgaaagcactgtagttgaatgcttaaaagattttgtaaagggtgtgaatgaggcatttggagatgagtatctaagaaggcttaacaacaacgacatcaatcgcctactacaaattggagagacacatgagtttctaggtatggtgggttctattgattacatgcattga

SEQ ID NO: 67987 - DNA, 282 bp, Glycine max
  Peptide Sequence Number=SeqID_184765
atgggacatcctgtcatggctcctcctatgccgatgtctgctcatcttgggctggtgcaagctcgccatgaggccaagaatcccaggtgctctatgctgcggtcatatcaactgcataatctacatcagcaacgccatcctcctcctcaaagacctccaaaactgcctctggagtggcctcatgaggtacctccagttgtaactgaggctcctaggctgcgaaagcctcacctccccccaaaggagaaggctggactcctggccaggccacttgagaagtga

SEQ ID NO: 67988 - DNA, 369 bp, Glycine max
  Peptide Sequence Number=SeqID_184766
atggggaaaacggcttactatggcttaaaggaattacattgtggtgaagttcttttctctcctggatatgggatttcgctggttgtggaaattacgtctggttgcttcatctctgcagacactgttgtttctcaagtgagggatgaagatacttctggccttacaggtgatgcgaaaagagacttgatgcctccagaggatgttggtgtggggattgttaatgctttactagggaagatagctcaaagtggagtggtagattcatcacatcagggtttattatttcttctttgtgctctatgccctcaagatgtttccaaggtctgtgtaggaaaactttcccagcatggagtcgaaactcaaacataa

SEQ ID NO: 67989 - DNA, 276 bp, Glycine max
  Peptide Sequence Number=SeqID_184767
atgcagagaagcaagtactcgagtgctttagatgcatgggtgaaaaaagttgttgagtgtaaggtaggcttaacagaggaaccaacactcacatctaacccatattcctccctaactgaatcccacaacttcctagtgcatattgcatcgtatccacctttcccattcaccaccaaaaacttatacaaatccaagtgttgcctatcacccagtaatggagaaaaaggcaaaaagcaattaaccgcagaattctcacctcaacatggaatttcttaa

SEQ ID NO: 67990 - DNA, 207 bp, Glycine max
  Peptide Sequence Number=SeqID_184768
atggtaggttcatcgagttttgatgtaaattattcattacaagaagcagaaatggaagagaaggaagaggagagttatatgcattcatctttgattgatggtgatgaagacagttgtgtggaatcagctatggcaaaagttgttttgttcaaggatgtatggaggagaagatcctctaacgatgatggggcattgactttaaaataa

SEQ ID NO: 67991 - DNA, 210 bp, Glycine max
  Peptide Sequence Number=SeqID_184769
atgaacgaaaacgcaattcatgggtctccgaaacagggtagagaatggagaattgcactaagccatcactacgcatggctccaaacttgtgggtggaggatgcatgaacgaaaatgcaattcatggggctccgaaaaaaggttgagaatggagaattgcactaagcaatcactacgcctgactccaaactcgtgggtggaggacgcatga

SEQ ID NO: 67992 - DNA, 105 bp, Glycine max
  Peptide Sequence Number=SeqID_184770
atggccaacccttgggggctcactgcaataagggatgcatcatatgcatgtgacagtgtttgcagtactcagcagaaaggcagcatcttcaactcaatgcagtaa

SEQ ID NO: 67993 - DNA, 1158 bp, Glycine max
  Peptide Sequence Number=SeqID_184771
atgttgccatgcgactactgcgactccaaacccgccttactcttctgccgagctgattccgctaaactctgtttagtttgcgaccagcacgtgcacgccgccaacgccctctccctcaagcacgtgcgcttccagatttgcgactcctgcaagtccgacaccgccgtcctccgctgctccacccacaacctcgtcctctgtcacaactgcgacgtggacgcccacggtgccgacgcttcatccctccaccaccaccaccaccaccaccgccgccttcacggcctctccggctgtccctccgtcccggagatcgcctccgcgctgggccttgatttccgggcccaggagcccgtggtccccaccgccgcctcccgcgatgaggtctatgagcaggtgctggaaattgcgcgccagaggaacaacggcctcggcgccgaacaactcaagttcgacgactcacccggaaacgacgtcgttgttgttgttgacgagatgctgattcagcagacgccgttcacctccttgcttatgttgcagaattctgaatctgagtttgacgctagaaaaagtaacgataacaacggttacggaaccgaggcatgggatcttcactggaattataataaccccgcgtatcagcctcctcaggtgtgggattttcaattacaaaaatcaacagattgcaatgaaccaagagttgtaacatttgatggtctagaagttccaaaattgtttcaggatgtgcacaacatgaattactcaacaattggtgatgatattgatattctatcaagaaataatcaatcggatcagtcatcatcaagccatgcaaagaggaaagaagagagcaacaaaaaagctagaggtgggttatcatcagagtccacattgtttgaatccataccgtatagtggcaccaacaatgtcgttgtcatggagcatcttgtgggtgggaatgagaatgttagcaccttaaaagccagggttagtttgcaagagttggctaagaatagaggggatgccatgttacgctataaggagaagaagaaaacgcgaaggtacgacaagcacattcgctatgaatcaaggaaggccagggctgatactagaaaaagggtgagagggagatttgtgaaggcaagtgatgttcaagcatga

SEQ ID NO: 67994 - DNA, 423 bp, Glycine max
  Peptide Sequence Number=SeqID_184772
atggcagagagatcagctaccaagtatatgaacaggaccatgatggagatcaccgagattagagatccatacttagccagcaacctctgtggacaagaaaagtttgatattaagttcaagtatacaggaaatatacccattcaaacttcttctcgggaggtctatcagaaagaacatccaaaggcaatatgggagttgaatatgcctcctaatagggaaaaaaactactacaataagaaacaagttgctcaccaaaaatcagtgttgctaaatggcagagccatggctgctacggcagaatggcatggcagatttttcgccaactgccataagcaatttgtgaaagaaagcccgcaatggcatgtttacatggtggaattttggcattccgccattgataacattgccagaaataaaaaatag

SEQ ID NO: 67995 - DNA, 375 bp, Glycine max
  Peptide Sequence Number=SeqID_184773
atggcggatccaatcgcgaaggctctgatcgcgtttgcgctcttagcttcccttttgctgtgcttgcaagcttcctccgatgtccccttcatcgtcgctcacaaaaaggcctccctcaacagactcaagtccggcgccgaaagggtctccgtcaccatcgacatctacaaccaaggaacctcgacggcctatgatgtaagcttatcagacgatagctggccaagtgatgcttttgatgtaatcagtggtagcacatcaaagtcatgggaaaggcttgatgcgttacctcctgtttctgctctgctgcattttagttcatctctttttacaaacaagtgctattttcagtggtggcatcatttctcacacatttga

SEQ ID NO: 67996 - DNA, 3105 bp, Glycine max
  Peptide Sequence Number=SeqID_184774
atggcttgggtgtttgagttgcggagtcgttccctctgcacgtcctcctcctcgaaatggagggtgaagcaggtgacaacctccaacttccaagagtccctgcaagagataaagacgcacatctccaactccgactttgtcgccatttccatgggaaaaacgggctctccctccgcgccgtcgtggctccgccctctacccttcgacaccgcccagactgcctactccaaggcccgccgcgccgcccagagattccagctcctccacttcgccgtctgccccttctccgtctcccgctccgacaaactcctcgctcacccgtataatttcatgttgtttccaagagatgaaatgaagatggggatgcccacttacagcttttcgtgccagacttcgctacttgcctccatggctcgccaggggtttgatttcaatgcttgcgtctacaatggtcatggcttcaaatcctctcatggggctaagattgagtacatttaccctctctgtaccttctttggtgttggcatatcatatctatccagagcacaagagtcagcagctagaattcgtcttgggactgctctcccttctcttcgtgtgatgaaatcttcttcaccctctactgttgctgatacagtgtttgttgagaggattagatcaaaggttaaatattggagagagtcatgtaaaagctccgacacaaacaaaagcagagatgaagaacttgtcaactcccttaggaatattgtcctgggcaatgaacagttcagatcaagaccttgcatgactgtagatgtttgcagtgaacgtcaagtgcaacttattctggagatggtgttagactactcagatgatcttcttcctttgccaatccctactaagagtgggaccattcatgcagtacgaattgttttggcaaattctaaagaagataaggatttattggagagagagcttcgaaatcttgaagaggaggaaagcaagaaaattcgtggattccgagaggtgatcgatttgatttctgcttcacagaaacctgttatctcccacaattgccttaatgattgtacactaattcattcaaaattcattgctccacttccgcctgagatagatgaatttgtgagctccttgtgctcggttttccctgaggtgcttgacataaattatttgatgaagaaacatggaaccatgagaaaagtgaccaacattccgagtgctatatcctacttgaataatcatttttttgcaccagttgatttggaaattcctgaccaagctacagtaaaagaaggcaagattcacggacttactgcattaaggctatcctatttatttatgaagctttgctctatattgaaaatttccccaaatgttactgaatctggcaacaagcatttggcccccgagcttgaagacttcaccaatgtattccatccattctcaacccctatccaagattcatttaatggtggggatgtcggcatgtggaccaataatacaaaaaaagtcagttgtgagcatttggttttcttatggggattcaaaattggtatcacagctggcatgctgaagagtttacttcgttcttcccatgatatcttttcacgagagtttgatgttaaattggtggacaagagttgtgccattgttgttttctggcaatctggggtatcaaaaagatttctagacatattgaatagtgaagaaataagaggagacttaaaggagttagtgtcagatggcatgaggagctccagcacgatggcttccctctctacattgctcccgaacccgaaccttatttccaagcacaacagcaccctttcttccactcacccatgtgcttattcctggaaaaacaaaaccccaaccagtaagggtcggttctccgtttcttgttcttcttcgtctcaagcatacgacgtcgtcgtagttggcgctggcgtcattggcttaaccatcgctcgccacttcctcgtttcttccgacctttctgtcgccgtagtcgataaggctgtcccttgttccggtgccactggcgcagggacatctgtggatggtaaacaaaacccctgggagtgctacgtgggatcttgcgtcaaggagtcatcaactttggaagacgctggtacagagcatagaagagcaaggactgatgctgagtcagacgtgctaaaagggagggtgaaactactatgtgaggctgggttgaaagcagagtacctgtgtagcagtgatttgattaaagaggaacctgatctactggtggacaaagacagtgcagctgcatttctaccagatgactgccaaatagatgcttatcgcactgttgcatatattgaaaaggttctgtattcttggagttttgcatcaaaaggaagatatacagaattttatgatgacccagtgaaatgtttcatcaggtcagatagcaatggagaggtcaaagctgttcagacttccaagaacacaatatacagcaagaaagcagttatagttgcagctggttgttggactggttctttgatgcaggacttgtttagaaattggggaatggatttacatgttccagtaatgcccagaaagggtcacctacttgtggttcaaaatttcaatttccttcaaatgaatcatggcttgatggaggcagattatctcaaccatccaacaatttctggttcagaatcccctgatcatcaaaagaacttatctgtttcaatggtagcaagtatagatgcagcaggaaatcttcttcttgggagtagccgtgaatttgttggtttcaacaccaatttggacgagtctgttgtcagttacatatggaagcgagttggagaattctttcccaaattgaaaacacttccactttcagatctaagtgcaagtagaaaagtcagaataggattacgaccttacatgcctaatgggaagccagtgattgggcctgtgcctggcttgtcaaatgtgtaccttgcagctggacatgaagggagtggacttttaatggctttggggactgctgaaatgatcgttgagatggtgttgggatatccagcaaaagttgatagcacacctttcgctgtgcagaaagttcttgtttaa

SEQ ID NO: 67997 - DNA, 135 bp, Glycine max
  Peptide Sequence Number=SeqID_184775
atgacagaaactgcagtgtccttggctgataaagtagctgaagcagaagaagatgatgggaagcgtgatagaataaacaaaatgggtgatgcggctgagagaagcagcttttcgcatggaagatgtcatcgatga

SEQ ID NO: 67998 - DNA, 625 bp, Glycine max
  Peptide Sequence Number=SeqID_184776
tgtcccagggcctaggttcggggagggcaacgaccataccttcgaggtcgtggtcgaggagaacttggcatccgagcctggagtgtttgttgaggacccttgctcgggaattgcgaacgaggacgtactcctcgtcgtaggagcgagggggcgtcgatctcctccaggcggtgggactccgggtcgaccaggcccgtgtttatcagcgccttcagcagggtctgaccggccaggcccaccacctcgtgcttcttacccgcgaagtcgatcgccgacagccgcacgatgcggtccgcgaccttcttcgtggaggaggaagaggtggaggtgcgggagatcagggatttggagaagaacgagacggaggggaggcggtgcacttgcgaggacagtctctgcagattcgccactgccattggtgattgttgttcggccaaggaagcccgtccagagtgctcttttggttcggaaatcggaacaaagggaaatgaatttgggttgggcccgatcgttttcagatgggctcaatgcagagtatgggggcaaaactttttgcactcccactattgcttcttacatttctcattgtatttcgaaaatcttccggaaaggcaacaggaagtga

SEQ ID NO: 67999 - DNA, 528 bp, Glycine max
  Peptide Sequence Number=SeqID_184777
atggaatcaagaaaaagagctataacagaagacatcccttcgtcatccactccagctcctccgtcagtaactgtaggacaggatgtgcaaagttcaccaactttagttcctatgctacaaagcttattccgaggacagttcattatcatgcacagcctgcaagagttggctcacaataggccaatcatatctatggagcattttcttgagcaagtagcctggcctgaagctcaacttccattggtgagacccaacgaggctgcttcgcttgagcccacacctgtgcaggtcaatttagagccagctaacccacaatctccagtggtgaatccaccttcttcgcctgagcttgaagcagttccaccatctcctcctctgattgtcatttttgacacatcatcatatgctcctcctgattcaccagttgtagaaacagctgacccccctgtttccccaattggaggaattgctgatctttttgattcgttatctggagaaactgttgctctcactgattccccaatttaa

SEQ ID NO: 68000 - DNA, 726 bp, Glycine max
  Peptide Sequence Number=SeqID_184778
atggcaatagtagaagctgttaagtccacaaaagtaaaacataggggggccactacgggacacactagtgacccttatgttttctatgattggaccgtgtcctacacctcagcctccccacttggagttaaacagaaggtaattgggatcaatggacaatttccaggaccaactctgaatgtcaccacaaactggaatgtagttgtcaatgtcaagaataatcttgatgaaccattacttctaacatggaatggtatacaacataggaaaaactcttggcaggatggagtttcaggaactaattgtccaattccagcaggttggaattggacatatgagtttcaagttaaagatcagatagggagttttttctacttcccttccctaaatttccagagggctgcaggaggatatggaggaatcatcataaataaccgaccagttattcctgttccttttggattaccagatggagatattaccatatttttgagtgattggtacaccaggagtcataaggaactcaggaaagatgttgaagatgggattgaccttggagtccctgatggtgtgcttattaatggactaggtccttatcgctacgatgaaaatcttgtcccaaacggcatttcttaccgaataataaatgtggaaccagaaactctagataattatgaaagcccgaatttgggtccaactcgacaattcaaaattcaaactccttga

SEQ ID NO: 68001 - DNA, 423 bp, Glycine max
  Peptide Sequence Number=SeqID_184779
atgcaacacgacggtgaggcgcgcaacgagggtgatgatgaggcgagtcgaggatacagcacgtcggtgaccggatgtgactcgaggtgcgccactgtgaccgaggggtctaagaagaggccgaagctgaagtcgctggtgatcataacacgggagagcacaaacacgccccatgcccaaatcctcaaagttggtattgactgcaacatctttgaaattgttgccaactacacaccagtgctagtgcaagatctgtatcctcaacaacaacgaaatgatcacaaatgtgagcctatagaagctatcatcgatgagtgttgtggtcacacttcacggaaggttcgagatactatccctgatagagtcgttccttccttcgtcgacgccattaggggtgaggagtctccacatataaagtcatga

SEQ ID NO: 68002 - DNA, 494 bp, Glycine max
  Peptide Sequence Number=SeqID_184780
atggtggaaccttacagaaggcccaaatcctttactccattggtcactatttacatggctgctttctactctggagtcattggtgctgccatcactgagcaactctacaaggaaaagtactgggaagagcaccctgggaaagcagtgcctctcatgagaccaaagttttatgggggtccttggagggtcatgggcgggactagggttgttgacattgtcagctatgcttccattatctctgacaaatgggttgcaattgcaaccgatcaattcgatcaacagcatccaaaggagaacaaagatagaaaagctctttctttatttggtgttgccatgatcattgcattgcttatcttcatgctcggaaccaccacctacaggtttaacatccagggaagtcctgacaagagccattttctccgaattggtcgtgtattcattgcagctataagaaatcgctcgagtagcctagagcaaagttctggacaattcaa

SEQ ID NO: 68003 - DNA, 585 bp, Glycine max
  Peptide Sequence Number=SeqID_184781
atggtcgtaaaaatcaaggttttcgggggcgtcctgttgttgggagcgaacggcgacgcattcgggcggggtttcgaagagggacaaggggaagcgcttggaggcggcgccgacgtcgaagtagatgaggccggtgctggggacgtcgacgcggatactcatgacctggaaccagaggaagagatcctgggcctcgaggccggagagggcgtcgatcatgccgtagctgaggtggccggagacgttgcgctcgtaatgcagctcgttctcgaacttggcgttgcaggcctcgtcgaggcgcacccagaagctaccatcctcgcccaccgcgaactcccgcacgccctgcgggaacaggcccatgggcagcccgtgctcgctcaggacctcgtagatggtcgtcgcattgctactcaggcccaacgacgaggcccaggagcaagaaataatgattggaaagacaaggatgaagatgatggtgtgagggaaggaaaacatgggtgtgggaacattgttggagggagggggatcattgaaatggggtttgggatttggcgaagaagagagagagagagagagaggtga

SEQ ID NO: 68004 - DNA, 183 bp, Glycine max
  Peptide Sequence Number=SeqID_184782
atggttaatggcctcttggtcaggttcaatctggaaggcttcggtataagctcaaacagggaacctctggaagagatgttctatagagtatggaccgtgcagaagaagatacttataaaaagggaagcaactgagatgaatttcctgaatccgtttctcattgagaagatggtggtaatgtag

SEQ ID NO: 68005 - DNA, 216 bp, Glycine max
  Peptide Sequence Number=SeqID_184783
atggagccatcccacacgtggttttcccgtattgctaactggacaatgcaagcttcatcattgtatgctgattttgagggccattgggtttcctgtgtatcgttaaagatgaggaatttgcctgaaagactaaaatggagagtccgatccatagaccatattccagaagataatgggctaaaactttgcgggggcaagcaattgcttggaatataa

SEQ ID NO: 68006 - DNA, 1113 bp, Glycine max
  Peptide Sequence Number=SeqID_184784
atgtctggtcactggggcattcttgtgtcagatccatggcttcagaaccagttcactcaggtggagcttcgcagcttgaaatcccaatttgtgagcatgaggagggagagtggaaggcttacggttggagacttggcttccaagatggcaaggttgaaggttgtgggagagaatctgagtgaagaagagagaggctcttatattcaggatttgtatcagaacacaggtgaagaggtcgattttgaattgtttctcaaggtttacttgaaacttcaaacttttgcaagttctaggacagggagtaatgcaaaaaactcctcagcattcctcaaggctgccactaccacattgcttcacaccataagtgaatccgagaaggcagcttatgttgcacatataaataactatcttgcaggagatgaattcctcaagaaatgccttcctattgatccttcaaccaacgacttatttgaaattgcaaaagatggtgttcttctttgtaagcttattaatgtggcagttccaaggaccattgatgaacgggcgatcaatacaaaaagattacttaatccatgggaaaggaatgaaaaccacacactttgcctcaactctgctaaagcaattggatgtacagtagtcaacattggaactcaagacttcattgaaggaaggcgtcatctggtgcttggattgatttcacagattattaagatacaattattggcggatctgaacctgaagaaaactccacagcttttggagttgatcaatgatagcgagggtatggaagagttgatgagtctggcaccagaaaagatcttgttgaggtggatgaatttccatttgaagaaaacatgttacaagaagatagtcacgaacttctcctcggatgttagggatgcagaggcttatgctcaccttctaaatgttcttgcacccgaatacactaatccatccacattggctgtcaaaaatccttacgaacgagcaaaattagttcttgagcatgctgataagatgggctgcaagcgatacataactgcaagagatatagtggaaggttccccaaatcttaaccttgcttttgttgcacatattttccaacacaggtga

SEQ ID NO: 68007 - DNA, 298 bp, Glycine max
  Peptide Sequence Number=SeqID_184785
gtctgagttcctcatgggaggatacgtaggagcaaaagcctcgcttttgtcgaccgcaccgctttctgttaccatgacccaagagttggtagcccgcggagacaccttacggtctgagttcttcattggaggatacgtaggagcaagagccttgctttttgtcggccgccccataatctttgtcatactgaccctgagaggcggcgggctcgatgacacgcggagataccttacagttatccgcacccttgtgtcatccagaggcggcgggcccgatgacatgcagagactgacatag

SEQ ID NO: 68008 - DNA, 246 bp, Glycine max
  Peptide Sequence Number=SeqID_184786
atggatgaaatcacaattaaaaagcacaactacctatctttcagactcctttggttaatttgtcttgcctccttatgtggtgggatcatgggttctccatctgcctccactactccttctcctcctccttctcctccttcttctcctcgtcctcccccctatttcggacgcatcggcttcgacgtctgccgtgaagcggacacgcaaagcctcacgtttacgatcgttgtccacaagaccacctag

SEQ ID NO: 68009 - DNA, 1635 bp, Glycine max
  Peptide Sequence Number=SeqID_184787
atgaggatatggagtgacttgcatcacttgtggttggatcagctggaggatggctttgtatttgggagaaacgatgcttccaagctagacatcacttcatcagagagagatttattggtatacaaggaacatagctggagaatggtaaggagattgttattgttaatgtttatgcaccaaatgatcaaggtgcctagtggagtagtgggtattgggggtgaggatggtagtggggatgaaagggaggaatttaatagatttattggtgacttgggggtaaaggatattcctatggtaggtaggaaatttacatggtatagacctaacgagagggcgaaaagtatgattgatagggtgatggttacaagtgagtggttctctttgtggcaaggatgcacacaatatgttttagaaataaacatatccggtcattgccctttgttgttgaagaatacaaacattgatttaggacctaaacctttaagggtgggagcctatgtactaaaagagaagttgatggaaatcaaaaagagtttgaagatatggaatgaggatgacatggagcttagtgaagaagaaataaataaaagaaaatggaattacaagagaagttttggaggatggtggcttgtaatgaatctttggctagacaaaagtcaagagctagatgggtggagggagccttgtagagttaagttagaagtggctagattttttgaggaaagatttaaagaggaagaagttaaggaggcggtttgcaattgtagaagtttgaagagtttgggattggatgggacaaattttaaattcatcaaggctttttggcatctttcaaagagtgatgtgatgaggccaatatctttggagggctggatatacaagattttggtaaaagttctctcaaatagacttaagagagtgttggatggtgtgatagataagcgacaaagtgcttatttgggggcaaggtatttactacatggtgctttggtggcaaatgaggccatttatgaagcaagaaggttgaagaagaaatgtttaattttcaaggttgattatggaaaggcctatgattcggtgagttgggacttcttgatttatatgctcaaaagattgggatttaatgggaggtggatcaagtggatcaaaaggtgcttggagagttgtagagtttcgatcttagtcaatgggagcctatcaaagaagtttccagtttccaaaggtttgagtggaatgatgagggatgcaattgaaaagaatttgaacacaagctatttggtggggacaatgggggtaggaggaaggtttttggggaaagttaggataatatttgtcaaagtaagaaaaatagcggggtctaagtatggagggtgcaaagcttttgaaaaggagaagcgtggtgttggacgcttgagtggaggaggaattggttccaatggaagcaagaattgctggaattttctagaagattttaggggaggtgtagctctaggctatatttggtccaatccatcttctatagagttatgcatgcgagaagttttggtaatgatcacgatgggagatcaaggtcagtgtctagggtgtaacaaagttgtggagtccatctcacacgtgttgttttggtgcccaaag

SEQ ID NO: 68010 - DNA, 183 bp, Glycine max
  Peptide Sequence Number=SeqID_184788
atgcagaagacgagtggacaaatgaagagatgtcgtgttaaaaattgcatctttagatgtaacaaaaatgcagaagacggggagggaaatgaaaacttacaaaggaaagctagtggagagataagcaagagcatgagcagcaaaggagacatcagaagcttccacttgtcttccatagcatag

SEQ ID NO: 68011 - DNA, 329 bp, Glycine max
  Peptide Sequence Number=SeqID_184789
gctacgcccctccttatcccccaccacagggttacccgccaccgggttacccgtcagcgccgccgcagcctccgccggggtacgtgccgtatccgccgccgcagtacgaaggctaccaaggctatttcaatcacgggtatcctctgccaccccctcccaattaccactgccatcacgctcagcaccatcacaatgataaccccggttttacttctttcttgcaaggctgccttgctattcaaaatcatgaccaaccggtcatcaaggcacaacttttcctcctcattggaaacaagattaatatttatatcactaggctattcaagtaa

SEQ ID NO: 68012 - DNA, 180 bp, Glycine max
  Peptide Sequence Number=SeqID_184790
atgaagttactgttagtgtgcttcacaggactcaattttattcctagtgatataaatattaatcttgtttccaatgaggaggaaaagttgtgccttgatgaccggttggtcatgattttgaatagcaaggctgcatacaataaccctctcccataccttcgtttagcaaggagcctttag

SEQ ID NO: 68013 - DNA, 315 bp, Glycine max
  Peptide Sequence Number=SeqID_184791
atggaagacgcacccgtgagccccgcgtcgccctcccaccgaagggtaggttgcgacaaccccgaaaatccattttcccctcacgcgatcagttaccaaaaccctttctccctttcttcctcatcgctcaggttgtttgtcctcctcactcatgctgccattcccgttcgagttggagttcgtgttcgagttggagttcgagttcgagttcgagttcgcaccagttcccgttcgagtttgagttcgagttcgtgttttagttggagttcgagttcgcaccaattcgtgttcgtatttgtgactatggcgatttag

SEQ ID NO: 68014 - DNA, 250 bp, Glycine max
  Peptide Sequence Number=SeqID_184792
gtgtgaccttgacagtagtggcattggtgttgatctagatggcgatgcggcaaagaggcataacacaaagaagatcttgcgggttagaagcaatggaggtactattgttggcagcagtggaggtatcattgtcaatagtagtggaggtgtcattgtggtgttggaacaaaaacatagttgtgtttgtttcaaagtgatggaggtgttgccattgacaatgtcttcggtgccgtcgatggaagttgcatga

SEQ ID NO: 68015 - DNA, 268 bp, Glycine max
  Peptide Sequence Number=SeqID_184793
catatttgtggcaattgatgcgatacaacatccttcaacttctaaagaacctgagattcactctcatgggaaggaaataattgatgctgatattctgcgatgggcgaacagcaaagtcagcagtttgggaagtcaaagccgaatggatagtttcaagaatgagttttggagggacagtactctcagggttctgaccaagaaattttggtcaggactggcaaactgttatgtgatgcctcacaataatctagcaatgtgtttagaataa

SEQ ID NO: 68016 - DNA, 468 bp, Glycine max
  Peptide Sequence Number=SeqID_184794
atgtctctcattagggaggattggtgtggtcttatatggaatattttggtgatattcctagtcaatgtgggtaaagttgttggtctagatgatatcccttttgaagtttggaagtggatgggagaacaaggtttcatttggctccctatgcttttcaatgaatttgttgacacaaagtggttagagtccctaacagaagcagagaaacaagcattgcttcaagaagttgaggaagagaagagtcgctggctagaggtacgcaggggaattggagtagcttgtttgtctatatacattaaaatgaagttttgccaaattgagaaaggttttagctatgctttcttcaatttacttagacaaaaggatgagacttcaaaatccttagtgttccgctcacaaaaatttccagatggaagcaactctgaaacctgcagtgtcaaagacaaacttatgagatatattgactga

SEQ ID NO: 68017 - DNA, 288 bp, Glycine max
  Peptide Sequence Number=SeqID_184795
atgggtgtcccggtgggtagtgagggtgacccaccatcacatggcaaggatgagatcctcaatggaatggtccacaacacaatagtgcaggttgagaatttaacaaacgagagcaaaacgaggaagcaaaacgtacacagaagggaaacaaaaccatggagaaaaggatgttacaaatatcttctgcgcactgagggatgtaaattctctcacaccaagaagaaggggaacacagacataaataacacctgcaatcgcaaatgttacatgtcgctaggcaaagtttga

SEQ ID NO: 68018 - DNA, 735 bp, Glycine max
  Peptide Sequence Number=SeqID_184796
aggactagacgtcctcgccatcaggggactacatgtcctcgccatcagagggctgcatgcccttaccttcaaaggactagatgtcctcaccatcagagggttgcacgccctcaccatcagagggttgcacgtcctcaccatcagaggactgcaaaactcagaggactgcacgtcctcacctctagaggactgcacgtcctcgcagttagaggactggacgtcctcgccataaaaggactgtacgtccaaacctttagagggctacacgtcctcaccttcagaggactagacttcttcgcaatcagaggactacacgtcctctccatcagagggctgcacgccctcaccatcagagggctgcacgtcctcacctttagaggactagacgtcctcgccatcagaggactgtacgtcctcaccttcagagggctgcacgtcctcatcttcagaggactagacgtcctcgccatcagaggactacatgtcctcgccatcagagggctgcacgcccttacctttagaggactacatatcctcaccatcagagggatgcacaccctcaccttcaaagggctgcacgtcctcaccatcagagggctgcacgccctcaccttcagaggactgcatgtcctcgccttaagaggactacaggtccacacctttagaggattgcacgtcctcgcctttagatggctacacgtcctcgcctttagaggactacacgtcctccattag

SEQ ID NO: 68019 - DNA, 2289 bp, Glycine max
  Peptide Sequence Number=SeqID_184797
atgcctggttttactgttggaaagaagagatttatccagccaaatatgtgtttcaccaatttgatccatcaagataaatcaactctttcacaaagcaatcattgtttattccctgaggcactgaataaagattatagccccattctacctgggctgcctgatgatgtggctgagtattgtcttgcacttgtgcctcgttccaacttccctgctatgggtgttgtgtgtaaaggatggaggtcgtttattcaaagcaaagaattcactactgtgcgaaaattggctgggatgctagaggaatggctctatttcttaacaacagactgtgaaggaaaggaaagtcattgggaggttatggattgtctcggtcataaatgccgatctcttccaccaatgcctggtccaggaaaggctgggttccaagtggtggttcttaatggaaagcttcttgtcatggctggttattctgttattgaaggaactgcctttgcctcagcagaggtttaccaatatgattcttgcctcaacagctggagcagattgtcagacatgattgtggctcgttatgacttcgcttgtgctgaagtcgatggcttggtttatgctgtgggaggctatggggtgaatggtgacagtctctccagtgctgaggtgtatgatccagatactgacacgtggacactgatagagagccttcgccgcccgagatggggttgttttgcttgtggatttgagggtaagctctatgtgatgggtggaaggtcaagctttactattggaaactccaagtttgttgatatatataaccctgagagacacagctggtgtgagattaagaatggctgtgttatggtcacagctcatgcagtattaggaaagaagttgttctgcatagagtggaagaaccagcggaagctagctatattcagtccagaggacaattcatggaaaatggtaccagttccgttgacaggaagctcaagcattgattttcgaattgggatactagatgaaaagttgttgctattccctctggaagctgaaactgcttttcaaacattgttgtatgatccaaatgcaactctggggtcagagtggcaaacttgtgacataaggccatctgtggagggagcagagaacaccaacaccatgtttggctccgctcaaccttcttcttctcccttcggcaccccttcttctacccctgcttttggcaccccttcttcaacccctgcttttggcaccccttcttcgaccccagcattcggtaccccttccttcggtaccccttcttctacccctgcattcggtaccccttcttctacccctgccttcggttcttccctcttctccacacccttctcttctcaaccgcaacaacaacaacaacaacaacaacaacagcaacaaactccactctttcaacaacaacaaacttcttctgctttcggctttcagaattccctcgcactcgcagcaccgcaaccctcgctcttcccaaatgctcaattgaccactcagatggctaacgttgcacctgttcctttctccctcgccgatcgcgatgttcagactattgttgatgcttataaggaagatcccgggaaccccaagtacgcatttaagcatttgttgttcagtgtaacagaaccgcagtttagagtgaagcctgccggtgtatcagatatcatgtgggcggaggcaatggggaagcttgagggtatggaaagtgctgatagagaacgtctgtggccacaacttgttcagggttttaaggatctttcacaacgccttaagatacaagatgaagtcattgtttctgatgcagagagattgcgtataacccaaagcaacgttaaaatggtattgctcttccctttgctcaaccaagagcacaatgttaatgtggtactggtaatgagaatagtggaggcattggaggaaaaaggctgccgtatccccttaacaaaaggggaagctgaacttgctgagaaattagccacaataactagacagctgaaaggatctggagcggaactgtcaagaagggtacaaaatctactaactgtatctcgtgttaaagctaatagcaatggatttggtagctccgtttatcttccagggtcaaccaaaattcatgaacagagtcttggtgatctacaagaggttttacagcagcagatggaggccattgcaagacttggcagtgttctgaagcgagatatacgggatatggagattatgatgaccgaggacacagcaagaactgaaaatgggaatttaatctga

SEQ ID NO: 68020 - DNA, 633 bp, Glycine max
  Peptide Sequence Number=SeqID_184798
atgtattcgaagaccataattgatccatcttctacaaaagccgttgctctgcttcaacattgcggaagcagaagaagcgccgcagctatggtgaagtactccagagaacccgacaatcccaccaagtcctgcaaggccagaggcgctgacctcagagttcattttaagaacactagggagactgcctttgccatcaggaagttgccccttgttaaagctaaacgatacttagaggatgttttggcccacaaacaggctattcctttccgacgcttttgtggtggtgttgggaggacggcccaggctaagaacagacactccaatgggcaaggacgctggcccgtcaaatcagctaagttcattctagatttgctgaagaatgctgagagtaatgctgaagtgaaaggtttggatgtcgatgctctgtacatttctcatatccaggttaatcaagcacagaagcaaagacgccgcacctacagagctcatggaagaatcaacccttacatgtcatctccatgccacattgagctgatattatctgagaaggaagagccggtgaagaaggaggctgagactcaattggcaacaagcaagaagaagggcgctcttcgaagtggtgcttcatcttaa

SEQ ID NO: 68021 - DNA, 570 bp, Glycine max
  Peptide Sequence Number=SeqID_184799
atggaccgtgccacatggacttggtccaatgagggaagccgctatcatttttgtaatacaacaatacaagacagagaaaatctcaagtcaagtgggcatgcattttgggcaataaataatactcgcaaacacgaaaatgctgcttacgaggcaaacaaccttagccggcgtcatccgcaaaacgacgtcgtcactatctctcacaagtcttccttcccacttgcactctctctctctctctctcactccctcactcaccggtcgccgaatctttctccgcatccgcaaccaccaccgccgtatcctcctttgcttcttcaaccgatggatcggccggcgaccggacctggcgtggacatgccgatcatgcacgatagcgaccgctacgatttcgttcgggatattggctccgggaatttcggcgtcgcaaggcttatgagggataaacagacgcaagagcttgttgctgtcaagtatattgaacgcggagataagttcttttgggctgtttcgttagttttggtgacgtctgctagggatatggttgctgaatacggaaaatttgcgtag

SEQ ID NO: 68022 - DNA, 1422 bp, Glycine max
  Peptide Sequence Number=SeqID_184800
atgtcgttcgcgtcatcattctcgatgctccggcaccgcgcggcggcttccgcggcgcctctcctcctcctccgccgcttccgctgcctccgaatcgccgccagacaccaacaacaaaaccctaacaaacaagccccccctagccgcaacctcctgaaggcgaaacagacactgaaggaattttcttctcttgcgcctgtcctctccctcgaagccagcccccctctcacggaatcccaggccatcggcgtggtggcggcgtcgcaggccaacttcatgcgcgtcatcgtccccgaaaacgacgagccttctggaagcttccgcggggttgagatactttgcgtggtgagggcgctgctgaagaagattaagcggagggtgatggtaggggacaaggttcttgtggggtccatcgattgggtggaccgcaggggcatgatcgagaatgtcttccaccgaacctccgagattctcgaccctcccgttgccaacgtcgaccaacttctcgtacttttctcgctcgaacagcccaagcctgaacccttcaccctaacgcgctttctggtggaagctgaatccactggaatccctcttacgctcgcactcaacaagaccgagcttgtggataatgaaatcattagttcgtggaaggctaggttgcgcagctgggggtatgagccggttttttgcagtgttgaatctggacatggacttgatcttcttggtttcaagttgagggatcaaacaacggtgattgtggggcctagtggagttgggaagtctagtttgatcaatgcccttagaagcaatccttccaatgctgcagaaggggagaattggtttgagcctgttctgggaagcaagtggcttgaggatcagcgagttggggaggtttcaacaagaagcggtagagggaagcatactactcgccatgtctctctgcttccattgtctgaagggggttttcttgctgatactcctggatttaaccagcctagtttattgaaagtgacaaagcagtctcttgcacagacttttcctgaaatcaggaaaatgcttagtgccagtgagattgagaaatgttcgtttaacaattgcttgcatctgggtgaacctgggtgcattgtgaagggagattgggaaagatattcctactatttccaacttcttgatgaaatcagaatcagggaggagttccagctcaggacgtttggaactaaaagagaaggggatgtaaggttgaaaatgggagacatgggtgttcagcaagcagaaccacgtttggaacctaagaagcatagaagacaatctcggaagaggattaaccagtcaattttagatgaattggatgatgatgacgacaatttgcttgatgaggagaatgatcccattttaagggcgctaaggaatgaaaactcttag

SEQ ID NO: 68023 - DNA, 462 bp, Glycine max
  Peptide Sequence Number=SeqID_184801
atggattggcaagggcaaaagatagcagagcagctaatgcagataatgctgcttgcatttactgtgattgcattcgcaacaggataccttatggcttctttccaaatgatgatcctcatatatgctggtggtgtggttctcaccacattggtgactgtccctaattggcccttcttcaaccaccatcctctcaagtggttggatccaagtgagttagaaaagcatccaaagcctcaatcatctctgaattgtgatgcaaatttcttgtgttctaagcttttgtttacaaaaagagaaacttgttgggatgtggttgtggaactcgtgcttcttgaccaggttgttggtaatatattcatcgcgtttctgtctcctggaagtgttatggctgaactagctgactccgagatacaagcgaaagcgcggaaaggaactatttacaatgagtactctggggattaa

SEQ ID NO: 68024 - DNA, 338 bp, Glycine max
  Peptide Sequence Number=SeqID_184802
atgcctccttttggaacttcttcaccaccttcgtgggaatctctagaggagctaccacctctccctccagcctccccaatttctgccgcgaatccatcctcagctgcaatgtcatgctccacctgccagaagaattgggagtgcgagcctaagtcctttgagttgggaaaccacgacgacgccaccgtgcaaataggaagctcgttgaggtttcctatgtacgacaatgattttggatgggggcggcccttagcctacgcagcggcggagcgaacaagtttgacggcaagatgtctgcatttcttgggaggaatggtggcgccgccatcaatttggag

SEQ ID NO: 68025 - DNA, 2172 bp, Glycine max
  Peptide Sequence Number=SeqID_184803
attgatgaaaatgttaaaagagaaatcattaatcacaggtctctaagacatcctaacattatcaggtttaaggaggttattttaacacctactcatctggccattgtaatggaatatgcatctggtggagaactatttgagaaaatctgcaatgcagggcgttttaatgaggatgaggctcgtttcttctttcaacaactcatatctggggtcagctattgtcatgcaatggaagtgtgtcaccgggacctgaagttggaaaacacgttgttggatggaagcccggcgcttcatttgaagatatgtgattttggatactccaaggagaatgataagttggcaggttggttgggggtgtggggtgaatatagggaaatggaggaacagtggaatgctggaagccaaagttgttgcattcaaggattcaatgaagttttcaatggtagtggaagcaatatgggtgatggtgtgacccttggtagtggaggaggaacttcgttgctggtcaaagaccccattgatgagtattttatggcggtttgtaaggttgagcttcccctaattgatggcatggatcctgttgggtgtataaatggggtggggactcatttcaaagttcaaagtatgtcggatgaagttgaagttaagttggctaagctaagcatggatggtgctaccatccacttgtttaatttgttgaaggagaccaaagaacatttgacttggactagattgaagcaagcactgagagtgtatggagattgtcattacaacaatatgattgaagatcttttttatctttgtcaaatgggaacaattgaagagtatattgcagacattgtgttcatctcgtggctagttgtaatcggttccatgctgggtatcaatgttattggggtaccattttggagtggtctacaagctgggaagagagaagatgacttgtactgcattcatgaggaaggggaattcttgagcctaagtgtagagaacacacttgaggatttccattcaatcatctctagttacattcaagtgatcccgctctacctgattatcaccggcgccactgtttgctgtcagtccgccgtcagctataactccggagaaaccaggatccacgcgtcaccttctaccagtcagaattgtgctctgacagtccaaaaaggttcgccggacctatctgggccctattctgctctcaaatcttcattatctctcttcaacgtcagtgtttcttcaattggtcccactgtcagttccactgtgggtcccactgttttgttttctgggacaccagtcataacctcagaaaagctgaatggcagcaaaaactacttgtccaggtcctcttctgttgaactttggttccttggccaaggacatcatgagcactcagaagcagtcagtaaagccaaacatcttagtgaccttaagtctgcagttgaagaattaagaatgttcctagatgctgagttagtggaagaaatgagaagaaagcatgacaacctgtatatggtgctggccttgcgggccatgaacccagatttcgatcatattcgtgatcaagttttgactaatgaagaagttccctcaatgaagagtcttcttacatgccttcttcgtgttcctaatccgagaaagaatgaaaattcacttgagcttactgaatcttcagcaatggtgtccagtcaaggaagaggaagaggaagaggccacgaaaatcgtggacgtggaggatgtggtggtggcagaaatgcaaatgtctccacatcgaaaacacatgagccaaagttttttgaagaggagtatcaagagtacctccagctgaagtccaacagtgcttctgatcatagttctctattcacctctctgtctcctcctaaaattcttcatctaatcacactagcaaatggcaccaaagtcacttctaaaggagtcggcaaaggctctatttctccgtccttaaacttggatccagaatgtggtacaggtcagttgattggcgtaggacatgaatccagaggtctctactatttggaaatgagttcatcagtgtcttgttttatgtctctgtctcctaagcttttgcatgatcgcttgggtcatccgcacttgtctaagctgaagaaaatggttcctagtctcaacaaacttcaagtcttgaagtga

SEQ ID NO: 68026 - DNA, 2331 bp, Glycine max
  Peptide Sequence Number=SeqID_184804
atggatgttgctgaggttgaagaaagtttttttgcagcaagcgatgccaagttacatggagaaatgtgcaagtgtctgtctgcaatatactgcaagatattgtcattatttccttctttagaagcagctaggcctaggagcaaatctggaattcaggcattatgttcattgcatgtagccttagaaaaggcaaagaatgttcttcagcactgctcagagtgtagtaaactttacttgagcatcttacatataacttcacctatgacgcaggctataactggggattctgttctgctaaaatttgagaaggctaaatgtgctcttggggacagtcttaaacgggtggaagatattgttcctcaatctattggttgtcagattgacgaaattgtgaaagaacttgcaagtacggtatttgcacttgacccatcagagaagcaagttggggatgatttaattgcattgcttcagcagggaagaaagtttagtgactctaatgatagtaatgaacttgaatgttttcatctggctgctactagacttggaatcacttcttcaagaacagctcttacagaaagaagagctctaaaaaaactcatagaaagggctcgtgctgaggaagacaagcggaaagaatcaattattgcttttcttttacaccttatgaggaaatattccaagttatttagaagtgagttttctgatgacaatgattctcagggttctcaaccttgttctcccactgttcagagatctcttgaggatggcattcccagtggtcattgtcatgcctttgacagacagctttcaaaacttagttcctttaattttaagccaaataataggaaatcagggcagatgctccttccgccagaagagttaaggtgcccaatatctctgcaacttatgagtgatcctgttataattgcttctgggcaaacatatgaaagggtttgtatagagaaatggttcagagatgggcacaacacctgcccaaagactcaacagaaactttcacatctttgtttgactcctaattactgtgttaagggtcttgtagctagttggtgtgaacagaatggagttcctattcctgaaggccctcctgaatctcttgattttaactactggagattggctttatcagacactgaatccacaaattcaagatccgtaaacagtgttggctcttgcaagttgaagggtgtcaaagttgttcctgtagaagagagtggtatctcagagcaaatggggggaaatgctactgaaagtttttgtgcgcaagaggaagataatgaacagtatgttagttttcttaaagtcttgacagaagggaacaattggaagaggaagtgtaaagtggttgaacagttgaggctgttgctgcgggatgatgaggaagccaggatttttatgggggccaatggatttgttgaagcacttatgcagtttctgcaatcagctgtgcatgaagcgaatgcgatggctcttgaaattggtgccatggctctgttcaacctggctgtgaataacaatagaaataaggaaattatgatatcaacaggaatcttgtcgttgttggaggaaatgatttcaaaaactagttcctacggttgtgcagttgccctgtatctgaatctttcttgcctcgataaagccaagcatatgattggcacaagtcaggctgtccagttcctaatccagattcttgaagccaagacagaagtccagtgcaagatagattccctccatgcactctataacctttctactgtgccctcaaatattccaaacctcctttcgtctggcatcatggatggcctacaatcccttcttgtagaccagggtgattgcatgtggacagaaaaatgcatagctgttttgataaatttggcggtttatcaagcaggaagagagaaaatgatgttggctcctggacttataagtgccttggcttccacactagataccggtgagcccatagagcaggaacaagctgcttcttgtctcctaattttgtgtaacaggagtgaggaatgttgtcagatggtcctgcaagaaggggttatacctgcattggtgtcaatatcagtgaatgggacctcgagaggaagagagaaggctcagaagctcttgatggtcttcagagagcagcgacaacgagaccattctcctgttaagattgatcaacctgaatccgaaagtagtgatttgtctatgcctcctcctgacaccaaaccgctatctaaaacaatatctagaagaaaggtggtggggaaagcttttagctttctctggaaaagcaagagctattctgtttaccagtgttaa

SEQ ID NO: 68027 - DNA, 2508 bp, Glycine max
  Peptide Sequence Number=SeqID_184805
atggaagatctgttcagtggaggtgctgtgggagcagtgatgggggagttactgaaaggggctattgcgaccataaacaaaggtcgagacttcagacccaccctcgagagcaacatagaaaccttaaactctctggctcctcaagtggaggagatgaagcgttacaacaagatgctggatcgccccatagaggagatagagaggttggagtctcaaatgcgagctggcgaagagcttgttcgcaagtgctccaaattcggtcgctggagaatgctctctttcccgtattaccagagcaagcttcggagcaaggacgaggctttgaagaggcacttttcggtgaacgtttcggcggagaacaagagggacttgatggagatcgtggccagtgtgagacagattctggatattctgtccaagaaggagggttttgggcattcgttccatttaaggggtctaagtggggccccccaagaaccggagtgtgtgggaatggatgtgcctatgagcaagttgaggattgacttgctcaaggatggtgtgtccgttcttgtcttgactggtttggggggatcggggaaaagcacgttggctaagaagatctgttgggaccctcaagtcaaaggcaagtttgggggaaacgtcttctttgtcaccgtctcaaagacacccaacttgaagaacattgtagagacactgtttgaacactgtggttgtccggtgcctaagtttcaaagcgatgaagatgcaatcaatcgattgggatttctgctgaggcttgttgggaaaaatccaatattgttggtcttggatgatgtttggcctagctcagaagctcttgttgagaagtttaaactagacatacctgattacaagattttggtgacttcaagggtttcatttcctagatttggcactccatgccagttggataaacttgatcatgatcatgcggtcgcccttttctgtcactttgcacagctgaatggcaagagctcatacatgcctgatgaaaatcttgtccacgagattgtgagaggttgtaagggttcaccattggcgcttaaggtcaccgcagggtcactctgtcagcagccttatgaggtgtggcaaaatatgaaggattgtttgcaaagtcaatccattctgctggagtctagtagttctgatttgctttttcgtcttcaacaaagtttagatatattggaggataagttcaaaatcaacgaaaaggtgtgcttcgaggatctggggctatttcctgaagatcaaaggatccctgttgctgcccttattgatatgtggtcagaactgcataaccttgacgaaaatggtaggaatgcaatgaccatcgtccatgatctaaccatcaggaatttgattaatgtcatagttacaaggaaagtagcaaaggatgcagacatgtactacaataaccatttcgttatgctgcatgatctccttagagagctagcaatccgtcaaagcgaagaaaaaccatttgaacagagagaaagactgattattgacttaagtggagataatcgtcctgaatggtgggtaggacagaatcagcaaggaatcattggccgtactttttcattcatcctcggaacgtcgtatagacagaaacaactaagggttgctgctcgcatattatctatttcaactgatgaaacgtttacttcagattggtgtgacatgctacctgatgaagctgaggttctagttttaaatcttaactctagccagtacccattaccgaagttcacagaaaatatgagcaaacttaaagttctgatagtcacaaattatggtttccatcgttcagaattaaacaattttgagctacttggttctttatctaacttgaaaagaatcagattggaaaaggtttcagtcccttccctctgcatattgaagaatctgcgaaaattgtcccttcatatgtgtaatacaaggcaggcttttgaaaactgttctatccaaatctcagatgcaatgccaaatcttgtggagatgagcattgactattgtaatgatctggttaaattgcccgatgggctgagtaacatcaccccattgaagaagcttagtatcactaactgtcacaggctatctgcattgccacaagatattgcgaagctggagaatttggaagtgctaaggctatgttcttgctctgatttggtagagatgccagattctgttaaagggcttaacaagctaagctgtcttgacatctcagattgtgtaagtctgtccagattaccagatgacattggtgagttgaagaagcttgagaagctctacttgaagggttgctcaaaactgagtgaattgccgtactccgtcattaattttggaaatttaaagcatgaaatatatgtgatctgtgacgaagaaatggctgccttgtgggaaagtttccctaccattcccaagttgaagatagagatatcttcaatggagattaacttaaattggcttccaggagttcattcctga

SEQ ID NO: 68028 - DNA, 2087 bp, Glycine max
  Peptide Sequence Number=SeqID_184806
atggtaaagagcttattgacaagtactccaaagttacttggtggagatttctctgcttcccttgttaccagtgcaagcttaaggccagtgaggatgctctgacgagacacacaactacgattgagccggttcacattaggctcggaatgatggagatccagtccggcatcaaaatcattctccagactctgctcatgtcagggaaggagaatattggcggagcaatcgaagaaccagagtgcattggaatggaacaacatttgaacaagttgaaaattgaactgctcaaggatggcatgtcggtccttgtattgactggtttgcctggatccggcaaaaccacactggctaagaagatctgttgggacactgacatcaaaggcaagttcggggtaaacatatttgtcacagtctccaaaacacccaacttgaagagcattgtagggacagtgtttcatggctgtagacgtccggtgccggagtttcaaagtgatgacgatgcaattaaccgattaagtgctctgctgctgagtgtggggggaaatgataaaaatccaatattattggtcttggatgatgtttggcctggctcagaagcccttgttgataagtttacagtccaaataccttattataagatcttggtgacttcaagggttgcatatccaagatttggcaccaagattttgttgggtcaacttgatcacaatcaagcagtggcccttttcgctcactatgctaaactaaatgacaatagcccatacatgcctgaagaagatcttttacacgagatcgtgagacgttgtatgggttcaccattggtgcttaaggtcactgccggatcactctgtgggcagccttttgagattttagatgcgttggaggatgagttccacatcaacgaaaaggtgtgcttcatggatctagggcttttccctgaagaccaaaggatccctgttcctgccctcattgatatgtgggcagaactgaaagttgcaaaggatgaagacaagtactacaataaccactttgtaattctacatgatctccttagagagttagcaatccgtcaaagcacagagaaaccatttgaacaagacagactgattattgacataacgggaaatgattttcctgaatggtgggtgggagaaaatcagcaaggaaccatcggccaaatgttcccatgtttctccagaatgataagacagaaacagctaaaggttgctgcccgcatattgtgtatttcaactgatgaaacgtttaattcagattggcgtgacatgaaaccttacaacactgaggttctgattttaaatcttcactctagccaatactcattaccgtgttttacaaagaagatgaaaaaacttaaagttctgatagttacaaattatggttttcatcgttctgagataaagaagtttgagctgcttggttctttatctaacttgaaaagaatcagattggaaaaggtttcagtcccttccctctgcgaattgaagaatttgcaaaaattgtctcttcgtatgtgtaatacaaggcaggcttttgaaaactgttctatccaaatctcaaatgcaatgccatgtcttgaggaaatgagcattgactattgcaatgatttgattacattacctgatggactgtgtgagattagcccattgaagaaacttagtatcactaactgccacaaactttctgcactgccacaaggtattggaaaactggagaatctggaagtgctaaggctatgttcctgctctgatttgctagagatgccaaattcttttgaagggcttaacaagctaagctgtcttgacatctcagactgtgtaagtcttaccaaattaccagatgatattggtgagttgaagaagcttaagaagctatacatgaagggttcaaaactgggtgaattaccatactccgtccataagtttgaacaatttaagcatgaaataaatgtgatctgtgacgaagaaacggttaccttatgggaaaattttcgtgcctttcccaatttgaagatagagatatttagagaggacattgacttgaattggcttcatggagttcattcctga

SEQ ID NO: 68029 - DNA, 324 bp, Glycine max
  Peptide Sequence Number=SeqID_184807
atggaggaagtgcctaacaagtccaagctccaagctcaagagacaagagcaatatacggcattccaggagatggtagatgtttgtttagatctgtggtctatggtgcatgtctaagatcaggggaaccatctccaagtcttagcaggcaaaaagaactcgcagatgaactcagagccaaggttgtggatgaattcataaagaggagggcagacactgagtggtttctagaaggtgactttgatacctatacagtacagatgcgaaagcctcaatatgaggaggagaacctggacttctcatgtcctcacatgttttacagctaa

SEQ ID NO: 68030 - DNA, 555 bp, Glycine max
  Peptide Sequence Number=SeqID_184808
atgaaggtgccacgaatgctgcaaggtttccacgtctcctcagaatcctacacgtatgttgacaatggtatagagaaggatgtagtcctatggagaagaaagaaaataaatataagcgttctagtctgcaacagtagcatgggtgttgatggaagtggtttagaactatgtaaatatgtaataattgtttccttgttggaagtgactgaagaaacaacaacgagaatagcaaagacagttcgagcatggattaaagaagcaataaggtggttgttccttgtgggcgcagagaaagagtggcccgtgtttgtgggggctgtggctgcattgttgttactgtcttatataggaagttgcatggacctcctaacactagtttatatgggtacattggtgggaatggcagttccattaacttatgtgaagaacgaggacaagattaagaggtttgtggggtggttgagggagaaacacaagagatattatcagattattgatgagaagaccattcagaagatcaaaagcagaatagccaaggagaagaaaacagagtaa

SEQ ID NO: 68031 - DNA, 1947 bp, Glycine max
  Peptide Sequence Number=SeqID_184809
atgagattgttccggggctatgccacaacagcatcagtgagagaagggcatctaaaaatattggaggtccttatcaatgctggggcgtcacaacttgcatgcgaggaggctttaatggaagcaagttacttggggagggccaggtttgctgaactactcatgcagtccaacatggttcgtcctcaggtagcagttcatgctcttgtctctgcatgttgcagaggcttcgttgaggttattgatgtactcatcaagcatggagtggatgccaatgcaatcgataggattttgcttcaatcttcaaaaccatttcttcacgctagtgttgattgcaatgcattattcgccgctgtggtcagcaggcagattaatgtagttggattactgttgcaggttggcgtaaggcttgatatcaaggtcaaacttggggcctggttgtgggacacggatacaggagaagaatttcgtgtgggtgttgggctagctgagccttatccaatcacatggtgtgctgtggagtattttgaatccactggtgctatattgcacatgcttctctgccagctctcgcctaatagcttgcacactgggaggagtctcttgcaccatgctatcatttgtaacaatgaaaaagctgtaaatatacttctaaagaatggtgctgatgcagaagtggtagtgcaaaccacagaagaaaccaatgaacaccctattcacatggctgcacggctcggatcatgtaacattcttcagtgcctgattaatggtggttgtaacttggactctcaaacaaaatgtggagacacagcattgatgatctgtgcaaggtacaaacatgagaagtgccttggagtcctagtatctgcaggtgctgatttgggtatggtaaattcatctggtcactgtgcaacttcaattgcaaactgtgttcagtggactaaagtcttccagagagcaatcttggatgtaatcagagccgggaaggttgttaaatcaagcaacacctctagattttccgctttgttatttgtaactcgtgcaaatgatatagagggtttgaagaaactcattgaaaataataacatcgatctagatgagcaaaatgcaaatggattttcagctgctatgatagctgctgtagggggcaatgtggaggctttcaagttacttctttatgctggggctgatgtgactaatcttaaaaacaagtatggtttgacagcccttaacctcatagatattagccaaaatggtgaagtgttccacaaggtgatgcttgaatatgcacttaaaaagggaggcaatggttcgattgaggtgaatcctctccaccgtgcagcttgctatggggacataaacattgctcacaacctactaaaagaagggtatgatgtcaatgcttttgatggtcaaggatatacccctttgatgttagcagcaagaggatgccgcggcgagatgtgtgagcttttgatctcttatggagctaaatgtgatattcagaatgagaggcacgagacagcacttttacttgcaagagaaaatggtgcacgaaatgatgcagaacgcgtgatattggatgaggtagctcgaaaactagtcttgcatggtggtcgtgttaaaaaacatacaaagtgtggtaaaggttcacctcatggtaagttactagtgatgattggagctgctggaatcttacgttgggggaaatctagtaagagaaacgtgatttgtaaagaggctgaggttggaccaagtgcgaaatttcgatggaatcgcaggaggaagtttgatgttgatgagccaggaatgttccatgtggtcactacaaaaaataagcaggtacattttgtgtgtgaaggtggggttgaaatggctgaattatgggtaagggggattagattagcaactagagaagccatttttggtcaaagagctgatgaagtttga

SEQ ID NO: 68032 - DNA, 1353 bp, Glycine max
  Peptide Sequence Number=SeqID_184810
atgcctggttgcgggcaaatgcaaaatgcgttgcttcactattccactttcttccataccacaagtcaaaacagcttgatggtgttccactttcccctgaaaattgataattttcacacgatgccgttttttgggtccttagatttcataaagaaagtcatggccatacaaacagagcaacctcttcccactcacactcccttcctcacttcaaacacaaaccaagaccaccaacacctaccacaagaaaataatgacaatgatgaagaaacacaaacaccccttgatgatgtccttgcacgtttagaagcacttctcacgctacttggcttcaaccagtcttcattgttgagcttcaccgtgtcttggacaacttttgcggcggttggtgtggtggtgccactcctggcccttcaggtgtatgacacggacaagaatcagataaaaagttttgaaattggcattgttgcatttcagacttgcctagcttccgtgtccttgatttgcctctctcacaatcttcgcaagtatggcctcaccagtttgcaactcattcactttgatgattacgggaaactcttgcaaagggaaaatgatgtgttggtttttatggaggagcacattcggttgcgattccatctgtccaagataagccatagattcagaatttacttgcttctacagttcttggttgtcacagctagccaatttgtgactctattacaggtcactggatttggtggagcactgactttcataagtggtggagattttgctgtttccacacttgttcaagtggttggaattattattgttctgcatgcagcaacaaagatttcacatagagctcaaggcattgtttcacttgcaagcagatggcatgcgctagtaacatgcacttctgattcatctaaactgagatattgtgctagtacagggagcttggaggttgcaaaacatttaaactcaatgtttttggattactcagaaagtgatctagagtcatcagattacattggtgtgccttcacatacccagttagcttcttatatgtcctcgcataacaagagacaagcctttgtgatgtatctgcagacaaatgctggaggaatcagtatatttggatggacagttgaccggtctcttgtgaacacaatatttttctttgaattgactctggttacctttgttcttacaccaataaaccctctacgacctttgggccttctaggttgccacaataaatttcttgaaagggtccacgagttctacaattcttcttcgttaccaagttaccaaattgggtacaagccatggatggcagtttcttatgacacaaggcatgaacaataa

SEQ ID NO: 68033 - DNA, 372 bp, Glycine max
  Peptide Sequence Number=SeqID_184811
atgatggtgttggcgaattctggtacggggcttaggaaacaggtttttcccgtagattacgaaacagagatttcgcagcgtctcgtagacgctgctcactacggtgacacagacgctgcgttcgaatgcatcgcgaatcccttggtggacgttaacttcgtcggaacggtgtcgtttaagtccaaaacgacggagatcgtgctgcaggacgagtcgcctcacagagttaactcggcgtacgaggagttcaagaccgagctcactgctctgtttttggctgcgcacacagggaatttgtcactcctccggaagcttctggtaacgcttctcaactcaacgttgtttgttccttgtgttgtgatgaacttatga

SEQ ID NO: 68034 - DNA, 2220 bp, Glycine max
  Peptide Sequence Number=SeqID_184812
atggcggctggtagacatggaggttatcgtgacaacgagtttagggaccgtgagtccaattttgatgtttcaaggcgggtttttaataataattctagacaagagtatgatagtatgacgaatggtagccgcgatgttgtgagggttgggagcaaggatgcaagagataggattagactgaggcagaaagatattagggagagggaagctccaaatggtagctatttgagtaagagtgactctggcggtagcggcggttgtagttgtggatttggtcccagaagatgtgggttttctgttaagactatggatagagagccgggtgagctttctagtgagagtgggtccgatgatgatggtattgaatcaggatcacaggaaaaatactgtgaggttgcaacaagtgaaggaaactgtgcacgatctccgctagagaggaaaagaaaattttctccaatagtatgggatcaggatgacaacgaagtcaataatttatccaaactcagggttgtcacagcagtgactactctgcctccacttccaagagtccgtctgtcacctaatgttccggatagaggagttgaaactcatcctgtcaaacacacagaggctgagattcttgagttaccaactgtaactaatcctcctttgctgtctgagtcagatcaggatgctgagtctgagtctcctgttggtttgcattcattgttgccagatcaggaagccaagcgacctgaaggtgaagattatattccaactcataacatatcatcttcaagatgggctgctggagataactctcctggtgatgaaggtgaaataaatgatgacaaggaaatccttaagaggaggaagctatctcctgagctgggtatgagagtaagaaacaggatgtcaagactagaggaatctaacatagaagattttgtaggagctagagccaaatcatccgaatctaaagaaagaggtagccgtgggagattatccagtggagattattgtcctggtaacatgtcaaggaaggatgattatatggagattgatggtcaaggtagcagaagtgaagctagtggttatcattcagatacagatttggaagatgatagcagagaaacttctgaacctccggttccaccacaaagagttgccaacatgcttcagggttgtagaagtgttgatgagtttgagagactgaacaagatagatgaaggaacatatggtgtcgtgtttagggccaaagataagaagactgatgaaattgtggcattgaaaaaggtgaagatggagaaggaaaaagaaggttttccactgacttctctcagggaaataaacattcttctttcctttcaccacccatccatagttgatgttaaagaagtagtggtaggaagtaaccttgatagtattttcatggttatggaatacatggaacatgatcttaaaggactaatggaggcaatgaagcagccctttagccagagtgaagtaaagtgcttaatgctccagcttttagaaggtgtgaagtatcttcatggcaactgggtgcttcatagggatttgaagacttctaacctccttctgaataataggggtgagttaaaaatttgtgattttggattggctcgtcaatatgggagcccattgaaaccatatacacacctggtggttactctttggtacagggctcctgaacttcttctcgggacaaaacagtattcaacagccattgacatgtggtctctgggttgtataatggctgagctattgtccaaggaaccactgtttaatgggaggactgaatttgaacaacttgacaagaattaccctgagtcaaggtcaattttgtcaagaataagctttcaactctgggtggttctggtctggctatctggcctctcttggtataatctcctgcacaaaaaatttcctgcaacatcagtcaccggatcgccagttctttctgattctggatttgatttgttgaacaagcttctaacttatgaccctgtaaagcggatcacggctgaagaagctctaaaccatgagtggtttcgtgaagttccccttccgaagtctaaagaatttatgcctacattccctgctcaacatgctcaggacaggcgaatgaggaaaatattaaagagtccagatccattagcaaagcaacactggaaggagatgcagcagggtgaatcagggactggtggtatttttggttaa

SEQ ID NO: 68035 - DNA, 1299 bp, Glycine max
  Peptide Sequence Number=SeqID_184813
atggagatattccacaaaattgatggccttgttgaagagatccaaaggtctcaaccaccagtagatttatggaggaaatttatatattgtacttccctctctggttcaattcttggatctgtagatcacatacaacctcaagatcttgagcatgttgtcagcccagtctctgttgcacacttctcacagtacaagctaactatgttactactcaagagacttgaaaatctaggcttccaaatatgtgcgcctgaaagcttggaaggaaatgaacagtcttgtgacaaaaaaataatgatgggccatgagtgtgtttccattgaggccagcagtgaatttgtaacagtaactgcatcttctatcattaaagggaagcgtgtagaacagaacattcactgtaacatccttattggtacagatggtgcaggaagtattgtaagaaagcttgtaggaatagaaatgagaggtgagaaggacttgcaaaaacttgtcagtgtccatttctttagcaaagaccttggacagtttttgcttaaggagaatcctggtatgcttttttttatcttcaatactgaagctattgaggtccttgttgctcatgatctcaggcaaggggaatttgtattgcagatacccttttatccacctcagcaaacaattgaggatttcagtccaaaggcatgtgagaaattaatcagcaaacttgttggtcaagagtttggagatgcagatgtaattgatataaagccatgggttatgcatgctgaagttgctgagaactttatatgtagtggtaaccgaatattacttgctggtgatgctgctcatcaatttcctcctgctggtggatttggaatgaatactggcattcaggatgcccataatcttgcctggaaaattgcttctgtgattaagggtattgccccaacttcagtgctaaatacctacgaaatcaaacgtaaaccgattgctttattcaatgcacgattaagtctagaaaactataaagctgccatgtttgttcctgctgcacttggtcttgatccaactgttgcaaacacagtacatcaattttttgttaatgggattggttccatcttaccatccggattgcagaaggtagctttggatggaatttttggtataggtcgtgcacaggtttcagaatttgtcctaaatgaaagtaaccctcttggatcctcaaggttggctaagctaagacatatatttgaagaaggaaaaagccttcaacttcagttccctgctgaggatcttggttttaggtatcattgtgaataa

SEQ ID NO: 68036 - DNA, 3471 bp, Glycine max
  Peptide Sequence Number=SeqID_184814
atgccgccttccccggctttgagatactctcctgggagagagccaagagctgatggtcacaagcgggggcgcagtcttgaaagtggattgcttttccgggagaagggcgatgatcttgctttgttcaatgaaatgcaatccagagagaaagatagttttttgcttcagtcgtcagatgacttggaggactcattcactacaaagttgagacatatttctgatgtcaaccttggaatctccattcctggtcgaggagaaaccagcgagttgcttaatgatggtgacaagaatgattacgactggttattaacacccccagacacaccactatttccttcgttagatgatgagccaccgctgaccagttttggaagcagaggaaggtctcagagtaaacccatttcaatatcgagatcttctacgatggataaaaattaccgaagcagtaggggcagtgcaagtccaaatcgtttgagtccatcccctcgatcaggaactaatacattgcaatcaaggggaaggcctttgtcggtgccaaattccagtccaaccccaagtgtgaggtttgccactccaaccagaagaccatctccacctccaagtaagtccgtggcacctacttctaagtccacctatactccccggaggatgagcactggctccagtggttctgtagtctcatcaggagttaggggaacttccccagtgaagacaaatcgtggaaactctgcgtcaccaaagataagggcatggcaaactaatattcccggcttctcttctgaagctcctcccaatctccgtacttcattggctgatcgaccagcatcatatgtgaggggttcatctccagcatccagaaatagtagggactctacctccaaattcggtaggcaatcaatgtctccaactgcttctaggagtagtagtcatgatcgggaccaatttagctcacgcagcaaaggttccattgcatcctctggtgacgaagatctagagtctctgccatccatcacagtgggcagcttggacagattgagttcaagaaggggtgaaccattttcaaccaacagaactcctgccatttccaagaaatcagccaagattgtgtccccaagttctgctcctaaaaggttgttcgattcagctatccggcaaatggatagaaaaactcctcagaacatgttcaggccacttttatctagtgttccaagcacgaccttttatgctggaaaagcaaactctgcacatcgttcccttgtatctaggaattcatctgttactacaagcagcaacacgagctctgatgtaggtacagcttttgcactggatactgaagggagtgaccataatcaagatgatatggcaagcgaagcggataagatattatatcctgatatacatgaagaaatgtttgtttttgataagattgatgcattaaatgcaaacattaagcaagagattaatagggaatctgtagatatcttgcaaaatgaaaccagagatcccaagacagttttttgtccgattgaatctgaggattctatttcccacattcatattgtcactagagtcaatgaaagttcagaaatttcacgtgttaaaggtgacatttctgaaactggtagttctgaaaatacagcactctgttctcattgtggttgttgttatgaggtcactaatcaagctgagaagaatattgggctttgtccagaatgcaagaccgcattattgagagttgtcatccctgagacaactttggcagtatctgaaaactcttcattgattacaacaaacatgccaaaagaagaaaaatcattacctggaacaaatcaactaatggttgcatctgaactgcctcaagagactaacgtgggtaacttgaggtttccccatggtgaactggatgctgaggaaagtcaaacttcatgcagtgaactaaatcaggatcactcacaaaacagacctcttccaaattcattgacggagggaggtaggcagacatctggcaaccagctagagatgaaccagtcgggagttgattacaagaagcctgataatgaatttggggatcagcatcaccacaatgatctccctaatttgaacatggaccccatggaaggcactggcatttctgtattgctgaaaaggtctagcagcaataaaggaccggtagttcagggcaggacttttactgccactaccatatcttacgatgatttgtctcttgcaagagacagtgtaagcagttttagaagctcaactagacctggtagttattctgcctcatcatcaattgatctcagctcaagtaggcaaacagagtttcgtgtgcaaaggcagttgagtggcaggaaattggatgtggactgtggatatgactcaaggatcaagcctccaagcactgcttcatctttctctggagcttcaatccattctcgccaagagttaggtcttgcaactcgagagacttctggcagtacagaatgtggctctgtagaggagatgccccgagttttgcaagaattgcaagcttcggaaaatacagtgacagacttaattgatgcttcttcaaccgatttagttgttgaggaagataaacttgaacatgatgatagttgtagagtaaataatgcttgcagctcagaatttttgagtcaggctgctgatgttcagtctgatgacagtttagtcgcatcatttcaaaaccatgaggattgtatttcatatgaaaatgttgatgataatccaaataatgccagggatgcctcagacacagaaacatcagctaaggagttatccagtcatgagaaacaagatgtgcagaattccaatgttattgaactggatgctttggttacgaccaactgttccataattactgaatcagaaatagaaggggaaaacgattgtgagaataatattggggtggtgaatgatgatccgtcaaagagcatccttgatgactttcgggaaccttgcaatgattgtcattctgcttctgtttcagaggtcaatgtctccgagtcccatcgcattgagggatcaacagttacagttgagtgccaaggggcaggcaacactagaagccttacacttgaagaggcaaccgatacaatccttttttgtagctccattgtccatgaccttgcatatcaggctgcaacaatagcaatgaaaaaggaatgctccgacccgtttgaaggttctgaaccaactgtgaccttgttggggaaagccaaatctgatagaaaggatagtcgcaaccgacctgtcaacaagcgcacgttgaaatcccacaagaccaagaccaagcagaggagggtggaaactgatgtcaaaaccccttctggcaagactgagaatgatgaaaatattgatgagtctttcactcacaatgttgggcttcctaacaaggtagatagtatgaggccccctaagcttgaatcaaagtgcaattgcatcatcatgtga

SEQ ID NO: 68037 - DNA, 534 bp, Glycine max
  Peptide Sequence Number=SeqID_184815
atgagtgaggctgcagctacgacgtcttcttcaatgatgcgcaattacccgctcatttccgccattgttgctttcgccatcgcacaattcatcaagtttttcaccgtctggtataaggaaaaaagatgggatcccaagcaacttgttggatctggcggaatgccttcatcccattcagctactgtcactgctcttgctgcggcgatcgggttccatgaaggctttggaggacctctttttgctactgctttggttctagcttgtattcttatgggttatatggtcgggcgagtttctgataggggatattgctggcaggtgatgtatgatgctactggtgtaagattgcaagcaggacgccaagcagagcttttgaaccaaatcgtatacgaacttcctgctgaacatcctctggctgaaagcagaccactccgggaacttcttgggcatactccgcctcaggtcattgctggtggcatacttggacttataactgcagctattggctatctaataaccatggctagtagttga

SEQ ID NO: 68038 - DNA, 1491 bp, Glycine max
  Peptide Sequence Number=SeqID_184816
atgtccaaagaaggtcaatttgtgccagacattcatgacgtcatctttgtgaccatatcaaacaaatataatattgctgatggtatgcggcaaatgtttgatccttttgaaagggttgcaagagctaatcatgtttgcccttgctgtgagcgtcctttttctccagaagaagaagacagttttgtcaaaaagcaaagagtgaaggctaccagttcagctggacatatgaaagttctcgccgtagaatcctcaaatgcagagtctcattttcagcaattggacaagcttcgtatgctttatgaagaatatgttaaacttggcaaggaaacaatccctaattccgaaaaggaacttcagcaacttaaagaagagatggatgacaaatctcaggctcttgatgatgttttaggcgttttagcacaagtaaaatctgacaaggatttggttgagacattggtgcaacctgttgaaaatgctgaccggattttccaagaaattcaagctttacaaaagcaagttgaggatttagaagataagcataattttcgagcacagggagtgaggactctagaagagattcaattggagcttaacacattgcagagcacaaaggagaatttgcaatctgaattggatcggttgaaggatgaacagaggtatatggagaaggatctatcaagtattcaaatgcggtggcacactgtaagggaggaaaaaacaaaggcaactaacatattgcaaggtgttaaaagattagaagaagaattggaacgtttaactgaagaaaagacccaagttgatctcgacgagaagcatttggcagatgctcttggacctttatccaaggagacagacaaattacttgctaaccataatgaactgaaaattagactcgagcgtgagtatgaggacctggctgaacagaagagaagttatcaacaagaagctcaagcactttttaaaatgaattctaagatcaaaacgtattctgatttaaagaaaggagacaggctaaaggaactgcaggaaaagaaatcttcatcagaatctcaacttcaaagttttgatacaaggaagcaggaaattttagctgaactaaacaaaagtaaagatttgatgcgaggtcaagatcaactaaaaagaaatattgaggacaacttaaattaccggaaaacaaaggctgaagtagatgagctagcacatgaaattgaaacaatggaagaaaatatattgaaggctggtaggatttccacagttgaaactgaactccagaaactatcacaggagagggagagacttctttcagagttaaacaggtgccgtggaacaatgtctgtttaccaaagcaatatttccaaaaataaggttgatcttaagcaggctcaatacaaggacatagataagcgatactttgaccaacttatccagcttaagacaactgaaatggccaacaaggatctagacagatactacagtgcacttgataagtga

SEQ ID NO: 68039 - DNA, 250 bp, Glycine max
  Peptide Sequence Number=SeqID_184817
cagaatttggcacaagtgcagaaaaatgctatgcatttgctggttgtggaaagagcagtgctgaatgagttctggcttgggaggattgatggggacccggtgttgagagaaacgaggatatgggctacgtgggagtacgtgagctcagttggaggtgggcaacaggggatggagaccttggggacgtcaggtggggtgctattgcccaaaaccaagcttgaccaatcccgacccaacccgggcatagtcg

SEQ ID NO: 68040 - DNA, 357 bp, Glycine max
  Peptide Sequence Number=SeqID_184818
atgaatgaaaaagttaaggtttatctatggatgaatgctcttctagaacctaagcttttgaatcctagaaaaaccatgatttattggcagtctaacctcatcacaagcctagaaagtcctttggattcattttgtcaaaagaggctaaatcttgaggtgctaaagggagcagttgcgctcagctcaccatttgggctcagcgtgcatccaacgttgagtgcagctttagcgcgcttagcgcgacagaagaatctggcagagcatcaatatcaaggccgcgtgctatgcgcgatggttgactttagccaggttcagcgcataacttgcgctaagctcaaatccacttactcacactaa

SEQ ID NO: 68041 - DNA, 990 bp, Glycine max
  Peptide Sequence Number=SeqID_184819
gtggaatatgcagaaaagaaaaatgaaaaggaagaaccactctttgaacaaaggaaagggaaggcaatcatgatggaggaagagggagtttcgaagaattcatatacaagggtggttaatgaagaaaatatgatggggagcaacccgtggaaaagtaagcagaaggaaagtatgagggggttttgggaaaggcaaaggagatgcttcatgctagagaatgtgggggaaaaagttgcttttccagtgttgtggtatagtttggatgctgaaacggaggaagtggtcagattagataaagcaagattccttgtcaaagtatatgaggaagaagaaggggggcaccagaatagagtggtgaaggagacaatgatggaaggtttcatgcattacctagtggataataagaaagacgggggacaaattgaggatgaggggagtaaaggggtggggaggtgtaataaggaaaatgttttgggctatgcaacaaagacccaacagaacaaagaaggtgggcttttcttaactcaagcaatatccgaacctttagagtctgggagtgaagagctaggtgatgtgggccatctaaataatgaagttatcaaagtgtctattagtaataatgaggggcctcataagtcgtgtaagggtcctaggaaggagacaccaaccgattctatgcaggactatgagaagatgatgaggaatcgagcaaagaaccaaaggcaaaataatggtggggagaatactaaagaagaccatgctgaaaataatggtggagctagtgaggctaagattagggacgaagcatcaaacgaagctatcacaagagtgtttttccatcaagaagcaagcttctcgagtggtgctagtcaggaaattatggaaagaaaggattttgaacaatgtaacatgaagactatagcctacaaggagagagacttgcgatgtcccttttggagttatgattggcttctggtgaagaggacttga

SEQ ID NO: 68042 - DNA, 1167 bp, Glycine max
  Peptide Sequence Number=SeqID_184820
atgaagaggtcaagggatgatgtttacatgagttcacaactgaaacggcctatggtgtcttctagaggagaaccctcggggcaaccacagatgacgagtggcggtgctcagaaactaaccacagatgatgccttggcatatctcaaggcagtaaaggacatgtttcaagataagagggaaaagtatgatgactttctggaagtcatgaaggatttcaaggctcaaagaattgatacatcaggtgtcattgcaagagtgaaggaactgtttaaagggcacaaagatctaattttgggatttaacaccttcttgccaaagggatatgaaattacacttccattggaggatgaacaacctccccaaaagaagcccgttgaatttgcagaagccataaattttgtgggcaagattaaggctcgttttcatgacaatgaccgtgtttataagtcatttctagacatattaaatatgtacagaagggaagccaagtctattgctgaggtttacaaggaggttgctgcacttttccaggaccatgtggatcttcttagggagtttactcattttcttcctgatacttcaggaacagcctctaatcactgtggtttggctcgaaattctctccttcccgataggagctctgctatgccaataattaggcaaatgcatgttgaaaagagagaaaggaacatagcttcacatggtgatcgtgacctcagtgctgaccatcctgatccagaacttgacagatgtttgattagggccgataaggatcagaggaggcatgatgagaaggaaaagggcagtagagattatgatcatgatggtatatctcgcaagcggaaatctggtattagggctgaagactctggtgctgaaccattgcatgatactgatgaaaattttggcatgcaccctatctcatatgcttgtgaggataaaagttctttgaaaagtatgtatagtccagtgcttggttaccttgacaaagtgaaggagaaattaagaaatcctgaggattaccaggaatttttgaagtgcctaaatatctacagcaaggaaataattgcccgacatgagttgcaatcattgaaagacttggagtatcattacaatgagaggagcttatcagcatggttatttatcagggtgaatgaccaagattaa

SEQ ID NO: 68043 - DNA, 1872 bp, Glycine max
  Peptide Sequence Number=SeqID_184821
atgggatttcatggtttcttcttgtttgcaattttgataccatacattagttttgggacaagtagtcatgaatctcaaaaccttacaagtagtagtctcaatgatttggaaggcttgattggattttctagctgcttagaatcagctatcccggattggaatagctatgcctcccctgattactgcacttggtctggtgtcacatgtgtcggcacaagcgtggttcgcttggaacttggaagcacaagacttatgggaaaaatctgtgaatccttagtaggtttggatcaacttagagtcctgaacctttcagataatttattcactggctctcttcctaacactttgtttcatcttcaaaacttggaggtgatggatcttagcaataatcattttgaaggtcctataaatacagctatctgctcctctttacctcagctccgagttattaaactatctggtaacttgttttctggtaagattccaggaaatttgggtaattgttcctctctgcagcatctatccattaatgaaaataatttgtcaggaagccttccagggagtatctttcaactgcaatatttgagggtactactcctacaagaaaataagctatctgggcagctgagtaagggacttggtaagctttcaaatctagtggaatttgatatctccaacaatgaattttctggaattcttcctaatatctttgggagcctcacaaggcttaagtttttctgtgctgaggctaatagattcactggtcagttgcctgcatctctgttgaattctccttctcttcaaattcttaatctgagaggcaattctttgggtggctcagttaatttgaattgttctgcaatgaaaaatctaaccaccattgttcttggttataatcaattccattgtccagtcctcgttagtctatcaaattgcttgagattggaaggaattggtcatggctctgaccatttacattgtggggagattcctgttaatttcaagaaacttcagtccctaacccaactctcactttcatacaccggactacataatttgtcatcggcacttgaggttttaagtcactgcaggaacttaagtacgctactccttccatggaacttccataatgaacaaatgccacaaccacagggtcaaaatatagttttcagtaatctcaaggttcttgtcttatccaacagtcagataaaaggttcatttccaaaatggttaagtggatgcaagatgctgcagatgctggatctgtcgtggaatcatctcactggaagcattccttcatggattggcaacttgaacaatctctattacttgaacttgtcaaataactctttcactggcaaaataccacagagcctgaccgtggtgttgagcctccagctcaggaatttatcactagaacaaactacttttgcctttccctttaaaatggttgggaatgtaaatatctacaaaagagtttcaagttaccgaccatctttagtgctcagttacaacaaacttgaaggaccaatgtggccgggttttggtaacctgaaaagcctacatgttatggacctaaaacacaatagcctctcaggaccaattccttggcagctatcaggcatgttgcatggggaaatcccagaaaagggacagtttgatacctttccacctacaagctttcaaggaaacatggatctctactacagtcacgacacttcaggctttattctttctccaccagatgagacgtgtgctcagcctcattaccagaagctggagatcattggttttccattttggtttggtggtgttgctggttttcttataaccattgccatgtgcttcacttctggatggctgttttcatag

SEQ ID NO: 68044 - DNA, 231 bp, Glycine max
  Peptide Sequence Number=SeqID_184822
atggataaaaggtgtgaagcattgaccaacgataaaggtgatagagagttattcaaagagcataaggacctagaagcacttcatgagttgaagggtccaatgacaaggtctagagccaagcttctacaagaagagatgaccaagaggatcaaggatggactactcatcaaaggcaaggaaagagaaaatcacaaggagctaaattggagcacattgcagattgttgaatag

SEQ ID NO: 68045 - DNA, 1977 bp, Glycine max
  Peptide Sequence Number=SeqID_184823
atgggatttcatagtttcttcttgtctgccattttgataccatatatcagttttgggactagtactcttgaattgcagaactttataagtagtcctaatgatttgaaagccttgactggattctctagctgcttagaatcagctattccagactggaacagctccacatcccctgattactgcacttggtctggtgtcacatgtgtaggcacaagggtgattcgcttggaactaggaagcaaaagacttaatagcaaaatctgtgaatccttagccggtttggatcaactaagagtcttgaacctttctcataatttcttcactggctctcttccagacaacttgtttcatcttcaaaacttggaggtcatagacttcagcaataatcattttgaaggtcctataaatacatttatctgttcctctttacctcggctccaggtatttaaactatctaataacttcttttctggtgagattccaggaaatttgggtaattgttcctctctgaagcatctgtccattaatggaaatgatttgtcaggaagccttccagaaaacatatttttgctacaaaatttgaatgaactatacctgcagggtaataagctatcagggccactgagtgagggacttggtaagctttcaaacctagtggaatttgacatctccagtaatgaattttctggaattcttcctaacatctttgggagcctaacaaggcttaagtttttctctgctgagtcaaataaattcactggtcaattgcctgcatcacttgtgaattccccatctcttcaattgcttaatatgatcaacaactctttgggtggttcaattaatttgaattgttctgcaatgaaaaatctaaccatcgttggtcttggttctaatcaactccgttgtccaactcctggtagtctatcaaattgctcaagattggaagcaattgatcttactggtaaccatttcaactgtgggattcctgttaattgcaataatcttcagtccttaactgaaatctaccttgcaagagccagactgcataatttatcatcaaccctagaggttttaagtcactgcaggaatttaagttctgtagcacttacaaataacttccataatgaagaaatgcctcaaccacagggtcaaaatcttggattcagtaatctcaaggttcttgtcttatccaacagtcagataaaaggttcatttccaaaatggttaagtggatgcaagatgctgcagatgttggatctgtcatggaatcatctcagtggaagcattccttcatggattggcaaattgaacaacctttattacttggacttgtcaaataactctttcactggcaacataccacaaggcttgaccgtggtcttaaccctccagttcaggaatttatcactagaaggaatcatttttgcctttcccttttatgtcaatgggaatgtaagaaatgcttacaaaaaagtttcaagttttcgaccatctttattgctcagttacaacaaacttgaaggaccaatttggccaggttttggcaatctgaaagggctacatgtaatggacctaaaacacaacagcctctcaggactaattccttggcagttatcaggcatgacaatgttggagattttggatttgtctcacaacagactctcaggagaaataccgcaatcattaattaaattgagtttcttatcctcatttgatgtgtcatataatgagttgcatggggaaatcccagaaaagggacagtttgatacctttccacctacaagctttgaaggaaacaggggtctctactaccgccatgatacttcaggctttatgccttctccaccagatgaggctcgtgctcagcctcatcaccagaagctggagatcattggttttccattcttgtttggtgctcttgctggttttctcataaccattgccaggagttttgcttctggatgggtattttcatag

SEQ ID NO: 68046 - DNA, 261 bp, Glycine max
  Peptide Sequence Number=SeqID_184824
atgggtgccaagcacctcacgaggaccaaagaatggtcgcacgtcatcgagcaaaggtccccggacgaaattaggacgcagaatgaccataatttgtctctgcgttttgttggacacaatcgagcctgggcggcgagacacagaatgaccataatttgtctctgcgtgccaccggacacgatcgcctctggatggcgaaaaggtgcgcggaatgaccataatttgtctccacccacctctcgacttactgtccccgaatga

SEQ ID NO: 68047 - DNA, 246 bp, Glycine max
  Peptide Sequence Number=SeqID_184825
atgcctcttcgaaaggcttgggctattgtgactattcaagccacactcgcctcaaacaccctctttgttgttgctatttcagaaatttccgtagtacctctagtatgggcaactttgtgtgatctcataatcgataaggtaatcgcagcgaagacaatccacaattcaagtaagagactcctcactctaccattactctacaatccaagcgtcaaatttaccaaacttgtatgtgtaactaaatga

SEQ ID NO: 68048 - DNA, 1956 bp, Glycine max
  Peptide Sequence Number=SeqID_184826
atgcctccatacttgcctcttcgctgggagagtacgggagaacaatggtggtatgcatctcccatcgattgcgccgctgccaacggccactatgatctggtggtggagcttctccacctggataccaacctcctcatcaagctcacttccctccgcagaatccgccgcctcgaaaccgtgtgggacgacgagaaacacttggagaacgtcgcgaaatgtcgctcgcaggttgccaggaatctcatgctgcaatgcgagacaggaagaggacacaattctctcattcgcgccggctacggcgggtggcttctctacactgctgcctcagctggtgacctggattttgttcgtgaattgttggggaagtaccctgcgctcgtgtttggtgaaggagagtatggagtcactgatatactgtatgctgcggcgaggagcaatagttgtgaggtgtttgagcttctgcttcgttctgctctctcgccgccgcaaatggaggatgtttacgagagggacatgatgaatagggcagttcatgctgctgccagaggagggaactgggagacgctgaaacggcttgtggggaacggttctggcgttttgggctttagagatgctcaaggatgcactgctctgcatactgcagctggtagaggacaggttgaggtggtgagaaatctacttgcatcatttgatgttgtaaacttaacagatgatcaagggaacacagcattacatatagcttcttacaggggtcacttagcagtggttgagattctgattcttgcatcccgctcactagcattgttaaccaatcactacggagatacttttcttcatatggcggtggctggtttcagaagtcctggtttccgtagactggacaagcatactgagctcatgaggcaattggtaagtggaaagactgtgaacttacaggacattatcaatgttaagaacaacgatggaagaacggcgcttcatgtatccgtgatggataatattcaatgtgagctagtggaattgttgatgtctgtgccatcaattgatttgaacatttgtgatgctgatgggatgacccctttggatcttttaaaacaaagggcgcgatcagcatcatctgatatattgatcaagcaaatgatttctgctggaggggtctctaaatgtcaggatgctgtggcaggaaatgccctttgcactcatgacaaagcccatgtcattggaggcagtcctgggacttcatttagaataccagatgcagagatattcttgtacactggcattgagaattcatcagataccaccaattatgatcaagcaagtgtggaatcatattcctgctcaaacgaactaagcaattctgactcagccaattccccacataacaagaagtctagttctgtcaatgtaaggcgctcaaagtttcgtctccactggcctaggagaagagagacaaaagcagctgcctcagaattggaagatgatgattctcttgaccctttcagttcaagtagaaacttggaagagtttccaatcccgttgcggcaaagatactcacaaccatgctcccatccaaacaacaaaagaacacaatctatgaggacttctcttccaagtccatcctccaatgtgaaattcagtgcaggtctaatgcaaggtgtaattcagctaaagccacattctgctcattcaactcctagtcctttccaagaattatctgtggcttctctcttttacatcaaggaacaaaagggtgttgatataattggaccctcttgctctaatggatcaatagatgacggcactcttctattgaactacaaacactgttccttcaataagaaattaatggatgggtatttttcttttggagcacagggcctggctgttgaagattccaatagctgcgcaaagtcaaacagcggttacaaacgtttaagttccatagttgcctaa

SEQ ID NO: 68049 - DNA, 527 bp, Glycine max
  Peptide Sequence Number=SeqID_184827
tgtgaaattcctcgctcatcgcgttccgaatcttcctctcttgttatccagcaaccgaattctagatctcttgaacgcaccgtttttggcggttatagaggatcgggacgcgaggcggatgacggcgaggaggttatcggatgtggtgctggactgcgtgatgccatacatacacgactccaaggaccgcgacgccgtgtcgcaggtgtgcaggcggtggtacgagctcgactcgctcactcgtaaacacgtcactattgcgctgtgttacaccaccacgccggaccggctaaggcggcggttcccgcacctggagtcgctgaagctgaagggaaagccgcgggcggcgatgttcaacctgatacctgaggattggggagtcgcttcactttcggcgcatgattgtgagggattcggatcttcaagttctagctcgttcgcgcggtcacgtacttcaagcactcaggctggaaaatttgctctggattctccactgatggcctctactatatcggtcgttattgccg

SEQ ID NO: 68050 - DNA, 1194 bp, Glycine max
  Peptide Sequence Number=SeqID_184828
atgtatttatcggagaagcctcgccccatcgatttctacaaggaggaaggcgcgcgtgacatgatgatcgaggtcgtctccaacggcgacctccctcctccgcctcctccgccgcctccgccgatgatcctcggcgagagcagcggcgaggaccccgaggtcgagataaaggccccgaagaagcgcgccgaaacctgggttcaggacgagacgcgctccctcattggccttcgccgcgagatggactcgctcttcaacacctccaagtccaacaagcacctgtgggagcagatatcggcgaagatgagggagaagggtttcgaccgttctcccaccatgtgcaccgataagtggcgcaatctcttgaaggagttcaagaaggccaagcaccaggaccgagggagtggctccgcgaagatgtcgtattacaaggagattgacgagatcctcagagagaggagcaagaatgtgcagtataagagccctactcctccgcccaaggttgattcctttatgcagtttgctgataaagaaaaaggttcaggtagtggagcaaggtctggtcacggcggagaagagaagatgttgcggggaggtattgatgataccagcatctcttttgggcctgttgaagctactggaagaccaacactcaatcttgagagaagtttggatcatgatggacatcctcttgccattaccacagctgatgctgttgcagcaagtggagtccctccttggaattggagagagactcctggaaatggtggagaaagtcagtcatgttgtggaagggttatatcggttaaatggggtgattatacaaggcgaataggtattgatggcaccccagaagccattaaagaagcaattagggctgcttttaggttgagaactaaacgtacattttggttggaggatgaagatcagattatcagaagtatcgaccgtgaaatgcctttaggaaattacactcttcacattgatgaaggaatggccattaaattacccctctatgatgagcctgaccatatacctgtgcatactgaagataagatattttacactgaagacgatttccgtgattttctgacccgccggggttggatatgtttaagagaatttgacagctatagaaatattgacaatatggatgatcttcgacccggtgccatatatcgtggtgtgagttga

SEQ ID NO: 68051 - DNA, 2024 bp, Glycine max
  Peptide Sequence Number=SeqID_184829
atggcaagccggagagaacgagatttgtttcacagcgacgagatcgatcccgtggacgcgttgaatggtgaggatttcgacgattcgtcatcggtggagagtgctacttccggtggttcgaggacgcaggttggacttacggagcggttgacggatattctcgttgacgaacgcgacggcgatctgttgattcagcagactaatagagaggaccggttgttgcagtggcttcaggctcttgatatgcaagttatgggagcgtgtcgcgctgacgagcggttgaagcccttgctgaagatgaacgctgcttgcggcgtcgcggaagatcctctgctggctcaattgactcagcattttgagccatctgaagttggaatgttagctagatgcttctgcgtgccgcttgtttcgatccgcgtcgggaagatcaacaaggaagggactcgcttctgccctacttcgattaggggtaacttgacacttgtactactgccaagttctgatcttcgtctctcgttcataggggatgatggtagaacagagagattattcacccttaccaacaaatcccaatgctctggtgttatggttgatgaaatcccaactgatagttctggccgatccttccttgtaaggactccagatagcagaattttttatttctggtgctctgaaaagtccaagcttttgggaattgaattacttggaaaggatttgctcaagagaaaaccatccattgttgagttgagtggcattagcaagtcacgacttgactgctttgcaactcagcttcgggcctttcttgtggggacaacgggaggcagaagtcatgatagttcagtctgtgcttcaacatctgctaattccatgtcttgctccaatgttgcttccgaaagttcacacccttcatcttcaaaatttccccgatcacgaaacattggaggtcagacagcaaagggagatacaactctttaccagagtattcttagtccaagatcaagttcttttaaagaggttccaccaagaaacttgtcttctcacaggattgcagccagggagaaaattaaacgtcgtggtgataatcatcagccaacagttgataccttgacaaatgattcaacaaacattttggattcatcttccacttctgatcatgacaaagcatcagaagttaccaaaactcttgagttttcaccaagttttctgggttcacttggaaagcttggtgatgttccgtcaagcatggggctgggtggggaggtccttcccgggatgtcacccgttttttctccttactattgttggtgtcccccaggggtttctacctgtccttccattgcagcggttacgcaattccccaactcatctattgaaacattgccttttccctcaggtgcctctttattacccaatcctctatcggctaacttgttagatccagtacatcctcttagtacttccatggactttcctccttttttccctgatccactggtgagaatgtccttgccatctcagcagattcccactttcacaccattaatgtgtgatccaattgttcatgtcccagtgattgacgtgtgctcttcaggtcagggctatcttgtgagtgctggccctgcaatgtcacctagcattccaccattgcatccaaaccttgtgaagccattgattcctgaatctgatgctgtggtgaagggtgcaagagagactctacgattgctacttagtggttcaagccagggtaaccaacagatgatgagggacactctgccagcaattttaactaatccagacgaaaagcaaaacaacatccttgtggctggcagtcgtggtctttacaccggaaccagagatattaatgctattgcaaacagcattgctgctatgggattagtatcactgtctggggtatccaaggtagaaagtggaggctattcggagctatgtgaaaactatgggaatttggaagcagtgaaaaattctaatgattcaggtggtgccattttggatgatgagggcgg

SEQ ID NO: 68052 - DNA, 192 bp, Glycine max
  Peptide Sequence Number=SeqID_184830
atggattctggcatgtcctggggtgatcaatgggacaacaaccctgcatcagacaaagacaagaagaagggcaaggatgggtcaggcaagaacaaatttgggaagactatgttgagcttcaaatgggtgaaagaactccgcaagaaaactcagaacctctggctcttagaaactaagaacgcaataatgtaa

SEQ ID NO: 68053 - DNA, 711 bp, Glycine max
  Peptide Sequence Number=SeqID_184831
atgacggaaagtgagggaaagtgtaagaaaatgggcaaagagaagagaggtagaagcttcatcgccttcaccggagctgcggcggtgcttggaattgcggcgaacctagctatcaccgcaatcaagtaccagaaggcaaaaaatgctaagaagaaaggttccaaggtgcgcgttaatctctctgcatctgagattcttaagctggctgagcaaatcattgctaactcaaacaaggcccataattctgttgcgtcggtgcctctcgacaaggttacatatgcaaatgttatatcacctctggcagaactgcaagcgcagcaattcccactggtccagtcttgtgtgtttcagaagatggtatctactcgagaggatgtacgcaaagcaagtgcagaagcagagcgaagaatagatgctcatcttgatgcgtgcagcaaacgtgaggatgtgtatcttgtcattaaagcatttgcagtaaagggggagtggatgaatgctgaagccaaacgctttgttcaaatcctggtgagagattttgagcgaaatggattgaacctcacagcaagcaaaagagaagagttgcagcgtcttagggctcagattgatgaattaagttttaaatacatccaaaatctcaatgacgatagcaagtttcttctcttcactgaggcagagttagctggattacctccagagtttctcaaggtttag

SEQ ID NO: 68054 - DNA, 759 bp, Glycine max
  Peptide Sequence Number=SeqID_184832
atgaaggttggaactaccaggcggatggtatcaagggcatatgggaatcagtgtggagaaatcaatgtttttatcttagaaagcctggtgcaacaacgccataaatatgctcgtttacttggctactcatgctatgcagagtatgccatcgatgttagaatggcaaagacaccaaaaaaggtttttgagttcctgaaagacatatcgacaagtttaactgacttggccatgaaagaacttaatatcttgaaagatttgaagaagaaagaggaaggggagtttccatttggaattgaggacctactgtattacgtaaaacgggttgaagagcagggttatgatttggactttggagagatcaagcaatactttccaattagtgtggttttatcagggatcttcaaaattatccaagatctatttggcttaaggtttgagaaaattgcaggagctgatgtttggcattgtgatgtttgtgttttttcagtgctggacttgggttctagtgaactcttaggttattgctactttgatttgttctcaagggaaggaaagtatggtcatacttgtgtgttggctctccagaacagtgcattaacaagcaatggggcacagcagataccagttgcattgttaatatctcagtgtcagaaggatgctgatggtagttctggattattacggttttctgaagtggtcagtcttttccatgagtttggccacgtggtgcttgtttgggtctggggaaaaggtaaataa

SEQ ID NO: 68055 - DNA, 189 bp, Glycine max
  Peptide Sequence Number=SeqID_184833
atgtaccttggaatcagccgcgtggctcacagttcagggccaaccattgaacttgacagttgccaggtgtgtgacagtgctattctgcctaggaattattacacttcttcttcagctcctcaggatcaggatatgtgcgaggtgacattgaagatgctccgttggaatacacacaacacaattatataa

SEQ ID NO: 68056 - DNA, 1437 bp, Glycine max
  Peptide Sequence Number=SeqID_184834
atgccttctcctgtacccaccttgctctccaaatgcaccgtcttcccagaccaaaagtccactctcggaaacctcaaactctccgtttcggaccttcccatgttgtcctgccactacatccaaaagggatgcctcttcacccaccccaatctcccactccactctttgatccctctccttaaatcctcactctctcgcactctttctctctttccacctctcgccggccgtttaatcaccgattccgacagttacgtctatatcgcttgcaacgacgccggcgtcgatttcattcacgccaatgccactgcccttcgcatctgtgacttactctcccaactcgatgttcctgaatcttttaaggaattcttcgccttcgataggaaagtcagctacaccggtcacttctctccgattctcgccgttcaggtcaccgaactcgccgacggcgttttcatcggctgcgccgtcaatcacgccgtcaccgacggcacctccttctggaatttcttcaacaccttcgctcagctctctagaggagccagcaactgcatccgcaatataccggatttccaccgcgagtcggttctcatctccgacgccgttctccgtttgccggagggcggtcctcaggtcacgttcgacgccaacgcgcctctgcgcgagagaatattcagcttcagccgcgaagcgattcagaaactcaaagccatagcgaacaaccgccggtggccggaaaacaacaacttcgccggcgagttgttacggaagaaaagcaacgataatctactaaaggagaacaaggcgacgacaattcttgagaactggttcaaggtgaattcaaattcgatttcgaaaccgcaaacggtggaaatttcgtcgtttcaatcagtgtgcgcgcttctgtggcgcggggtgacgcgagcgaggaaatttccttcgtccaaaacgacgacgtttagaatggcggttaactgtcgccaccggttagaacccaaactggaagcgtattacttcgggaacgcgattcagagcgtgcctacttatgcttccgcgggtgaggtgttatccagggatctacggtggtgcgcggagcagctgaacaaaaacgtgaaggcgcacgacgacactatggtgcggcgcttcgtagaggattgggagcgcaacccgaggtgcttcccacttgggaaccctgacggtgcatccatcacaatgggtagttctccgaggtttccaatgtacgataacaatttcgggtggggaagaccactcgcggtgcgaagcggaagagcgaacaaatttgacggtaagatctcagcgtttcccggaagagatggaacagggaccgttgatttggaggttgttctagcgcccgaaaccatggaggcgctagagtctgatcccgaattcatgaaatatgcaacgtgtcaattatga

SEQ ID NO: 68057 - DNA, 312 bp, Glycine max
  Peptide Sequence Number=SeqID_184835
atgatgcttgacatgttgccacaagatcttgcctttactgttttggttccgtccgaggatgctttcaagcgagatctgcgtctgtcggtgaatgatagtttcaaaccggacaagttcaatgatacctatgcgattgtgagtcgtatattggggttttcagctgttcctgggacactttctttggctaatgtgcaattggaaatagtagatgttaggaagaaggagattcttgtccatgtcatggatggggttattatggatgctgaatttgaggaatcgattttagctgaggatgatacagaggaggattga

SEQ ID NO: 68058 - DNA, 1473 bp, Glycine max
  Peptide Sequence Number=SeqID_184836
atggattcctttgccaaagttctgaaaatttctataattcaaactcacgttgtttttgtcgaggatagcaatcacgcatgggtttcgatgtcgctgggtaaccctattcgtgcgcttggagaatctatctcttttgggaggtttatgacagaaggcctggattgggagaaatggtcaacattttcacacaatcgctatgtagaagaagctgagaaatattccaagccgggttctgttgccgcgaagaaagcctactttgaggctcattacaagagagcagctgcagagagagcagctgcattgatcccagaagcaaatgctcaggctaatggaacttttgaggcacaagttcacgaaggaaactgtgctgattcatcctttgggacgagttcaaatgtggcaaatgttgtggccgccaatgaacagctggataatgaaactgctaattaccaagttgttgaatgtgctgatactgaccaacataaatgtgatgccggacaaagtcatttggacatttccaatgtgaaaggagcagaggatgtgccacatcctcgcactgatacagatcttaacgtggaaagttgcacatttgttgctaattcttattctaaccagcttcatcatgttgaggacaatacatatattgctgtccctgcagaagagaagacacctgatcatggtgctgttggtcaggaagttttaactttgtctgtcaagggaagagaagcaaactcttctccgaaattatcaaccaaaactgtggttgccaaacattctcgttctcctgatgaaaggaaggctgctgtgctacccagaagcggaataaacagtggtccaaaaggtaagaagtctgttggagactcagttgagaagaagagactaattgcacagtcagtccgcatgtcaatcaatcttccatctggtaccggtgaaacacgcaaaagaactgcaactgcttcacagtccagaaatggcacaaacaatttttcaacaagtaagaagtctgttagagggttggttgagaagaaaagaataactgcaccatcacttcgcatgtcaatcaatctcccatctggtgccggtatgacaagcaaaacagatactgtagctgctaaacccagaaatggaataaactttgctgcaaaaagtatgaaatctgttggaaactcagtggagaagagaccaactaaaaggtcactccacatgtcaatcaatctgccttctggtgcaggtgaaacaagtaaaacagcttcagtgttggaacagaacggaattaaaaaaaatcattctaacatttccaaaaataatccaggggtgttgcggacatccactaaggtatctcatggtttgctaaatcaagcttcagcaaatcccccttctcagggtagaaggactgaaagaccacttaataagtctgtatctggagctcttacagcaaatgcaaaaccttcctcctccatttcttttgagtaa

SEQ ID NO: 68059 - DNA, 198 bp, Glycine max
  Peptide Sequence Number=SeqID_184837
atgtctcgtcaatttcagcgcaattctcctcctcctttacccaagattgaagacgatggcaatcccaaattcgtcatcttcattcgcatggccaatgatgaaaaggaggtacagaaatctgcatgcaaacagtaccgtgtattgcgatcagctactgatttcagatacggctacaaacttcttgtaatgctcctatag

SEQ ID NO: 68060 - DNA, 516 bp, Glycine max
  Peptide Sequence Number=SeqID_184838
atgggaaattgtataaaagcagggttgcgggatcgatttcctacggcaaggacagtgcaagaaatgatggagacgatggagagaatgatggaggacccttttgctttcagcacacttgaatggccttcatcaccccttccaagtgagggagtgggagggtatcgaagaaggggaagggcaccatgggaaattgaagagtgtgagggtgaatacaagatgaggtttgatatgcctgggatgaacaaggaggatgtgaaggtgtgggtggaggaaaagatgcttgtggtcaaggctgagaaggcaccaaaaaagaagcaagagaatgagattgtggaattacaacaagaggaagaggaatggtctgctaagagttatggtaggtacagcagtaggattgctttgcctgataatgtgcagtttgagaatataaaggcagaggttaaggatggtgtgctctacataaccatacccaaggctatcagctactcctgcatccttgatatccaagttcaatga

SEQ ID NO: 68061 - DNA, 297 bp, Glycine max
  Peptide Sequence Number=SeqID_184839
atgaagaagatgaggaccgggggcttccccccagagctaagcagaatggtcaaacaggaagaccaagaaataaaaccacaccaagaagagatggaaatcgtaaacttgggtattggcgaggaaaagaaagaggttgcctttgaatcccggttgttccccggtgaaacaaaaactaagaaggatgaagcccgagatgtccttaaagaaaaagaggaggtgaaaaagcaattggatgccggtttcttggcagttgctgttcggtcgtggcaagtgcaccggatcacgcaagtagtataa

SEQ ID NO: 68062 - DNA, 630 bp, Glycine max
  Peptide Sequence Number=SeqID_184840
atgatcggtcaatggaacaagcaagttgattttagggtcgacggttatcctcgacaagagggcttattgaactttaactccaactacatggtctttgcatcagagcatcaatttccagcacaagagtttcacattctccagtcaagtgttgaaactcaaggcatagacaggcgaagggtggttgttgaagcggaagaatattcccaacaaatggcagagcgtggccatggaatgtattacacaccaccaacattttctcagtatccaacacagatgtatcagtatcctttcaaaggtcatcacactgatatttctgcaagcaaacactcgtttggtggtgttgcggaaacacatcttcatttttcatggccaactatgaccccttcacagcaacatgatgccccaattccaacacctaacgccccattaggtacgcaatggaatgtacccagagcaatacctgatataggtgacttattaggtgctgatttgcatcaccaattttctgttgaggctgaccaagtagaaacggggagacatcgggacagaagaaatcctgatcgccaagcgcaacgatgggatcgatcatgtgacacatcctcacgtcatcacggatatcataatgaatga

SEQ ID NO: 68063 - DNA, 972 bp, Glycine max
  Peptide Sequence Number=SeqID_184841
aaggagttaaagaacagtgatgttagctcccttaggagaatgatattgccaaagaaagcagcagaggctttccttccagctcttgaatccaaagaaggaattgtaatcagcatggatgatatagatggtcttcatgtatggagtttcaagtacaggttttggcctaacaacaacagtcggatgtatgtacttgaaaatactggagattttgtcaacacacatggccttcgctttggagattccattatggtttaccaagatagtgaaaacaacaattatgttattcaggccaaaaaggcttctgatcaagatgaatttatggaagaaactagtgataccatcaatgatatcttccttaatgattatgaggtgaacaaacctggttgcttcaatgtaactaatcctgcagtgaatgatacaggcatgtcattcatatatgagactaccttctcaaatgactcccctcttgattttttgggtggatcaatgaccaatttttcaaggattgggccagttgaaacctttggctctgttgagaatttcggtagcaactgtttggaatcaaccgcgaaagccacgacggcgagccgattagccgcgccgagagaagatataaccaactgcatcgcacactttagcatagaacacgagcgtggtgaagaggatcgcgagaacttggaaagattgcgagaactcgagccacatgaaagacatgaaagcggaaatcgcatggtagaagagctgaaagaaaacgagcttacaacgtcggactcgtcccaagggggaaacatagcagccactggagcgggtcttgtagcgctgccagagccaccgcgtctctttgatttcagtggcggcggagaccaagaggtcggcgaatatggtgacggagatgacggacatcgagaggctgtggagcacgggaatgggtcccagcggaacgggtctgccacatcgaagaaacaaggctaa

SEQ ID NO: 68064 - DNA, 1380 bp, Glycine max
  Peptide Sequence Number=SeqID_184842
atggcgagcaggtactgggcagtgtctcttcccgtccacaactcggcatcatctcagctctggaaccaattgcaggaacgaatctccaagcattccttcgacacacctctctacagattcaacattcccaacctccgcgtcggaaccctagactctctcctctccctcagcgatgacctcgccaagtccaacaatttcgtcgaaggagtcacgcacaagatcaggcgccagattgaggagctcgagagagtttccggcatcgacagcggcgccctcaccgtcgatggtgtccccgtcgattcctacttgaccaggtttgtttgggatgaggcaaagtacccgaccatgtcgcctttgaaggagatcgtggatggtattcacagtcaagtggcaaagatcgaggatgatctcaagaaattgtggacaaatgaagcctctgtgaatgcgacagtcgtggacactccaaaatccttcatgttgcagccaaaatcatggtcatggaccttttttaaaaccttgggaataagactgaagctggttcgtgtttctgagtataacaatatccgcagtcagcttaatgctatcaaccgaaagcaaacaggaagcttagcagtccgtgatctttccaacttggtaaaacctgaagacattgtaacttcagaaaatttaactaccctccttgcaattgtttccaagtattcacagaaggattggctctcaagctacgaaacattgacaaactatgtggtccccaggtcttctaagaagttgtatgaggataatgaatatgctctttatactgtaacactcttcagtcgtgttgcggataattttagaactagtgcacgcgaaaaaggattccaaattcgtgactttgaatacagtccagaaacacatgagaaccgaaagcaggaattagataaattggtacaagatcaggaaagattgaggacttctctgttgcaatggtgctataccagctatggagaggttttcagttcctggatgcacttttgtgctgtgcgtttatttgctgagagcattctgagatatggtctgcctccatccttcttggtaatatactcttctaaaatcaaagttcagtctaatggcccctgggattttcaaatactgttcactgaccattgggtattccaggcatgcgttttagctccttctgtaaaatccgagaagaaagtacgttctatccttgaagggttgagtgatagcacaaacaggcaagtctatgatgtccggtttagaatatatggcccttgtgcatactggaagaatgaggatgaagtaggtgccggtatggctggcctagcaggtgatgccgatggccacccgtacgtttctttcactatcaatcttgcttga

SEQ ID NO: 68065 - DNA, 709 bp, Glycine max
  Peptide Sequence Number=SeqID_184843
atggacgacgcgcaggtcgaagtgttcttgcaggtattgcagttgggccggatccgaatcgatcaccgtgatgtcgttctgttcggacaccaggttttcagccacgctggtgcctacgcgaccagcgccgatgatcaggatcttcatgcgccccgtttgcgcgccgattcaatgcccaactgcttgagcttgcgatacaggtgggtgcgctcgaggccggtggtattcgaagtagatgcgctcgaattcatcgcgcgcctcgcgcagcggctggtccagcgaaatgctgcccagttggccgttggcggtgacggggacctcgttggcgggggccgtcgacaacgccggcggatcgagttcgtcttcgagcgccacggcggcgctggccgtgaccggcgccaccacgggcgccggatgcggcacccggccacgggccaggccggccgccacggtcttgagcaggcgttgcagcgtgatgggcttttcaaggaagtccatggcgccgatgcgggtggcctcgaccgccgtgtcgatggtggcatggccgctcatcatgatgaccggcatgtccagcaggccttgcgagccccattccttgagcaggctgacgccatcggtgtccggcatccagatgtccagcagcaccagatcgggacgcatgcgaagacgcgcggcgcgcgcttgcgccgcgttttcggccagctcgacc

SEQ ID NO: 68066 - DNA, 744 bp, Glycine max
  Peptide Sequence Number=SeqID_184844
atgtacgaccagatgaacgatgcctctatcagcagcagccgacagcttgacagttacatcacattgctgcagtgttggatatacgagcactttccctcagtcgcggagtccactgctgatcaggactactacgaggattcaccgcgtgcctgtaggtggattgcgacgaagaagaccatgaagagcatatgtacaccggcgtacagggagcgcctggaccaactctggattttggatgtctgttggatcccatatggggagcaccgactagtctgggacttccatttgatttcattctattccggtctcctgggctgggggcccgttgctgtgtattatcgaccagagagggtcgtgcggcaggttggatacacccagaccattcctgctccgcctgtcgattcatgggtgtcatatgatgatatacacgacaggtggattcactactcggatcatatggttccagctggtgaggtttgcactgtgtcaggtcagtgtgtcagtgactacatggactggttctttcgcatctcgcatcctttcatgacatcagaccaggcatcagatcctctgccagatggtcatgctccgcaaccccgagtcatccctcaggccccacagacagatatccctcacgtgccagagccaggagcaccgtcgacatctgcgaggcccgttgtggaggagcctaaacatgcagtgaagtttgccatgggattgttgagaggttggagcgccatctga

SEQ ID NO: 68067 - DNA, 165 bp, Glycine max
  Peptide Sequence Number=SeqID_184845
atgacgacgtcgggcactaggcacaactataccatgaggcactcttcccacaccaaagtgcaagggttgtggttgtgggcgatactaaggcccccccctaagtgtttggtatgggtacaccacaaaatgcctgcccctcagtggcatatccgaggtgaggcttga

SEQ ID NO: 68068 - DNA, 330 bp, Glycine max
  Peptide Sequence Number=SeqID_184846
atggcgaagggaggtcgacaatacagttggcaaaggcttcaaactcgaaaagagtgtgccacgggggtcatcgtagaaggaaggtgcaaaacgcatctccaaagcttgaagaaaaccagaccaagagggcagttaatcgttacggaacatccattgaaaccagctgaaggttggcccgtcaaggtagaaagaggcgacttggagttgttcgtcgttaggggtaccatggtagtaaaaaaattgactaatcttgaatatccaagacatggcatcaatcccgtcgaagcgaggaaccttaaggttcatacggggaggtgggggccgcaatga

SEQ ID NO: 68069 - DNA, 483 bp, Glycine max
  misc_feature (451)..(451): n is a, c, g, or t
  Peptide Sequence Number=SeqID_184847
atggagcaaagcatgctaactatcatagggcaatacaaggaagagttgaaccagtctgtggcccataaacaaaagctagtggaggattttgcacaagtgtacgccaaaaaagaagcaagagggagggtgattgatgcattgcatcaagaagcgactatgtggatggataggttcgccttgaccttgaatggaagtcaagacctcccgcgtctactagccaaagcgaaagccatggccgaagacaaagccacggcaaccgcctccagtacggttagggaagcggagccggtgctgcaacccgctttaaatccgggccgagacagaaacacggccgtgttttgtcgaaggtatagtccgcaagcttatccttatggcttgcctccggacttcactccccgtgccactccggaagatttaagccaagcccctacttttgaggggcaactcccgncttatgacgactatcccgggcaggacgaatag

SEQ ID NO: 68070 - DNA, 1197 bp, Glycine max
  Peptide Sequence Number=SeqID_184848
atggtgtcttcaatgcgcttggccaccttctgcacctcctctactgggaagagggacgcgagtgaggtcacagaccccttcttcggcaatgacacttacttgggaccttcccacgcgacagctgtgcctttgacgctctcagcttttaaaaactatggttctgactcccgtcacctgttcgacgaaattcccgaccgaagcgtggtctcctggacctccatcattgccggttgcgtccaaaacgaccgcgctagggacgcggttcgcgtctttaaggagctgctggttgaggagagtgggagtgtggagtccgaggatggtgttttcgtggactcggtgcttctggggtgtgttgtttcggcgttttcgaagctggggtggagaggtgtgacagaaggtgttcatggattggtgatcaagaggggttttgagaggtgtgtgggggttgggaatactttgatggatgcttatgccaagtttggggagatgggggtggcgaaggtgtttgatgggatgaatgagagtgatcactatttttggaactctgtgattgctgagtatgcgcagaatgggttgtcagctgaggctttttctgtttttggtgacatggtgaagagtggcaactttagatataacgcggtgatcatggattggtctttcaggagctttgcagctggggaagtgcatacatcatcaggtacttctattgttgatatttactgcaaatgtgagagagttgagatggctaggaaggcatttgattgcatgaaagtgaagaatgttaagtcatggactgctatggttgctggttatggaatgcatggccgtgcaaaagaggctatggaaatcttctacaagatgataaggtctggggtcaagccaaattacattacttttgtgtcagttttagctgcttgcagccatgctgttgagaggatgaggatattgatgaagagtcgtggattgcttaaagcccctggatttagtatagttgaacttaaagctgcaagaacttgggtatatgccaaatgcaatatggtgcttcatgatgttgatgaggaagagaaaggaatggttctaagagttcacagtgagaaactggcagttgcctttggaatcatgaattcagttcctggcggtttcatcatttcaaggaagggtcgtgttcatgtggggactattggtgacagcaattga

SEQ ID NO: 68071 - DNA, 306 bp, Glycine max
  Peptide Sequence Number=SeqID_184849
atgacggaaggatatactggaagtgatctaaagaacttgtgcacaaatgctacttatcggcctgttagagagctaattcatcaagagaggctaaagagtctgacggtgcttacatcagtaccgtctttgaaagtacgcattcttagacggtgcttacatcagcaacgtcttagaatgtctattttcaaagacgttgctaaggtaaacaccgtcttagaatgcgatactttcaaagacggtgcttacctcaacaacgtctttgaaagtaggcatttaaagacgatgcttacctcagcaacgtcttag

SEQ ID NO: 68072 - DNA, 909 bp, Glycine max
  Peptide Sequence Number=SeqID_184850
atggagaataaagatcctaaatcatggagttctgctcatatctaccagtctcagtggcttcaaaccaccatatcagatttggatgagaaattggatgctatgaaaaccattttaaatggtgacaattctccaaaccaagaaagcatggattgcaaatggagaggagacctcatacagatgcttgatgaatttgggcaatcttaccgtgtattagccttagcatacaaccaattgaagttcaacacttctaatggtaccttcaattcaggatctttatcatcttctggtacatcaaataccatttgtgctatctgcaataaaagaccaacaggtaacttggaggataaaaaactcaacgagggctggaatcaccatccaaaatattctgcagagcattccaatatcaaatttgatggtagtaaccttggttttgatcaattcaacaagcaaggagatgaatgccgtgaattcttatcagctgacccatgcaacatgaaatttaaatcagaacttgaatgcagagacactcaaatggaagacagaatgaacaaaatttctaccacagaaaatgttcttatgaagattgaggattcggaattaaatcagagaaatgaagatccatcaatgatcaatttcaaatttgacaatatgtggtcaacgctgaagtatcaaattacaaaacttacagaggacaatatgcatcagttggtagagttggtccaaagaaatgatgaaaagagagaaaccattagaaggcttcaatttgaggtggaaacattgaagtgtgagaacaaggccctccagacttctttaaggcactccaatgctgattcagaatgtgatcaaccacagatatcaagagcaggaggaagatctatgggcaacctcttcagaggttgttctccatga

SEQ ID NO: 68073 - DNA, 1737 bp, Glycine max
  Peptide Sequence Number=SeqID_184851
atgttgccgaagttatcaaacttccagttcatctggccttgggaagagtgggcttatgtcctagacctcccaaggtgggcccctcaacgcgtctttgttcaggaggttttggagagggaagttcgcttgtcatactgggacaaagttaagcagttgccttgcaaggcaactcaccaccagaatcttgtatcagtggaattgtggtggaatcttgagttggagcataaaattgtgagcttggaatggcttacgcaatttcaccagaagtgggtatcgggttggattctcattttagtgttggtctcagccttttctcaccctctctgtttctacaagcccccaaccaaagccataatcagagcagagaagggagaacccactgtgctgttctcttaccctcatgctttggtctgccaggcgctgtggagcttacaacagaggggagacaaacagacggtggagcttgctgcagaggagagaagcttctcttctatcacatctagtagtattgaaaatgcacctggtttagaagaattgcttcctccaaagggtgggccgaactttagttttggtgcagaagatggtaaagaaagcaatgagcatgtactgtctggacagctcaacaacatggttaaaggaaaggcacctgtccgtgaaataatctcatggattgatgaaagtgtgtttccaagtaatggtctagaagttactctcagagtggttgtacaaacttttctcaatattggatccaagagtttcactcatttgatgactgtcttagagagatatgggcaagtctttgcaaaagtatgtcccgaccaggataagcaagtcatgctgatagctgaagtgagtgctttctggaagagtaacacccaaatgacagcaatagctattgacaggatgatgggttatcgacttgtttcaaatctggctattgtgagatgggtcttctcagcagaaaatattgagcaatttcatacgtcagatcgtccatgggagattcttagaaatgcagtaagcaagacacacaatcgtatttctgatctaaggaaagaaatattatctcttaaaaagaatttttcatctgctgaagaaactgcaaaggaggcaaaagcagagttagatgctgcagagtcaaaacttacactagtggatggcgaaccagttcttggtgacaatcctactagattgaatagattgaaattacatgctgaaaagacaaagaacgaggtggtgtctcttcaaaaatcttcagaagccaaggaagctcttcttgcccaagcaatggaggaaaatgagacagttttgcatatcaaacatatgtttaaagtgctggcattgtttctcttgttgtacaaaagcttctcaaacgtgttgatagagcgccttcctgaaggagctagaacactgcatgagttgaagtctgcacaagttgatgtggtgatggcagtggaccctgaagagccatcatcaatggaattagacaatgagagtcagagacctcaaaacagtcaaacaaatggcgagaagaaaggtggtgcttataatgtaggtgaaaaggagcagtggtgtatcatcactttgggttatgtgaaggccttttctaggcagtatgccgctgagatatggccccatgttgaaaagttggatgcagaggtattgacagaagatgcacctcttctttttcggtcatctgtttattctggtcttcgaagaccaattcatgacgcttga

SEQ ID NO: 68074 - DNA, 363 bp, Glycine max
  Peptide Sequence Number=SeqID_184852
atgactagtgaagaacccataataagagataatgctagcgacttcagtgacgatgagcaacaacacgatgttcatgaacatggagaaccaaacaatcaaagtacaatagtaagatacaaaacttcttcttcaatggaggatggcgaggatgagtctcctaaggtgattcttaatcgtgtattttggacttttaagtcatgcattgaaggctttcaatattgcaagtcaattgtgcaagtagatggaacatttttaactggaaaatatcgtggtattttgttgactaccattggacaagatggtagcaagaacaatttttcacttgcttttgcaattgttgaaagcgagaccaaagaagcttga

SEQ ID NO: 68075 - DNA, 225 bp, Glycine max
  Peptide Sequence Number=SeqID_184853
atggagtctcctccgactacaaagatcacattgttcgctttctattcttcttcttcttctccctttcgctctgaatcgcacgcgcctaatgtctcttctcttctcttctcttctgcttttgatttctcaggatacgtgctttggcgcccttcgccgcgagctcgacctctctcaatccgagattatggagtggaagtgctactcagtgttatggcctgtatctag

SEQ ID NO: 68076 - DNA, 858 bp, Glycine max
  Peptide Sequence Number=SeqID_184854
atgtcaggtcatggcattgacttggaaagtgtcaccttgcttactccctatggagctgtgttgtatttccttgcaaacccttctattttattccatttacttggaagttgcccacatattccaagatctcatctttcatttgaagctcagctggttgctgggaagtctcatgaatttgggccaatatgctgcccccgcttaccaagcccgccttcagtcccttctggcgtgtctattggtaaacagaagcatgaagcagaattaaaataccctcaaaggatacaccggctaaacatatttcctcctggatctacagcctatagacagatttgttatggaagagtatctcctagatgtgcttctgttcttaaatggctgctagtcgaaaggaatgtgcttctttcatggttggtctgccagtttccttcagatatgagtacctcatggctgaaacaatattctctcagagactcatgggtaaacagaagcctgcaagccatgagtgtgttggaaaaggccagacaaatagtgggtgtggctggtgaacagtcatggtgctgtgagcactgggtcattgtttgggttgaaacagagctgctgatgctaccacaaccacctttcaaaccagtatattacacactggttattattgacctttgtaaggctcttcctggagcttttcctgcagttgtagctggagcagttcgtactctctttgagaggattgctgatttggatatggagtgtcggacacgtctgatcctttggttctcacaccatttgtatgttcggaatcttagtaattgcattacaccatgcatcattcaagataatatattctgtgcatgttctgcttga

SEQ ID NO: 68077 - DNA, 276 bp, Glycine max
  Peptide Sequence Number=SeqID_184855
atgggtgccaagcacctcacgaggaccaaagaatggtcgcacgtcatcgagcaaaggtccccggacgaaattagggaacaaaaggtgcagaagactatgtcggcccctgcatgctatcaagcgttctgtcttacagatagcaaaagaatgggtgcgaataaccataagaatgaccaaacttggtctctgcgtgccatcggacacaactgtgtctacctagcaaaggggggtgcagataaccgtaaggtatctccgcgtatcatgggtgcagaatga

SEQ ID NO: 68078 - DNA, 324 bp, Glycine max
  Peptide Sequence Number=SeqID_184856
ggtaaaacagagcatgatcacaagaagctgcggcagcgcagtggctctatatccaaactaaacgaagacaagcctggtggatcacaatctccaagcaatcagactagaaagatctcacttacactgccccagtcaccaaaacttgggaggaaagcgagttctagttctagcacagttcaggacagaagcttaggaaattcatggaagcctcctatcagcacctccaaacgtactgcagaaaaaaactaccgaacagcatggcgaccagtaacttcatcatcaaataccacaagagaaaatgcttcaccaaatattcagcaatga

SEQ ID NO: 68079 - DNA, 1620 bp, Glycine max
  Peptide Sequence Number=SeqID_184857
atggataatggttgtttctcttccccaaagcgtgattttcctgctggtctgagagttctggttgtggatgatgatcctacgtggctcaagatccttgagaagatgctaaagaagtgcaattatgaagtgaccacatgttgtttagcaaggcatgctctaagcttgcttcgtgaacggaaggatggatatgatatagtgatcagcgatgtaaacatgcctgacatggatggttttaaacttcttgagcatgttgggcttgagatggatcttcctgtcattatgatgtctgtggatggggaaacaagcaaggtgatgaaaggtgttcaacatggagcctgtgattatctccttaagcctataaggatgaaagaactgagaaacatatggcagcatgtcttcagaaaaaagatacatgaggcaaaagaatttgaaagttttgagagcattcacttgatgagaaatggatcagagctatcagatgatgggaacctgtttgctgtagaagatgttacctcatcaaagaaaagaaaagatgctgatagcaaacacgatgacaaagaatgtttggatccatcatccaccaagaaagctagagtagtctggtctgtagatcttcatcagaagtttgttaaagcagtgaatcagattggatttgataaagtggggcccaagaaaatactagatctgatgaatgtcccatggctgactagagagaatgttgctagccacttgcagaaatacaggctttatttgagtaggattcagaaagaaaacgatcagagatcttcctcaagtggaatgaagcattcagattttccttcaaaagatatgggaagttttggttttcagaactcagtaatcaagcaacaaaatgatgttgcaattgacaactacaatcattcagatggatcattacaacttcagaatgtggaaactaaaagtcatgaagctgatcccaagggaattgtttcacagtccaccatagcaaaaaaaggaaggattttgactggtaacattgctgacacgaacatgagagagagtttaagggttggccttaatcaaacttttccccctctagagtcagaaggaaaccatgcagtgtttgattgttccatgccaacaccatactcttggactgaagttccacacatgcaactcaaagaagaacacaagtcacttgtttatttagaagatagcttcaatcagttgccattacatgattacaacaatgattatgccagttctgtgagttcaatagggaatgcagttgccacctttcctattcaaccaggaagtcttattatgaatggtcaatcttcagaacgcatttccactacaacttctggattgaaaacacaggaatataataatctcagtagcatttctgatcaggaaatttaccaaagaaaccttttgggatgtgaggcagcttctgcgtcattggacgaggacttgcatttctattggctagaaggcgaatgctataataatatgaactttggtctgcagaatataggaatgtctgaatattatgatccaggacttatttcagaagctccaatccacttatatgattcagctgattactcagttatggatcaaggtctattcatagcatga

SEQ ID NO: 68080 - DNA, 291 bp, Glycine max
  Peptide Sequence Number=SeqID_184858
atgcagcaatataaagcagtgcagttgacgatgaaattaatgaagaaggaaagaaaaggtaaggtatacgctgatggaatgccatctatttcctcaaaagaaaggaaagcaactataaaggaattttatgctgtcatatacccttcattaaggttacttcaaggcgagtttaataatgatcaaagaaacagttgtgcagaagtgagcagaaagaggcttgcaaaggttctcaataaagatctagagggagatgaagaatgtggcatatgcatggaaaacggcatgaagatg

SEQ ID NO: 68081 - DNA, 1551 bp, Glycine max
  Peptide Sequence Number=SeqID_184859
atgggtggtagtggagttagtttacttggagtttctttgaagggattatgtgcggtttgtttgttaggttttttgttgaatgctgatcccagaaagtgtgggtcaggggctttgaaggagaggttctttagcttacccttcctatcaacccagatattattaaagtatgcagacaccaaaagcaagttgtttggtgaaacaccaaatgaatcaatattgagatgttttttcatctgcatgcttattggcctatgcttgtctgtgagcagaactggtacttcagaagtgccccaaaggaagtctcctgcatctcctcagaatgctcgcaaattgaagacaccaggctctgataccgactcagtctcatcatctccaaaaccaggaagtaagacgccaaaaaatagaagtcctaaggtcacagaacgcaagtcaccaagaagtccaatatctgagaagaagcgaccaggtagggttcaagaattggagtctcaacttgctcaacttgaagaagatctaaagagaactaaagaccaactcaactcatctgagtcatggaagaggaaagctcagcaggaggctgaagaagcaaataagcagcttttagcggtatcgaaagagctggaggaatcccagcaacagcttctggaactatctgcttctgaagaggaacggcttcaagaactccgtaagatttctcaggaccgagatcgagcatggcagtctgagcttgaggctgtccagaagcagcactcaatggattcaactgctctagtgtctgccatgaatgaaatacagaaactgaaaattcaacttgaaagagtgcgcgaatgtgaagctgttcacattagcaatgctgagtcagataatgctgagattgaggatttgaggatggagcttgatgaagcactcactttagtggaaaagctgaaaagtgaggtaattgattgcaaagaatctgaatcccgggctttggaagtagttggcaaaactcaaatgcaattggaagcagcaaacaagactgtggaaacactccagttagaaggtgagaaagcatcagaagcttacaaatccttagctttagagttggagcaatcaagagctcaagtaaaatcattggaggaacttgtcagcaaacttcaggctgatttggttggtggtggtaacaaaaatatgttaggtcccgtcaatgaagcagaacttgaacttgcaccgaaaaacgtacaaaatgaggagataaaccatctcaaagccgagcttgtttctgccaaatctgaagcagtgcagttaaaatctgcactggacgtttctgaggtacgataccaagaagagtatattcggagcacattgcagatcagaagtgcttttgaacaactggagcatgcaaaatcagaatcttctcaaagacaaggtgaattaaatgaggaattgaagagagctagagctgatattgaagagttaagggagaagatgatggacaaggaatctcagttgcagggtttatcagatgagaatgagatgctcgtgtcaaggatcaggcaaaaccagtgctag

SEQ ID NO: 68082 - DNA, 5286 bp, Glycine max
  Peptide Sequence Number=SeqID_184860
atgtctgagaatcacgtagcagggcaggtttcggaagcggattcggattcgggtcatggtgttgtgcacgacgaatcaaatgtggataccgaatcaaacactgatacttatcaagatcagggagagcgtgttgatctcagagatcctgaagatggaaaatctacagaggattctgccagagatgacatgtttgttgattgccctgatgagttaaccacatttgatggtaggcaaaaggaggaggaagttgctgctgcgaaaaatgaagatgacggatcagaggaaaatgaagttatgcatcaacagcagagtcattttgataaattgggcaatggagtgggagatggttactcctcaggccagctagagaaagttgttgctcagaaggaaattattttgaaggaataccaggaagaaagacaaactgttactcaaggagtgcttgatctttgttgtcagctgaagactctcactggtcaacagaatgaagctgaagttggagatagggaagtgactgatgtttcattgagggagatgataaaggaatgtttggagtttgtgaagaccgcctcagaagaacagtcaaacagtgaaactactataaataatcttcgtgaacatctatctacaaaggaccgtgagatagaggatcttaatgcaaagcttgcccaattaatggtatctaatgaaagtatgcaagtttcatccgaagctcaacttgaaaaggatcgtaatgttgagattgtgatagataagatgatatcttctcttgcaacagttgttactcgagagcaagtattggatgattctattagtgggaaaatagtttatattgaggaaggcactatccatttaattgaaaagtataatcagattctttctgaaatttatcaacttgggcaatctttctctgaggtaggcttggatactaacgagcatgaatacgggaacatactcgctgatgctcgtggtgggttactggagctcaaaaaaaaggaaacagaattggttgaaaaactggctcatttagaagatgaaaatcagaaaatggttgatgagcttgacaagggaaaggtgatgataaggacattaaatactgaacttggaaatctgaaaatagaactcgagcaggaaaaggttaaatgtgctaatacgaaagaaaagctcagtatggctgtgacaaaaggaaaggcattggtacagcagcgagattcattaaagaagtctctggctgataaatccggtgagcttgataaatgtttgattgaattgcaagagaagtcagttgcactacaagctgctgaacttgctaaggaggagttgtcccaaagtgaaaatatggttgcatccctgcagaactcattactagaaaagaatgcagttattgatcaagtggaagaaatcttgtctcaggcaaaacctgatgaacctgaaatgtttgatatgccagagaaactaagatggcttgtggatgacagaaatactttgaaggaagccttcctagagctatgcaaattgaagaaagctctatctctagcggacctgccagagcctgtttcgtcatctgatttggaatcacaaatgaaatggcttacagattctttgctcagggcccatgacaacatgcatactctacaggaagaaatttccacaatcaaggaatcatcccgtaactatattgatcagcttagtgtttctcttttgctggcattgcaggaaaaagattaccttctgtcagaattaactgatttgaggttcaaatatgatgagcttgttagcaagaaccatcagatttctttggagaaggatcagatagtgcatatgttagtcgatctttgtggtctgaacttggaagatgaagggattgatcaaatctcttccagcacttatacgatcatcaatttatgctttaaagttatcaaaggacagagtggtcccttgtctagagcatcccatattgatgctgagttgtttgaaaggattcaaagtctcttgtatgttagagatcagggattaatactctatgaagatatactggaagaggagatgctaattagatcagatgtgaataagctgtcaaatgagttgaaagtggtatctgaggaaattatagcactgaaagaagaaaggagttctctgctgcaagatcttgagcgatcagaggagaagacttccatgcttagggacaagttgtccatggcagttaagaaaggaaaggggctggttcaagatagggacaatctaaaaggtcttctaaatgaaaagaactcagagattgagcagttgaaggctgatttgcagaagcaagaatctgcagtttctgaatacagggatgagatcaatagattgtccaatgatgtggaaagcatcccgaagctggaggctgatcttctggaaatgaaaagggataagaatcagtttgaacagttcttaatggagagcaataacatgttacagaaagtgatggagtgtattgacggtgttgctcttccagttgttccagtttttgatgaaccaatagagaaggtgaagtggcttgctggttatgtcaatgaatgtcaagatgctaaggtacacagagaacaggaattgcagctagtgaaggaaaatgccagtatacttgaaattaaattagcagaagcccaagcaactgtaaaatcccttgaacaggaattatcatcttcagatgacaatgtttctcaacttgctgaagaaaaaattgagttagaacatggcaaagtgaaagttgaggaagagttacagaaagttaaagataaagttgctgaagtttgtaatactactaagtcacttgaagatgccttatcacaagcagaaaaagaaatttctattctttccgaagagaaagagcaggctcaagttagcagagttgctgcagagagagagttagagatttttaaagatgaagcagccaggcaaacaagcatactggcagaggctagcaagaccattaaggatctagaagataaactatctcaggttgagggtaatgccaatttattgactgaaaagtataatgccgatcaagttgccaaaattgacatgggaaatgaattgaagaagctacaagatgaagcttcaaatcatgctagtaaactggtgggtgcctctggaactataaaatcactggaggatgcattattgaaggcgcaagatgatatttctgccttagaagatgcaaataaaattgcgaaacaggagatatcttcacttggctttaagttaaattcatgcatggacgagttagctggaaagagtggcagcttagaaaacaagtccttacagctcattggactccttaatgatcttcaggtgctcatgaaagatactactccatttcccggaattaaacaatgctttgagagcaaatgtgagacgctaaagaatatgaatctcattctgaacaaaataagagataatgttgccatgactgcaaaggattcaaagggacagcctgtgatggtggaaaatccacttgtgagagaaacattcttggacagccctgaaaattatgaagttgaactggacaatacagagattgatggtgctgacattgacaccataatctcatcatttggaaagattgtgaaaggatttcagtcgagaaacaaacacattgcagataagttttatgaattttcggattttatggatgagtttatttctcctctccatgaaaaactactggaaacagagaccatgtcaacgactattgttgagaacatggaaattatgaaaaaagaagcaaataccatggaaaaattgaaagaagaacaggaaaatactattgccactttagaaaacaatgtcagtgtattgctatctgcttgcacagactctaccattgcacttcagagtgaagttgacaagaatcttgggcagccaggctccatttccgaggttgaacagttaaaccttgaagcaggtgcacaaacagagcatcataagaacagcaaatacgtggaagccacacataagttgatgaatgcttctagaaaagctcaaactttgattgcacagtttggatgtagaagtgagcaagtggatgcaacaattgaagatttgcggaataaattgaaagaaacaactgttgcttttgaattagtcactgatgagagagacttgaataaaaacagagtttcacaactggagtctgatattcaatcactgcaaagtgcttgcagtgagcttaaggataagttagaggattatcatgccttggaagaaaaattagaggaaaaagaggctgagatttcatcaatgcacaatgctttgttggcaaaagaagaaaactccctctttccagcatctcaaatgagagatctctttgacaagatagataggatcaaaatccctattgtagagtccaaagaagatgatttggagccacatacttcagcccctatgagaaaactcttttatattattgatagtgttcctaggttgcatgatcaaataaactctctgtctcatgataaagaaaagctgcaatcaatccttgaaactagggatcttgacattaaggatctgaaggatgaagtcaaacaactcaatagaatctgtgaagactctaaaatgatcaagaatgaattgtctgagctcacctatgtattagaaaaaattatggatattttgggagctggtgaatgggttgtagataggaaatctaaaggttcgaaggaattaataccagcattggagaagcatatcattgccattctttcagaatctgaaaattcaaaatccaaggctcaggaacttgatattaagttagttggaagtcagaaggttattgatgaattaacgaccaaggttaaattacttgaagattcactccaagataggacttctcagccagacattgtacaggagaggagcatatatgaagcaccctcattacctgctgaatctgagataattgaagttgaagagggatcatcacttagcaagaaagcaatatctcctgtcccatcggctgctcatgtgcggaatatgcgaaaaggatctactgaccatcttgcactcgatattagtggggagtctgataatttgattaacagggtagataaggatgatgataaaggtcatgtattcaagtctctgagcactactggattcgtaccaaaacagggaaagctcattgcagatcgtattgatggactctgggtatctggtggccgggttctcatgagtcatcctagagcaagattaggacttattggctatttgtttgtcttgcatatatggctactggggacgatcttgtag

SEQ ID NO: 68083 - DNA, 447 bp, Glycine max
  Peptide Sequence Number=SeqID_184861
atggaggggcttgatttgttcctagtagcaacgaataccataggcttcatttgtgtgtgcagtgcccttatcaaatttctcaagtgggtatgggtggtgttcttgaggccaccaaagaatctcaaagagtatggttcatgggccataatcactggctccactgatggaattggcaaggccatggcttttgaattggcatctaagggacttaaccttctcttggttggcttggcttacccttatgctagattctttcatgaggttgatttggagcttatggatgctattataaaagtaaacttggagggagcaacttggatcacaaaggcagtgcttcccactatgatcaagaagaaaaagggagcaatagtgaacattggctctggttccactgttgtgcttccttcatatcctctagtcaccctctatgctgctacaaaagcgtaa

SEQ ID NO: 68084 - DNA, 972 bp, Glycine max
  Peptide Sequence Number=SeqID_184862
atgaagcctctaagcagtcgctgtcacatgaaagctcaatggaccatcccagttgtatccctccattcattgtatattgccattttggttggggttacagctgctgttcatcacatagagttcaggtttgatgaactcaaagacctctggcggggaatacttgtatcagctgtgtccattgctgtgtgggttactgcttacatactaaatgaaatttatgacaatatctcatggcttgaagttgcctccagatttctgcttttagttgtggctagcatacttgtggtggctttcttttcaatatcaagttcacaaccacttctctcacaaatcagcttgaggagaagagaatccagagaatttcgcacaatgagtcaggctctgggcatacctgatagtggggtattagcacaaagtgaaccaatttcaaggatagatcctaatgaaccgttggataagcttctcctgaataagagattccggctgtcttttatggcatttgctgatagctgcttggctggggagagtgtgcacttctttgatgaagtatatgagcttagtaaaatacctgaagatgactgtggcttccttcttttatccttggttttttccatgatgcccaggttttgccatattcaaaattgtgtggctatggaggtgaacatctctcatagaagcagacaagaaattttatcaacttccagcctcacacgccctgatctcttccataatgcacttaatgaaatcattcagctgatgaaaacaaatctagctcgagattactggtcttcaatgttcttcctgaagttccaggaagacaccaatgtaagatctaatgagtacgagctggagcaaatgaccgggtggaacttttctccaaggttgagttctgtgcatggtatagacgatccttttcaccaggaccatcttctgaagagctcaggctgtagcaatgatacaactgatttatga

SEQ ID NO: 68085 - DNA, 2369 bp, Glycine max
  Peptide Sequence Number=SeqID_184863
ggtttgatgaagaacctgatttggtgggtgtagggagtggtttggaggaaggagtgaaagttgttgatggagggtgtgatgagaaagaaagagaggtttcgtgtgggacggtgaagaatgaagatgagaaaagtgggattgaatgttcagatggagttttgtttgattatgggggtttgtttattgaatttaatgatggttttcagagtgagctggggtgtgagaaggctagtgatgttgctgaaaatggtttgccgagcattgtgtcgaataatgtgactcaagggggtgataatgatgcggttgagtgtgcgcaggaggaggttaagaacgatggtttggtgaatttaagcatggttgtggaggctgatggcgagaggaatgatgctgatagtttggttactaaaaatggcctggaagatttgcatgccacagaagttgcaacctaccaattacgggatggcattccatgtatggaaggtgtggatgtcattgctgaagaatctttgcatgtgaaagacttgtcaaggaattgccttgagctagaaccttcatgtgagttgaaacagccagcctttcaggtagatgcagatgtagatgtgatgcagaatcaaaccatggttgttgatgtttctgaagaactatttgagaatatacaaagtgagtgtcatggttttaatcttgttgtggatctgaattcttacagaagcacgcagaaggttggcatgtactggggatcagtgtcttcggaaatgaatttccgtgtgtctgatttagtatggggaaaggtgactggccatccttggtggccaggtcagatctttgatgcctcagctgcatcagcgaaggcaaagaggcatctcaaggaaggctgtcacctggtagcgtattttggggatcaaacctttgcttggaatgatgtatcaatgattaaaccatttcagatgcatttttcgcaaatgaacaagcagagcaattcagaaaatttccaccatgctgttgattgtgctttagatgaggtctcaagacgggttgagtttggtttatcctgcccttgcatgcctggagatgtgatttctaagattaaaactcaagtaattagtaatgctggaatcaataatcagttgtgcagaagaaatggaggggacaggattatgaacccaatgtcttttgaacccatgaaacttgtcaattttgttaaatcattagcccagtctccacttgttgaatctgataggctggattttgtaattgcacgttcccaattgtcagccttctattgctcaaagggttattctcaactacctgagttcccagtgcttggtgggttgttcgagaatgatatggaaactctattcttgaaagggaaagagcaatgtgattatcaaacccatgttggttatacacaacaggagcacaagcacatctcgggggatgaaaagcggcgcagtaagaaaaaaaaacttttgtcagatttgatgtctgagaagggcttctgtatttcaaatggtgaaggcacatcagaacaggaggctaagtcagttccacggcgtcgtgggaggaaaaggaagtcagcttacaatatttcggaagattatttccataattccctaaatagaaggctcttccaatttcagcatgcttctacaaatgacatgaggtctcaactttgtttggctgccaaggatccaattggagaaagttgctctagtgacatggtacatttctttgcagaatttcgaaaatccattagcattgattattctgcttccttggatcaagaaatgtctttggaacaaatgcatgatggtgagaccggagtaacttctataacagcattgacatctgaaatggagccttgcagtgattcttattggcctgatagaataattcaaagcattcctgaggaccaatcattgacaaaataccagaatgagagagccatttttttgcctgagactctaacagaggctaatgatagaaatcttggatcagaatcttctaagcttgtggaacatttggttgggagttctcaagagggcttctgccccactgctctgactctgaaattcacaaacttggattctgttccttcaacaaccgatctcaacaagatttttgcccgtttcgggtcactgattgaatcaaagactgaactgctagagaggactaaccgcgccagagtggttttccaaagacgatcggatgcagaagctgcttttagtagtgctggaaaatacagcatatttggaccttcacttgttagttatcgcctcaagattttgcctcgtaagccacaacaaaagggtacagtaaagcgaggcagaaaaagaagagaaacaagttctgtggatggcgcagcagtttga

SEQ ID NO: 68086 - DNA, 3243 bp, Glycine max
  Peptide Sequence Number=SeqID_184864
atggcgactcccaaccctaacgtcgttttcatagacaccaacctcgatacccacttggccctcgtcgtttccgaccttgacactgtctccgacctcaaaaagagtattctgtcggaacatcccttatgctttccgaaaattgggcaagttcagattcatggtataaaggttgagcgcaaggggtacttttaccaccttacagattccatgcccgtgagaagtgccttcaggggcatcaatgggagctggtttctcagtgttgatgtttctgtgttgagggagtgttctcagaatgagcaattattttctcacggttcccctaaccaggtggccactcttggcattgcaaataatgctttgattgtgggttctccatccaagagggtgtccacctttgaccatttcaagttgcctcagttggagaacagacaaaatgaagaaattcatgttgctagtccatgtgtttcaaaacataccggcaaaggagttaaatcgtctgctgacaatgacatggaaaccccattacctggttctgttcatgagacagaggaccattgctttgtaaatcgtgaactgccaagtttaaatattgagtgcgaagtagatggatctggtaaaggcattaaggatgatcataatgtatgtgaagagactcctgtgtcaagtgcaaagaaaaaacgaaagaataaaaggaaaaaagaagacacagcgcaagatgatactgctgtagacaatgctcttagttttccatccaaaagggcatccggtgcaaataatgaacttccaggttcacgtattgaacacgaggtagatggaaccattgaaggcattaaggatgcttgtattgtacatgaggagggaaattgtaaatctgtatcaaatgtgaagaaaaaactgaaaggtaaaaggaaaaaattaggcacgttgcagcatgacacttcaaaagtaaatgatgcttctgttgttggatctggtgattatacaattcagcaggatattgaggtcatagcaaacccttcagaggatgcagataaagaagtaactaaggaaactgaaattttaaaggagcatcagcacactgattgcaacaataataacactaagaatgacattgatgttgctgcatctgcaaataagaagcataggaaaaggaagaggtctttggctgttgattctaaagaaatgttcaaggtagagacagcaattcagcaggatgaagtgcataagtctaatgaagcacataaggaaaagaaagaatcaaaagagcagtttgaacttaaaaatgaaaaatctagggatgatgttgaatataagcaagatcaggtaactgaagacattttaaatactggacctcctgcaaagaaaaagaggaatggcaaagagaaaagtgtagaagtaattttgtccaaggcaaagttgattaatcatttcaatggagacaatgcttctcaccacattttggaggatcaacagaagattaaaaacagcaatgctgaccaatcagctaaacattttgatgacacagatccaccaagaactagtgtgcagggtaggaggaagaaagggaagataaattcatcaaatcctcatgaaacacctgtagttacttcttccaggaaaggtgaagaagcagattgttccagcattcaaagaggtgttcaggaggaaatatctgaagatgccctatcatctaaagataatagtatgagcaaagctactattgacaacatggagactggaacagatgcatgcaaagaaggctttcaatatacagaaagagcaacaggatattataagaaccattctgacattgaaacaaatgcacacatagctgatgtggatgagcctatggagctgacagagaatagtgagaatgttgtccttgatcaatgtcataaaaatgaagctggtcagattgagggagctgaggaaggaagagaattatcaccacaaaatgattctaagttagccctgttggaaaagtccacatcatccagccaggataaaacagatgcaaacatcagagaattaaatgtgacttcaaaaggtgtggatgccaatggaatgactgaacctataaagtcagagaaggaaaaaagaaggatgagaaaagctaagagttcaggtggagggtctgcacttagagaaggtattggccttgtggatgcttctgagagtgaaactgttattatgaaatctcttagtgcaaaaaattgtgatcctatgtcaggaaatacagagacagaggataaccctttaaatcaaacagaaggggaaaaaattcatcaggagaaagtacaagggacttctgataaggaagatgattttggtgttgataatgctggttccttggaacaaattacaactaaatctaatgaacgcatggacaagagacagagaaagaaatcaaacgacaaacagacttctacctcaaagatcatatcaagtatgctaacaaaagataaagttcttgatagtaagaagccatcaccatcttctgacagtggaacgcatggcaaaccttcagttgcagtgacaaagaaaagtaaatctacaagcacaaagtccactaacaaatcaagcaaaacaaatttggaactggtggaagagtctgttagacttgaactttctgattctcgatttaatactgggggtaaagatgctgcccaacaatcaacacgctctggagagaaagatgatgataacttggaagcaataaatggacaagctcatgctgaggatttaagctcctcacagcaattattatcaaaggaagagcttgatgtaaggagtcacccttgtaagaaggttccaaatgtacacagggctggacaagattcaaaattgtctggtaggtctgacagggccatgtccttatttggagaaaacagaaaggctcatgtcaatgcttctgggaaaagtatggatttggagaaacgaagaaaacatgttcctgtatcaaactcaaagccggaaggttccataaaaatggttcaaaataaagcaggaaaagcttctgggaacaacattcatggagttgcaagtaaaatacaacagaagaagagcttgttatcaggagcaattttcaaggatgatagtagcggcacctctgtagatgaagttgataattctgatgccagtactagaactccatcatataatccactgttgtctgatttttctgatggggatagcagttcaggtctggattcacaagtagatggtatctgtaatatattttaa

SEQ ID NO: 68087 - DNA, 189 bp, Glycine max
  Peptide Sequence Number=SeqID_184865
atgggtgatcaagccacaagcattttccaccaacttcagtgttttaaagactccttgacgtttcagattctgaaggctcgcttagcaagagtaagtgacttttggcttagcgagctgggcgtgctaagtgcgagaagagacaaacaactcgttgggcgagctggcggcacgttgggcgcatgcatttga

SEQ ID NO: 68088 - DNA, 1641 bp, Glycine max
  Peptide Sequence Number=SeqID_184866
atggatgccacaaccagcggaaccccaactgtccaataccataacatccctgaccagccaattactgccattattgccactccacttccaacatttcaaaggcagcaacgccattgctttggggactccactcctggagagtttcccttgtctgctaatccctccattgtccttcatgtcctcactgcatgcaatttggaacctcaagaccttgctaaactagaggcaagtgatactatgttttgcttatgtgaacttgcaacatgctccttcttcaggcagccggcaaactttgctccggatttggacttgtccttatccgagctcgccgcactcgacatgtgccagaagagagccatcttcaagccaatgacaactgaacaacgccaagatttgaagctaaggtgtggaggttcatggaaactggcgctgaggtacttgatggctggagaggcatgttgcaggagggagaagtctcaggctatagcaggtcctggtcacagcattgctgtgacatcaaaaggggttgtttattcatttggttccaacagttctggacaacttggacatggcaccactgacgaggaatggcgacctcgaccaataagaactttgcaaggcattcgaattatacaagctgctgctggggctgggaggacaatgttggtcagtgattctgggcaggtttatgcatttggaaaggactcatttggggaagctgagtatggagttcaaggttctaaaacggttgcagctccacagatagtggaatctttgaaaaacatatttgttgtccaagctgcaattggtaactttttcacagctgtgttgtcaagagaaggcagggtttatacattttcttggggcagtgatggcaaacttggtcatcacactgatcaaagtgatgtggaacctcatcccttgttaggtgctcttgaaaacataccagtagtgcaaattgctgctggatattgctatctactttgtctggcttgtcaacccagtggaatgtcggtatattctgttgggtgtggtttggggggcaagcttggacacggctcgagaactgatgaaaaataccctcgtttgatcgaacagtttgggctgctgaacctccaacccatggttgttgcagctggtgcttggcatgctgctgtggtggggcgggatggccgtgtttgtacgtggggatggggccgatatggttgcttggggcatgggaatgaagaatgtgaatcagtacctaaggtggtggaagcattgagcaatgtcaaagctgttcatgttgcaacaggagattacacaacctttgtcgtgtctgatgatggtgatgtgtattcatttggctgtggagaatctgctagtcttgggcataatgctgctggaaatgatgagcagggcaacagacatgcaaatgtgttaagtccagagcttgtcacttcactgaagcagatcaatgaacgggtggtacagattagtctaaccaattccatatactggaatgctcatacctttgccctcactgaatcagggaagctgtatgcatttggtgccggagacaaaggacagctaggaattgaacttgttgctaaccagactgaaaggggaaatccagaaagggttgaaattgatcttggttaa

SEQ ID NO: 68089 - DNA, 468 bp, Glycine max
  Peptide Sequence Number=SeqID_184867
atgttgtacataacccaaacaatcgcaggtgtaaccacaataagcaaaagctgtcccctgttgtcactggcggcagcatcagcaatcacagcaatctcactagccgatgcatctgagccaaaaagcatgcccgatgcgcccagcccgagcccaagcccaatgatgaccccccttgctgctacgcatgcggttcagttgcaatttgcgacgcagccaaggctgcgtcacagtttgcgagtgagggagaatattgcgcctgcaatggcagtgcctgctgtggaagttgagacgttggagagggagagtgtgggttttgaaggtgggagcttgggattgttcgacttgggtgatgaccctgttattgggttcaaacacttggagtttatcatagccattgttgctgctatggttgctgccattgcggaacatgaacgtgcagagtgcagagtgccgaggcagagacaatag

SEQ ID NO: 68090 - DNA, 1605 bp, Glycine max
  Peptide Sequence Number=SeqID_184868
atggcagctctgttaccttgcgcgccgaacgtagtctctgctcccttggggaaccggagcacgtgccacttcccgcaccgaccttactcccacgctttctccggttcgaccgccagacactttcttcgcggttcgcttaccgtcgcccgcttcgggttccaacccggtttcttgcccgagccggacgaagctgaaggtgttctcagagaactgtttggccgagcggagggacttctttacacgattgccgatgccgccgtttcttcttccgatactgttgcggcttccaccaccgccaaacagagcaacgactggctttccggaattgccaattacatggagaccgttctcaaggtactcaaggatgggctttctgctttgcatgtcccgtatgcttatggttttgcaattatactgctcacagttcttgttaaagctgccacttttccattaaccaaaaaacaggtagaatctgccttagctatgcgaactttgcaacctcaagtaaaggctattcagcagcaatatgctggcgatcaggagagaattcaacttgaaactgctcggttgtataaactagccaacattaatcctctagcaggatgcctccctacacttgcaacaataccagtgtggattgggctatatcgagccctttcaaacgtggcagatgaggggctccttactgaaggtttcttctggataccttctcttgctggtccaactacagttgcagctcgtcagaatggcagtggtatctcttggatttttccttttgtggatggtcaccctccccttggatggtcagatacattggcttacctggtcttgcctgtgttgctgattgtctctcagtacatctctgtccaaataatgcagtcatcacagccaaatgatcccaacatgaaaagttctcaagccttgaccaaggtccttccattaatgattggttactttgctctctcagttccttctggtcttagtctttactggttaacaaataatatattgagcactgcacaacaagtatggcttcaaaagttaggaggcgctaaaaatcctgtaaggcaagtcccagatgatatcatgaagaatgacctaacacaggttcagaagtcaatatctaagctaaattccacaaaagcggaagaagccagacaaagtgagaaaacatcagaggggccacaacctggtgaaagatttaagctaataaaggagcaagaggcaagaagaagacaacgaaaagaagaagaaaggaaagccttggaagcagcggctagaaaagctaaaatagacgagacatttgagaaaacagttgaagagggaaatcaaactggaggtgatctagttgttgaaaaatctcggtttgtggcttcagatactgatccctccatatctggagtagtaaatggtaatccattaagtaaagacttggagggaaatcagaattctacgtctatatctgagacagaaaataatgatggttctgctcatttcaacaatgttgagataaacgagaaaaatttagacaaggaaccaagagaagtattaacaactacaaccgccacaaacaaacaacctcctgcagaagagacaaaggattga

SEQ ID NO: 68091 - DNA, 1026 bp, Glycine max
  Peptide Sequence Number=SeqID_184869
atggaatgctgcataatcgccaggctcaagacccaacctttatggttcgcgctgctcttcgttgtcggattgttaacgattctcaaattggctttcgttgttttcagatgggtctacgtcaatttcctccgaccaccgaagaatctcaaaaagtacggatcttgggcagtggttactggacccactgacggcattggaaagagcttcgctttcgagctcgctcgcaagggcctgaacctcgtccttgtcggaaggaaccccgacaagctcaaagacgtgtcggattcgatcgcggcgaagttcagaagaaccgaggttaagaccgtcgtggttgacttctccggggatctggacgagggcgtgaagaagattagcgaagcgattgaagggttggaagttggagtgctcgttaacaatgtgggagtttcgtatccttacgcgaggttcttccacgaagtggacgaggggcttctcaacaaccttattaaggttaacgttgttggaaccactaaggtcacgcaagctgttctgccagggatgctcaggagaaagaagggggcgattgttaacattggttctggagctgctattgttattccttctgatcctctttatgctgtttatgccgccaccaaagcgtacatcgaccagttttcgagatgtctctatgttgaatacaagaagagtgggattgacgttcagtgtcagacaaaactgaacggaaaagaatcccctttactctatcactctatgctttttcagttaaggcagattccattatatgtggcaaccaagatggcatcaatcaggaaatcttcattctttgttccatcaacagatggctatgccaaagcaggtgtgaaatggataggctatgagcctcgttgcacaccatactggccgcatactcttctttgggctgtggcattctcattgcccgagtttgttgttgatgcttggcgcctgtggttttgcttgggtattcgaaagaggggacagcgcaaagagtccatgaagaaggaataa

SEQ ID NO: 68092 - DNA, 294 bp, Glycine max
  Peptide Sequence Number=SeqID_184870
atgggtcatcgacctcaccaccgattgcctttcacgaagtctgagatctcgtcgagaacgacgacgagtcctcctcctctttcggcttcccaaccactcccatggcatggagcctctagaggtgccctcgcattttgtattctgtttcatcaaaagtgggtctgtgcaacaatgttgatggtgaagatgccaaaattgccacttgcaatgtttacggaaataccgccgtcggaaattccctctggcggtggcgagcagtggttgacggcagaagtgttgggggagaaagtttga

SEQ ID NO: 68093 - DNA, 1218 bp, Glycine max
  Peptide Sequence Number=SeqID_184871
atggaaattccaattccaattccactctcatctatgttactctttctacttcttgtaccttgctgcatttgctcttccccacttcaagatcctgaactagtggtcgaagatgtacaaaagagcattaatgcctcaaggaggaacttagcatttctttcttgtgggacggggaaccccattgatgattgttggagatgtgaccccaattgggaaaagaaccggaagcgtctggcagattgttccattgggtttggtaaacatgctgttggaggaagggatggaaaactatatgtggtgactgaccctggtgatcaccctgtgaaccccaagccaggaacacttagatatggtgtgatccaagaggagccattgtggatcatattcaaacgtgacatggtgatcaagctcaagcaagagctaatgatgaattctttcaagactattgatggtagaggagtaagtgtgcacattgctggtggcccttgcattactatacaatatgtgaccaacattatcattcatgggattaacatccatgactgcaagcaaggagggaatgcctatgtgagggactctcctacacactatgggtggaggactctctcggatggtgatggagtgtcaatctttggtgggagtcatgtttgggtggaccactgctctctctccaattgccgtgatgggctaattgatgccatccatggatccacggccatcaccatatccaacaattacatgacccaccataacaaggttatgcttttgggtcacagtgacactttcactagggacaagaacatgcaagtcaccattgcctttaaccattttggagaagggctagtgcagagaatgccaagatgcaggcatggatacttccatgtggtgaacaatgactacacccattggagaatgtatgccataggggggagtgctgccccaactatcaatagccaagggaatagatttcttgctcccaatgacaataccttcaaagaggtgacaaagagggagaattcaccacagagcaagtggaagaattggaattggaggtcaaatggagatttgatgttaaacggtgcgttttttacggcatctggagcaggcgcatcttcaagttatgcaagagcatccagtttggcagcaaaatcatcttcacttgtgagttctataacagcatcagctggatcacttagatgcagaaagggttcacgctgctga

SEQ ID NO: 68094 - DNA, 2123 bp, Glycine max
  Peptide Sequence Number=SeqID_184872
atgaacgccacactcttacaacccccactctctcccttccaacgcgccaccaccacaaactccccggaaccccgcgaccagaagcttctctccctccttcgagaccgcaaaaccgaagaagcctggctcgcttactcccactccacgcacctccctaaccccacctgcctcagtcgcttggtctctcagctctcttaccagaacacactctcttctctcacgcgcgcccagtccatcgtcacccgcctccgcaatgagcgccagcttcaccgcctcgacgccaactgcctcggcctcctcgccgtctccgccaccaaggccaaccacacgctctacgccgcctccctcctccgctccatgctccgctccggctacctcccccacgttaaggcctggaccgccgtcgtcgcctgcctcgcctcctcccctgaccgcggcgatggccccgccgaggccctccagctcttccgctccgtcacgcgccgcctccgccggctccccgaccccgccatggccgccgcgtcgcgccccgacacggccgccgtcaacgccgcgctcaacgcctgcgccaatttgggtgatcccagggccttcttgcaggtgttcgatgaaatgccgcagttcaatgttgcccctgatgcgttgagttataacactatgattaagctgtgttgtagaattggtagaaaggacttgcttgtgtttgttctggagagggttcttcagttggagattcctttttgtgtcaccactttgcagtcccttgtttctgcttatgttgagtttggtgatttggaaactgctgagaaattggttcaggcaatgagggaagaaaggagggatatttgtagggtgctgaaggagtgtagcaatttagagtattcgagtggtaatgaatcaagtgatgatgatgatgatgatgatgatgatgatgatgatgacaatgattgcatttttgagaagttgcttccgaatttggtcgatcaaagtggcaatgaggttgaaccacccttgttgccaaaaggttatgctccaaacactaggacttacaccactctaatgaagggttatatgaatgcaggacgtgtgagtgatacggtgaggatgcttgaggcgatgcggcggctggatgataagggtagtcaacctgatcatgtttcctacaccactgtggtttcggcacttgttaaggtgggtgccatggaccgcgctcgtcaggttcttgctgagatgaccaggattggcgtgcctgcgaatttgataacttacaatgttctcctcaagggttattgcaaacagctgcagatagataaggcaagggaattgctcaaggagatggttgatgatgcagggatacagccggatgtggtgtcttataacatactcattgatgggtgtatactggtggatgacagtgctggggctctttccttctttaatgagatgagagcaagaggaatagctcccaccaagattagttacactactttgatgaaggctttcgcatactcgggtcagccgaagcttgctcacagagtgtttaacgagatggacagtgaccctcgggtgaaggtggatttgatcgcgtggaacatgttggtggaaggatattgcaggttggggttggtggaagaggcgaagaaagtggttcagaagatgaaggagagtggatttcaccctgatgtgggcacttatggcagtttagccaacggaattgcattggcaaggaaacccggagaggcacttctgctttggaacgaagtgaaggagaggtgtgaggtgggaaaggaaggggggaaatctgattcttctgttcctccgttgaaaccggatggagcgcttttagatactattgctgatatctgtgtgagggctgctttctttagaaaggcattggaaatagtggcttgcatggaggagaatgggatacctcccaacaagaccaagtttactagaatctatgtggaaatgcattcaagaatgtttactagtaagcatgcttcaagggctagacaagacagaagagtagagaggaaaagggctgctgaggcgtttaagttttggctgggtttgcctaattcctattatgatggaagtgagtggcggttagaacctatggaagg

SEQ ID NO: 68095 - DNA, 2187 bp, Glycine max
  Peptide Sequence Number=SeqID_184873
atgactacactgaggattttcatactgttgacccattttcttctgtgcattccattgaaagatatctatggccaaaggacttctgacatgatgacagatctccctgaaacacagatggaagaggcaaagttgtcacagcctagacctggtcaagcagtcaatgagaatgctggggaatcatcatcctctggaactcagggttatgctgaacaggaactgcaaatgaatacagaaccaaactcaaaactagaaaaacagcatcctgcatcttgtagcaatgaagctggtcaaaagcttgatttttacctcgaaggacaacacctggatcataaattgactctatatcaggcaattcttcaccatataataaaaaaaaatgcagattctttttctagtgcaaaactgtggagtcaagtgcacataataacctatagaagggatgtagaatctgaggatgtaatacctccagaatgtcattcttcaccccagcatttctctgatgaaaaagttttagcttattatcagcatactccttttttctcagacatgttctcttgtgaactagtttctgatttggagatgtccagtccaatttatgatattttgtttcttcttaaaagcttggaaagcatgaacagaattatatttcaccttatgtcgcgtgaaagaatttgtgcttttgcccaagggaaagttgataacctggatagtctaaaaataacagttccttctgtcccacagattgagtttgtaagcagtaagttgacagagaagctagagcaacagatgagggactctttggctgtctccatttgtggtatgccattgtggtgtaatcaattaatggcttcatgtcctttcttatttagttttgaggcaagatgcaaatacttcagattggcagcatttggtcagccacaagtccaaccttctcacaacggctcaggaacagtaagtgacaggcgactgagccctggtggattgcctcgaaagaaatttttagttcatcgcgaccggattttggaatctgctgcacaaatgatggacctgcatgccagtaataaagtggttcttgaggtggaatatgatgaagaagtgggcactggtcttggaccaactttggaattttatacgttggtgtgccaggagttccagaaatctggcttggccatgtggagagaagatgattcttcctttaccctcaagacaaacttgcaggctgaggaaataggagttcattccttttatggactctttcctcgtccatggtcatcaatgcaagatacatctggtggcatacagttctctgaagtaacaaagaattttttccttctaggccaagttgttgctaaagcacttcaagatggaaggatcttagatcttcacttctcaaaagctttctataaacttattcttggaaaggaactttctctctacgacatacaatcctttgatcctgggcttggtaaggtgctacaagagtttcaagcattagttatgaggaagaaatttatggaatctgtcagtggagggaattccgagttgcaatatggactaagctttcgagatatgagcattgaagatctttgtcttgattttactcttcctgggtttcctgatattgttcttgcttcagggaccgatcataccatggtaaatatgagaaacttggaggattatgtttctcttattgtcgatgcaactgtgaggtctggagtttcaagacaagtggaagcttttaaatctggctttaaccaggttttctccattgatcatcttcggattttcaatgaagaagaacttgagcgaatgctttgtggagagtatgactcttgggctgtcaacgagtttggagatcacattaagtttgatcatgggtatactgctagcagtcctcccattgttaatttgttggagattgtccgagagtttgataatggacagcgacgagcatttctgcagtttgtgacgggcgcgcctcgccttcctccgggaggattggcatctctcaatccgaagttaactattgtccgaaagcattgtagcaaccgggcagacacagacctacctagcgtgatgacttgtgcaaattatctcaagctgcctccgtactcatcaaaagaaaggatgaaagagaagctcttgtatgccataacagagggtcaaggatctttccacctttcataa

SEQ ID NO: 68096 - DNA, 2064 bp, Glycine max
  Peptide Sequence Number=SeqID_184874
atgggaagtcgaggccaaaagcgtcctgagatggttgatgaactgcctgctgataagcgggcgtgcagttcattggattttagaccaagtacttcaaactcatcagttcaaacccagatgaattcaacagtggaggcgcatgatcatgacatggatacttcctcatctgcttcggcttcgagtcaatcagagggagagccagagaaggattcggcttatggatcgtgtgattcagatgacatggagcagcatcacagcactctccatgaatatcacaggcagagactgtccagtgatcatgggaaatttaaaactattatatctagcttgagtggtctgactgaaccctctcttcaattagccgtactaaccgaactttgtgaggttctgtcattttgtacagagggttcaatctccagcatgacttcagacttgttatcaccactacttgtaaagctggcacagcatgagagtaacccagatataatgttgttttccattagggccatcacctatatctgcgatctgtatcctcgatcagctgcttttcttgttcgtcatgatgctgttactactttatgtcaaagattattggcaattgagtatcaagatgtagctgaacagtgtctccaagcattggaaaaaatatcacgcgagcaaccacttgcttgcttacaggctgggacaattatggctgttctgaactatattgacttcttctcaacaagcacacagagagttgcacttgctactgtggtgaacatatgtaagaagcttccttctgaaagcccttcacctttcatggaggcagtgcctatactgtgcaatcttcttcagtatgaggatcgacaggttacacatcttttaagtttaaatggtcagacatcgctatctccattaatatacaatggattgataggattacttgtcaaactttcatctgggtcacttgtagccttcaggactttatatgaactcaatataagcagcatactgagagagatattatctacatttgacctctcacatggagtatcaacttcactgcttgttggtggacactgtaatcgggtatatgaagcactcaaattgctaaatgagcttctccctgtccgggctaaagatgagaatgatcaactcatgctagacaaagaatcctttctagataatagcccagatcttctgcgaagacttggaatggatgtgtttcccatgttaatccaggtgttcaattctggtgcgagtttatatgtttgctatgggagtctatctgtaatgtacaagttggttagtttgagcaaatctgacatgcttgttgcattgcttaagaatgccaatatttcaagttttttggctggagtattcactcgaaaggatcaccacatgctaatgttagcattacaaattgctgagataatccttcaaaatttttcagatgatttcctaaagttgtttgtaaaggaaggtgtcttttttgccattgaggcactattaacaccagaaagatcttcaaagttgatgtacccagcatttggtggcattcagctgtcattggactctagtcaaaagtcttcttcaagagatgccctcaagtgtttatgttttgcattttcaactggccaatcccctacatccttagaagccagaaattgcaaactggacaaagactctctctataatcttgcaacgcatataaaaaacaaattcttagcaccagaattatttgattctgagaaaggattgactggtattctacagaatctcagagcactttctaatgatttgttgagcatgtctactgacagtggtgctcttgctgtgcatgaagagaagatcaataatatattatatcaaattatggacaagcttactggcaaggaacaagtttctacttttgaatttattgaaagtggagtcgtgaaatcacttgttaattgtttatctcatggtcagtatatcaggaaaaaaagagagtacatggtgtttgtattatatcttgtcatagaaaaacgatttgaggctttggctagtgtatgcttatgtgctctcagctctctcaggtga

SEQ ID NO: 68097 - DNA, 960 bp, Glycine max
  Peptide Sequence Number=SeqID_184875
atgggactcttaatcatccagagcaattcgatcacaatccgaggattacatgtagtgcaagagattatggcattttcattcacatttatgttccagttcttgcttcttgccccatctgtgatctatgcttctccagttcaagaccctgaattagtgatccaggaagttcaaaagagcatcaatggctcaaggagaaacttggggtatctttcttgtggaacggggaaccccattgatgattgttggaggtgcgaccccaactgggaaaggaaccgaaagcgtctagctagttgtgcaattgggtttggtaagcatgccattggtggaaaagatgggaaaatatatgtggtgactgaccctagtgataaccctgtgaaccccaagccaggaacattgagacatggtgttattcaacaagagcctttctggagtgcaagatcagacggtgacgggatcacaatctttggtgggagccatgtttgggtggaccattgctccttgtcaaactgttttgatggcctcattgatgttgttcatggctcaacggccatcaccatttccaacaataacatgacacaccataacaaggtcatgctcttgggccacagtgattcctataaagctgacaagaacatgcaagtcaccattgccttcaaccattttggagtaggactagggggaagaatgccgaggcagcagcttgatttaatttcctacacaaatttgcagatgcaggtgaccaaacattttaaatcatcaaagagtgagtggaggaaatggaattggaggtctgaaggagatctaatgctgaatggtgccttcttcacagcttccggggcgggggcaactgctaggtatgataaagcgtcaagcatggcagcacgaccacctatgcttgtggtttccatgacagcaggggctggagcacttagatgcaacaagggcaatctatgccactag

SEQ ID NO: 68098 - DNA, 1620 bp, Glycine max
  Peptide Sequence Number=SeqID_184876
atgggagaaaccgggatcattgtcagcttccagggtaacttagacccgagagcagaggagttcagacccctcaatcttcaatgccaatggtatcctcttcctcttcccacacccctctccacctcctccacccgctccctcctcctcactccgctcccattcacctcccactccgccctccgcgcagaactccaggccttcggcgacatcagagccctccaaaccgactccctccgccacggcatcctcaccgtccacttcttcgacctccgccatgcagagtccgccttcgccgccatccgctccatgcacctccatttccctcaattcctcctctcggcccaccccatctccgcccactacgtcctcccttcctccaacgccttccccgacgcccacaaccaaggcaccctcgtcatcttcaacctccaccccaacctctccaccgtccaactccgtcgtctcttccaacctttcggtcccataaaggaattgagagataccccatggaaaaagaatcagagatttgtggagttcttcgacataagagacgccgccaaggccttgaagcacatgaacggcaaggaaattcacggcaaacaggttgtgattgagttcagtagacccggtggtcacacccgcaagttcttccatcattctcctccttccgaaaccacacctttcaacgttcctccgccaccaccaccgtttcctccttccccgcgacgtcgttttgctgctcctcgcttgcattcctctcaaaagaaatcaccgggaagccacaagagtacgggatctattgatgcggaaatgggatcaatgagtttgaccggagaagttgaagttcagcattcttcacatggccccacacagaggaatcttagcagaaagcacaattgcgataccactgtagtagtaggaaccaccaccaagcagcagcagcagcaacaacaacaacaacaagtacctagaagtaggcactggaagggaaaacaagcgaagaaacaagaaactaggtttctaatcaaagagggtgccattgtagaatctggtcccaaagatactagaactactgtcatgatcaaaaacattcccaacaagtatagtcagaagttgctattaaacatgctggataaccactgcagacactgcaacgagcagattgcagacggcgatgagcagcagcctctatcctcctacgacttcgtgtaccttcccattgatttcaacaacaagtgcaacgtgggatatggttttgtgaacatgacttccacggaggcaacactcaggctccacaaggccttccatcttcaacattgggaggttttcaattcaagaaaaatctgcgaagtcacctatgctagagttcagggattggaagcattgaaagagcacttcaagaactcaaagttcccatgcgagatggagcattacttaccagtggtgttttcgccgcctcgagatgggaaagaactgacggagccacttccaatagtggggaacaagcaacaacaacaagccatatcaagtggcggcggcggcagcggcagcgtaggtgatgatgatgagacaaatgaagaagtgggtagtagtgttgtgattctgaaagacagcatttaa

SEQ ID NO: 68099 - DNA, 108 bp, Glycine max
  Peptide Sequence Number=SeqID_184877
atggcacctgtggcttccaccaccgggaaggagatggagacggcggaggggaattgttctaatggcgagaaggaactatggaacaaggtccgtggaaactgtggctga

SEQ ID NO: 68100 - DNA, 300 bp, Glycine max
  Peptide Sequence Number=SeqID_184878
atggtgaatttggcggtcgcaaagtacgaaagagctgtggggagcaacgaaggtggcggtggtgggaagaagaggaaagctgaaattaatgatgttcctatgtggaaaactattaaggatttttctttgcctgatatatctgttaatgttgaaggtaaaggtcaagacttggaagggagagtaaattcaaaaggcgagtgtggcaatggtgggttgagaataaatgctcctggtgatgctgtgttgagacacgatgctaagaacgatttggtcgaaatgtctcttgaactagacaaatga

SEQ ID NO: 68101 - DNA, 105 bp, Glycine max
  Peptide Sequence Number=SeqID_184879
atggattcaatgtggaagggtctccctcgtactagtctaagtgatatggaagagctaaagagtgaggtcatgaaaggagaggactcagaggagaaattaccttag

SEQ ID NO: 68102 - DNA, 450 bp, Glycine max
  Peptide Sequence Number=SeqID_184880
atgattgacggacagtacaaaataaaaaaggatggactagacaaatacccaaaaacttgtaactcatcaaacctcagtacaactttttgtctaatgtctaacaaaacctctgacgaggctaccttggctgctggtgtgggcaccttgactgctggcgaggaccgcatggactgttattgtttcctttttgctcattatttctttcttttcattgttaatttgttcaaatgttctcatcatcatcttcctccttctcgttgtattttttttcttttggccaactccagtgaagctgcgtcacgccaccgtgcctctgccaccatcgccgtgaccctatggcagcctcacgctgctaggccatgtgcccagtgtcgtcaggggccgcgcctcctccatggaggtgcctctcctttgttgcaccgcgatgttgctaatgcacctaggatttga

SEQ ID NO: 68103 - DNA, 246 bp, Glycine max
  Peptide Sequence Number=SeqID_184881
atgacacagtggtggaggaatctggatggagaagtctggcgcaacattgatcttgcggaggaaggggaaggggcaatgatgatggcaaagttgttgtggagtgagttgagggaggcgacgacaacaaactcaatcagaaataaagggaagggtggtgcagtgccgttggaggcgaagttgttgtgcaatgatccattggaggttggatttggatgggggagggtggtgtggcaccatgaaagttga

SEQ ID NO: 68104 - DNA, 226 bp, Glycine max
  Peptide Sequence Number=SeqID_184882
tcccgatccggtgggctgtcggtgtactgctcgagctgcttcctcggcgagagcgggttgtcgcgtgccgacagggggacggattgggaacggacccttcggggcatcttccccgggcgtcgaacagtccactcagatctgcgaaaccacagccaagggaacgggcttggcggaatcagcggggaaagaagaccctgttgagcttgactctagtccgactttgtga

SEQ ID NO: 68105 - DNA, 513 bp, Glycine max
  Peptide Sequence Number=SeqID_184883
atgaccggccctctcgatgagtcgatctcttgctttttcataaaggtggacccttgggtactagtacctatcacctttagaggactgtatgtcctcgccatcagaggaccacacgtcctcaccttcagagggctacacgccctcgccatcagaggactgcatgtcctcaccttcagagggctacacgccctcgccatcaaaggactgcatgtccttaccttcgtagggctacacgccctcacctttagaggactacacgtcctcgccaacagagggctgcacgccctcacctttagaggactacacgtcctcgccaacagagggctgcacgccctcacctttagaggactacacgtcctcgccaacagagggctgcacaccctcacctccagaggactacacatcctcgccttgagagggctgcacgccttcacctttagagggctacgtgtcctcattttcagtgtgctccacatctacaccttaagagaatttaaggtcctctgtccttaa

SEQ ID NO: 68106 - DNA, 240 bp, Glycine max
  Peptide Sequence Number=SeqID_184884
atggtggcaaaacggaaaaatgatatggggtggtggaactggagcttgcttcacggaagaggagatggagcgaatcagcatcgtccatttggagtgagtggaagctatttaaaggcatattctgagactggcagacttggtaacgatcgagctttggagatggcgttgttggttgagaaaacaagcagcggaagagagtacaatgacgcaagcagatttcggaagattaaaatcgtttga

SEQ ID NO: 68107 - DNA, 1209 bp, Glycine max
  Peptide Sequence Number=SeqID_184885
atgaaagggaagtatagtcgggatgcaaaagtagtattagtgcttgctgcttttgcactatatcgtggtaatactttggcagctttaatttcaagtattaagcagctgccctacaacttaaagccaccgaagctacaaatcaaggcattgagcttgttggttaagaccatgatggatttggctatgtgtatcattaagtttgagtatcttccccttcaacatgtagagccgggaaatgtgtcacaaagtccaaatatacgaagctgcatactggatcaccagaagctgtttagcatgtattcagattcaacaataattgctgcttgggagctttcaagtttggcttatagattaggtggcatatgctgtaatcccagaagacagacggatctgtcacaaagaactaggttacttttctccttcttaatattgcttataatgatagagagaaacttgtatgacaggctgctggatcttgctcgtgaggagcacattgataatcacaaagattctcactttattttttcattccaagaattacttgccattgaaggatttctcaacagaagtaaaggcattatgctctttgattctgctgagaaatattttgcctttttttttggaagagatagatcaataggatatgacttgctaatatatctttctagcctaagcaatcttctaatcttaatcctctgtcgtctacagattggtgtttctgaactgaaaaataagacagttctgttgttgatctcaaaaccgcagctactcaacccgatagatatattcttgctggtccagcaaacatgtgatcatcctctgaatgagaggttgagggagagttataagattgtgtggatcccccttccattttctgatacatggactgaagctgaagaaagtagttttaattttttgtcagattctttggcttggaatgctgttcagaaaccaaggttacttagctcagcagtggtgaagtacacaagggaacaatggaactacaaggatgagcccatcatggtagctctagattcaaaagggaaggttacaaattacaatgctcttgatatgatcaagatttggggtccccaagcataccccttctcggcttcaaaagtggaagagctatggcaagaccagaatttgacaatgcaacttttgctggatggcatcaatcctttccttgcttactgggttggagtctga

SEQ ID NO: 68108 - DNA, 927 bp, Glycine max
  Peptide Sequence Number=SeqID_184886
atgttgattaaagaggggcgaacgaagcctttaattcaggggcgtttgtcgcgtttctgtgtgttgggcgaggaatctgggtacgcgcctgtctctttttctcttgacaccaacgagacgaaaatgtcatgttcccacaacgacaacgaggctgttcttgaaacaagaccgcacgtgcgaaagaaaaccaaccttattcaactttcgcatgaagtacttgttactacaattcatggttcttatactcccctccctaccgcagagagacaaatgttcaattttttgggagtgatttggtacgaaggagagaaaaggggaggaggagggaagaggaggaaagaaaagagaagtagaactgaggaatggtttggtaagaatgaagaggaagattttccttatatcacaagtgtgaatagtgaagatcaggatcttggtaagcaaatgagaagaagcagcaaagaaataaaaacaacctatactcattcattaggcctcacaagctgcactgagtcaaaggcaagtggtttggctagtggaagtcttaaccaatatcttgaaagaatatgttggaaaaggagtttaggaaacaagcatcttgcccccttctgtgtgcacaagagagaactttacttcccattaaattgtgactttgataccgatacagtggtgaagtggatgtgggggttgaaccctaatgggaccctggtgaaaagttattctggcttgtgtgcaacagtagagtctagtgaagatactataaattctggtggcctgcactcttggatagctacaggaagaaaaggagaagtctacgttgcattcttcaatcgaagtgaaaagaaggcggtaatatctgcacaaacatcagacctggcagagacttcagttcttgtgagtgcagtgaagtgtggagaggagatgctatag

SEQ ID NO: 68109 - DNA, 1830 bp, Glycine max
  Peptide Sequence Number=SeqID_184887
atggcggagacggtgagacttcgcgtggtgttcgaggatcgtggcatgttgagcaagtcaaagaagaagcaagggctcaagcgttgctggtttctgcttaaaccccaacacaccaccatttccgatgttgcctctcatctactcaacactttccgcctccaccgcacctgtccccatggcatcgtcctatcgatggatggttttgttttgccatcttttgagttcacttgcattttgaaggataaggacattgtgtggctattgagcttcagaaacttctcaaaaattgagggccttcaagaggaggagtctggggcagaagaaaccatgtcccaaaaggatgatgatgaccagcttgaagatgcagtttatgtggaatctaaatcggatgggaatgttgtcttcaagaaaagaaaagcttcaaagaagctcaagagccctagtcagaagaagattaagttgtctactgccgaaaacttgtcagtcactcctaaggtccatgagaaggaaaacggaagctctgaaggccatgaggaggaaaacggaagctttgacggctatattcatcaccaattgagtcttgtcaagaaggacaagaagaagtcttccaatttatctagtcagccaaataagtctagcaaccttaataaacaaaagaatgacaaaagtgatcctacaagtgatgaaacaagaagtgctcggcgaaagaaagctaaaagaagatggctgagggaactaaaattagagaaggagaaggagaagctccatcagactcctgtgcttgaaaaaggtggacaagaattacctatcaacgataataattgtgttgtttctgatgtacatcaacaacctgatgaagaaagtgaagaagaggatgacattgctcctgtggaaattaggccagggcacattcggattaattgctttcatgatctgatatatgtccatggtctatttgatgcagatcaggatcaggcagtgccacagaatcagtttccagtggaaacatttcagtggaatggaataaccaacaagaagaagggccagaaatggggtaaagagagaatgcctttccgtaagcaggatggatatgaagattccggtcaagattgtcctacagttcagaatgctgaaaaggaacagacatccaatgtgatagattttgataagcttaaacattatacaagcttgcctaaggaaggtgatgtaattgcttatcgattgattgagttaacagcatcttggactccggaactttcctcctttagggttgggaaaatatctcggtatgatgctaaatcaaataggatttggctggaaccagttttagaatacccatttgattttaagaaaaaaatagatgaggatgcatcttctgtacagtatgatccatccccttatcaggaggatggttctttagagatagagtatacattgctggccgatgttcgaatggttaagcatggcattcctgatttgaaaagtgatgctttggttaatccaacaaaagcaactaatgatattaccaatgaaaaacttgcggcaaaagcaattaatggtagcactggtgagaaactcgcgggtgatcaaactactgtgggaagttgccatccagaaagaggtcatatcactgctaaagaaaatggggaagtaaacgtgtgggacaaaattaacgaggcattaaaagcaaagaaggccaagctgtcgcaggaggattgttggagtagaggaggagagagctcaagcacgaggtcatggtcccatagagccatgagatgcagtgcgttgggtcccacaatggcattgttaaggtctaacaatggactttaa

SEQ ID NO: 68110 - DNA, 291 bp, Glycine max
  Peptide Sequence Number=SeqID_184888
atgtctgggaccattcgagtgcacgatgacctgcttctggcagcttctgaggctttggcttcacaggtgacacaagaggactatgacaaggggctcatatacccaccattcagcaacatcagaaagaagatttcagcacacattgctgccaatgtcgctgctaaggcctatgaacttggtgagcctgagttttccttcaacagcttggccactcgccttcctcaaccaaaagatttggtgaaatttgctgagagctctgtgtattcaccagtctatagaggctaccggtga

SEQ ID NO: 68111 - DNA, 822 bp, Glycine max
  Peptide Sequence Number=SeqID_184889
atgcagttgcaggagagaaatgaaaggctgttttacaagcttctacttgatcatgctgaggagttactcccagttgtgtatactccaactgttggcgaagcttgccagaaatatgggagcatcttcgtgcatcctcaggatctttatttaagtttgaacgagaaaaaatgcttgcttattaccatcgatgttggtacaaacaatgagaagttgttgaatgatgaattatattttgggctcaggcataaacgagcaactggacaggaatacgctgaacttctgcatgaatttatgaatgcagtcaagcaaaattatggtgaaagaatcctcgttcagtttgaagactttgcaaaccacaatgcttttgatctacttgaaagatataggtcaacacatcttgtctttaatgatgatattcagggaacagcacaagtggtccttgcaggactagttgcagctctgaaattggttgggggagacttgactgatcacaggttcttattccttggtgctggagaggctggcactggaatagcagaactcatagcacttgaaacatcaaaacggggtttgattgtgagttcccgtaaggaatcacttcaacattttaagaagccatgggctcatgaacatgaacctgttaaggaacttgtaaatgttgttaagcaaattaagccgacggtgttaattggaacatcaggacaagggagaacttttactaaagatgtggttgaagctatggcttccattaatgagaaacctattattctttctctttccaacccgacatcacagtcggaatgcactgctgaagaggcttaa

SEQ ID NO: 68112 - DNA, 357 bp, Glycine max
  Peptide Sequence Number=SeqID_184890
atggccaccggaatctcccatcgcacaccacattatcagagttcaatccaaatccaacgaaaccagatcgatagaggaaaaacactcgctccgttgtttaagggtaaaagcaaggagagaaaaaagagggtaaaggccaaaacgaggaagttccgttgtgtcatcgcttatagagctcgtagtaaaaaccaagtcctggctggtgtgggttacatcgttggggacaactgggggttggattcgagtgagtatcgctggcacgatgttgaggtttggtggggaaagattggctacggcgacgcgcaccataacagtgggtttgaggtggggcccataccaactgggttaatgtgttga

SEQ ID NO: 68113 - DNA, 573 bp, Glycine max
  Peptide Sequence Number=SeqID_184891
atgaaggtgagccaatatatgctcctggtggtcctagtttggcattcttcattatgtgcgaatgcacagtggaataacccaataaactactctccattcgacgagacaaacaaaggtggaaactactccaagctccgcgcgtgttgttgttgttgttattcttcttcttcttcccaacgccataacacaaagctcgtggcagccacagaagctattgaaaagtgccccatctttgaatactcgacggcgaaggagcttaaagtggggaatggggcagaggagtgctcggtgtgcttggtcgagttcgaagactccgacaccataaagatgctcccaaaatgccaacacgttttccaccagaattgcatcgatacatggttaccctctcgcatgacctgtcccatttgtcgccagaaactcacgtctcaggataccgtaatcgacattaatgatgatgatgtcgtcccaatggaacaactagaacatgatattggtacagagattacagagtcagaggtggcagtaactgatgaaactgacactggcactgttgtggaacaggttttggtttga

SEQ ID NO: 68114 - DNA, 1239 bp, Glycine max
  Peptide Sequence Number=SeqID_184892
atgggcatgtgcattcttactctgctgctatctcatctattctggggtatattcaggcttggtggtgatagctactttggaagaaattggaattgtagacattattctagattgactgaagaattctttcagaattttaattttgtacctccgaaggccaatttcttacatgtggtggtggaggctgctctgtctctgcaacaacgaaatctccttcatcatcagagacatggaattgagcgggacggaaaaaataggattcacctcaagataaagggtggggcatatcttcagagacatagaaatagctttatcaccatagaagatttcaaatttctatataaacatggaataaatactgtgaggataccagttgggtggtggattgcttatgatcctgatcctccgagtccatttattggaggaagtcttgaagctctagataatgcattttcatgggcacaggaatatgatattaaatgcataattgaccttcatgctgctcctggttcccaaaatgggatggagcatagtgcaagcagagatggatttacaggctggccaacttctcctgattatatttccgactcattatatgttattgaatttttagtttctagatatgcaagaaatcctgctttgctgggaattgagctattgaatgaaccatctgctgccacagtttcattagatgttttaatttcatattacaagcaaggctaccaaattgttcgaaaatattcatcatcagcttatgtgataatctgccagagaattggtgttgccgatcctatggaactttatcaagccaacataggatctcacaacttagttttggatttgcatttctacaatctcttcgacacatttttcaataatatgagtgctatggataatattcaatacatatacaaaagccgggaaggtcaactgcaggccttaaacaattcaaatggcccacttattttagttggagaatgggtgaatgagtggaatgtaacaaacggatcccaaaaagattatcaagactttgcaagagcacagctagacgtctataatgcagcttcctttggatggtgctattggacactaaaaaatgatgagaagcactgggattttgaatggagcattaggaacaactatcttcaattaggtaactcacccagcaaacggagcttgaacattctaggattgttaggattagcatgcacctggttttgtctacttccatttttgtga

SEQ ID NO: 68115 - DNA, 2031 bp, Glycine max
  Peptide Sequence Number=SeqID_184893
atgatccaagtgggtaattccccttggtataaagtagaaagaaaacttggcaagggtggatttggtcaagtatatgtagggcgacgtactggtggaaatttgaatgagagaactggatctggagctgtagaggttgcattaaaacttgagcatagaactagtaaaggatgtacctatggaccaccctacgagtggcaagtgtacaacactctcggtggcagtcacggtgtacctcaagtacactacaagggcaggcagggtgactattatgtcatggttatggatatgctgggacctagcctctgggacgtttggaataatagcaatcatcacatgaccactgaaatggttgcttgtattgccattgaagcaatatctatattggaaaaaatgcactctcgagggtatgtgcatggggatgtgaagcctgaaaattttctgcttggtgctcctgggacacctgatgagaaaaaattgttccttgtagatctgggattagctactaagtggagggatagtacaacgggctcgcatgtggaatatgaccaaaggccagatgttttcaggggtacagtccgctatgctagtgtgcatgcacatttagggagaactgcaagcaggagggatgacttggaatctcttgcatatacactgatttttcttcttcgaggtcgccttccttggcagggtttccagaattgttggtctctaacattattttctcagggggaaaacaaaggatttctggtttgtaagaagaaaatgggaacatctcccgagaccctatgctgctttagtcccctaccttttaagcagtttgttgaacatgttgtaaacttaaagtttgatgaagagcctaactatgcaaaatacatttctctatttgatgggattgttggccctaacccagatattagaccaattaatacagaaggggcacaaaagctcattggtcacaagagaggccggttggcgatggaagaagaggacgatgaccaacccaaaaagaagattcgtataggtttgccagcatcccagtggataagtgtttacaatgctcggagaccaatgaaacaaaggcattttaaattgatccatagggtcatagggatgataattgctcatttccccatccttgagattaagggtggagagggtgattcttcttcccataccatctcgtggaatctgttttacaaccttttatatcactacaacgtatcagatacaaggctatcccagcacatcgagaaaggaaatgaggatggcttatatattagcggtgttgcttcatgtcagaacctatgggcgttaatcatggatgcagggacaggtttcactgcccaagtttacgagctctcacccttctttctccataagaagacatgcttgctacacactttccaaccaacatacaattcacccaataatgaagaggaatggatcatggagcactgggaaaaaaattactatatcagtgcaattgctggagctgtaaacgggagctcgctagtagtaatgtctaagggcacacagtatttgcagcaatcatataaagttagtgactcatttcctttcaagtggattaacaaaaagtggagggagggcttttacgtgacttcaatggccacctcagggtccagatggggagtcgtcatgtctcgtggtgcaggattctcagaccaggtggttgaactagattttctgtatcctagtgaggggattcacaagcgttgggactgtgggtatcgaatcacagctactgctgcaacttgggaccaagctgcttttgtcctgagtgtgccaagaaggaagcctttggatgaaacccaggaaacgcttaggacttctgcttttcctagcacacatgtcaagttaattaggtctctgctaagatgtcatactttgttgtacaggagaagtgggcaaagaacctctacattgcttccatttgctacggacgtacagtttcttaaccctgcaaacgttgccgctgctgagaagcacgatccaggcccaaagaaattttga

SEQ ID NO: 68116 - DNA, 5466 bp, Glycine max
  Peptide Sequence Number=SeqID_184894
atgaagaaatcctcctaccctaatcccacccctcgccgccacgattttcaccgtccgccaccacccacccacggctgcggttgggctccccgccccgcctaccaccgcccctaccaccaatggaggccccgattccacccccacgccgcccgcatcgaccgccctccggagccctatttcagggtggagctccgcctcggcagcagccccctccaccgcgacgacgtcgaggccctgatcgacgaatgccactcccggcacgacaccttcactttctaccccgtcgacgacgtcgccgccgttctcagttaccggagctgggagcaggcgcgagacgccgtcgtttggttctgggaggcgcggctcgcggagaagcacgatttcacgccgacgctggattccaacgtcgtcgtcgtcaaggacgatgtggattgtcgccttcgaccggtgttcgcgaggcacgtgaaagggttgacggaagggaaggaggtgaagcggtggatggaggagagtgaacggttgtcgaaagaaatttctcggctttcgagttcgctgagtaagcccttgcgacttggcgtgcacaacgagttggtggagaagaagaaagggcttgttgatgagaagaatcttgttgaaaggaggttgaaggagtttgagtctgcgatgcagtgtttattgaagtatttggagggtggtgttgacgtggagggtgtgactgtctttaggtttgatggaggttttgattggaagcggattcattgtctgatcaaaagggagtgtcggaggcttgaggacgggttgcctatttatgcttaccggagtgatattcttcaggaaatacattatcaacagtgtaactatatttttccttttcttcttgttgggaagtgccaattactgggggaaattgtggacaaatgccaccgcaattgcggtcgcgaagactccaaaatcctcgacattgcacgggaaattgggccaaatgttgccgcaattgtggccgctaaaaaccttaagacggaggggatctttcctgtatcgcttggtctttcaggcatttgtggagtgtatatgcagataatggtattaatcggagagactggttctgggaagagtacgcagttggtacagtttcttgctgattcaggcattggtactgacgaatccattgtgtgcacccaacctcgcaagattgctgccaaatcagtggctcaaagggtccaggaagaaagcattggatgttatgaaggccaatcaatcaaatgctgttctacattttcatcctcacgtgagtttgattccaggatagcattcatgacagatcattgtttattgcagcactacatgagtgataataatttatccggggtctcgtgcatcataattgatgaggctcatgagaggagcttaaatacagatttactgttgactttgttaaagagtttactttgtaggagggttgaaatgagacttatcattatgtctgctacagctgatgcaaagcagctgtctgattacttttttgcttgtggaatttttcgtgtgcttgggagaagctttccagtggatatcaaatatgttccttctgactatgcaggagattctggttctgctgttgttgcctcatatgtttctgatgttgtcagaatggcaactgaggttcacaaaactgagaaagagggaactattcttgcctttttgacctctcagatagaagtagaatgggcctgtgaaaagtttcaagctccctctgcagtagctttgcccttgcatggaaaactttcttctgatgagcaattccgtgtttttcagaactacactggaaagagaaaagtgatattttcaacaaatcttgcagagacatcacttacgattcctggtgttaggtatgtgatagattctgggctggttaaagacagcagatttgatcctggtagtgggatgaatgtacttaaggtttgctggatcagccagagctctgctgatcaacgggctggtcgtgctgggaggactgagcctggtgtgtgctatagactgtacacggaagctgattatcagtctatggacctaaatcaagagccggagattcggagagttcatcttggtgtagcagttctgaggatccttgctttaggagtgaaggatgtgcaaggttttgattttgtggatgctccaagtcctagctccatagatatggcaatcagaaatctaattcaattaggagccattgaactgaacaatgatgttcatgatttaacttctgaaggttggtgcttggtaagaatgggaattgaacctaggctgggtaaacttattcttggttgtttcaaacatggtttgggtagggaaggtatcatccttgctgctgtgatggccaatgctagtagcatcttttgcagagttggcaatgaatttgataaacaaagatctgattgtcttaaagtgcaattttgccattgtgatggtgacctctttactcttctctccgtgtacaaggaatgggaagctttgcctcgagaaaggaagaacaaatggtgttgggaaaacagtatcaatgccaaatccatgaggaggtgccaagacacaattttggagttagaaacttgccttgagcgtgaacatgacgttgttactccgagttactggcgttgggacccttgtatgccctctaatcatgataagaatttgaaaagggtaatactgttctcacttgctgagaatgtagccatgtactccggctgcaatcaacttggttatgaagtggcacaaactgggcaacatgttcaactacatccatcttgttcattgcttgtatttgctcagaaaccaagttgggtagtttttggtgagcttctttccatttccaatcaatatttggtctgtgtgagtgcatttgattttcaatcattatacgacctttgccctgctcccctgtttgatgtatccaaaatggaagagcggaagttgctaatgaagacactgtctggtcttggctgtattcttctcaagagattttgtggaaaagccaactgcaatttgcttgctcttgtttcacgtataaggaaagcttgtatggatgaacgcatcttcatcgaagtgaatgttgacaataatgaaatccacttatatgcctcttcaaatgatatggatatagcccttgggttggttaacgatgttctagaatatgagagaaagtggttacgcactgaatgtatggataagtttttgtatcatggttctggtttctctccacctgtagctttgtttgggtctggtgctgagataaaacatttggaacttgagaaacgttccttgagtgttgatgtgtgtcatccaaacataaatgaaattgatgacaaggagctcttgatgttttttgagaagaatacctctggttgcatctgtgctgtgcacaaattcacaggcaatacgagggatgaagatagggataagtggggcaggataacatttatgtccccagatattgtcagaagagctgctgagctagatggacgggagttttgtggctcatccttaaaagttgttccttcacagttgggaggggataaaacattttcgttccctgctgttaaagcaagaatttcttggcctcgtaggcttagcaggggatttgccatagttaaatgtgatataaaggacgttgattatatcttgagagatttctataaccttgcagtaggagggaggtatgttcgatgtgaagttggcaaaaagagtatggacagtgttgttataaatgggcttgacaaagagctttcggaagctgaaatatcagatgtgctaagaactgctacaactagaaggattttggattttttcttggtgagaggggaagcagttggaaatccaccatgcagtgctttggaagaggcactcctaaaagaaatttacccctttttgcccaaaaggaaccctcacattagtccttgccgagttcaggtgtttgcacctgagcccaaggatgctttcatgagagctttaatcacttttgatggaagattacatttagaggcagcaaaagctttggagcaaattgaaggaaaggtgttacctggatgtctttcatggcaaaagataaagtgccagcagttgtttcatagctcccttacatttcctactccagtgtatcgtgtgattaaggaacaactggatgaagtacttgcaagcttcaggaatttgaaaggtcttgaatgcaacctggacaggacatttaatggttctcaccgagtgaagataacagcgaacgccacaaggacagtggcagaagttagaagacctctggaagaactattgagagggaaaaccattgagcatgacagcctcacccctgcagttctccaactcatgttgtccagagatggctttagtcttaaaaactcattgcagcaagagactggaacttatattctttttgacaggcacaacttgaatttacgggtgtttggttccccaaacatggttgctttggctcaggagaaggtgatacagtccctcctttctctccatgaagaaaagcagttagaaattcatctgagagggagggatctacctcctgatttaatgaagcaaatgattaagaattttgggccagatctccatggattgaaagagagggtacctggggtagatcttacactgaacatacgtcgccacataatcattcttcatggtagcaaggagttgaaaccgagagtagaggaaatagtttttgagattgctcgttcaagccatcatttggttgagagatttggcaatggacccagttgcccaatttgcttgtgcgaggttgaggatggataccggcttgaaggctgtggccatttgttctgccggatgtgtttggttgagcaatttgaatctgctattaaaaaccaaggcactttcccggtatgttgtactcacagggactgtggagatcccatcctgcttacagatttgagatctcttttatttggtgataagttggaggatcttttcagggcttctttgggagcttttgtggcaacaagtgggggaacttacaggttttgcccttctcctgactgcccctcaatttatcgagttgcagatcctgggtctgctggcgagccatttgtttgtagggcttgttattcagagacttgtaccaggtgccacttagagtatcatccttacctttcatgtgagagatacaaagaattcaaggaagatccggattcatctctgatagaatggtgcagagggaaagaacaagttaagtgctgctcggcatgtggatatgtaattgagaaggtagatgggtgcaaccacgttgaatgcaagtgcggaaagcatgtctgctgggttgtgacttttctgctatgcaagctctacattatgtgttcaaaagcagttcaatacggttgtatttatccattaaatgagccggaagagagaattgattacaagtcgattagcacgaactag

SEQ ID NO: 68117 - DNA, 753 bp, Glycine max
  Peptide Sequence Number=SeqID_184895
atgggaggaaaagtgctaaatcggaagtcatgcctggagattgctaaacgttttagttcctcatcaaatggtgctggtaaaacttccttatcatggcaacaggtgcggctgtggttcaaaaataatcagagaatgttactgggtaaagatatctcatcttctgacctgctgaaaatatctgctgatcttgcagagtcacctcttttaggaaatggaaaaggtaaacaagctgcagctctcgatgacctgggatttgaagcaagatctacaaaagacattgcatggcatgatgtttcaatgttccttaactacagagttctgagtacaggcgaacttgaagtccgcgtacgatatgctggatttgggaaagagcaggatgagtggatgaatgtgaaattgggggtgcgggagagatctattccattagaaccttcagagtgtcacaaggtgaaggatggagatcttgtactatgtttcctggaaagagaagattatgccctctattgtgatgctcgaattgtaaaaatccataggaagatacatgatccaacagagtgtacgtgcaccttcattgttcgattcgtccatgacaacactgaggtaaaatcttcgatattaacactatctgatgttgtttcatatgcccatgccaggaaggagtttcttttgacaggatatgctgtaggcctacacaagaggaatctgcttgctacccagatcttgcccttgatcccacctcaagtccctccttaa

SEQ ID NO: 68118 - DNA, 366 bp, Glycine max
  Peptide Sequence Number=SeqID_184896
atgattaaggactccgaaatattcaactcaatgtctctatacgcaaaatgcaatgagattaactactcccagtctgcttcacaagttgaacaaccttcaactaatttaggaattactccaactcctaatgttgaaagtgctctagctcaaattccaactaccactcaaagtgttccaactccaagtgttgaaacaatcttcatacttccgtcaatgttaactgcatttagactagctccagttagacctccaacaccaattcggattatattcccagataaagcatcttataacaagaaccaaccgaattacacgagcttcatactcataccaagattgcccagtcatcgagattcaaagaagtga

SEQ ID NO: 68119 - DNA, 1074 bp, Glycine max
  Peptide Sequence Number=SeqID_184897
atggccttatccgttatttgttcttcaaaaggcaatgtgttgagtgagtccaatatcttagttgtctcttgtgttgtgttgaatggccttgcctcgttcgttatagtggagggcttgcatgacggttctaaagcgagagatgtgaacttaggagggtggctggttatcgaaggttggatgatcaagccttcactctttggtggcactgccaatggagacatgcttgttcaatttaagtcagggacgttgcagaagtatgtgtctgctgagaatgggggagaaatgaataacttgacaatttgtgtgtttataattgtcatagctagcacagcttgtgtaattatgtttctcatcacgttgtccaaaatcctaagttactattatgcaaggagatataacgttagtagaagtaacccaccaatattatttgacattcgtggagattttcccttttctgatgatgaggaacaagaacaagccattaggcaccccatatggttcatccccacagagggtctccaacaatcaatcatagactccatcacagtctgcaaatacagaaaagatgaagggttagctaaagaaactttaactgagtgtcttgtttgccttggtgagtttcaacaagaagagagtctcagagtgttgccaaagtgtaaccacgcttttcacatctcttgcattgatacttggttgagatcacataaaagttgtcccttgtgccgtgcccctattgttcttgatgctgctagtctcctacgttatggatgggacttgtttttactaaatgggcatgtgcattcttactatgctgttgtctcatcacttctggggtatattcaggggttgcatggaggttctaaagtgagaggagtgaacttaggagggtggctggtcatcgaaggttggatcaagccttcactttttgatggcattgccaatggagacatgcttgatgggacagaagtgcaatttaagtcagtgacattgcacaagtatgtatccgctgagaatgggggaggaatgaatgtgacagttgacagggatgtcccatcttcatgggaaaccttcagg

SEQ ID NO: 68120 - DNA, 153 bp, Glycine max
  Peptide Sequence Number=SeqID_184898
atgtgggatcggcacaggcttaaaggagtactcataccgggtgtatttacccccaaggcctacactccgaagagtccgtcagggcctctctctcctgattcagacactgctcataaattatataatacccacgacctcacactcgtgttttaa

SEQ ID NO: 68121 - DNA, 318 bp, Glycine max
  Peptide Sequence Number=SeqID_184899
ggactacgccatcgttcaagtccccatccccaaggttctgttgccggctccgcctccgtccaactatgttcctcttggcactggcgcgctcgatgcgatgtgggagaaggcggtggagagagagagaggaagagcgtaaacttcaactcaatagcaaagcgcgtggtggcaaatactaataacaacaacgacgaaaatttggagaaaaagactagcgagttccagaagttcctccaagtctccgccaaagagcacgacagggtgcaacgcatacaggtcatcaatcgcgccattgccgccgctaggcaactcctttag

SEQ ID NO: 68122 - DNA, 963 bp, Glycine max
  Peptide Sequence Number=SeqID_184900
atgagtgggcacatgggcgacaccaacactatgcgtcgcctcaaagaccaatttttctgggataacatgagccgcgacatccaccaactgatttcggaatgtagagtatgccaacagacgaagactgaatgccgtaaaccagtaggtttgcttcaacccctccctatcccgacgggcatctgggaggatttgtctatggattttgtcactgggctgcctccattccacgggttcaccacaattttagtggtcgttgaccgattctccaagggcactcatctcggcgccttaccccctaaatactccgcacataaggtcgtcggactcttcatcgacatcgtctgcaagctccatggatttcctcgcagcctcgtctccgatatagatctgttatttctcaatgcattttggcgcgaattgttccccatcagtggcacaaagctccgttatagtactgcttaccatcctgagtccgatggtcaaatagaagtccttaacaggaccctagagcaatacctttgctcttttgtacatgatcgccctgccctgtggttttctttcctctccttagtcgaatggaattacaacacatccactcactccggcacgggtctttctccctacgaggtcacctatggtaagcctccacctaccttaccacaatatattccagggacatcttgcattgaagctgctgattccataatcaccaccaaacaggcagtgcactccaaactccaacaacgcctgctaaaggcccaaacacttatgaagacatacgtcgaccgccatcgttgggatgtccaatttcaggtaggggattgggtttatgtccgccttaggccttatcgccagctttccctccgccctcattactccaagctcgccaagcgtttctatggcccttacctggtcgttgagaaaattggcaccgtggcataccgccttcagctgtcggcgtga

SEQ ID NO: 68123 - DNA, 495 bp, Glycine max
  Peptide Sequence Number=SeqID_184901
atgccggtactgcgtagcggagcgcgcaagggccgggcagcagcgaaacagcaacaacaagaacaacaacaacagcaacaaaagcagcagcagcagcagcatagtcccgtggtggagggagaggctattgcgacgaggactcgtcggcggcgtgcggcggcggcagcagcagcggcagtgccggagagtaacaataacaacaacaacaataataccaataaccagcagcaacagccggagcaggtggcagtggtaaatgagaacgtagctattgcggtgagggaagaagagaataatcgggtagcggaggaaggtgttgttggcggtggtggagcagagagggaaggggttgcggagaaagagatgggtggctgtgacagtgggggaccgagcaatgataaggccaatgccgctggggaagatgacgccaatgctcctcaggttcctgagaagtgtagcggtcttatattttcccttgctttttctagtctgtaa

SEQ ID NO: 68124 - DNA, 1569 bp, Glycine max
  Peptide Sequence Number=SeqID_184902
atggaaaagtggtgcgtgatctctccaagttgctacgataatcatcatctctgctttgcaattttcttgtcctttctcttctcctctttgctgttatcctttcatggtcccaacctccctttcttagtgaagccatccaagaccataagtgtcacagattcctgcattggccgctatgtttacattcaccaactcccctcccgcttcaacaattactttcttaagaattgccagttccttactagaggcactgacaaacccaacatgtgtccttacatgcttaacatgggtttaggccctcagattcctaactctcaaggtcttttctccaacaacacttgctatgccaccaaccagttcttgttggaggttatttttcacaacaggatgagccaatacgcctgcttgaccaacgattcctccctcgcctctgccatttttgtccccttctatgctggtcttgatgttagccgtttcctttggctctctaatcttaccgagagagattcctctggtcgtgatcttcttcaatggcttgcaaaaagacccgagtggaagaaaatgcggggtagagaccatttccttgtttcagggaggattgcttgggatttcaggagacaatacgatgatgagtcctattggggtagtaagttcaggtttctacccgaatccatgaacatgtccatgttagcagttgaagcaagttcgtggaataatgactatgcaataccctacccaacttctttccacccatcagaggacactcatgttttccagtggcagagaaaaatcagacatcaaaagcggccatacttgttcactttcacgggagctccaaggcctgagcttgaaggttctatcaggggtaagattatagaccagtgtcgagcttcgagtgtttgcaaattcgttgattgcagctatggtgttcagagatgtgacgaccccatcagtgttataaaggtgtttggaagttctgtgttctgtttgcagcctccgggtgactcatacaccagaaggtccatttttgattccatgttggctggttgtgttcccgttttctttcatccaggtactgcttattcgcagtacaagtggcatttaccgaagaataggactaagtactctgtgtatataccagtgaaggatgtaaaacaatggaatgtcaatgtggagcaggtgttgcggggaattccggagggtgaggtgtttgcaatgagagaggaggtcataaagctggttccaaatattatctatgcagatcctaggtcaaagttagattgctttacagatgcgtttgatttagcagtaaaaggaatggttgaaaggatagagaaggtgagggaagaaatgaggagtgggagagatcctagcattggttttgcagatgaagaccattataatgtaactggtattgaaagacatgggcatgggatgcatgtgaggttgatgaaatttccagttataacgtttagacatagtcacagtcagagtcataaaagaagtagaccccatttgattccaagccccgtatcaccgcctgcaatcaaggtcccattccaccattaa

SEQ ID NO: 68125 - DNA, 771 bp, Glycine max
  Peptide Sequence Number=SeqID_184903
atggcggcggctgcgaactctgagggcaatgctcagaaaccgagttcggaaacgtttcagttattctcttcctccgcttccgccttcggaatcttcgacgatgctgcgcaacaagttcctcctatacctcctcctccctgcgttgaagtcctcgcttctgaggttccttcatccctcaaacacaacgtggactctgtaaatttagatggagttattttgttaaagttcccgggaaatatgaaggtgctgccattttctgtttattcacccattcccatctcgttcatgactaaatcagttgctgcaactttggtttcctttggtctaggaggacttaagctgtgggaaggttcacttgatctaattaaagcccttcgttcagatataaaaaatgggcttatctcatttgctgggaagcgagtattagaggtaggatgtggtcatggactgcccggaatctttgcatttcttgagggggcagctgctgtacattttcaagacttcaatgctgaggtcctacgttgcctcacaattcctaatttaaaagcaaatctttctggagaatctcaaccatcatcatccaactcgacaatttgtgacgaggcagaagttcgcttttttgctggcgactggagtggaattgataaactgctccctcatgttactacagatgcaaaacataatcaaggtgatggttatgactttattcttatggcagagacagtttactcaatcaacagtctccaaaatctctataatcttatcaagaag

SEQ ID NO: 68126 - DNA, 168 bp, Glycine max
  Peptide Sequence Number=SeqID_184904
atggctgcatggcgtggggtcggagatggaaggttgattattactactctcgaccgtgcggcaggggggtatgtttggttcatgagagtgaatgtggagcaggagctggaagtgattttgagtgaaagttgcgagaaggaatgtttagtgggcgtcaaatgcatgtga

SEQ ID NO: 68127 - DNA, 1263 bp, Glycine max
  Peptide Sequence Number=SeqID_184905
atggggagagccactaggtgggtgaagagtttgtttggaataagaagagagaaagagaagaaactaaacttcaggtgtggagaggctaaaagtatggaattgtgttgttctgagagtactagtaattcaacagttttgtgtcacaattcagggactataccccccaacctttctcaagctgaggctgcttggttacaatcattctgcacagagaaggagcaaaacaagcacgccatcgcagttgctgctgccacggcggcagctgctgatgctgccgtggcagcagcacaggctgcggtggcggttgttaggctcaccagccaaggaaggggtcgcaccatgtttggtgttggacctgagatgtgggctgccatcaagattcaaacagtgtttagaggattcctggcaaggaaggcactaagggcattaaaaggattggtgaaattgcaggcacttgtcagagggtatttagtgaggaagctagcaacagcaaccctgcatagtatgcaggctcttgttagagctcaagctagaatgcggtcccacaaatctctcaggcccatgaccacaaagaatgaagcatataaacctcataatagagcaagaagatccatggagaggtttgatgacactaagagtgagtgtgcagttccaatccacagtagaagggtatcatcttcttttgatgctacaattaacaacagtgttgatgggagccccaaaatagtggaagtggacactttcaggcctaagtcaaggtctagaagggcaatttcagattttggtgatgaaccatcactagaagcactttcttctcccttaccagttccgtacagaacccctacacgtttgtccataccagaccaaaggaatattcaggactctgaatgggggttaacaggagaagagtgcagattctctacagcacatagcactccgcgcttcacaaattcttgtacctgtggctcagttgcaccattgacaccaaagagtgtgtgcactgataactacttgttcctaaggcagtatgggaattttccaaactacatgactagtactcagtcttttaaggccaaattgaggtctcatagtgctccaaagcaacggccagaacctggtccaaggaagaggatttccctcaatgaaatgatggagtctaggaatagtttgagtggggttagaatgcagaggtcttgctcacaggttcaagaagtcattaatttcaagaatgttgtgatggggaagcttcagaaatccacataa

SEQ ID NO: 68128 - DNA, 343 bp, Glycine max
  Peptide Sequence Number=SeqID_184906
atgggaaatgcaagatttcttaaggaagttaagtttgaaagggaagaaaacatgaggaatgttgtctttgaggaagaacctattatttacagtgatcaagtcctcatacctattcctactcaagacataaatttagtaatagaaaataatgttcaaactattattgatgacattcttctagaacaagataacaatgaggatgatgttggtttaatagaagatccaataaacttttatcaagctatgcacaattcttactctcaaaattggattaatgccatgaaggatgagatgaagtctatgaaagataacaacgtttgggatctcgttgaattgtctgaag

SEQ ID NO: 68129 - DNA, 180 bp, Glycine max
  Peptide Sequence Number=SeqID_184907
atgatgtaccagtactcatttaggacactgaaattggtcattgcttctctatcccccactaccacatcagatttatttgctttgctaaccagttctgttgcactgcaaggtgcaaacgctgataaaaacaagattcagattaaagagagaggtgacaaaggaaacaactcaaacaagtag

SEQ ID NO: 68130 - DNA, 669 bp, Glycine max
  Peptide Sequence Number=SeqID_184908
atgacaacggaaagtggtggcaacaattggaggcaccaacagcgggttgttaacggcacaagacgaagcgaaacacaaagaagaagggggcgcaccaacaacataatagagatcaagcgcagacatgggaacttacaaaggaagaaacgcgaattgatgatggaggtcaccaaagacgaagctgcaacgccaggatcaggaggtgctcaacctcccaatccaatttctaacggtaaccctaatccaaatccaaaccctaacccgaacatgcctcacacccccagaggatccaaaggaaaatcgtgtaagggatgcacctactacacatcgcttcataaggccaagtccaaaaaccccacatgcgttggtttctccagagcactccagcaagtacccccttttgttgttggagaaactgagttggaagcttcaaaagagggccgcagccttgcaaatttcaagtatgcatgtattggatactctgtctacttagacaacaaagattcttctgctggctctcaggataaaacagcaaaattgcccttttgtgttggtcttgaggtggtcttagtggagaaagcttcaaattcagatgctggccatgttcctgctactcataaaactgacggtattgaaattcttggtttttatttttatttacagttctag

SEQ ID NO: 68131 - DNA, 441 bp, Glycine max
  Peptide Sequence Number=SeqID_184909
atgtgggtgttttacctgatttcgctgcctctaacaacaggcatggtgcttttcacgcttaggtacttcgctggccccgatgtccctcgctacgtgctcttcaccgttggatatacctggttctgttctctctccatcatcatcctcgtccccgctgacatttgggcggaaattgcggttgtgatgtggttgcggagtgtggactgttttttaaaacctcaggcactgccagagaaacaatgtttagttggacgtgtgaattgtttttatgacacatgcagacaatgtcttctaaccaagagaatggagctatttcattcttctggagctggtcctattggagtacatttttacttacttggtatgcttcaatgttacatgtttgcatcactttcacatccttttgtgtacttcaaagttcaaacatattgcattgtttag

SEQ ID NO: 68132 - DNA, 1437 bp, Glycine max
  Peptide Sequence Number=SeqID_184910
atgaaaacaagcactactacaactacaaccatattagccatagccacctcttacttgtttcttctgatcacgccaacccaaaaatccacgtaccactctctcttcatatccgattccctatcagacaatgcctccatatacaaccaccttaaaactctcacccgcagaccccatgtcgcaggttccaaagccaacgctgaagctgcctcatacgttgtctcagtcttcacctcctcatacataccatcacacatagtttcctacgaggtttctctcacgtaccctttgtcacgttcgttggttctaataacgaacccttctacaaccttcactctccaccaagaaacctacgagggtgatccttatgctgacgtggcagatgaggttgtccccactttccacgcgtatgccaagtcaggcactgtggctgctcctgtgtgttatgtgaactatggaagagtggaggactatttgactctgaaggataaaaatggtgtgaatgtttcaggcactgttgtgttggcaaggcatgggaagatatatagaggggacattgtgaagaatgcttatgaggaaggtgctgttggggtggtgatatattcagataggaaggactatggtggtgaggaaaagtggtttcctgatgagaagtggttgccaccaagtggggttcaggtggggacagtgtatggtgggttaggggaccccacaactcctggttgggcaagtagtagtagtggtgatggagagtgtgagaggttgaacaaggatgaggtggagaagggaggtgatgttcctctcataccttcattgcctgtgtcagctgctgatggggagaagataatgaggtcaattggtggaccagttgctgaggatgattggcagggaagcaaggatgcccctatttacaggcttggaccaggaccaggaattctcaaccttagttacaaggggcaggatgttatagccacaattcaaaatgttattggtgtgattgaaggggcagaagagcctgaccgatttgtcatactaggtaaccatagggatgcatggacatttggagcggttgatcccaatagtggcactgcagcactgcttgagataggatcaactgaatgggtagaagagaacagagaaattcttgcttcaaaggcagttgcttacttgaatgctgattgtgtagtaggtggaccagggttcaatgtccgtgccactccacagttagatgaattgatcaaaagagcaactcaggaggtcaaagaccctgataactcatcacagagcatttatgaatcttggactagttctggtagttctcctctgtttgggaggttaggaggtggaggatcagactatgcatctttcttgcagcatgtgggaatcccggctgctgacatagcctttggaggaggtaacagacaaaactcattgttttga

SEQ ID NO: 68133 - DNA, 2772 bp, Glycine max
  Peptide Sequence Number=SeqID_184911
atgacgtcttcagtggtggaaggtggacgcgacgaggggaaacacgagccgtcggatttgatcacggaaaccatgaatctgacggctccaaacctttcacttcccagtgaaactgaaacattcttgagcgcagcaatttccctcaaggacaaggtggtggaggagacttggaaccggagagatcaagtggttgatccgacggtgtacacgggactgttgggcaccgcctttacttgcttgcggtcctaccaggttaccggttgccggaacgacttaatattatccagcgaaatcattgacacgtgtgtcaccgctgcacgtgcctccctcagaggaggcgtttatgcgcttggtgctgtcgttgccaattacatgggggaccttcaaaagcgtgacctgtttttgggtctattcattgaggtggcaaaagagagagccctaccagttggaccagaggaaggtggttttggaatgtcatatgatcttctgtatggacgagctggattcttatggggtgcattgttcgtgaacaagcacctaggagaagatgcagtgcccaaagacattttgatgcttattattgatgcggtgttggctggtggtagagcaggagcatctgatattaaagactgcccattgatgtatagatggcatggaacaaggtacttgggtgcagcaaatggccttgctggtatccttcatgtgctgctacattttccacttccaagtgaggatgctgaggatgtcaagggaactttgtggtacctcatgagtaagcgtttccctcacagtggaaactatccctccagtgaaggtaatccaagggataagttagtgcaatggggtcatggggcgactggcatggccatcacgttgtccaaagcagcagaggtatttcctaatgacagagaactaagagatgctgcaatagaagcaggtgaagttgtatggaagagtggattggtgaagaaggtgggacttgcagatggggtatctgggaatgcctatgccttcctttccctctacagactcactaaagagagtatatacgaagagagagcaaaatcattcgcttccttcttgtatgataatgcaaaatctctggctgctgccaatggctattcacttttccaaggacttgctgggacagcatgcctctggtttgatctgcttgcacccgacaactctaggttcccagtgagactgcaacacgatggggagaggaaaaggagggaaagagcatttccagcagaacagagagaatgtgtggacatggaaacgagcagggaatcgctttcgataaaacatgtcatgtctagaaatggatatattgattgtcttacacatggaaaagtcgagcatgattcgtatttctggagtttaggaggaaataatgccttcattgcttatgattatgaatcaaactacttgaattttcttgtgtcatctgaaagggttttgaaggaaagctgtgtgagtggggctgtctatgtttcttctttgccacaccccctcgggtttaaggttgttgtgcagcagtatgcatttgcatctgaaggtgtgagtttggatgtgcaggtatgtgacaagggcaagtggttcgtctcttgcaaagatgttcccatgtctcttagaaatgtagtttttcccagcatgtttccaaatggtggaaactatcaggatgttgttgatacagagaatcctgtgatgcatgaatttactgaggaagtttctgatttcccacttgagcggttcatgaggttactgcctcatgatcagaataccggagctttctttattgcagtattgcagaaagtttctcctctgccagacaatgaagatgcacaagaattgcaggttaatccattggaaagtacacctgaagaaatttcagaggctaatataaatgacaatggacctaatacagatttgaaagttagttctgctacatttgaagaagtggatttcaaggcagctcaagatccgtgcaatgtagaaaacataacaaagaatactccaggcaaaagaaaactgcagattcaaggcaaatggagaggcattgaccctgttgtcttcttcaaagatgaagtagttattaacagcataaaggaattttatgctattgacgagcagtttccattcaatggtcaccttgtaactaggaacagtgatacaagccacatgaaaagaatttactacatctccaagtcagtcaaagatgttctggagttgaacttctcagtcggacagcaacttaaaataacttctgttggcctgaagatttttgaaagacaaacgtcatgtgaaggtaggtctgcaccatgtgcttttcggatcacttctgaaggattgccccttattctccctcacatctccaaacagattctgagttcatctgctatagacttcaagcatcttctgcagtatagagctgtaaaatttgcagattttgtcgatgccaagtttggtgaaagggctgcaaacctaatgcccggctgttgtgttgtagttctggggagcagaggtgctgcatggcccctccaagtggatgagtcaacaatagccattggctgctggaagggtagagcaagtttgactgtaatggttggtgcattggaatgccaagaactgctcgaaaggcttataatgcgtctagaaaaagtaacagaaaaggactcctccatgcataagaacagaccgtctgataacaagggagatgaagcacaagaatcaaacggtaaaaatgaagatgttgaaattactgggtgttaa

SEQ ID NO: 68134 - DNA, 303 bp, Glycine max
  Peptide Sequence Number=SeqID_184912
atggatctagatgcattcactgccagcctattcaagtgggacccatgcaccgtcctcccgcccacggcacccccgcgacctcttctcctcgaatacgcaatcgctccgtcgctagtgaccctagcgttccatcccgcgagggcggcagcgccgcgcgagctcagaggactggaggagctctttcaagcttacgagatctgctactacacggcggcgaagatcgctgagctcgggttcacggtgagcacgctggtggacatgaaggacgaggagctcgacgacatgatgaacaatctctcctaa

SEQ ID NO: 68135 - DNA, 258 bp, Glycine max
  Peptide Sequence Number=SeqID_184913
atggtgaatgagtctgagatcgtcatttttctaaaacaggctcgtgggaatctcgctagagaactggttgtaggaaaggtttatcaactaaagctgagagaggtttgcaatggagctcaaaatctcgtcaaagaaagtgttcgacgagatgttgagggttctgaggctgagggggagttcgtcaaggatgttgccaaagatgtggttttgcacggtgccaagaatctgaaggccgatgaggttcgcgatctccactag

SEQ ID NO: 68136 - DNA, 1068 bp, Glycine max
  Peptide Sequence Number=SeqID_184914
atgtcttctttcccccgttacgacttcgatctccatgatgatgagatggagatggactttctgcgtgaacggtatcaggaggacaacagaaactatgatgtgtttttgagtttcagaggggaagacacgcgtgcttctttcacttcacatctctataccgctcttcacaacgagggagtctttgttttcaagaatgatgagacacttccaaggggaaatcaaatttcaccctcgctgcggttagcaattgaagagtctcgaatttctgttgttgttttctctacaaactatgcagagtcgcgatggtgtttgaaaatgttggagaacataatggagtgtcagagaacaacagggcaagtggtagtgccagtgttctatggtgtatatccctctaaagtacgccatcaaacaggcgactttggaaaagcatttcgaaaccttgaggagaacagacttttaaaagtgaaagaggaaaagctgctaccatggtggaagacgcttgctgaggccgctggcatctctgggctttctgttgtccgaaattgcaatggtcgtgaggcacttcgtgataagatagatctcctcgtggagcattggagggaggcacttcgtgaggctgctggcatcttggggggttcagtctcagaattgggaaaaatggacattgctaatctaatagactactttgtggggcattggaaggacggacttcgtgttgccgctcgcttcccgcggggaaacaaagcttgcccaggagataaacctcctcgtgaagcattggagggaggcacattgggagctttatggcatatcaggggtgttgaagaggggatcagaaaagattttgaggtacatgtatcaagtgttgaagaggtgatcataaaagattttgaggtccttgtaattcattggacggaagcacttcatgaggctgctgccatcttgagggcatttgcatactattgcggtggtggttgtgtcatagtgaaagtttttgtggctggtggctattgtgacggcagaatcacttgtgaaggtgaagaggaccaaaagggtggcaatgagtag

SEQ ID NO: 68137 - DNA, 267 bp, Glycine max
  Peptide Sequence Number=SeqID_184915
atggcaaagttaaccataatccagttcaaacttttggctttggcatctatcaacaattggtttattcaccaattggatgtcaataatgcatttctccatgggaatttgaaggaagatgtgtatgtgcaagtgcctcaactgtcaggaaagaataagttgattcccttactactcgtgtatgtagatgacatagtcattgttggaaattctatggatatgataacttcattcaagcagattttagataatcaatttgggcattcttaa

SEQ ID NO: 68138 - DNA, 246 bp, Glycine max
  Peptide Sequence Number=SeqID_184916
atgtgggatgatccaacagtgacatttagagggccaagcaaggccaggggtaagagatcaaaggtccccactacttcaacaccaccagagatagtagctccttcttcttccacagctccagtacctcccattcagactccagtcattcctgctccatctactcagataccacttcctgctccatttccattccagcttccagctcctttatctgcaggaccttcagatttttcatttacacaatag

SEQ ID NO: 68139 - DNA, 231 bp, Glycine max
  Peptide Sequence Number=SeqID_184917
atgtccaattctgaattccaggcgaagtgcattggtgaggctgaagacaagtatgcaagtttactgaaatcacttgatccacatctctctctgagctaccagaaaagatgtgcagaagccactaaagaaggtggaaaggtatcagagcaccctcttggaacatggagtattccaaccgtgattcaagatgaggaattgtatagattaaagttgaagtcagatatttcgtga

SEQ ID NO: 68140 - DNA, 4134 bp, Glycine max
  Peptide Sequence Number=SeqID_184918
atggggaacaaaatcgcgcgcacgacgcaagtatcggcttcggagtactacctacacgagctgccgtcgacgtacaatctggttctgaaggaggttttaggtcgcggtcgcttcttcaagtcgattcagtgcaaacacgacgagggtttggtccttgtcaaggtctatttcaagcgcggcgatttcctcgatctctccgactacgagcgccgtctctctcagatcaaacacatcttcacttccatcgatcaccctcacgtctggccctttcagttttggcaagaaacagataaagcagcatatcttttgagacagtttttcttccataatctgcatgataggttaagcacgcgcccttttcttagtctcgttgagaagaaatggttggcttttcagttgcttgtagctgtaaaacagtgccacgagaacggagtgtgccatggtgatatcaagtgtgagaatgtgctgattacgtcctccaattggctttaccttgctgactttgcatctttcaaacccacttacattccatatgatgacccctccgatttctcttttttctttgacactggtggacgaagactctgttatcttgcacctgagagattttatgaacatggaggggagatgcaggtggcacaagacacccccttaaaaccctatatggatatatttgctgtcgggtgtgtagttgctgaacttttccttgaggggcagccactatttgaactgtctcagcttcttgcttatcgcagagggcaatatgatccaagtcagcatcttgaaaaaataccagatcttggaatccgtaagatgatattacacatgattcagttagaaccagagtctcgattttctgctgaaagatatctgaaggaatatgctgcagttgtatttccaatctatttttcaccatttctgcatgacttttaccgatgctggagtcctcttcattctgatatgagggttttactatgccaaagtgcttttccggagatacttaaacaaatgatgaacaataagtcatatgatgatgcaggggttaattctggtgaacttttggaaaacatggttgctaaagaaagtgtgagtttcatgaatgattcactgatgaagagagaggacataggcaaaggcttagtccatgatcactatgaacttctaggtgatattaatagcctactgagggatgctaaaaaaaataataatcaatcgcatgtagcagaaaatgcacataattctacctttcctgaaaatctaaaaaatttgcaaactggtaaactacttcaaactatctccaatgcatttcgaggaaatgaccatccctttctgaaaagtgttactatgaatgatttaaattcattgatgtctgagtatgatagtcaatcggatacgtttggaatgccttttctaccattaccaaaggatagtatgagatgtgaaggcatggttctgataacttctttgctctgctcttgcatacgaaatgtcaagttgcctcacttgaggagggcagctgtactcttgttgaaggcttctgccctatatattgatgatgaagatcgtttgcagcgtgttatcccttatgtgattgtgatgctttctgattcagcagcaattgtgcgttgtgctgctttggagactttgtgtgacattcttcccttagtgcgggattttcctcccagtgatgcaaaaatatttcctgagtatattcttccaatgctttcaatgcttcctgatgatccagaggaaagtgtgaggatatgctatgccagcaatatagctaagctggcactgactgcttatggattcctgatacactcaatatgcttgagtgaggcaggtgtccttgatgaattgagttcaccacagaagccattgacatcatccactcatagttctggaagattgaagaggataaatggtgatgcccaacttctgcagctgaggaaatccattgcagaggttgtccaagaacttgttatgggtcctaagcaaaccccaaatataaggagagcacttcttcaggatattggtaaactgtgctgcttttttggtgtgagacagagtaatgactctcttttacctatccttcctgctttcttaaatgatcgggatgagcaattaaggacagtattctacgaaaagatagtttatgtctgcttttttgtgggccaaagaagtgttgaggaatatttattaccttacattgagcaagctttaagtgacgtgacagaagctgtcattgttaaagctgtagaatgtatgactattctatgcaaaagcgggttcttccggaagaggatattgcttcaaatgatagagcgcgcctttcctttattgtgttatcctagtgaatgggtgcggagatcggttgtctcttttattgcggctagcagtgagaacttgggtgcagtagattcttatgtttttcttgctcctgttatacggcctttcctccgcaggcaacctgtgtctcttgcttcagagaaggctctgctttcatgtttaaaacctcctgtctcaagacaggttttttttgaagtcttggagaactccaggagttctgacatgttagaaagacagagaaaaatatggtatagttcttcacaatctaaactatgggaaattgatttactgaaaaaaggaattgatgagttggattcattaaagaactggagtgacaagcaacaaggtcatggggttcaacaaacagttggcactgccttccaacagccagggataactggttgtgacaaagctgaggcaaaattgagagatatgggggcctttatgcataatgatagcaataatgtggtacatcgtgatacccaatgctcagagaagttacagttttcaggatttatgtcaccacattttagtggtatgaacagtttgacatatgaaaagccatcagaaggcatacctttgtactccttcagtgtggacaggcgaggaatgggaatccctcctgcagcatctgatcctccactgccaatgaattctctgggtgttagttcatctgcaatgccttgggttaatccacttagtaagtcctttaatttggctaattcagttccagcaccaaagctcttttcaggttcttttagtatcagcaatggttctaaacagttccatcgagtggtacatgaaccagaagccagggaaaatgagacagcctatgttaataacacatttcaagatgtgggattatctgctaatattaaaggtacttcaattgcattggaagatgcaacttcccaaactgatctatctggatttccatcatttgctcgagcttccattcccgactctggttggaggccccgtggggtgttggttgcacacctccaggagcacctttcagctgtcaatgacatagctatatctgctgatcatagcttctttgtgagtgcatctgatgattctacagtaaagatttgggattccagaaagctggaaaaggacatttcattcaggtcaaagctaacttatcacatggagggaagccgtgtgttgtgtgcaacaatgcttccaggttctgcacaagttataattggagcgtctgatggatttattcatatgttttctgttgatcatatctctagaggtctaggaaatgttgttgagaaatattctggtattgctgatatcacaaagaaggatattaaggaaggtgccatactcaaccttttgaattgccctgtggataactataccatcatgtatagcacccagaactgtggcattcatctgtgggatactaggtccaattccaatacctggactcttaaagctactcctgaggagggctatgcttcttctctggcatcagggccttgtggtaattggtttgtatcagggtcatccaggggggttattacactttgggatctgaggtttcttatacctgtgaattcttggcagtattctcttgcttgccctatagaaaagatgcgcctctttcttcctccttcaaatgcttctgtttcttcagctgctaggccccttgtttatgtggctgctggttgcaatgaagtttctctttggaatgcagagaatgcgagctgccaccagataataaaagcaatatgtggtagaacgaaatgcagtaccaacaaatattccagctaa

SEQ ID NO: 68141 - DNA, 378 bp, Glycine max
  Peptide Sequence Number=SeqID_184919
atggcttcattcaattcaattcagaactccaccaccccaatcttgcttattactattctcattacatttctactccaccatcttctgtgcccagtttcttgtttcaaccagccacaacatgcaattcctccaccggaccctttatgtgaggagaaaaacagattaggttcaatgcctcctacttgccacaacaagtgcaaccggtgtcatccatgcatggcagtgcaagttccagcctcgcctagccatgaacgagttcacccaggtcttgccccaactgctgcaatggaagttttctttctccaaggtaacaggtactccaattacaagccattgagttggaaatgccattgtggtgaccactttttcaacccttag

SEQ ID NO: 68142 - DNA, 2220 bp, Glycine max
  Peptide Sequence Number=SeqID_184920
atggataggttttcaattgcagccattgcggccgccatagcggctgttcaggtgttacaaaggttatcatttattggtgctttgggccacatgacaagagtctcaccacagtttgagaagtccaggaaagtaagtggacctagagctttgcagcctagccagtggggcatgctttgtccttgtgatacccctgaaggtgagtcttgtggactagtaaagaacttggctttgatgactcatgttactactgatgaagaggagaagcccttgatttctctgttctattctttggatgttgcacgcatagaacacctctttgcagaggagcttcatacaccggattcctttcttgtcatttttaatggtttaatccttggcaagcataggaggccactgcattttgctactagaattagaaagttgcggagagcaggtgaaattggtgagtttgtgtctgtctatgtcaatgaaaagcagcattgtgtctacttagcttctgatggtggtagagtttgccgtcccctggtcattgctgacaagggaatatcaagaatcaaacagcatcatatgaaagaattaatggatggagtatgcacatttgatgattttttacgagatggcttgcttgagtatcttgatgttaatgaagaaaacaatgctttgattgctttatatgaaggagatgccacatcagaaactactcatattgagattgagccttttaccatcttgggagttattgcagggttaattccatatcctcatcataatcagtcacctagaaacacgtatcagtgtgccatgggtaagcaagctatgggaaatatagcatttaaccaggttggatatgataagcttggagccggtcaaaatgccacagtagctgtaatgagctatagtggttatgatatagaagatgccattgtgatgaacaaggcatctcttgatcgtgggtttggtcgttgtattgttatgaagaagtataatgccatcattcagaagcattcgaatgacacatcagaccgaatacttaggcctaatagaactgcagacaccgctggacgtatgcagatacttgatgatgatggtattgctgctcctggggaaattcttaggccatatgacatctatatcaataaacaatcaccgattgatacacgtactccaaaaacaggatctgcagcaaatttgccagatagtgcatatcggtccaatgcacaatcattcaagggtaatggaggagaagtagttgatagggtggttctatgctcggataaggataataacatgtgtatcaaatttctaattcgtcacactcgtagacctgagcttggtgataagtttagcagcagacatgggcaaaaaggtgtttgcggaactattgtcccgcaagaagactttccgttttctgagaaaggcatttgtcctgatctgattatgaatcctcatggtttcccaagtcgaatgactgttggaaagatgatagagcttcttggggggaaagcaggggtttcatgtggtaggtttcattacggcagtgcttttggggagagaagtggtcatgctgacaaggttgaaaccataagtgaaactcttgtgagtaaaggcttcaactacagtgggaaagatttcatttattcaggcctgtcaagtcgtaacttgcctgtgtataagttcacaagtaacagctgtggtgttgagcaggtgcttgataagatgcatgctcgtggtagtggccctcgtgtcatgttaactagacagcctacagaagggagagctagaaatggaggtcttcgtgttggagaaatggaacgtgattgcttgattgcatatggtgctagtatgttaatttatgagcgactcatgttgtctagtgatccttttgaagttcaggcctcttatattattggtttcattatagattaccatttggtagacgtggagacaatgttctatggattgggatcaggaagggaagagagtggagatattgaggagggagatattggcatggcaccgattgaagaaaagatgacagaaaatcgggtaagtggtttggcatgtctaagaaggccaatggaagcaccaatgaggaatataaattacatggtttttagtcctgtgaaaaggggaagaggtagaccgagaaggacattggaggaagttgttaagaaggattttatggatatactggagctagacatatactcatacatgtag

SEQ ID NO: 68143 - DNA, 1230 bp, Glycine max
  Peptide Sequence Number=SeqID_184921
atgattgaatacaatacagggaccggaatagagaagccagactatttggcgacagtggatgtggatccaaactctccaacttattccaaagtcatccataggcttcctgttccttatttaggtgacgaattgcatcacacaggctggaattcatgcagctcttgccatggagacccctcagcagaccgacgatttctcatcgtacctgcactcgtatcaggtcgagtatatgtggttgatgtgaaaacaaatccaagggctccatctttgcacaaagttgtcgagcctgccgatatcatacagaagactggattagcttatccacacacatctcactgccttgcttctggtgatataatgatctcgtgtcttggagataaagatggaaatgctgcaggaaatggatttcttcttcttgattctgagtttaatgtgaagggaaggtgggagaaaccgggtcacagcccactatttgggtatgacttttggtaccaaccacgtcacaataccatgattagcacatcatggggtgctcctagtgcttttacaaaaggttttaacttacagcatctctctgatggattatacgggaggcatctccatgtatatagctggcctgggggcgaactgagacaaacaatggaccttggtgattcagggcttatacccttagaggttgccatatcagtgaaaccattgaaagtgcaaaactggattcttcctgaaatgcctgggcttataactgattttctgatttctcttgatgatcggtttctgtattttgtaaactggcttcatggggatataaggcagtataacatcgaggacgttaaaaatcctaaactgactggacaagtatgggttggtggacttatccagaaaggaagccctgtagtagctataactgatgatggtgaaacatggcaagctgaagttccagagattcagggaaacaagttgagagggggccctcagatgattcaattgagtttagatgggaagcggctctatgctaccaactcactatttagtacttgggacaaacaattttatccagagcttgtccagaaaggctcccacataatacagattgatgttgatactgagaaaggtggactgaaaatcaaccccaacttctttgtggactttggaactgagcctgatggtccttctcttgcccatgagatgagatatcctggtggtgactgtacttcagatatatggatttaa

SEQ ID NO: 68144 - DNA, 288 bp, Glycine max
  Peptide Sequence Number=SeqID_184922
atggagcatccatctgcagatagtttgctagttgaggaggacaaagtgcggcagaatcgttgtgttgtacttataacaaatgtcaaacctggaaaactacgggatgtgatgtctcaaggattggtattgatgttgcatttgctaaattgctttgcggtcttatgtgcttcgaatgaaggtccaaccattgtagagcccttgcttctccacaaggatcacaaattggggaggtatttctttttctggttagacgtgggtaatgatcaggtcaaggtggaaacggattga

SEQ ID NO: 68145 - DNA, 483 bp, Glycine max
  Peptide Sequence Number=SeqID_184923
atggccattgcaccttttggtaatacatcagctactcaatggggaattcatcctcagattttcgcgggatcgactgggttgggaaagattgcatcatccaggaacaatgttacaagcaggataaggtttatggttgccccatgttcgagctttttttcttgtcattccttgcatgcactatttgacaaaggttcatcgcaaactttgcaacatcgcaggggatcgaggttaatagttagagcagatgcagattactattctgtactcggggtgtcaagaaattccagtaaatctgaaattaagaatggcaccgtctcccttggtggtgccgtcaccactgtcaaccccacttccactgctgcatacatgtgtgcaatttgcagaagtttaaaattgcggatggggaacatcaatgatcaggaggatgatgatagaggcttatcggaagctgcccggagttatcatcctgatgtgaacaagtga

SEQ ID NO: 68146 - DNA, 483 bp, Glycine max
  Peptide Sequence Number=SeqID_184924
atggaggattgggggaattttctccaccaagtccttgaggaggattatgaggattccacttcgattaaagtgttcctcttggtgtgggggttaggcgtcaagcagtggcagctcgcagcgaccaccggtggtcgtgggtgctggagaaggagcgagctcttctcgctaagtcggagtccacttttcacgcttagagcgacaattcgggcttcgcgcaactccctctgcactagggttcacttagagggccaaaaatcgctcagcgcaactcccttttgggttggaattgcgcttagcgcgcccttgcttgctcatcataattccctctcagggtgttacaggaaatctgtttcacttgcaatccaagcaaaagttaatgttcaaagaagggaaggtttgagtttgactgggggcagaagtttgacaggccaaaaagagcatcctaatgttaaacccaaccaaccaatgaaggcaagtgtttag

SEQ ID NO: 68147 - DNA, 423 bp, Glycine max
  Peptide Sequence Number=SeqID_184925
atgtctttctcgacatcggagacccccttgccagtaagaaccttggactttgtctctgaatgtttgacagtatcaatgtcaaaggcattagcattcttggcactcttgttcctacacaggaaaatgaagagggacagagccattgagaaggttgtcggagatgttgaactggtcgaggatgagtttgttcaggtcagggattgggtcggagaattggttgtttttgagaaacaaagttttctagcaggtgaggctattgaaggtggtgggaaagggcccgaagaagttgttgaaacccatgttcaagcgaaccagtacgccaaagagagcgataccggggaggtgaagctcaacaacgtggtgcgactgagaactaaggcggcgacaatgaatgacgtggaagcctatgtgtatagtgactag

SEQ ID NO: 68148 - DNA, 237 bp, Glycine max
  Peptide Sequence Number=SeqID_184926
atgaataacgtgacatgtcgtggtttctgcgtcggtgcagaggggttggtggatgaggtcaatgacaacgatgttgtcagagtcggaggatgcggtggcggttgcggcggaggggagggagtgtggggaagtgaggtaggaagtgagatcgtggaaggagatcgagagaagcgaagtgaccgttgtagaaggagttggggtcgaggtggaggatggttttgccgacagcggaggtga

SEQ ID NO: 68149 - DNA, 909 bp, Glycine max
  Peptide Sequence Number=SeqID_184927
atgtccaattctatctccgacccgacccgaataattcactctcaggatccgaataccaccgcggaccctcaggttccgcttcggaacctttcccaggttcggaacagaatggattctctacaacacttcctatctcaatccatcaataccaacactcccctcaccgtcgatcaaatcgccatggtctccagccagatcctctcctccatccaccaagtcatcgtcaacggcgccgccctcgtctcttactctcagaattccatcgccgccggagcaccggatccaccgccgtatccgaagaagccgaagccggaaccttcagttgccgataaagcgaagcaaacactcgattccaaactcgagcctctcgaaggcgacgacagcgaaatcgtggagctcgacgccgtcgaaatcctcgcggagcacatgcacttttgcgagatctgcgggaaaggcttccggcgcgacgcgaacctccgcatgcacatgcgcgcgcacggagaacagttcaagacggcggaggcgctggcgaagccttcggagaaagcctcgctgcaaccggaacaagctccaccggcggttccggccgctgaaatcggtgatttgcgtgaagaaccacttcaagcgaagccactgcccgaagatgtacacgtgcgagcggtgtcgcaagaagcacttctcggtgctctcggatttgaggagccacttgaagcattgcggaggagaggccagggccacgcgcctgcgctcgcgtgtgactcagagggtaaagggaaacaaatggtggaggacgacgaagatccaatgttgatgagtgaaagtggatttgaattggatgattgttttttggatcaagagtttcccgaaggcttctttgatgattttgggtccattgatgactactgttaa

SEQ ID NO: 68150 - DNA, 474 bp, Glycine max
  Peptide Sequence Number=SeqID_184928
atggctgcaatggcagattttttgccaaccgccataggcaatttgagaagggaggcccgccatggcagagccattgaccacaatggtgtgtttatatggccgaattttggccttccaccattgataacactatttgacagacttctgatgtccaaacataattcatcaggattagaagtactctttacacagctgaaagacctgcaaaacgctgttgcagtaacaagtattgccaaaattctcgaggccaaagtaacgctctccttcggggaattggtcgccgagagccttctcgagcttggagcccgcagcacccatgagcgcgtcgaaccgatcaccgcgactcagatctttatccggttcaactcagcgagtcgcatcgcacagcatcaaatcgctagggtttgtcgagcgaaagagaatgcagatggaggaagaaaaaatggagaaaatggaaagaagaacggcgtttag

SEQ ID NO: 68151 - DNA, 705 bp, Glycine max
  Peptide Sequence Number=SeqID_184929
atgtggaacaactttccagctttgatggaaaagaaaggttggaaaagtctcaacgagagtcataaagaacatcaaattcgggagtttgtggacgggaatggaaacgtagctgtcggtttgaagttgcataataaaccaagtaatgatggccttaaccgacagtttcctctagagattccgccgattctatttgaagagacttcacttccagcaggattgcacggttcacatactaaagatgtttatagtatttcagtgttgcctgaggaagatgaaaatgcaaattgcgcttcaccactacctttcttgagcatcttaggggttcctaatcaagttaaaagcccaatgtgcttagatgatcccataaattgtcaaaactgcattgattttcaaatgaagaatgagggtgtgtattcccagtgcataattgatatccctagtgtcaatggaaactcagtttcacctgaatcctatgaagaggcagttgaaggttttaaaactgggaactcaccaacaagtgtactgtggagagaatcaagtttcaaagcggggaaacttatgcagagtctggtgaatgtgagcaatccaagagataaaccagtctctgagaagctacatgatttaccgagtaacagatggagaaaatataagcgtgctgcctcatttgattccagaaaagttgctcttctgttttcaatattgtaa

SEQ ID NO: 68152 - DNA, 624 bp, Glycine max
  Peptide Sequence Number=SeqID_184930
atggcgactgtgtcccctctcgccaaatacaagctcgttttcttaggcgatcaatcggtcggcaaaaccagcatcatcactcgcttcatgtatgacaaattcgacattaattatcaggctactattggtattgacttcttgtcaaaaacaatgtaccttgaagatcgaacagttcgtctgcagctttgggatactgcagggcaagaaagatttagaagtctgattccaagctacataagagattcttctgttgcagttgttgtatacgatgtagccaaccggcaatcatttttgaacactaacaagtggattgaggaggtgcgtacagaacgaggcagtgatgttattattgtattggttgggaataaaactgatcttgttgaaaaaagacaggtttctatagaggaaggagatgccaagtcccgtgagagtggaatcatgttcatagaaaccagtgcaaaagcaggcttcaatattaagcctttatttcgcaagattgctgcagccttgccagggatggaaacactttcttctacaaaacaggaagacatggttgatgtaaatttaaaacccaccgtgaattcatcccaggcagagcagcaaggaggaggttgctcttgctaa

SEQ ID NO: 68153 - DNA, 189 bp, Glycine max
  Peptide Sequence Number=SeqID_184931
atgatgaacatgatgatcttggaagtgtgtatgcatcccatgcacatgaggatgcatggggttaggctaatacatggtgtcggtgttgaggacacgtggcgtgatggaattggtggaggtgagggtgagtggggaagcaatgccatcggtagcaccattttaggtttctttcaacagcagacaacctag

SEQ ID NO: 68154 - DNA, 230 bp, Glycine max
  Peptide Sequence Number=SeqID_184932
tggagccagtccaagtgattgaggtgacgtcatctgaggaagaccccgaggaggaaccagaggagctacctcctgagcctgctgtggatgctcttgactttctagagggtgatgaggacccacttcctgaggtggattctcccgaggacgtcatgtcggcatctgaggcagactctacggaggagagcggtcccggagggatagcgactagtagaggttcttcatcatag

SEQ ID NO: 68155 - DNA, 327 bp, Glycine max
  Peptide Sequence Number=SeqID_184933
atgacgtgcgaccattctttggtcctcgtgaggtgcttggcacccatcattaggcaatttgtgaaattccaagacatgccgaaaaaccagagagatattgatgcacaatcccacccaggcccacttgggccctccggaatattcctccagaaggcggttgcttctggaggaagcaaccctgctcgcctgggcgagctgggcggcaaccacctcccctattttgctataaataggggaggaaggcaagaaggaaggggttcagcccctttggcacttctctctctttcgaatttgcttggaaaaattgtttccgtgaagaaaatctaa

SEQ ID NO: 68156 - DNA, 402 bp, Glycine max
  Peptide Sequence Number=SeqID_184934
atggccaaccagctgcagcgttatctgaaccgggcgaaagagggtagtgacgaatatcaaaaactgactgaaattaaggacgcgcttattcagcatggtggtaaatggcctcccgcgccggttttcattttctggggaacgatggatgcgctggctgttgcgatctactgtgcgcagtctgtacgccatgacagagtcccctttgtatccgatatcttctccttcattgcgacaggaaacgggccttctggtggtggcatggtgctttctgacagggaagccttttgcgagcaaactggcgctctgccaggaagttttccgcctgatctctttccggtgttcggtgaccctttttccgctgttgttgaacctcacgggggcccagaacgtctggctgaatag

SEQ ID NO: 68157 - DNA, 225 bp, Glycine max
  Peptide Sequence Number=SeqID_184935
atggtagccataacccctgctaggtttcctcaacctccatttttccgaggatacgactcgaacgcaatgtgtgcttatcatggaggagccccggggcattctattgagcattgtagggccctgaagcataaggttgtgaaaacaaagatggatgcctcagagccctacactgggggaatgaggggcatcgtgcatgaacctcaactgaacctaggtgcagattag

SEQ ID NO: 68158 - DNA, 249 bp, Glycine max
  Peptide Sequence Number=SeqID_184936
atgcagcaatgtcattacacgagtatttcaagtctccagaggccattcaggaaagattgggccaactgtagccgcataatgatgaccaaaatattgatggccaatattatggttggagagtggcttctgatgagaagcttgagtggggatgtttacattgaagtcactgggggcagtggtcccactgttaattactggtatagctcctggacgggtctgggttggttaaaattggaactcagtgaataa

SEQ ID NO: 68159 - DNA, 399 bp, Glycine max
  Peptide Sequence Number=SeqID_184937
atggtgtgtatagtgcagatcctagaaaagatatattctgcagttggtgatgctgtgattttgaagacactgtcttatcaagaagcatgggaaatgtcttattttggtgccaatgtcttgcatccacgcacaataattccagttattagatatggcattcccattataataaggaatgttttcaacctctcttcttctggaacaaagatttgccacccttctattattggtgatgaagataagcagatattcaaaaattatgtcaaaggctttacaacaatagacaacttggcacttgtaaatgtagagggaaccggaatggctggtgttccaggtacagctagcgctatttttggtgcagtaaaagatgttggagctaatgttattatgatatctcag

SEQ ID NO: 68160 - DNA, 291 bp, Glycine max
  Peptide Sequence Number=SeqID_184938
atgcagagaggcacgccagtgagaaagccacacaccaacacctccgatctcctcacttggtcggaaactcctccgccagaatccgccgccaccgtcgcctccgccacccgctctggccagccttccgatagaatcagcaaggttctccatggcggccagctcaccgacgaagaagctcagacgctagccaagaggtacgatacaacattcatttcttacttactctctgttagattcacaactcagatcagatctactagtgcttttcttttctcgatttcttcgatctga

SEQ ID NO: 68161 - DNA, 2067 bp, Glycine max
  Peptide Sequence Number=SeqID_184939
tcgcagattcaaatggagcccgagcccgaacccaagcttgagcctgagccagagcccgggcctgagtttagttcgaaagaggaagcattctcatactaccaaacctacgccaaatccgtgggcttttccgccataatcaaagccagccgtcgatctcgaatctccggcaacttcattgacgccaaattcgcctgcacccgctacggcactccaccgaaccctcaaaaacccaagcccaaacgggcccgaacaagccccaaaactgattgcaaggcctccatgcacgtcaaacgaacaccccacggcacatggatcatctcttccttcatcaaacaccataaccaccaaactaactcaaataataatgcaagtccttcgaggaagcctaagattaagaaaacgctgcatcatttggttttcgccgaaggagaccttcaatttctgcttgatactttcatgtctatgcaaaacgaaaaccctaatttcttttacgccgttgattttaatgaggagcagcgtttgagaaccgttttctgggtggatgctaaagccaggcttgattacagacactttagtgatgtggtgcttttggacaccatgcatgttaaaaatgagtgcaaattgccctttgttccgtttgttggtgttaaccaccattttcaggtttttttgcttgggttggcgtttgtgtctgacgagtccgaatcgacgttttcgtggctgatgaggagttggttgagagcaatgggaggatgtgctcctaaggtgatgctcactgactgcgacgaggcgctgaagaaagctgttgctgaagtggctcctgagtcttggcattgtttttgtctgtggcacgtgttgagcaaggttccagagaagctcggtcgcgtgatgcaacggcatggtggggagtttttgactaggtttaacgagtgtgttttgaggtctaggacaaaggagcagtttgagaagaggtgggggaaaatggttgggaagtttgagttaggtgatgagagttggttgtgggatatttatgaggatcgcgaacggtgggtaccggcctttatgaaaggcagggttttagcagggttgtctaccgtgcagagatcagaggctatgaactgtttgtttgacaaatatgtgcagaggaaaactactttgaaagagtttgtggagcaatacagagtggtattgcaggataagtgtgaggaggaagcgaaagcagattttgtaacgttgcatagacagccagcgttgaagtccccgtcgccgtatgggaaacaaatggtggagttatacacgaatgaggtgtttaagaagttccagagtgaggttttgggagctgttgcttgtcatccaagaaaagaaagagaagatggaccaacaaaagtgtttagggttcaggattttgaagacaatgaagattttgttgtcacctggaatgaatcgaccttggaagtgttgtgtgcctgttatttgtttgaattcaatggctttctctgcaggcatgtaatgattgtgctacagatttctgctgtacacagcatcccacctcggtatatattgaaacgctggacgaaagatgccaagagtagacaaacagcaggagatttgtctatgtcagatgcagttgtctctgactctagggctaagcgctataataatttatgtcagcaagcctttcaattgggtgatgtagggtctttatcacaagagagttacattgctgctataaatgcattggaagccgcattgagaaagtgtaagagcctgaatgattcaattcatagtgtcaaagaaccgaacctgccatgttctggttctcaagaagggattctgatcagtaacagtgttggtcatagcaacaaaagggatagtactcttggaaaaaggaaggtatgcccagaaccagagacagttgctattggagtaaattctaactggcagcaagtggaaaactccaatacacaagcagctggtcttgattgttcgtatgaatcacaacagagcattcaagagatgggtcagctgaactcgagctcagaacccggatggttatttttcttctga

SEQ ID NO: 68162 - DNA, 381 bp, Glycine max
  Peptide Sequence Number=SeqID_184940
atgaaaaccagagtatgtcagagcagagagaatcaccggaataaagagggtcaccggacaaagtgggtcaccggagggttgacacatagggaaggttttgtgcagctagggttcgacctaaagaggaatacaacttataacctaattgcgactgatgatgacctacaagtgactaatcagaggttgtctgttgggatgacacccaaaacacttaggctgcccaaacctggcgagatgtccatggatcacctctgggtgcttacaaggaagccatgcatgaatcagaggaaggtcgaatgccatctaaatcagttgtcctccaagaacaagctacacaagtctttctgtcatcactctagatatgggctacttgaaaattaa

SEQ ID NO: 68163 - DNA, 1380 bp, Glycine max
  Peptide Sequence Number=SeqID_184941
atgcagagatcacgtgaagctcttctacaaagaagaagagctaaaactcaactctctctctcgttgctttttgttttatggcctctaatcttcctcttcagtcgcgctcatggttacactcctacaccctcagttcgattgtcaaattggaaggaagataagcaccgacagtgtaaaacctctaattctgctaataaatgtttgctcaaagaaactcatgattacattctcccaaattataaggaagattgtgatactcccactgtagtggatgctcaaatgtctgatcacttaccttgggctgtgcctctcggtcttgatgaattcaagagcagggcaattagttctaaaattaagtctggcacttctggttcctctggaagtgttatgcatagagtggagcctggtggtgcagaatacaattatgcttcagcctccatgggagcaaaattattaggttctaacaaagaagccaaaggcgcctctaatatcttaagcagagacaaagataagtatcttcgcaatccatgttccgccgaagacaaattcgtcatcatagaactttctgaagaaaccttggtagatacaatagaaatagctaattttgagcaccattcttccaacttaaaagcttttgaacttctcggaagtctgagctttccaacagatgtttgggttttccttgggaatttcactgcctcaaatgtgaggcatgctcagaggtttgttcttcagcagcctaaatgggtgagatacctaaagttgaatcttcaaagtcactatggttctgaattttattgcacactaagcgtagttgaagtttatggtgtggatgctgttgagaggatgctggaggatttgatacatactcaagataatctattggcacctggagacggtaatgctgataaaatgacagtatcaccccatcctaatcctcctgagagtgaagatgctcatcaaaatacttttggagggatcaattcttatcctgcttcagatatctcttctgcaaatcatgagaaactaaatagtaacgttcctgatccagtggaagaaatccgtcaacaagttggcaggatgcctggggatactgttctcaagattctgatgcagaaagttcgtactctagacttaaatttgtttgttttggagcggtatatggaggacttaaatactagatatgtcaatattttcaaagagtacagcaaagacattggaggaaaagatatacttatacagaatatcaaagaagacattaggaatctcgttgaccagcaagatgctataacaaaagatggaagtgatctcaaatcttggaagtcccatatttccatgcagtttggtcatctactcagggacaatgctgttttgaggtga

SEQ ID NO: 68164 - DNA, 966 bp, Glycine max
  Peptide Sequence Number=SeqID_184942
atgcaggaatgtaacattgaagaggttgcagatgaagaggatcctccatccaaaagctcaaaggacaaaaagtccaatggacctgattctggcaaagtcaacctgttatttaaaattaccagtagagttccttataaaactgttttgaaagcacacagtgctgttgttttgaaggctgaaagtgcagctgataaggttgaatggattaaaaagataagccaagttatacaagcaaagggaggacagattaggacatctgatggtggccctacaatgaggcatagcctctctgatggttccttggttagtttctgtggcttaaaggacacaatggctcgaagacctgctgatcctgaggaagaactccgatggatgtcacaagaagttcgtggatatgttgaagcagttttaaatagtttagctgctaatgtaccgaaggcagttgtcctttgtcaagttgaaaaggctaaggaagacatgctgaatcaattatatagctctgtcagtgctcaaagcacggctaagattgaggaactgcttctagaagatcaaaatgttaagcgcagaagggatcgaatccagaaacaatcatcccttctctcgaaattgacacgccaattgagtattcatgacacccgagcagcagctgcctctggctggtcaaatggtagtgcagagagtagcccaagaagcagcagcggacctggtgatgactggagatctgcctttgatgcagctgccaatggccctgttagtcgaagtggttcatcaagatcgggatccaatggtcacagtcgacattctagtgatgctgcccaaaatggtgatgtgaactctgggtcaaactccagcagccgtcgaacgcctaatcggttgcctcctgctcctccgggttcttcaggctgctcccaccccatttcatacggtcatccccaattctttgtttctgccggtatatttaggtga

SEQ ID NO: 68165 - DNA, 1107 bp, Glycine max
  Peptide Sequence Number=SeqID_184943
atggcggggttgtgcatgttccccactaaccgtcaaaaccgtcgcaagcgcaaagtggggagcaagaatcctctgcattgcgtccacgtagatcaaaagccaaatcatgtcacctgctgccacgccacaaacatcagaaaacaaaactttcgtaacgttcctcgcgtgcgcaggaaggaaagaggcatggaaattagagagttagagatgataaagaaggggccatggagtagtgaggaagatgaggtgctgttgagacacgtcagcaaatatggccctcgggaatggagctccattcgatccaaaggcttgttgcccagaacaggaaaatcttgtcgccttagatgggttaacaaacttagacccaacttgaagactggatgcaagtttacagcagaggaggaaaggttggtgatagaattgcaggcacaatatgggaacaaatgggccaaaattgcaacgtatttgcaagggagaaccgacaacgatgtgaaaaacttctggagcagtaggaggaaaaggttggagaggatgttgcagaagccaccagcgtcaaagccaaagaaaaacaaaggaaaagctcatcttaatcaagtgcaacaagtggaagaaatggttccaccatgcagttccaatcaggtggaggaaattctatcttacgctacttcctatatgggaaacacgctagtgttcgagatgatcaacctacaagatttgataaagccaaactatcaacagttggaaaatgattatctgagtgcagttgaggttgatgccaccccacttcacacagttccatcgtttgagtcttcatcagggtacaacttccctctactccctgaacctgaaccactcttggactttccactgttcccagagtgccaggaccttgttcctgagccctttgacccaaactttgtttatgggttcgaggagaaaaaatgtttacaatgtgcatgcagcagtagccagaagcttgggaccaggttgccaactttcggattggaaggaaattctcaaagtgcaagttcaaatggctttttcaaggacttccctagcgagatttttgaatactttgagcacattccaacctcatcagatcaatga

SEQ ID NO: 68166 - DNA, 170 bp, Glycine max
  Peptide Sequence Number=SeqID_184944
atggcgatcataatcgtgatcctcattttcgcccagtttctaatgggtttcttctccatttacatccgccactgctctgactctccctccaccaacatccacaaccaccccggatcctccaagaggtcacggcgtagctctcgcaagctcgaccagacagtgatcgacac

SEQ ID NO: 68167 - DNA, 312 bp, Glycine max
  Peptide Sequence Number=SeqID_184945
atgggagctatgcttaaatacatgaatttggaagttacaatgtgccaaagatttttattaaagaaaagtgcaaaaactaatggttggagcaggcgatggtttgtgctaaatgaaaagacaggaaagagtgctctaaaacattgcaatgttttgcaagattcggaaaagtatcagctttactattacaaaccaagcttagtgaggctaataccatttgacactgatttacttagcttgaagcctagctttctattgattaaaccagtgaatttcagacaagaaaagggaacaggccaaacagccccgggttga

SEQ ID NO: 68168 - DNA, 903 bp, Glycine max
  Peptide Sequence Number=SeqID_184946
atgggaactggtcacagtactcacactaaccttggaagcgaatgcacttcctatgatgctggtgccacaggcaccatagcacgttggggagaatcttttgaagtttccatgggcaatagcaaagaaaacaatgatcacacagaagtttggggtgtgaaatacaaaccaagtcagaaaaactacacttgtggctttcaccttagggcaagccgtgacaataacaaaagtgttgagagcatatatttcggattaggcgatttttccaacaacaaaactgaatttgctttgaagattacaagaatcggtcgcgatagtctccgaggagggataaccggcatcgactcttccaccgcaccaatgtacttcacaagagcaaagcaagatcacacaatagagacaactattgttccatatggttgttcattcagagatggtctttttgttatggaaatgaagaagaaggttaatgctgagaatgcttatatggttaccatgggacactattatgttaccaaagatgttggtctttctgttgaggccaaaatccttcgcagtaaaaactgttttgttgttcaagtggagggtcctttcagccaccctggtgatgaattgcgtaaggttcttgcgaaaacgcatcgaactggaatatggtcgcgtagtgcttgttctcattgtaataacaatggaacaaaggctagcactagcaaaaaaagtggagaatccgattcaccattgaaagctcaaccaagtcaccagaagggacacggtactgtaggtgaaattgttagccatgctttctcgagcagtgtcaaggagcaatacaacaaaggccttatcaattcgagtggatacactactggttctctgaataattctatcgtctttattgattgtaatttttaa

SEQ ID NO: 68169 - DNA, 729 bp, Glycine max
  Peptide Sequence Number=SeqID_184947
atgtctgagtgtggctgttccgagtcagacccttcgtgtggttgttggtcgagcagcagcagcagatctgtggcctcaactgaactgaagctgtaccgagcattcatcttctgtgttcccatcttcttcactctcattctcctctttctcttctatctcttctacctccgaccgcgaactaggctccattggatttcacactttcgccttcccagcaacaacaaccgcaataatgccatctccacattgggtttgggcttgaacaaagaacttagagagatgctgcccattattgtctacaaggaaagcttctccgtcaaagatactcagattttcaacacaaccccttcatgcccagaagcttcagtaattgctggccttacaagccacacaacaactaataggataggatttgatatcatcttagaatttgggttagaccctaattcagctcatgagatgagggatgtcaaaaatattcccctcacatcaaagataggacatttcaaggattgtagatgctcagtgtgccttttggactaccaggcagaggataggctgcaacaaatacctgcatgtggccatacatttcatatgagctgcattgatctttggcttgccacccataccacctgtcctctctgccgcttctccctactaaccactgctaaatcttcaacgcaggcatccgatatgcaggttactactttgtcatacatggttttgtaa

SEQ ID NO: 68170 - DNA, 327 bp, Glycine max
  Peptide Sequence Number=SeqID_184948
atggagaagattggagtcgtagtctatcgattacaattactggcaggtgctaagcttcaccccgtgtttcattgctcccttcttcgcccccaccacgaccccattccgatagcggatccaaagcagctaccattagaggtcatcgacaatcagtctgttttgactccattatccatcttagactctaagctggatgagtcaacccatccaaccaccaaattggtcttggttcagtgggcccattaccaccttgaggacaaggtggatttcgagaggggaggtattactagcaacacccacacagcctggcccaacaagaacacttag

SEQ ID NO: 68171 - DNA, 2364 bp, Glycine max
  Peptide Sequence Number=SeqID_184949
atgggttcggtgtgggggcgaaggggatggtgggtgtttgaggtgggggtgggtcgggttcaggggcggcgtgaagttcaacagggagatggttgtatcggggtagaggagggtacagtcgaggatgacgtcgttacctaccagaacgcgaaggggggatgtggttgtggtggggagacgaaggaaattggcgaggcggggttgcaagaagttgtgagtactgccactgtcgatgaggacagtgacttgggtgtggttgatgtagccaaagaggcggaaggtctcaggggtagggaggtcggacaaggtgttgagactgatatgagggtgggagatggtaggtctaggtctgagatggggttggggtctgagggaatggcaaggtcaatggttgtgggatcagaggggttttcggggttcttggggtcgcgttcgcggcagaaggcgatttcggttggtgtgcgctggatgaagggtggtttaggtcgaggagatggggaaggggaacaagaggatgagagtgtgtggtacggcggcgatcgtgcagcttgtcctcttgcaatttcgcaagggccacagcttccggcaaggaaatgggttggagggccaagacttcgcggcgaatttccggcactaggccggagacaaagcagcttaagaggaatggatgagggacttgaacaaggcacccttgggatcgtcatagtacgtgggtgtgaagcgcgactccaaagcctaaaggaagccgaaccaggatgtgatgaaaccatttctgaacatccattggtaccaactgagcgtggcaccgtccagctcggcgtggtggagagacaaacgagagatggcttcctcaagtttgtccgtggtggtcttacgggtgtggtggtcagatcagttgataggggagggaacagagagccttgttttgaggacaagggccttgctttaggttgtgacatagtctttcaagtaattgggacgctgagtgttcctgttgggcctggctgtgtggaggctgaaaaagaaatggaagattcagttccaattttaagaaactctgattgtattgtgcaggaaaagttgattccctcatgggatgaagcgatagagaatggtttgcgagaattggggtggtcggggatggcgcaatgcatccttgtgtccattgctatgtgctttgatgcacagcagtccttcatggcaatctactccgacgactacccaacatggcactgcacagagacagcatgcacctcatcacgttctgacatatgcaagcttccaaagtcctcttgggcatgggatggaccctcttctaagacaatcatatcacagtttggccttgaatgtgcaggcagcttcatcacaggtttacctcaatcttctttcttcgccggttgccttatcggttcctttcttcttgcctccttggctgatacatctcttggaagaaagaacctcctcttgctgtcttgtttatcaatgtccatatcttctatcttcattgtcttctccaccaatgtttggatctactccgcctttaaattcctcatcgggttttggcgttcatccatcggaacatgtgttctggtgttgctgactgagaaagtgagcactgagtggaggttcacagtgggaattgtcgaatatttctgcttcacattggggtatatgatcttgcctggaatagcttatataaacaagaattcttcatggaaaactctctatgtgtggacatccattcctgccattttttactctatcattgcttacctttttgttaccgagtctccaaggtggcttctcatgcaaggtcgagagcaagaagccatggcaatgcttaacggagtttcttcagtagaaaatggtgctaatttaactgctagcctgctgaaagttcctgctgctaaacaaaagtcttcaattttccaactttactcatcaatagcagagttgtttgagagaagttgggctcttaaacggatggtggccattatggtgcttggtcttgggattggaatggtgtattttggcatgcctttggccgtcgggaacttaggatttgacatttacttggcagttgtgcttaatgccttgatggaaataccttcttgtgtagtcacctacttcttggaaaactacagaagaaagccatctattcttgcattttcagtagcaagtgggatatgctgtgtattgtgtgtggtcgtaggcagtgggcagcaggtagctaaggtggggatatcattggtagccttttttagtgctgtcacggcttataatgtgtttctcatttacattatagagttgtttcccaccagcgaaggaaaaatgatattttctcctatggcgtatttggagtag

SEQ ID NO: 68172 - DNA, 1842 bp, Glycine max
  Peptide Sequence Number=SeqID_184950
atgttcaagaaggcggtggaggcgaaatctcaccagaggttgtctggtgcggaccggaagaagctgaggcgaagcattaaggacaaattcccaagggtttctgattccgatttagatgccttgcttcctcccaaggcagagattacaatagccaagcttcaaaaccgtgtccatgtttatgctgtggaaggaggctttccaatgtttttcgatgttgatggccgcggctcagacattttccctacagtttatgcactgtggatggtccctgagctactgccagttttcgtgctaaagggtggtgaggtatcccggttcgttatcggaggagcagacttgatgttccctggtataactgtgcctcccgaaggtcttccttcctttcgggctggggaaccttgggctgtcaaagtacccggaaattctgctcccattgcagttgggagtactacaatgagcagtgctgaagcattaaaagctggattacgtggaaaggcgctgagaataactcattactatcgtgatttgctttggcaagtggaatctgccgaggggcattgcgtgcctaatgcaggttttttcgaagatgttgtctttgaggatccttctttgttacaagcttctcatgattctgatttgactgaggctgtcggtgagacatcaattgatcagcacaacaacccaaaaggtgatggaccggaggaatctctagatgtaaatgagttccaacctgattctaaccctgcattgacgatgccaaatggtaatgaaaatgataccgctgctgaagtaactgaaggcgtggctgatttgaatttacgggatactgcctctgctaatgacccagatgaccaacagactctatcaactgcagacgttaattccctgttagataagtgccttcttcaagctttgcacacaacggtgaaggacaaagaccttcccttgcctggaagcactctatggtcaaaccatgtattgccgtgtaggccttcaggaatcactttagacatcaaaaaatcttcctacaaaaagttatcaaagtggttacaagcaaaatccacctctggcttgatatcagtgaaagaagataaacacaaaaaggaagtaatgctattttcagtaaaccgaaaacatgctgattattcatcctttaagcctgaaaaaaggcaagtggagaaaagtgagcaacccagtgttcagtctgccaatgaaattcgttcatccaaaactcttgaagtggctgaaatctacaaaccaagtgtacatgtcaattccatattttcatctgtaggagctgacacagggaaactttttagtgcttctgaagctactgatattgtcttcaaatatgttgaaaaagaaaatcttgtgaaaccaacaaataaatccgttgtggttcttgatgtaatattatgtgatgcactgttcaagggggctattaaaaaaggaacaacatatcctacagaaattcacaagaaggatttaggatcaacatttgtgagccgtatgcaacctcatcatgttgtgacaagagggaatgaatctgttgtttgtaaaggtgcccttaaaacaattcagttattgacagaacgtcggcaaggcaacaagaaggtaaccaaactctctggtatggaatcttttcttatagatgctgaagcattggcatcagaactgcagaagaagtttgcttgcagtaccactgttgcagaactaccaggtaagaaagggaatgaagttttggttcaaggaggagtcatcgatgatttagctaggcatttgattgatcaatatggagttccaaagagatacattgaagttcttgataaaaccaagaaatga

SEQ ID NO: 68173 - DNA, 690 bp, Glycine max
  Peptide Sequence Number=SeqID_184951
atggttaaactccgacaaccccttcatcgagtcactgatcaccgaattccactcaactcccctcggaggacatttgggggttgcgaaaactacccaccgtgtcagctccaatttttattggaccactctctgtcaggatgtcaagcgctttgtccgcaactgtgtcacctatcaacagtccaagacacccacgacatgatcgaatggcctcctgcaacccatactcattcctttcggcgtttgggaagatctttcgctgaatttcatcactcacctgtcgtgctcccatggttttacagtgatcttagtcgtggaactattcggctttgtgacacgcgcctacgcatgagcactgcctaccatccccaaacggatggacaaaccaaggtcatgaatcgcgtcctggagcaatatctgcgttctttcgttagctctcaccctgctgattggttcaagtttttggctatggctgaatggtcctacaacacgtcagtgcactccgacacgggcctcactccttatgaggtcatttacggcaaagctccgccgacatttcctcattacattctgggagcttccaacaatgaagctgttaatgaagctgttgattctctcttgacttcacgacaggacatccatgattccttgcaacgacgcttaaccaaggcacagcaggctatgaaacaatag

SEQ ID NO: 68174 - DNA, 5814 bp, Glycine max
  Peptide Sequence Number=SeqID_184952
atgggcatgcaagtgccatgcattcttgttgtgtcacacgtcttcaacgttgtgtttaggactgtgggtcaacctggatcaattggacaagttctgatgaatattcactacaccatgcgcaatctatgtatggtgagcttagtagcatgtggtggtgcaatatgggtggtgtttttggtctatccgtctcattttacttgcatcaagagcttaacaccattgacaatgcccccttcagagttaaggtttgcagcatctgatgtggggcgaatcgcggtgtcttctgcattgatcacggaaatggggtgcttgttgttcttcaatgtgatggttaactggagaaaaccaaatcacatctcttatgcctggagaggtgctatgaactcagaattagcaccagaaacagagccaactaaggaagaagaagcagagattttcgtgaaagagaccaccatgtcttcttcacccaagatggacagaatcgaagaggcaattgccaagcttgcttcaagccatttaatcctcaccgagaagcttgacgaattgattaatcgagttacgaaccttgagaacataaccaacccttccccttcaccgtcatcttcctcagctatgcccataccacagatccaatcggccaatccacatagactgaaacttgatgtccctcgatttgacggctctgatccctcagggtgggtattcaaaattacccagttctttgaataccacgcaacccctgaggctaagaggctcaccgtcgcgtccttttacatggacggaccggccctcgcgtggtttcaatggatggctcgaaaccaccagctcaccacgtggtcggggttcctgcaagcaatcgaagcacgatttgctcaatctccctatgaggatccaacaggactcctcttcaaactaacccagaaaggcacagtgagggaatacctggctcagttcgaagccctcgcgaatcgtatcacggggttatcgccggcctcgctcctgagttgcttcatttcaggacttgaaccagacgtccgccgtgaagtccaggctcttcagccttcaacattggttcacgccgccggcttagctcgacttcaggaggagaagattcttgagcaccgtcgagctttccaccaaagacctcaccccagccctccacaacactcacccacccccctttcaatagtcacccccacacccagccctccgttacttccctctccgcccaaaccaccacccctacccatcagacggctaacaccggaagagatagcaagccgccgggagcgcgggctctgcttccattgtgacgagaaattcacgagaggccaccgctgcccctcgcgattcttgcttctcttggcagatgaagacccaccagataaccctaatatagacaaccctgacccattaatggacccgaaccgacccgaaaccccaattattaacccaattacccaagacccaactgaacccacccaagcccaaatcagcctccatgctttatccggctatggaaccccggaaacattacgtgtcaccggccggattaatttccaccatgtcacgatcttggtcgacggaggcagcacacataactttgtgcaagaacgcctcgtcaagaccttaggcttgaacccccaacccacacctacccttcgcgtgcttgtcggcaatggcaacaccgttgaatgttcgcaagtctgctcagaggtcaccgttcacattcagggagtcagtttctctgtgaatttgcatgttcttcccctatatggtgctgatgtcgtatttggagttccttggctcaaggccctgggccccgtgttaacagattataataatcttgtgatgaagttcatgcatgatgacaggataatcgaattaaagggctcatcggaaactccattaacggccataagcccacctcagctccgacgattagtgcaaacacaaggtgctagtgaattttttcacattcgtgtctgcccctcacctgaacataccccaaacaactccccaaacactcaatccgccatccttgatgtcatcaatcaatttccaagcctctttcaaccacccacaaagcttcccccgtcacgagccaccaaccaccacatacacctcctacctaactccaccccagtcaatgtccgcccttatcgatatcctaacttccagaaggaggaaatcgagtctcaagtcaataccatgctccaaaacggcattatttgtcccagtaatagcccttattcttccccagttcttcttgttaaaaagagagacggcacgtggcgtttctgtgtcgattacagggcactaaacgcactcaccgtcaaagatcgatttccgataccaacaattgatgaattgttggacgaattgggtggtgcctactggtactcaaagctggatcttctccaaggttaccatcaaattctaatggctccggaggatgtcaataaaacagcgtttcgcacccatcacggccattacgaatttctggtaatgccgtttgggctttgcaacgctccatcatcctttcaagcgacgatgaacgccatttttggaccttgtctgcgaaaattcctcattgtcttctttgatgacatactggtctacagtaagaccttccatgatcatctagaccatctacgcagcacctttcagatcttatccgacaacggcttcgtccttaagaagtcaaagtgttcctttgcaattcaacaagttgaatacttaggacacgtggtttccgcacgcggggttgaaccagttcctgagaaggtccttgcggtgcaacaatggcccccaccgcggtcagtaaggcacttacgtggattccttggattatcgggattctataggcgcttcatcaagggctatgcaacgctggcgacacccctcaccgctctattggctacggaccaatttgggtggacaccggaagctgaggatgcatttaatagactcaaggaagctctatgtaaagcccctgttctagctctaccggattttgccgcgccgttcataattgaaactgatgcttcaggtgccggaatgggagcaattctttcacagcaccaccatcctttggccttttttagcaaacccttttgttcaaaactcctcagagcctccgcgtatgtccgagagctcgccgcaatcactgccgcggtcaaaaaatggagacaatatttgttgggtcaccattttagcatcatcacagatcacaggagcttaaaagaactcatggcacaagcggttcaaacaccagaacagcaagtgtatctggcacgattgatgggatacgactataccatccattatcgtgccggcaaacacaattcagcagcagatgctctctcacgtctccctgagccccctccaaacccattagacacaacccaaagccagatttttatgctaacaattcctaattgcgttttcttgcaggaactcaaaagggagctgttcaccaatgaggaatttcaggccaaaaagaagcaaattgaagaagagaaggaaaccccttctgaattcatcattaaggatgaattcattctccatcaaggacgcatttggttaccgcggaaccttcctttattgcctacaatcattacagagtttcatgcaactcccacaggaggccatatgggaatcatgaagacaatggcgcgtgttcgtgaaaatttcacctgggcttcgatgaaggaagacattcagaggcacataaccaactgcatcacttgtcaacagattaaaacagatcatcgtcacccaccggggcttctctgcccacttccggttccggcaaggccatgggaggacctctcccttgattttatttcaggactgcccccttatcgtgggaattcggtcatactggtgattattgaccgcttctcgaaaggaatccatctgggatctctaccctcacatcacaccgcttttagtgtcgcacagctattcatggagctttccggcaaactccatggtatgcctcgcagcctagtatcagatagagaccctttattcttaagtcgtttttggcaggagctgtttaagatgagtggaaccaagctccgtatgagctcagcatatcacccacaatccgatggccaaacagaggccatgaacaagattgtcgaacagtaccttcgagctttcacaccgtatgaagtaacgtacggcaaaccacccccaagcctaccccaatatatcacaggaagttcgaatgttcaagcagtggacgaatggttgaccaatcgagagacattgaatgcatgcttaattaaaaagttgaccaaggcccaacagagaatgaaggagatagcggacaagcaacgtcgagatgtcagctatgaggaaggagattttgtgttagttaaattaagaccccgccggcaaacatcagccacaggggagacatattcgaaacttgcaaaaaggtattatggaccattccaaattaccaagaaaattggaagtgcagcttatcagctgaatttaccaacaagctcaagaattcacccggtgtttcactgttctttactcaagccttttaatccatccaccacggaaggctcccttgaattaccagccatcgcagaagacaatgaacccttgatacatcccctcgtgattatcgacacaaggtgggacatcacaccaattggaagacatctgcttgttctcgttcagtgggctgggcttccacctgaagatgcttcatgggagaaatgggaagtcctcaagaaagactacaaccttgaggacaaggttgttttggaagtaggcggaaatgctatgaactcagaattagcaccagaaacagagccaactaaggaagaagaagcaggggcaaagaggagaattatcagaccaaaatatttgaaggattacgaacccttggtgccagttcataacaagaggtcagccaatttggccatattgatattgttgagcattggaagcaagcttggtggtactcttatagtttgccgctaccttaaaattcctactagtgaaggaatttttcttggattcatattgaacaccagaggctatgctgatcttctattcattggtgcagcagcaaagcaaacttatgattcagaggcgtacaatgttttgctgcaattgagccacaacaaatggaggacgagctacgaattctggcttgtgtatgaccctcgtcagaaagaaaacgctgaccttagcgacgatgaggactatggaggcaatgatgtggtggaaattaacaatgctttagataccttcacggcggaaacaaagattctagtccaacaaagaacgtgtcttctttcccatcatcaacgcattgatgggaaactggaaagtggtaaagagggtataaggatcactaatcagaaggtactaagacatgccccctgttcagttggtatcatagtagaaagaagacttgcaagggtacccggcttctcagaactagtagcatctgaatccatacaaaatgttgcaacacttttctttggtggccctgatgaccgcgaggctattgcgtggagcctgcgcatttcgggtagtccgcgtgtcaacttgacaattattagattcttgttgagttcctcgtcacagaatgaacagattgagagtggagaatctgaggacaaagagatcttaatgtcattgtctagggaggagactgtgaatgagattggcaacaccttcatggttgatttctacaataggtatgtgacttctggccaaataggctacgtggaaaagtttgtcaaggatggagcacaaacactggagtctctcaaatag

SEQ ID NO: 68175 - DNA, 1314 bp, Glycine max
  Peptide Sequence Number=SeqID_184953
atggcggcgatcgaggacttgtcggagctcgccgattcgatgcgccaagccgcggcgctcctcgccgacgaagacgtcgacgaatcctccaccaattctcgaagaccttccactttcctcaacgtcgttgcactcggcaatgttggtgctggtaaatccgcagttctcaacagtttgattggacatcccgttttgcctactggtgagaacggagctactcgagctcctatatgcattgatctgctgcgagacacttcgttgagcagcaaatccattatcttgcagattgacaacaagtcacagcaagtctccgcaagtgctttgagacgttcgttgcaggatagactgagtaagagttccaccggcaagggtcgggatcaaatttatttgaagctacgcacgagcacagcaccgcctcttaaattggttgatttacctgggttggatcagcgcatcatggatgaatcactggttagcgaatatgcagagcataatgatgccattttgctagttattgtacctgcagttcaagcacctgaaattgcttcatctcgagccctaaaatatgcaaaggaatatgatggagaaggtaccagaaccattggcattattagtaaaatagatcaagctgcatcggaccaaaaagcgctggctgcagtacaagctctcttattgaatcagggtcctgcaaaaacatcggatatcccttgggttgcactgattggtcaatctgtttcaatagctacggcacagtctggatctgctggttctgaaaattcattagaaactgcatggagagcagagagtgaaagcctcaagtccatattgacaggagctcctccgagtaagcttggaaggatcgctttagtggatgccctggcacaccagattcagaatcgtatgaagcttcggcttcctaaccttctttctgggttacaagggaagtctcagatagttcaggatgaattggcaaggcttggtgagtcaatggtcaccacttcagagggtacacgtgctatagccttggaactttgccgtgaatttgaggataagttcctacagcacattaccactggcgagggatctggttggaaaattgtttcttgttttgaggggagatttcctgatagaatgaagcaattacctttagataggcattttgatatcaacaatgtgaagaggattgtgttagaagcagatggttatcagccgtatcttatttcccctgaaaagggattgagatctctaatcaaaggggttctagagcttgcgaaagagccatcacgtctttgtgttgatgagttggcttcttga

SEQ ID NO: 68176 - DNA, 900 bp, Glycine max
  Peptide Sequence Number=SeqID_184954
atgtgcgtcgactatcgagcactcaacactgccactatccacaaccgttttccaatgcccacaatcgatgagttattggatgatttgggccatgcatcttggtactcgaagctggatttgcaacagggattgcaccagatactcatggcaccagaggatatactgaagacggcctttaggactcaccagggtcattatgagtaccgtgtgatgtcgttcggtctctgtaacaccccatcaacgaggcttgaatacctgggacacatcatttcagagaaaggagttgagcctgacccagcaaagattcaggttatggtggcttggtcaacaccaaccactcccaaggatctcagagcgttccttggcattacggggttctaccgtaaatttatccagggctacgcaacaatcgcttcccccttaacgactctattgtgcaaaaatgccttcgcttggtcccctgagtcccaatcggcctttgagaaattgaaaacagcaatgactcaagcttcggtgctggccttgcctgactttgagcttcccttcgtgatagaaactgatgcttccggcatggcaatgagggtcgtcatgctccaacagggtcatcctttagcggagttacacgctatcgacacagcggtccacaaatggcgccagtatttactgggccatccattcaccatcctcatcgatcataagagcttgaaggaccttctgtctcaggtcatccagaccacggagcaacaacattacctgtccaaactgcttggttatgagtatactattcagtataaagctggcgcatcaaatgttgtggctgatgctctatcccgcgtcacacacccacctgaaggccattgcctcctcctgtccatccccaatttcgtattcatggactag

SEQ ID NO: 68177 - DNA, 1200 bp, Glycine max
  Peptide Sequence Number=SeqID_184955
atgccttcaatcatgtcacctcagtggcaagataaggctgctggtttcttttcttcctccggggtgaagcttaaagaagccaaggaatcagcaggaacatttgttggcgaggtcacgaaggatacaaagagtaatgtggccgaagtggcaggacgagtgggatcgatggtgaagagtcggtgggcacttcttcagcagccatccacaagacatgctgtgcaggatcgtttcatatcagctgctgctacaacaggtaccctcctgaggagaggcttctcagggacaaaggataaggtggttgtgggaaagtccaaggttgaagaggttgcaaaaataacagcacaaaaaagtaagactatcttgacagatattgaaagatggcaaaagggagttgcgagcactgatttatttggagttcctattgaggttactgcacaaaggcaagattgcagcaaacctattcctcagatattagtcaaatgtggagattatcttatagtttcaggattgaactcgccaaatctttttaaatctgaaggggataaaaaggttatccaccagttggtttccctatacaaccaagattctactgcttcggtaccagaaggcacaaatcctgttgatgtagcagctcttgtaaaatattatcttgctagccttcctgagccactaaccacattagagctttataatgagattagaagtgctcgatccagtatatattccatgagaaacatactcaagaggctttccagtgtaaactacatgactctggagtttataacagcacttctactccgtgttagccagaaatcacttctcaataagatggatgctcggagccttgctatggaaatggcacctgttattatgtggcaaaaggaacggagacctgaattttatcatcaatattggaatcaggtgtcaaaaagtctttccaataagactgtggatccaacacctggctcatatactgcctgggacatgcttgctgatgatggtgaagccacagatgcatcatctcctattcctttggatgacggcacaccagtagattttggtgcaattgaggttgttcagttgctcacagaacatcataatgcaattttcacagatgcaaatgagacattatccacaatcatcacgcgcggaaagatgttggatattactggtccagttttagtgataatccctatctga

SEQ ID NO: 68178 - DNA, 1067 bp, Glycine max
  Peptide Sequence Number=SeqID_184956
aacctcatcaaccagagagcaaagccttgtctggtgatggcagcagcagaagcagaagaagaatgttgttgttggagttggattctgaaaaggaagaatttgaacaacccctgaaaaagaaatccaccaaaaaccaaaccaagttaatcaaacccaccactagcctctcctccaaaaaccaaaccaaaaccatcaaatccaataaccttagttcctccaaaaaccaaaccaagctagccaaaaccaaagccaccaccctcaccgacaccgaggttgtcgtgaagaagctcaactccaccaccttaaagtccaagaagctgaattccacatccaaaggctccacgaaatcatcctcattggatctcgcgaaaacaagtggtactagtggcggcaagaacaaaacgacaaaagccaccgccaccaaggacaaggaagttaccaataaaaagaccaagttggatcaaaccgaagaatccgacaagcagagtaataagaagagtaacaccaccaacaacaagaagaagaaagaacaacaaggacaacctagttgggtgttcgaagacgaggtggacgatgatttggtttcggagttcaaagatctacccatgaagttccaacaaacactgatcccagacctggaacgaatctccacaacctcaaaagcctacataacaaaagccaacaaagagatcacgagagggttcaaaccctacgttggcaacaagtacgcacccaccatcaccactttactctcttgcgcattcgctttgatccctttgcttttggcctcactcctcttcaacaaaatcaaagcctatttctcactccaaaagctcttaatcttcatccaagcctacctcgctatctacttctccattctttgcctttcttccttcgtcactggccttgaacctctcagggttgtgttgaagcaaccgcccaagaccaattggaagattcacgccatttatgccacgtgttttttcctcatttgtgtcattgctagggctgatagaaagaagaagacctacttggaagaaggtggagaagagggcaagaaaaattga

SEQ ID NO: 68179 - DNA, 1572 bp, Glycine max
  Peptide Sequence Number=SeqID_184957
atgtgttcaggaaggagactagagttatcttggcagaagcattggaaaactttattacttgcatctggtatcttaattgctggtggaacagctgcatatgtgcaatcaaggtttagagttaataatcacgatttatttggccattgcaatgggcacagtaatgataaagaagttgcagaggaggttgtgaaggatgttagtactccaaaaaataaacaaaagaaagggttgaagtcactccaagttctagccgcaattctactatctggaatgggcaaatttggtgcaagtgatcttttaggtttagttgcgatagcggtgctgcgaactgctttgagcaacaggctagctaaagtgcaaggcttcctatttcgtgctgcttttcttcgacgtgtaccattgtttcttcggctaatttcagaaaatattcttttgtgcttccttttgtcaaccattcattctacgtcaaagtatataacagggactttgagtttacatttcagaaaaatattgacaaagcttatccattcccactattttgagaacatggtgtattacaaaatatcgcatgttgatggtcggataactaatccagagcaaagaattgccagtgatgtgccaaggttctgttcggagttgagtgaaattgtacaggatgatctaacagcagttactgatggacttttatacacttggcggttgtgttcatatgctagcccaaaatatgtcgtctggatattggcatatgtacttggagctggtgctgcaatcagaaacttctctccttcatttggaaaacttatgtctaaagagcagcaattggaaggagagtatcgacagcttcacgcacgattaaggactcactcagaaagcatagcattctatggtggagagaggaaagaagaagctcatattcaacagaagtttaaaaccttggttaggcacatgtataatgtgctacatgaccattggtggtttggcatgattcaggacttattattgaagtaccttggtgctactgttgctgttattttgatcattgaacctttcttttctggtcatctaaggcccgatagttcaactttagggcgtgcagagatgttaagcaatcttagatatcatactagtgtcataatttccttatttcagtctctaggaactctttctatcagtgcaagacggctcaatcgcctcagtgggtatgctgatcgcatttatgaattaatggccgtatcaagggagctaagcttggtgaatgagaaatcttccctgcaaagaaatgcaagtagaaattgcatacgtgaagctaactacattgaatttgatggtgtcaaggttgtaacacccactggtaatgtcttggtggatgatctgactcttagggttgaatcaggatctaatcttttaattacagtgaaacctggaattggctctgatcttaataaggagattttctatgtgccgcaaaggccatacactgctgtaggaacacttcgagatcagttgatttatcctcttactgaagatcaagagattgacttctcacagatcgtgggatggtggagctgttaa

SEQ ID NO: 68180 - DNA, 1413 bp, Glycine max
  Peptide Sequence Number=SeqID_184958
atgtcgctgaatatgaaaaccctaacccaagcattggcgaagaccgcggcggtgatcgagaagacagtgcagacgacggtgcaggaggtgacgggcccgaaggcacttcaggactacgagctgctcgaccagatcggctccgcggggcccgggctcgcctggagactctattcgggccgggcccgtgatccctcgcggcagcaccagtatccggtggtgtgtgtatgggtgttggacaagcgctctctttccgaggcccgaatgcgcgcgggcctcaccaaggccgccgaggattcctttctagatttgattcggacggatgccgccaagctcgtccgcctcaggcatcccggcgtcgttcacgtcgtccaggccctcgacgagagcaagaatgcaatggctatggtcaccgaacccttgtttgcttccgctgccaatactcttggcattgtcgacaatattcctaatcttcctaaagatctcaggggaatggttgctgatgaaagagcctttgctttgcaggaaatgggaattttggaggtgaagcatggtttacttcaaatagcagaatccctcgactttctccacaaccatgctcatcttcttcatcgagctatatcacctgagaacattctgatcaccttgagtggagcttggaaactcgctggatttggttttgcagtttctgctactcagacctctggtgactcatctaatctgcaacccttccattatgctacacaaatttctgcttctagtaaccttatatacttctgccagcagaagtctctacattttgtaatcatacctgtgcggttattcttcctggaatatgatgttgaggactctatcttgccacttcaaccatcacttaattacactgctcctgagctggcgaggagcactgcgtcttcagctgggtgctcatctgatattttcagttttggatgtcttgcctaccatttaattgcccgcaagcctttgtttgactgccacaacaatgtgaagatgtacatgaataccttgacttacttatccagtggcgcattctcatctatcccatcagaactggttcctgacttgcaaaggatgctttctccaaatgagtcttccaggccatcagcaatggattttacaggctcaccattttttaggcatgacactaggttgcgtgctctacgcttccttgatcacatgcttgaaagagataacatgcagaagtcagagttcttaaaagcattgtcagatatgtggaaagattttgattcacgtgtattgcgatacaaggtccttccaccactttgtgcagagcttaggaatgtggtgatacagccaatgattctaccaatggttctaaccattgccgagtctcagctgccatggtgtagtggagcagctcttggcttctcttga

SEQ ID NO: 68181 - DNA, 1299 bp, Glycine max
  Peptide Sequence Number=SeqID_184959
atggacgctgccaaagaagaatttctcagagactttggtgaacactacggctaccctaacggccccaagtccgttgatcaaattcgagctactgaattcaagagattacaattacaagatcttgtatacttggatcatgctggggcaactctatactctgacctgcaaatggaatctgttttcaatgatctcactactaacctatacgcaaatcctcacagccaaagtgactccagttctgcaactcttgacattgtcaagaacgcccgccagcaggtccttgactactgcaatgcatctcccaaagaatacaaatgtatatttacttctggggcaacagcagcgctgaagctgccttacccttgcatatgcaaagaggctgtttccggattcgaacccatgaccaacaagtcaccaaggcacaactttaccgttgcaccagggctcgccctcattctgataaatatagattatagatatgctcttggtcaaggagcagcagccattgcagtagatattgaaggagaattacatcctgaaatatcaggagaaacaattactacaaagatatcaccacaccaggttcagaggagaaaagtagctggatcactgaaagaagagccaacagagtgcaatttctcagggttgagatttgacttggacttggtgaagattattaaggaagactcaagcaagatcttgggaatttcttcagtttgccatggacagtggatggtcttaattgatgctgcaaagggatgtgctaccatgccacctgatttgtctaagtatcctgcagattttgttgctatctcattttacaagctgtttggctatccaactgggcttggagctctcattgttcgaaatgatgctgccaagttactgaagaagacttattttagtggaggaacggttagtgcatcgattgctgatattgatttcattaaaagaagggaaggtattgaggaactgtttgaggatgggactgtttcatttttgagcatagtatctatccgccatggcttcaaaatcctgaattctttaactgtatcagcaatatcaaggtttttgatagatgtttattttggtcttgttgattgtatggctggtttaactagctgcttatgcttttcaacatctgatcaaggaaaaaatattgacaaattcacacataacattgcagttggagctgttgtattgcaattttgtgtaacatacccaaaattgtgtcaatttgccgctgttgcagctgcagttggtaacgggacatcgatgccatttcattgtagtttatga

SEQ ID NO: 68182 - DNA, 574 bp, Glycine max
  Peptide Sequence Number=SeqID_184960
acagcaaaaagtttatacggataaccactcgggtatttccgcccgtcagcgtgactcaaaagtcagtatgacagatcttgtgagcgcggaagatgacggcgcagaagacgacattagtctctgcgtgctaccgggcttttcatcttacagacagcaaaaagtttatacggataaccactcgggtatttccgcccgtcagcgtgactcaaaagtcagtatgacagatcttgtgagcgcggaagatgacacagcaaaaaagaatgtttatacggataaccactcgggtatttccgcccgtcagcatgactcaaaagtcagggcgccgaacacgacattagtctctgcgtgctatcaggcttttcatcttacagacaacaaaaagtttatacggataaccactcggatctctgtgagcgcggaagatgacataaatctccgcgtgtcaacggtttccgcccgtcagcatgactcaaatgtcaagtatgacagatcttgtgaaggttggccgacaaaaagcgaggctcttgctcctacatatcctccaatgaggaacgcagacctacgttgttcttga

SEQ ID NO: 68183 - DNA, 105 bp, Glycine max
  Peptide Sequence Number=SeqID_184961
tttgctgggctattattattgcagcggcgaacccagcaacagcttattaccttttcgtgatcgatggggatgacgtgcagagcagtgagagagctaaaagggcag

SEQ ID NO: 68184 - DNA, 204 bp, Glycine max
  Peptide Sequence Number=SeqID_184962
atggcttggaagcactctagtgatggtaactttacttgtttgactatcatctctcctgatagagatgacattgttcttcccattcctgagaatgagaatccaaagggtttatggtttactactaaagaaggtggagcaaaagcattaaaactgaagaaagaggccctcaatgggctcccaaaaatggaccgaaccccacatgta

SEQ ID NO: 68185 - DNA, 495 bp, Glycine max
  Peptide Sequence Number=SeqID_184963
atgacttccactgccctatctctgtcccacatgcactggcctcgtctttgtcctaaatgccttggcccttgtctttgttccagttgcactagcccttgtctatgtcccggttgcactagtccttgtctttgtcccaaatatattggccccgtttatgtcccagcatgtgacatagtttgggttgacgaaaatttcctatgctgccaaaatttcctttctttctttgaaattttgcatgtatctgatgtggaaataagagagaccaagatgatgggctcatctccagtaattattgtaatgtttcaaacacagcaaatctattgtgtacgtgataggaatggggcaattacagaaggaggcaaggatacaatccacactgtattctatttttgggcattacaacaaatggaccaagaagatcgtggagaagatggtatttacttaatgtggagactaagagagatgcaacagcaaggcatccaagctctcatctag

SEQ ID NO: 68186 - DNA, 4236 bp, Glycine max
  Peptide Sequence Number=SeqID_184964
atggcggccagcaaatgcaattcagctactcctctcatccccgtgccccctaaatctcttattttcttacatgaatggtggcttgtcaagcaacgcaagggtttagccgttggcgggcttgcttctgtcgacgtgattgtaggcagagaagagaccaatgtcctccactctgaagatggtatcactattcttttccgtggtttcattaacacctctcgttcatctcaaaatggcgtcccctttcaggtatgccaacacttccttgttggatttccgcatgattggaaaaagtattcagcttatagttttggagatgcttttggtgactcaagtgtttgttcaaagaatatttgccatggactgggaatttcttctgggaatcattccaagcaatctcaatctactgataacatggaatgtgaatgtaacaatacagcgtcccagctgcaggttggtgaaaaaggaatctcagatgttgcagttgaaagccaagctggaaacaaaaaaagcttcatgagtatgtttgattctaacaaatgtacaagcacttctggaaaaggcacggttaaacctctaacttccaaagagaaaatggaccgcaaggagaagcaacaaattagacaaaagatagtattagatgccagcaattcctgtaataggatggtaactagaagcatttccaaaagaagtcacacaatgcctaaagaagatgaaaaagctacaatagccactgttgtttctccagtgaggaggtctcccaggctttatagtctgattatggaagcggattatggaaaggattgcaccaaatttgagaagagagaaaatctttcagttccccctgagccaatcttcatggagactatacccgagatgaatgacattactgcttatagacaggatccctctttaaatgctggtcgtccaaaaggggccatacatggatgtccaaactgcagtaattgtgtgaaggtaacagcaaggtggcatcctagggatgccataagaggagttttggaagaagctcctattttccacccaacagaagaggaattcaaagacacacttaaatatattgcaagcatacgttccaaagcagaaccttatggaatttgccgtattgtccctcctacttgctggaaatcaccatgctctcttgagaaaaagaacttatgggaaaagtctgaatttgttgctcagattcagcgaattgatggacaccaagttcagaatgcacaagaaactacggctagtgctcgtggaaatacaaaaaccaagagaaaaggagatgtaaaagtagctttagactctcagcttggaatagaaacaccagcattccaaatacccagaatgttgaaaaatgtgacttgggaaccatctgtgaagaatattgagggtgaatatggacggattgttcaaaatccaactgaagaaatcaaagtgcttcgtattaacactttggaggctggagtttttagcagtggattttccacactttctgatcctgtggaggcatgcacttaccctgaatatttgaaatctggatggaacatgaataatatactttcactgtcaggttcccttctttgttttgaaagctctgaagcttcacgtaattttgcccccaagattcacgtgggaatgtgcttttctccactcaactgggtgtttgaacacaaaggtggtaaggacgcggggacagaggtgtgtaggtggtgttgtgcgtggttagagtggttgggttcaaatatagggtggagatggtgtgacagtgattggatgggtagtggcgcattgagtggttcatgtgcggatctagttggggtgggtgctacttcttcaaactgtaatgtagacttaaattcctctctggtcaccaatggcacatggaattcaccttctggtcactttgcctttggtttccaaagtgttttattcgacaacaaggagttcatgtccgtgcttgcagtttggtttgccaaagaccccaacagaaccatagtatggtatgcaaaacaaaaacaaagtcctgcttttccttccggttccacagtaaacctaacaaacaaaggaattgtagtcaacgatccaaagggtcatgagatgtggcatcgtccagaaaataacactactattgccttagtatcatgtgcttctatgttagacaatggaagttttgtgcttcttgatgaaagtgggaagcaggtttgggagagttttgaagagcctacagataccattttgcctggtcagaatctggctaagcctaaaaccttcagagcacgtgaatctgacacaagtttttataatgggggttttgaactcagttggcagaacgatagcaacttggttctttactattcaccacaatcaagcgatgatcaagcctctcaatctcctacaggtgaagcttactgggccactggaactttcaaaactgaatcacaactattctttgatgagtccggacgcatgtacataaaaaatgacacgggtacagtgatcagtgaaatcacatacagtggaccagaagagttcttctacatggctagaattgaccctgatggggttttcagattatatcggcatccgaaagcggtaaagttgtgccttggtgacttgttggtcatgggttcaaatccggaaacagtctctttgcatatgcaaggttcggggtggtggagtgtggtgcaacagtatccccaagatatttgtctttccttcacaaaacaaactgggaatgtaatctgtggttataacagctactgcattaccatcaatgggaagcctgagtgtgagtgcccggatcattattcttcttttgaacatgacaatctcacaggttgtaggccagattttcccctgccgagctgcaacaaagacgggtgggagcagaataaggatcttgtagatttcaaagagtatacaaatttggactggcctctctctgattatgacaagttggttgcaactgctatggacaaggatatgtgtaaacaaaagtgccttgaggattgcttttgtgctgtagccatatatggtgagggacaatgttggaagaagaagtatcctttcagtaatggaaggaagcaccctaatgttactagaatagctcttgtcaaggtacctaaaagagatttggacaggggtgggagagaacagactacacttgtgcttgtcatatcaatattgcttgggagctcagtgtttctcaatgtgcttctatttgttgccttgtttgttgcttttttcattttctaccacaagaggcttttgaataatccaaaattgtcagctgcaaccataagatcttttacatacaaggagcttgaagaagcaaccacggggttcaaacaaatgttgggtcgtggtgcttttggaacagtctataaaggggtgttaacatcagatacaagcaggtatgttgctgtgaagaggctagataaggtggtgcaagaaggcgagaaggagttcaaaacagaagtgagtgtgattggacaaacccaccacaggaacttggttcgtttacttggttattgtgacgaaggggagcatcgtcttctggtgtatgagcacatgagcaatggctccttggctagctttctctttgggatatcaaggccccattggaaccaaagagtgcaaattgctttggggattgcaagaggtctcacatatttgcatgaagagtgcagcactcagatcattcattgtgacataaagcctcagaatatactcttagacgagttgttcacgccaaggattgctgattttgggttggcaaagttgttgttggctgaacaatcaaaagctgctaagacgggtttgagagggacaattggttactttgcacctgagtggtttaggaaagcttcaatcaccactaaaatagacgtatatagttttggggtggtgttgttagagatcatatgttgcaagtcaagcgttgcctttgcgatggctaatgatgaagaggcacttatagattgggcatatcggtgttatagccaagggaaggtggctaaattggtagaaaatgatgaggaggcaaagaatgatataaagagagtggaaaagcatgtcatggtagcaatttggtgcattcaagaggatccttcgttgagaccctccatgaagaaggttacccaaatgcttgagggcgtgacaacagtttctgtgccacctcgcccttccatattcagttcatcatcgtttgaaatttcatttacttcgtaa

SEQ ID NO: 68187 - DNA, 1761 bp, Glycine max
  Peptide Sequence Number=SeqID_184965
atgggttcatttgtccgcatagctcgaaaccttttatggtcttccttttgttcgcagtcattgtcgaagaatgtcagccaacaattatttacgtcttcggcgtctgtgttcaaaagttacaagttcaggtatgggagaacgccggttaggaagcatcgtgaggccaacgccacgcatactacagcggtcgagcttgcattcaattctgtagtcaaaattttcactgtttcctgcagtcccaactacttacttccttggcagaacaagtcccagcgggaaacaatgggttctgggtttgtaattctcggtagaaagattcttacaaatgctcatgtggtagctgatcattcttttgtacttgtaaggaagcatggttgtcccaccaaatatagagcagaagtcaaagctgttggtcatgaatgtgacttagctatattggttattgagaacaaagagttttgggatggtatgaatcccttggaacttggagatgtcccatttctacaagaagctgttgctgttgtgggatatcctcaaggtagcaatagagggggaggttctttgaggatttcttaccctcatttgtacttctttctcttgaaaaactctcccctcccaaaaagaaaaataaaaagctttcaggcatgttacgctactgcaaagttatatgaggcatacattccatgggaatctgcaaacacctgcggcagaggtggtgacaacatttcagttactaaaggagttgtttccagggttgaacccacacagtatgttcatggtgcatcacagctgatggcaatacagattgatgcagccataaatccagggaacagtggtggccctgcaattatgggcagcaaggttgctggagtagcattccaaaatctttcaggtgccgagaatataggttacattatacctgtacctgtaatagagcattttatatctggtgtagaagaaaatggaaaatatattggattttgctctctgggtttgtcatgccagactactgaaaatgtgcacctcagaaaccattttagcatgctacctgacatgactggggtgcttgtaagcaaaattaatccactttcagatgcatacaaggttttgaagaaagatgatattatactttcatttgatggtgtgcctatagcaaatgatgggacagttccttttcgaaacagagaacggataacatttgatcacttggtgtctatgaagaaaactaatgaaaaagcattagtcagaattctgcgggatggccaagagcaggagcttagtatcattctccaacctatccaacccttagttccagttcatcagttcgataaacttccaagttattacatttttgctggtctggtattcattccactcactcagccataccttcatgagtatggggaggactggtataatacttcacctcgtcgtttgtgtgaacgggcactgcgggaattgccaaagaaagcaaatcaacaacttgttatcctatctcaggtcctgatggatgatatcaatgctggatatgagcgtctcgcagaattacaggttttgaaggtcaatgaaacggaaattgacaacctagaacacttacgccaacttgttgaaagctgtaacacagaattcttgcggcttgatttggaggatgatcgagttattgtcttgaactatggaacggcaaaaattgcgacttctagaattttgaagcgtcacagaataccttcatcaatgtccgttgatcttcttgatacagaataa

SEQ ID NO: 68188 - DNA, 141 bp, Glycine max
  Peptide Sequence Number=SeqID_184966
atgtggcatgcttattggagatctagtgttaatgtggatttggtcaaggagtaccaagaaagaggttgtgcaattggtggtgatggttatgcaacaaagaaaggagaagtagcgaatctccaaggcttgtgtaaatactga

SEQ ID NO: 68189 - DNA, 501 bp, Glycine max
  Peptide Sequence Number=SeqID_184967
atggtccggcacggatgcatctttgatagctctggcagtggaacatgcatcacaggagactgtggaggcaagcttaagtgtgatggagttggtggtgcgccacccgcttcactagcagagtttacactagacagccaggaaggggatttttatgatgttagccttgttgatggttacaacttgccagtgtcaatcttccctactggaggatccaggcagtgtaaggcggttacatgccggtcggatttgaacagaaactgccccagcagattggaggtgagaaaccaaagtcacattgttggttgtaagagtgcatgtatggctttcaacaagccggaatattgttgcacaggctacttcaatagcccgaagaagtgccagccaacaagctattcaaaggtgttcaaggcttcttgtcctcaggcttatagctatgcctatgatgatgcaacaagcactttcacttgccaaggagcaaactacttaattaggttttgttag

SEQ ID NO: 68190 - DNA, 234 bp, Glycine max
  Peptide Sequence Number=SeqID_184968
atggttccgcttctagaaggttctcgtgagctcctacattgtgagcagggagatgaagagtgcatcaaaatcttgaagaactgtagagaagccatcccaaaagaaaatggaaaggttattattgtagatcaagtgattgaagagggaagcaaagagtcatcaaaatggaaggattcagctcatacactggaatccatccatgctctgcaatttgtcattatagctttctattaa

SEQ ID NO: 68191 - DNA, 3543 bp, Glycine max
  Peptide Sequence Number=SeqID_184969
atgaaactggttgtggaagttattaatgctcatgatcttatgcccaaagatggcgagggatcagccagtccctttgtggaagtagactttgagaaccagcttagccgaaccagaaccgtcccaaagaacctcaaccccacttggaaccaaaaactaatcttcaatttagatgcaaccaaaccttaccatcgccaaacgattgaagtatcggtctacaatgagaggcgacttactccaggcagaaacttccttggaagggtgagaattccttgctccaatattgtcaaggaaggtgaggaagtatatcagattttccctcttgaaaagaagtggtttctctcacctgttaagggtgagattggcctcaaaatatacattgcatcagagtctaattccaaaccaaaacctctttctcctgttttcccttcagaacaagaaaaacttccaccttccactccaccccgagaaccagaatccaccattagtgaccttcctccgccacctcatagtatcccctcaggcctaactgacagaacattagaagctgatctcagtgaagaacttcctgcatttgacaccccaaaagcaagcacagaagaagcagaagtatattatgttgcagaagctcggtctagcagtgttgatatcgatcaagagccaaagaaagaaaatagagaagctgtcgtagagaccgtccaacaacttgacaagcaccaagttctccagccacaaacgatttcaataaagagaagaccacaaggtactccatccaccatgcactcagttgatcctcaagtccaatctagccatcacgaaaactataatcacaatgacaccaatcaacagccaaggatttcaataaagaggcgaccgctagcgcaaggtgctccattcacgatgcactcgggtgatccacaagtccaaccaagccatggtgaaggctacaatcataatgacactaacctgcagccaaggatttcaattaagagacgaccgcgaggaccgggtactccatcatcaatgcactcctttaatccacaagtccatgctagccgcaacgaaagctacaataacctcatgggaaccaacccacaacagccaagaattttagtagagagacaaccacagaatactccgctcaccgtgcaccgagttagtccccaagtccctactagcaatgatgaaaactacaatctcagtgacaccaatgtgcagcttggcgagcggtggcccagtgatggagcttatggtagaagagggtgggtgagtggtagtgacagattcactagcacgtatgaccttgttgagcagatgttttatctgtatgttcgtgttgtgaaggcaaaagatcttcccccaagcaccatcacctcaagctgtgatccttatgtggaagtgaagctggggaactacaaaggaagaacaaagcactttgagaagaaattgaacccagagtggaaccaagtgtttgctttctccaaagaccgcattcagtcttctgttttggaagtctttgtgaaagataaggcaatggtgggcagagatgactatcttggcagagtagtttttgatctcaatgaggttccaacaagagttccaccagatagtccactagctcctcagtggtaccggctcgaggactggcgcgaagaaggcaaggtgaggggtgacattatgcttgcagtttggatgggaacacaagctgatgaagctttctctgaggcttggcattctgatgctgccactgtctatggggagggcgttttcaacgtcagatcaaaggtttacatgtcaccaaaactgtggtatctcagggtgaatgtaattgaagcacaagacgtgatcccaggtgacagaaaccgcctaccggatgtttttgtgaaagctcaagtgggctgccaagtgctgacaaccaagatatgccccaccagaacaaccaccccattctggaatgaagatttggtctttgtagcctgcgagccatttgaggagcaattaacaatcactgtggaggatcgtgtgcacccttcaaaagatgaggtacttgggaagataagcctaccaatgaccctctttgagaagcggctagaccacaggccggttcattcgcgctggttcaatcttgagaaatttggttttggagtgctagaaggtgatagaagaaatgagctcaagttttcaagcaggattcacatgagagtttgccttgaaggtggataccatgtcctagatgagtccacattgtacacaagtgatcaaaggccaacagcaagacagctatggaagcaacctattggaatacttgaagtaggcatcttaggagcgcaggggcttctcccaatgaagatgagggatggaagaggcagcacagatgcatactgtgttgccaagtatggtcagaaatgggtccgaacccgaacacttctcgacacttttagtcctaaatggaatgaacaatacacatgggaggtctatgatccttgcactgtgataacgttgggagtttttgacaactgccatttaggtggaggggaaaaagctcctggtgacagtgctgctagagattctcggattggaaaggtaagaataaggctatcaacacttgaagctaataggatttacaccaattgtcaccctcttcttgttctacaccaacatggagttaagaagatgggtgagattcagttagcagtgaggtttacggcactttcactagccaacatggttcacatctatggccaacccttgctccccaagatgcattacttacatcccttcacagtgaaccaaatagacaacttgaggtaccaagccatgaacattgtagctgcgaggctaggccgagctgaaccgcctttgaggaaggaggtggtggagtacatgttggatgttgattcccatatgtggagcatgagaagaagcaaggctaatttcttccgaatcatgtcccttttctctggtatgatcacaatgggaaagtggttcagtgatgtttgcctttggaagaaccatgttacatcagtcctggttcacattcttttcctcatactgatatggtacccggaattgatcctgccaaccgtgtttctctatatgttcttgattggtctgtggaactataggttccggcctagacacccgcctcacatggatactaaactctcgtgggcagaagccgttcaccccgacgaactcgatgaagagtttgacacgtttccgacttctagatcacaggatgttgtgagaatgaggtatgacaggcttagaactgtggcaggtaggattcagacagttgttggggacatagctacacaaggggagaggtttcagtctctactgagttggagagaccccagagcaaccagcctctttgtagtgtttagcttctgtgctgctgtggttctctatgcaactccattcagagtggtggctctggtgacaggtttatactttttgcggcatccaaagtttaggagtaagatgccttcagtaccaagtaatttcttcaagaggctcccagctagaacagatagtttattgtga

SEQ ID NO: 68192 - DNA, 1740 bp, Glycine max
  Peptide Sequence Number=SeqID_184970
atggcgaaatcgagcaaaaatcccaccacgtcgtatccggcgataaaggcagagcaatacttacacagccccgttcactacgcgctggccattcgcgaccacacaaagctttccagaatcatttcttcgcttccccgagttcccgaccctgcccgagtcatcaccgagtccgactcgctcagtcaggaccgagtcggggagaaaatctccgccgtcctggaccgccgcgacgtcccgttccgggagacgcccctccacctcgccgtccgcctcaacgacgtcgccgcagcgcgcgccatagcctccgccggcgccgatatctccctccacaacgccgccggctggaacccgctccaggaggcgctctgcctgcgcgcctctgacatcgcacaggtcctcgtccggctccaccaccgtgccgcctgggccaagtggcgccgccgcctgccgcgcctagtggcggctctccgccgcatgcgtgatttctacatggagatctcgttccacttcgagagctccgtgattcccttcgtcggaaaaatcgctccctccgacacctacaaaatctggaagcgcgacggcaacctccgcgccgacaccaccctcgccggcttcgacggtctcaaaatccaccgcgccaaccagagcttcctcttccttggcgacggtgacgccatcgcaggcgtccccgctggctccctcctcgttctcaaccgcgacgataagaaaatctttgacgcgttcgagaacgccggagctccgatgagcgattccgatgcggcgggattctgctcgcagagcagcgtgtaccggccggggatggacgtaacgaaagcagaactcgtcggaagaactaattggagaagacaagagaagatggaaaatgttggagagtggaaagctagggtttatgaagtacataacgtggttttcagtttccggtcacggaaagttactggaggcgaatccgacgtggcagggagcgagcaggttttaccattggagcttgatgaagacgaagacggttttctcgttgcggaaaatccgagttttggaatgcctctcggtagtaacaattccgataagagaagacatagtagttttgtgagagaagaaagagagtgggtcccaatagggagaaaaagcgtggattttccttccgtttcggtcgcgccaccgaggaggtcatcggcggctgcggcggctccggctgccccactgacgaaggagaaggagtatttgagaagtttgaggccggcggtgtggttgacggagcagtttccattgaagacggaggagctgttgccgttgttggacattctggcgaacaaggtgaaggcggtacggcggctccgggagcttctcacgacgaagttcccgccggggagttttccagtgaaggtggcgatcccggtggtccccacggtaagggtggtggtcacgtttaccaagttcgtggaactgcaacctgtggagaagttctacacgccgttatcgagtcctacgcatttgctcaatgcagatgatgatgatccttctgggagatccacgtgtctgagaagaactagtactagccattcgtggggtggggggagtaagcaccaacaacgatcttcttcttcttctggggctttggattcggacccttttgctattcctgttggatatacgtggaccaataatggggatgattcgtcacggaaattgaacaagtccaagtccgtcagaaaatccaagtga

SEQ ID NO: 68193 - DNA, 381 bp, Glycine max
  Peptide Sequence Number=SeqID_184971
atgactagaggtatagctaacttacaatgctggccgaagtatcactactacgtgacaaggttgaggattaataatgaaattaccgaagatgcctcacaaagtttgcttaatcaggcggaaatactcaaattggtgagtcggcaagataacattaaagatagattaggcaacgaaagaaagatggcgagcgaggcaccacgttgggctgaccaatggggtgctggtggtattggtgctatggaggatgatgatgccaccagatcccaaaaagacatgcgcaagaacaagaattctggtggttttgccaaaattaaaagcggggcctctatttgtgtcacatggatcaaaaaccaattcaagagaaacaacacttccaaatag

SEQ ID NO: 68194 - DNA, 461 bp, Glycine max
  Peptide Sequence Number=SeqID_184972
atgccaaaggtgaagcgttttagaaatccacaaaaatcagcacctcaaccacaatgtcatggacctctaacacaagctccaacacattctgttccagcaatgaatcctgaaatttcttccccaccaagtgattccacacaagctcctgaagtcccaactggtaatgtccctctttctcatgtatcaacatctgaagttccacaagaagatgaaacaattagacgtcatgttgggcgtgagtctacacaatgttggactgttgaggcaatagactctaaagaaacgatcaagaagattaaggtgaaagttaggggagtcaatagcttacctagggagttatgcatcattgtgaattttgatgaccaaggccaagcaattggtgaagcacaaaccttgcttacaggatttcttggaacactagcaactgattgcaaattatttcctatggattatgatagatg

SEQ ID NO: 68195 - DNA, 405 bp, Glycine max
  Peptide Sequence Number=SeqID_184973
atggcgcgccgcgccttccagatcgacgccgtcggccagttcgttgaccagcagcgtcttgccgctgccggtattgccgcccaccaggaccatcggcaattgcgcgctttgcgtcagtacaccgagcagataattgcgcagcgctttataaccgccagtgatacgcggataatccacgccagcctcgtgcagccattgctgcaccagctgcgagcgcagcccgccgcggaagcagtaaatatagccttcgggccgcgctgcgcaggccgccagccaggcggcggtgcgctgttcgcgcagtttgccgttcaccaggctgtggccgagcgcgatcgccgcctgctgcccatgctgcttatagcaggtgccgaccgcctggcgttcgctgtcgatcatcagcggtaa

SEQ ID NO: 68196 - DNA, 769 bp, Glycine max
  Peptide Sequence Number=SeqID_184974
agataccaaggaagtgcttggaggagaaggcgaaagctttggccaaccaaggagaatgggcaacattcatcaacgtattagctctgctagtgtttgggacagtactattcccgaatgtagacgggttggtggatctagtggcgatcgacgcctttcttgcttatcaccacagcaaggaaagcccgatcattgctgttttggcagatacatgtgatatattcgacttgagattctgtctcctacaaggtcatctcatgtgctccgaagagggtaaagaaaattgggaagaactcttggtaggcatgacgggagtgtccattagttggttcccacggtggaaagaaggagagccaggagtgttatgctcatgctatcctatgagaggtgagtcgtcggagaaaatcatcacgcctttcatcgagcgaggtttcaatgaagctaatgcgaagatacttcacaaaatctgtaaagcgtggaatagagtgggaagaaaagataaggagcttaggggaggtagcaatggcgtcatcagtgactatcacaagtggttgaagtctagaatgcaagggatagcctggctcccaaagctgagaagtctaagtaggaaagaggctgaaattcttgtggaaagtgaagaagtgcaagctttgaaagcagagctcgaaagaacaagattggtgaaagagaatcttaagacggtagtcactagggtcagaaaagagtgtgatgagctgaaagatatcaacatgaccacggttgaagcattaga

SEQ ID NO: 68197 - DNA, 474 bp, Glycine max
  Peptide Sequence Number=SeqID_184975
atgttggtgcgcatgatccgcactcgtctctttgcagcggcacgggtgaaatcttgccccggtatgcatagtagttgtgtgatagcctccctctctggttgtgctcgcacagttggccctcctccaatatcagggggtggcccaggaactgtgcggatgtggagcacactgaaaatgaggacacgtagccctctaaaggtgagggcgtgcagccctctcaaggcgaggacgtgtagtcctctggaggtgagggcgtgtagccctctgatggtgaggacgtgtagtcctctcaaagtgagggcgtgtagccctacgaaggtgaggacatgcagtcctcttatggcgagggcgtgtagccctctgaaggtgaggacgtgtagtcctctgaaggtgagggtgagggcgtgtagccctgcaaaggtgaaggcacatgaccctttgacggcgaggacgtgtagtcctctgaagttgaag

SEQ ID NO: 68198 - DNA, 450 bp, Glycine max
  Peptide Sequence Number=SeqID_184976
atgaagctcatgtcgtcttcaagatgcgtgatgcgtgagtccatagcattgaaacgatcaccggcgaaagcccgaagatacctaagctcagtgagaacgtcattcaataaggaagatgaggaatcccgttgcggtggcggggagggtgttggcaggttgtgtttaagcccgaagatacctaagctcatgtggtcttcaggaattggagatggaaggttgcgtttacgcacatccacatcctttcgctatccaaaggaggcaacaacactagcaccaatagctaataaatgtttgaccttaacaaaagaaaatagagtcaataaccatttagaagaaaaagaaggattagggggcactggtgggtcaccggttgtgccgtggcggcgttgtcctacagcggtggttgtggaggatgaaccatttcaattccttgatggttctgtcatttga

SEQ ID NO: 68199 - DNA, 426 bp, Glycine max
  Peptide Sequence Number=SeqID_184977
atgcagtttggtgttgagaaacttgtacgatcgaactataagtattggcgactgtgcatggaagcttttctccaagggcaggatttatgggatctcatggcaaaaaatgataagaaaatgccaccagatacaccggacacgatggaggcccgacgaaaatggaaggtaaaatatgggaagatgttgtttgttctgagaatgacggtcaacaaggaattaattgatcacattagagatcttgacacaccaaaggatgtatgggagacactagaaaaactcttctccaagaaaaatgttgctcgattgcagttgctggaaaatgaacttgcatccacagtgctaggtaatcttacaattgctgaatacttcttaaagattaaaaatctttgtgtagatctgagtgagaaaatcagtgaggcaaggtga

SEQ ID NO: 68200 - DNA, 897 bp, Glycine max
  Peptide Sequence Number=SeqID_184978
atggacgtcccgcagctcttcctccctgcctcccgaagaattgcagcagctaacccatcaaatcaaggaccagctagaggagtccatcacagaaaaagtgacgcaacagctcatggcatccttcagccagatgcagtcccagattcagtcccaaatgcaatcttagggacttgcactacctcccgagcctctggttggtccctccggtcctcgagaaacgatcctgagacgggtgactctgataggtgcggcttgtacatagaagcagatcctacccgtctggttgccctgaggagagtttatgagggatccactgttgttcataacactcctttgttgcctggccaagtaaaggtgagtgtggaggaagttacagatgcagatgctctagttcctgtacccactgatgaggtttccttagtggggcaggcacttcacaccttccttgcttggctgacacatttggtcaagtctttatcacagcaggtagttgtgtctccggcaaaaccacctccaaagcccgatccggaggttgatgatccgctttatctgatgacattgaccatcccagagcttttcttgaggccttatcaggttacatgggatgccaccatgttcggggcctttaatccagatttcccgctctacataaagcacgaagacctctccgaaatcgcacacggtggtcaatgtctcagcatttcagtgttacagttgtggattatgcatctcactgatacaagtatgcgagcggggaattatgatatctatggattcctcgagccacagtccattcagaggtttggacaatcacagtttgagtctgaaagttacataaaaacttggatgcagagttcaaaacgtgatgtctatcttggagcctacctaaatgggtaa

SEQ ID NO: 68201 - DNA, 276 bp, Glycine max
  Peptide Sequence Number=SeqID_184979
atggcgctaaaaacttgttcgacggccgacaagtgcaccggatcgcacaatggtgggtgcgaaggcagatggtcaacgtgttggtcttcctactgggcgagtgatgctactaaagatgttctctacctaacaacattcctgtgctctatgttgtctcctggactgctaaaccctgatgtctcgtgcatgtttaacctaatcctagccaagcatcatcctcagatccctcttgttgacataccaacaactaggttaccgtaccccgatccctcgtga

SEQ ID NO: 68202 - DNA, 414 bp, Glycine max
  Peptide Sequence Number=SeqID_184980
atggcggtttccaaactcagaatgatgcaaaggaaaacaaaaggtcagattagggcttcgttctctaccgaaaccgcgaggcaagtttggaagattccgctttggttgaagggttcctctcggtgtggggtttcaacggagaacaacggtggagaagaaatggcatttttccaaagctacttggactgcaaggctcaaaacgcacaagtgactaatgctctcagaaatggaaacgtcgcgcacactccagagaccaaatttcgagaagatccaacggttaacgaagactgggcagcatttttatcgagacagcttcatgtagcttccttgagaagcttcattaagaggcttcctcatggcttctttgagaagctagattcttatctacccacacccctctatgaactaaattaa

SEQ ID NO: 68203 - DNA, 227 bp, Glycine max
  Peptide Sequence Number=SeqID_184981
gatgacaaaaagtgtggggcggttgacaaaagcgaggcttttgctcctacgtttcctcaatttgagatgaggaactcagacctacgtagttctagcttacacgatgtgcggataaccggaaggtgtctccacatgctaccaggctcttgggtcatgatagcaaaaggtgtggtgattgacaaaagtggggcttttgctcctacgtatcctcaacttgtgatgaggaa

SEQ ID NO: 68204 - DNA, 354 bp, Glycine max
  Peptide Sequence Number=SeqID_184982
atgtaccctctcttgttctcagtcaaacccaagtcctctacttgtaccacaaaggatgtatcctccaatgtgttaagacaaagatctcaggcggttaaacgtttgatactttgtgaatggggatacaaaagaattctcaggcgggagaagggagacacaaaagaattcagacgattagtccttcgttcttttggaaaagggagaagagagacacaaaaagaattcaagcggttagtccttggcgaattctttttggcaaagggagaagagatgaaaagaatgaatagcacaagttttcaaggtttagaaaaccagaaaactttggaaagcttttggcgcaaagaagaagaagaa

SEQ ID NO: 68205 - DNA, 345 bp, Glycine max
  Peptide Sequence Number=SeqID_184983
atgttcaacgctcccgcgaaggttttccaccgttcttcatcgttcttcgttcgttcttcgtcgttcttcggtcttcaaccacttcgcggacttggtattcgctggggaaagaatcgaagtagggttgaaaagagggaagagagagtgtaccacacaggctatgacagttataacaacatccttctctttgtacatacttatacatacaacaaccctatgaatcagtcacacattcatgctcaagacaagaagacagaaatacacacaatgtgtgacttaacgttactccccgaaacctacttccaagtttcagagatacacaacattcacacagcaagaccataa

SEQ ID NO: 68206 - DNA, 186 bp, Glycine max
  Peptide Sequence Number=SeqID_184984
atgcggggttaccttatggttatccacacctttggtcaaccaggggcaaacaagcatgttgacgcgcgggtttaccatatggttacccgcacctttggtcaaccaggggcaaacgagcccgttggcgcgcggagactaacatcatcttctacaccatttggcgtcctgacccgtgaagtcaggtga

SEQ ID NO: 68207 - DNA, 819 bp, Glycine max
  Peptide Sequence Number=SeqID_184985
gcgaacggcgcgcccttgttgtcaccgatgcgcacgatgcgcgcttccggaatgccgaccatgtcgcgccacagttcgtaggcttcgtcatcggtctggtagacggtgaccagcaggcgctcggccggcagcttccagacctgggtcagcagttcccaggcccaggcgatcgcgtccttcttgaagtagtcgccgaaggaccagttacccagcatttcgaagaaggtgtggtggcgtgcggtgtagccgacctggtcgaggtcgttgtgcttgccgccggcgcgcaggcagcgctggacgtcggccgcgcgcacatagctacgcttctccgcaccaaggaacacgtccttgaactgcaccatgccggagttggtgaacagcagggtcggatcattgcccggcaccagcggcgccgacggcacgatggtgtggcctttgcccttgaagaattcaaggaagtcgctgcggatctgggaagtcgtgaatttggcggatgcgttcattgggggctggcagtctgcgggccggcgggcccggaccaccggccgcattggccagggtcgcgagggaccgccgaaaacctaaagggtatcaggcccggcgccgccagtctcagtcatccgggtcgtagcgggtcgcacggcggatgctgtcgccgtcgaagccgcgtcgggccagcagatcggcggccttgcgccgctgcgtcaggtcctgcgggccggcctcgccaaagcgtcggcggaccagatcacgggcattttcctgccagtcgccttcgtagctgtccatcgccgcggcaatcgcggcactgtccaggcc

SEQ ID NO: 68208 - DNA, 663 bp, Glycine max
  Peptide Sequence Number=SeqID_184986
atggcccgcaccaagaaaaatggccaaatgacgtctgaggcatcaaaggaaattgctgacaagattgcctcacagggttcctttgtcgcccatggacattgggatgtactgactgctgccattgggcgacaagaacacgctggtcgtgtgcgtgctgctggagctggacctccacacttctttgtccatggctctcgaagacctggagcagctgatgcaaaagatcagggaccagctggaggagccaatcatagaaaaagtgactcaacaactaatgttgtccttcagccagatgcagtcccagttggtcctttagctgctcgtgtcagcataaaggagagttgcattgatccctcagggaacgacctagacacgggtgactcagagaaatgcaggttgtacatcaaggaaaatcctccccacctgattgccctaggaagactttatgaggggtcaacaaccgttcacaacatccctttgcaccatgatcaagtcaaggttggtgttgaggaagttagagatgcaaatgctcccattcctgtacccactcaagagggagctgtgagatcggggaaatctgcacataggtcggatcatcatgtcgatgatcccctatatctgatgacattgactatcccacggctttttcttaagttgttacag

SEQ ID NO: 68209 - DNA, 475 bp, Glycine max
  Peptide Sequence Number=SeqID_184987
atgactcaggatgttcctgacatgactgaggatgtccctgatatggctgaggatgcacctgagatgactggggacgtacaaggtgatgatggtgttgaggggtcacatgttgatgatgctgagggatttccaggtgggccacgtgacccatcagtgctgacatcatttccaggtggggtcacacgccgtttggagtggacaggattaagtccactgatcgggtgttcagttgttactggtgatcctggacttatatccgcatttgtggagaggtggcacaacgagaccagcaccctccaccttccggtaggacagttgacgatcacattggatgatgtgtcgtcactcctccatttgcctatcactggcgcgttacacagctttcatgctctttttgcggacgaggtgatatttttgttgaccaagttgcttgaggtctctgctgaggaggctagagccgagacagcacgatcac

SEQ ID NO: 68210 - DNA, 426 bp, Glycine max
  Peptide Sequence Number=SeqID_184988
atggtgacacagatgatatccacacgtagtgctgcgcattgcgtgcaccaaacaacaatgtggattcttcaacacctgaaatgctactcctgggatgcgaaggcactgatagccatagctgctttgtctttggagtacggaagtttcgttcaccttactcagtttcaaacagacgacgtgctcggaaactcgttgaggcagctgaatcaagttcagaacaggaatgcctctgctgttggcgaacttgtcatgtacgtagtacaagtgtttcaacacattaacgagtggaccacgtatgctgatgatggctatgatccagaggacgtgcctgacttgacagaagcctttcaagccatccttgttgttgtatactggtcaattgcttccactgttgcttccaccggcaatctcatcggtgtatcgtaa

SEQ ID NO: 68211 - DNA, 168 bp, Glycine max
  Peptide Sequence Number=SeqID_184989
atgaatagaggagctagtgcatcctacgtggaagagaaggatagcatgggaattatggggaacacacatgcagtgacaaaggaaaataacataattgccgatgtggcagatagagcagaggtagttgggcggctaaaagggagaattgagagtggaggaagcatttaa

SEQ ID NO: 68212 - DNA, 417 bp, Glycine max
  Peptide Sequence Number=SeqID_184990
atggtcgtttgtattggctcagagcttcaacattcaatttcgagcgtctcgatatgttacgggactcaatcagacatccgagtaaaaagttatggtcatttgtattggctcagagcttcaacgttcaatttcgagcgtctcgatatgttacgggactcaatcagacatccgagtcaaaagttattgtcttttgtattggctcagagcttcaacattcaatttcgagcgtctcgatatattacgggactcaatcagacatccgaaggttcaacattcaatttcgagcgtctcgatatgttacgggactcaatcagacatccgagtaaaaagttattgtcgtttgaattagctcagagcttcaacattcaatttcgagcgtctcgatatattacgggactcaatcagacatccgagtaa

SEQ ID NO: 68213 - DNA, 819 bp, Glycine max
  Peptide Sequence Number=SeqID_184991
catactccggacccggagagcggggccttttatgcccgtattcgtcatgagcgttatctcaaccagcagacgcggctgaatggggaaaccaactgcgcggcgctggctcccggccagcagctaaaagtgagcggcggcgaagaggtgacggacgtctggcgccagggggtggcgatcgctgcgattcactgccgcgcccgtcgcgaccgcagcttcgtcatgacgtttcaggcgattccctgcgtagagacttactgctttcgcccagcggtcatcagcaaacccagaatggccgggacgctgccggcgcgcgtcaccagcaccaaaatcaacgatctctatggccatatcgatcgcgacggacgttatcgggtgaacttattgttcgatcgcgatcgctggcagccgggggaggaaagcctgtgggtgcgccaggcgcgcccttacgccggtgaaacctttggcctgcatctgccgttgttagcgggcaccgaagtggcgatcgcttttgagcagggggatcccgataggccctatattgccggcgcgctgcacgactccacgcaccaggaccacgtgacgctctacaactacaagcgtaacgtgctgcgcacgccggcgaacaacaagattcgcctcgatgatacacggggtaaagagcacgttaaggtcagcaccgaatatggcggcaagagccagctcaacctcggccatctggtggatcatcagaacacgccgcgcggtgagggatttgagttacgcaccgatagctacggcgcgatccgcggcgggaagggaatatttattaccgccagatga

SEQ ID NO: 68214 - DNA, 941 bp, Glycine max
  Peptide Sequence Number=SeqID_184992
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatacgctggttatgaggacaatatggtcctccagcagggcgcgccgctgaccctgtcgggacgcacccaggcaggggtcaaggtcgaggcaaggctgggcaagaccggggctagcgcggtttcggacgggtctggcgccttttcgattaccctgcccgcccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 68215 - DNA, 736 bp, Glycine max
  Peptide Sequence Number=SeqID_184993
atggctgcagggcagcctggctggcggcatctatcacctgacggcctccgggcacaccacttggcatggattggcctcacatgtcgtcgagcgtgcgcgccaaaatggagtaacgctcaagaccgaagcgggcaacatcaaacccattgcgaccgaagaatatccggtcccggcggttcgaccgaagaactccaggctgaataccgccgccctgacaactccgctgaaactgcagttacctcattggacggtccacgtcgaccgcacggtagatcaactctcgtctttggaactctccgcatgaagcgcaaaggtattattctggctggcggctccggcactcggttgcatcccgccaccctcgcgatcagcaagcaattgctgccggttttcgataaaccgatgatctactacccgctgagcacactgatgctctccgggatccgggacatcctggtcatctcgaccccgcaagatacgccccgtttccagcaattgctcggtgacggctcgcaatggggcttgaacctgcaatacgcagtccagccttcgcctgatggcttggcgcaggccttcctgattggtgaaaaattcctcgggaacgacctgtcggcgctcgtgctgggcgacaacattttctacggccacgacttccatcagcttctggccaacgcccatgcccgcaccgacggggccagcgtattcgcttatcacgtgcacgaccccgagcggtatg

SEQ ID NO: 68216 - DNA, 414 bp, Glycine max
  Peptide Sequence Number=SeqID_184994
atgggtgccaagtacctcgaagtggtcaaacgagggtcgcatcccaacaacagatggtccccggacaaaattagggaagaactaaatcaatttgaaagaaataatgtttgggaactagttgaaaaaccagaaaattatcctatcatagggacaaataaaccagaattaaatcaattctctcatgacatgcaaagtgagtttgaaatgtctacgatgggagagctcaacttctttcttggattacaaataaagaaaaccaaagaaggaatctttgtcaatcaatcgaaatactgcaaggaattaattcaaagatttggaatggaaagtgctaagcacacggctacacccatgagtactggttgctatttagataaagatgaaaccggtcaatctatagacatcaagcaatattga

SEQ ID NO: 68217 - DNA, 231 bp, Glycine max
  Peptide Sequence Number=SeqID_184995
atggagaattggcgaacagcgctacgcaataacttcgcggggctccagactcgttggtggaggatgcatgaacagcgccaggcaatgacattcatggggctccgtaaaaaagtggagaatggagaattgactcgttggtggaggatgcatgaacagcgccaggcaatgacattcaaggggctccgtaaaaaagtggagaatggagaattggtgaaaagcgctacgcaataa

SEQ ID NO: 68218 - DNA, 303 bp, Glycine max
  Peptide Sequence Number=SeqID_184996
atgataaatgatggaacatacgaatttggggatcccacggttatgtggctccgcatgccccggacccttgggtcacgaggaaacactgggtccaacaaagataggagaaaatcactcaaagtgtatcaatctcacacagggcaaggattgacattctcaccctgggtcaaggtttatgataagttgggattttggctcaaggcttgtagaacgactggtcatgatatatgtcagggtttggctagtggttcgaggataaaggggatgccctacattatttccatgatacacatgcaacaatga

SEQ ID NO: 68219 - DNA, 240 bp, Glycine max
  Peptide Sequence Number=SeqID_184997
atgcctcaaaatttggagcgttggggattgtgtaccggaagaaaagtgagcattcccttcaaccccattaatgcaaagttccaaaagttttggaacggggcgaggaaagttgcatccttttattactgggaatggagagagagtgtgaatgatgaaatgagacgaagagtacaggtgcgggagaagaaggcagagacagtgacccctgccaacaacgacacaaacaaaggtgctgtgtga

SEQ ID NO: 68220 - DNA, 1401 bp, Glycine max
  Peptide Sequence Number=SeqID_184998
atgaaatgcgtgagggatttggtttcatggagttcggttgtcacgtgttatgttgagaatggacgaccgggagaagggttggagatgttgccttggatggtttctgaggggattgtaccagactcggttacgatgcttggcatagctgaggcaggtgataaagttggttgtttgagggtggtgaggtcagtgcatggatatgtgatcaggaaagagatggctggtgatgcaagtgtgaggaactcccttattgttatgtacagtcagtgtggttacttgcgtggagcaaaaggggtgtttgaaagtgttgctgatcaaagtactgcttgttggacttcaatgatttcgtcttgtaatcaaaacggacgctttgaggaggctattgatgcttttaagaaaatgcaggaatcggaagtggaagttaatgaagtgacgatgattagtgttctttgttgctgtgctaggttaggctgcttgaaagaggggaagtcagttcattgctttattttgaggagagaaatggatggtgctgatcttgatctagggcctgcgctcatgcatttctattctgcgtgttggaaaataagcagttgtgaaaagattctttgtttaattggaaacagcactgttgtatcatggaacacactcataccaatttatgcgctggaaggtttgaacgaggaggccatggttctctttgcatgtatgttggaaaaggggctaatgcttgattcatttagtctttgcatgtatgctggttcaatacgatttggacagcagatacacggccatgtcacgaaaagaggcttcgtggatgaatttgttcagaactccttgatggatatgtattcaaaatgtggttttgtggatttggcatacacaatttttgaaaagatgaaggagaaaagcatggtgacatggaactgtatgatttgtgggttttctcagaatggcatttcagtagaagcactcaagttatttgatgagaaggatctttacattgatacatctctggttgacatgtatgccaaatgtggagaccttaaaacggctcaaggtgttttcaatagcaagtcgaagaaaagtgtggtgtcatggaatgccatgattgctgcatatggcatacatggttttgatgatatcaaaaagaatttgtttgataatgagtgtcatcatcaaaaaggggagaatgtgaatcatgcatgttttgatgatgttgaaaagaaatcatttgataatatgattgtcatcatcaaaaaggagaagaatgtgaatgtgtgtatacatgattttgattatgtcaaagaagaatcaaacaaggttgcttcaaaggataagcattgtttcaagattaatacaagattgtttcaacaaacaaagtcttgtttcaagattcactaa

SEQ ID NO: 68221 - DNA, 231 bp, Glycine max
  Peptide Sequence Number=SeqID_184999
atggaaaaatccgacaagatgaatttcaaagagaagaaagaaaagaaaggatacatcacttgggaagataatgtcataaattattcaagtgattcagagaagaaaatcataagtctgggtatcttgatgaaagactatgaaaatggagaagagcaaagtcaatacattgatagcaatttctccaaacacatggcatgcatcaaagtttattcatatttctccccaagataa

SEQ ID NO: 68222 - DNA, 216 bp, Glycine max
  Peptide Sequence Number=SeqID_185000
atgggttctggcaatgcaatgtggttggactctcatgtcgatctgaatgaatcatcctttccacggagatgtaactccagttacttcggaaatggtaagatctttggcgcaagagacgcgagaggaggggttgatccgtatcatcttgacttggttctgatttctctattttttaataaaatcgagtcgggttcttctcctacccgtatcgaatag

SEQ ID NO: 68223 - DNA, 339 bp, Glycine max
  Peptide Sequence Number=SeqID_185001
atggcagaggtctccacggaagccattgcttccctcacccagtattatgaccagcctttgaggtgcttcacctttggggacttccagttaacacccacggtagaagagtttgaagagatcttgggatgccctctgggaggaaggacaccatatcttttctcagggttctatccctctttggctagaatttccaaaatagtcaaaatctcggcacaggaattggaccagggaaagcaagtcaaaaatggggtggttcgagtaccaaggaaatgtttggaagcgaaggcgagaaccttggcaagccgagacgaatgggcttcattcattgatgtcctgtaa

SEQ ID NO: 68224 - DNA, 327 bp, Glycine max
  Peptide Sequence Number=SeqID_185002
atggaggattgccttgaggttcctctcttaggcaatcatggaatacaactccagactcgaaaatggaggacacgtgaacgacaacgcaattcactcacgcggctccggaaaaggatgagaatggaggattgccttgagggtcctctcttagacaatcatggaacacaactccagactcaaaaatggagaacacgtgaacgacaacgcaattcactcacgtggctccggaaaaggatgagaatggaggattgccttgagggtcctctcttagacaatcatggaacacagctccagactcaaaaatggagaacgcatgaacagccctaa

SEQ ID NO: 68225 - DNA, 273 bp, Glycine max
  Peptide Sequence Number=SeqID_185003
atgatacgcggagataccttacggttattcgcacccttttgtcatccagaggcggcgggcccgatgacaagcagagaccaagtttggtcattctgcacccttgtatcatccagaggcggcaggcccgatgatacgcggaaatacccgagtggttatccgtataaacatcttttgctatctgaacgacaagtcatggtcacccacgactctcgtcaaccgagaggagcgaaattagtgtcatacactgatattcgtccggggacctttgcttga

SEQ ID NO: 68226 - DNA, 505 bp, Glycine max
  Peptide Sequence Number=SeqID_185004
gatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataagg

SEQ ID NO: 68227 - DNA, 690 bp, Glycine max
  Peptide Sequence Number=SeqID_185005
atggtaagatttggaaccgtttcccagtattatgaccagcccctaaggtgcttcacatttgaggacatccagctagtgccaactgtgaaagagtttgaagaaatcctgggatgcccactgggaggaaggaagccatatcttttctctgggttctatccctccacgacaagagtttccaaggtagtgaaacctcagcacaagagttggacgtgtaaagcaaaacagaaatggaggagtcggagtaccaaggaagtgtttggaggaaaagggcaaaggccttggcaaaatcaaggcgaatgggcttcttttattgacatcttggcgcttttgatctttggagttgtcctctttccgaatatggaagggttggtggacctagcagtgatcgacgcttttctcgcctatcataaccacaaagaaagcccggtcgtcgccattttggccatgtatgacacgttcaaccggggatgtaggcccgtctatccgctacaaggtcaccgctcgtgcatcgaaaaaggaaaggcgaattgggaccaactcttggctagcatggagaggcgtctgttaattggttccctcgctggaaggaaggaagaatcaggattctatcttcatgcgaaggatgtccaaatgtcccttgatggaacaaggggttgtattaattataatcccgtcctcgtcataagatag

SEQ ID NO: 68228 - DNA, 591 bp, Glycine max
  Peptide Sequence Number=SeqID_185006
atggccagcctgatcgtgggcggagtcgtggcggtggtggacggcggctacgcgctgtggagctacctggccgcgccgccccccgcggtctcaaacgtcaacagtgaaccgggtagccggtaccgcgcaggtgaacgcgcaggagcagccggactaccgcgaaaagctgcgcgaaagcaacgccatgggggcgcagaacgccacggcctcaaaccagagctttatcgccagcatcccgctggagcaggacgtgatcgcgccgaaggaaccggcgaaggtcgcgccggttgtggcgccgcgcgagctgccgcgcccgcagggtaccgggcgcacgcaggagcaggagaaggcgctggccgagacccgacagaaatcgcttgccgccctgctcgcgaagatgcaggccccgccggcggccggcgaactgcccgccgctcagctgctgggcggaaaggacagcggctgggcgaactggcgcgattcgctgcccgggagttacgtgcagcaggccgccgcgcgcagccggcaggctgcggcgaatacgccgccggcgaccgtggtggtcgatccgtaatggcgcgggccgggtga

SEQ ID NO: 68229 - DNA, 606 bp, Glycine max
  Peptide Sequence Number=SeqID_185007
atggttcatggtccatgtggaagtctgaatcctggatctccatgcatgaaaaaaggcaagtgtagtcgtttctatcctaaaatgttccagccgcatactgttttagatgctgatggttttcccgtctatcgtagaagaaacaacggtaatgcaattgagaaaaatggtgttatagttgataacaggtatattgtaccttacaatccaagattgctcagaaaataccaagcgcatatcaatattgaatggtgtaaccaaaacacttctatcaaatatttatttaagtacatcaacaagggatatgatagagtgactgctgttttgattgatgaagataatgatcaaactgagaatggtggcacgcataatgatgagatcaaagaatatctagattgcagatacatatgtccctgtgatctacttggagatctttggatttccaatacatggcagaaacttgttgttgaaagattacacttccatcttccaggccaacatattgttctctatgaagaccatgatgatattgatgatgtattgtctaagccaagtatctctgattcaaagtttatttcatggatgtacaccaaccaaaattctgtttaa

SEQ ID NO: 68230 - DNA, 294 bp, Glycine max
  Peptide Sequence Number=SeqID_185008
atggaaaaatccgacaagatgaatttcaaagagaagaaagaaaagaaaggatatatcacttgggaagataatgtcttaaattattcaagtgattcagagaagaaaatcataagtttgggtatcatgatgaaagactatgaaaatggggaaaagcaaagtcgatacattgatagcaatttctccaaacacatggcatgcatcaaagtttattcatatttctccccaagaaaagtgaatatgcgatttatggagacaacaaacaaaggccacttgatcaacaacctcaacaagtaa

SEQ ID NO: 68231 - DNA, 210 bp, Glycine max
  Peptide Sequence Number=SeqID_185009
atgccgatctccccctacggaaatattagttggggtcgtgcccacaagacacccagtggacccggggaagtccaacaaggccctggggtttccagctcgggttacgggcctctgtcagtcctacagggtgttcgtccccccagcaagggatcgtgcccgcaagacacccaatggacccggagaagaccaacagggtcttggggtttctag

SEQ ID NO: 68232 - DNA, 216 bp, Glycine max
  Peptide Sequence Number=SeqID_185010
atgaccaaacttggtctctgtgtgccaacggacacgactgtgtctgaatggcaaaggggtgcggataaccgtaaggtatctccgcgtatcataatgaccaaacttggtctctgcgtgccatcggacacgactgtgtctgaatggcaaaggggtgcggataactgtaagaatgaccaaacttggtctctgcgtgccaacggacacgactgtgtctga

SEQ ID NO: 68233 - DNA, 474 bp, Glycine max
  Peptide Sequence Number=SeqID_185011
atgacattgctacttagcaacattctgcccagcgaccgcaatgccaatctccccctgcaaaagtatcagttggtctgtgtcgtcccgacatggggatcgcacccacatagacacccagtggacctgaagaagtccaacagggccctggggtttccagctctggttacgggcctctgtcggccctacagggcgcccgttccccccagcaagttcaagtcgtcgtggcatagggattgtgcccgcaagacacctagtggacccgaagaaggccaacagggtcttggagttgccagctctaaatacgggtctctgtcatcaggcccccctaccaatcgagctttcatcaagaagttctgcgcccccaggcaggcgcagggcgaaacaccacatcagcattgggatggccggcaacgggcaactgatgcactgccatcacctctagagttctcctctgctcttcctcttaaaggttag

SEQ ID NO: 68234 - DNA, 306 bp, Glycine max
  Peptide Sequence Number=SeqID_185012
atgtttgggtttggctatgatccgtcaagtgacaaatacaaggttgtagcaattgcattgactatgctttcacttgacgtatctcaaaagactgagatgaaagtttatagcgcgggtgacagtagttggagaaaccttaaaggttttcctgttctttggactttacctaaagttggtggagtgtatctgagtggaacccttaattggattgttattaagggaaaagaaaccattcattctgaaatcttaattaattctgttgacctggagaaggagacttgcactatggctaatatgtttcattga

SEQ ID NO: 68235 - DNA, 246 bp, Glycine max
  Peptide Sequence Number=SeqID_185013
gctggtaaaacactaagtgcaagaaaatggcatgctgcatttactccagaagggtatctagatataggcaagactctaagccgaatctaccgtggggatatggaatttagtctgtctactatccattatggtgtagtcagtgcaacagggaacacttgcttgctagaaaaacctaaggagcatgagattccattaccatggctgagattgaagaatgtgcagacaacaagtattagaattaattaa

SEQ ID NO: 68236 - DNA, 192 bp, Glycine max
  Peptide Sequence Number=SeqID_185014
atgaacacattcaagaactcaaaagaaaaatggaagaacgagttgaaatcttcaattcttgatctcgatctccttccaaggcttctaagagaagaggaggttgtcaccaacaatatgcactccttgctcctcgatatgcatgaaacgctccaaaccaacatttttcgagtcagccagggttgccacttttga

SEQ ID NO: 68237 - DNA, 306 bp, Glycine max
  Peptide Sequence Number=SeqID_185015
atgtcgatctccccctgtgaaagtatcagttggtcagtgccgtcccgacatagggatcgttccagcaagacacccagtggacccagagaagtccaacagggccctggggtttccagctctggttatgggcctctggatcgcgcccgcaagacacccagtggacccggacaagtccaacagggtcttggggtttccagctctgattacgggcctttatcagttctacggagtgcctgtcgcccccagcaaggcaggcacagggcaaggcaccacagcagcctgcggatggccggcagcgggcaatag

SEQ ID NO: 68238 - DNA, 540 bp, Glycine max
  Peptide Sequence Number=SeqID_185016
gttcatgagaacactaaggccttctttagtagctctagctcaatcctcttagatcctcttgctcatggctctggtaactggtcccttcctagggaggattgcatcaattccattgtgacaggctcaatcttaactgtttcacaagcgagaagtcatgtgtctaatgataattctctgtggcacatgtgtcttagtcaaatgagtgaaatggtaatggaaattcgaagtatgcaaaggctacttggaaaccacaagatggatcctcttcagttttatgagcattgtatctatgggaagcaacataggatgaaactttcaaagaaggctgttgcttctggaggaagcaaccctgctcgcctgggcgagctaggcagcaagcatctcccctattttgctataaataggggaggaagtgagaaggaaaaggccgaggcgcttccgaaacgtttccgtaacgttttccgtgaagaatttcgcaaaggtttcgaccgttcttcgacgttcttcattcgttcttcatcgttcttcgatcttcaacgg

SEQ ID NO: 68239 - DNA, 189 bp, Glycine max
  Peptide Sequence Number=SeqID_185017
atggaacgagaagagaaaagggaattgtatcggatacattgttcttccgaggaaaacaacgtaggagatgatatggaggaaggaatttgtgttgtctgtgctttggatgctccgtggcttcaagtttcggtgactgaggaggaagtcgaaacaccctttcgcttcttcgatggcaaagacactctgtaa

SEQ ID NO: 68240 - DNA, 588 bp, Glycine max
  Peptide Sequence Number=SeqID_185018
atggcacatttgcaagaaatagatcgagtcaagaatgaagttatacgtttagagcgcgaatctgtcattcccattctgaagcctaggctcataatgacactggccaatcttattgaacatagttctgaccgggctgagttcttgaagctctccaagagaatagagtacacaattcgagcttggtaccttctacagtttgaggacttgatgcaactttactccctctttgatcctgtacacggggcacaaaagttggaacagcagaagttatcttccgaagaaattgatgtgcttgaacagaatttcttgacatacctatttcaggtcatggaaaagagcaacttcaagatagtgacggatgatgagattgatgttgcacattcaggccagtatcttctaaatcttcccataacggttgatgaatctaagcttgacaagatacttctgaagaaatattttgaagagcatcatcatgatgaccttcctgatttttctgataaggccaatttggcccggccaaatgggccaggctgggccacaaaagcatggcctatgagatattcaggccaggctgttttcaccatttga

SEQ ID NO: 68241 - DNA, 267 bp, Glycine max
  Peptide Sequence Number=SeqID_185019
atgacgaatgactatatatatttacacctttgggcagattttgacagagaagtgacttgcacttttggaatttctctgaagaatgatgacaattgtttcgtccctatgccattaaataactttggatcttctagaggtcccatacagtcaaacgttatgaaaactgctagcaggggaggtgaaaggaggaacataggatttgtagtaacaggaacagctcatgtgtttgccactgtgatgagattgcaagtggcattaaacaactga

SEQ ID NO: 68242 - DNA, 204 bp, Glycine max
  Peptide Sequence Number=SeqID_185020
atgcagagtttgtgtggaaaccatggtgactgccggacagatctcgccggcgagggggtgttgccggaaaatggaggtccggcggtgagagtcagtgagagagagagtgaaggaaagagatgtgagagtggcaaagcagcgaaatacgttgaaaagttatgtctcatttggagcgaaaacggtaacgtttgtctctctctatga

SEQ ID NO: 68243 - DNA, 3047 bp, Glycine max
  Peptide Sequence Number=SeqID_185021
atggatcttctttttcttcattccctcttcttcttcttcttcttcttcacttcaaatgacgcaaatgccctcgatgccactattcctcgcgacgcattgtcccttctcagcttcaaacgcttcgtctcttccgacccttccaacctcctcgccgcctggtccaaccgcacttccccgaatctctgccgctggcgcgccgtcgcgtgcggcgtcgccggcagagtcaccgtcctcaacgtgaccggcctccgcggcggcgagctatcgccctccgtcggcgacatgtccgagctccgcgtcctgtccctcgccggaaacatgttctccggtgagattccggtgaccttggtgaatctccagtttctcgaggttcttgagcttcaaggtaacaacttttcagggaaaatccccacccagatgagttttacttttcttcaagttgttaacctctccggtaatgccttctccggttcgataccgagtgaaattattggctctgggaatgtaaaaatcgttgatttatccaataatcagttttctggtgtgattcctgtgaatggtagttgtgattccttaaagcatttgaggttgtcgcttaactttttgactggggagattccaccccaaattggggaatgtagaaacttgaggacccttttggttgatgggaatatcttggagggtagaatcccttctgagattggccatattgttgaacttagagttctagatgtttctagaaactccctcactggaagggtccccaaggagttggctaattgtgttaaactgtctgtgcttgtgctcactgatttgttcgaggatcgcgacgagggaggcttggaggatgggtttagaggagagtttaatgcctttgttgggaacatacctcaccaagtgttgctgctttcgagtctgagggttttgtgggcgccaagggccaaccttggtggacggttgcctagtggctggtcggatttgtgctctctgagggtgctcaatttggcgcagaattatgttgccggtgttgttccagagagtttggggatgtgtaggaatttaagtttcttggacttgagttctaacattttggtggggtatctgccttcattgcagcttcgggttccttgtatgatgtacttcaatatcagcaggaataatatatctggcactcttcaagggtttaggaatgaaagctgtggtgcaagtgcactggatgcttcattcctagagttgaatggttttaatgtctggaggtttcaaaagaatgctctcattggatctggttttgaagagaccaacactgttgttgttagccatgatttcagttggaacagtttcagtggatccttacctttgttttctcttggagataatctgtctggtgcaaatcgtaatgtctcctacactctgtctctcaataataacaagttcaatggaactctactgtatcagttagtttcaaactgtaatgacctcaagacattgtcagttaacttgagtctgaaccaactatccagtgggaatttccaggcatcattttgggggtgccggaagttgatagattttgaagccgcatacaaccagattgatgggtcaattggacctggtataggagacttgatgatgcttcagcgtcttgatttaagtgggaacaaactatctggatcactgcctagtcagttgggaaacctacaaaacatgaaatggatgcttttgggaggaaacaatctaaccggggaaattccttcccaacttggcctgttgacttcccttgctgttttaaatctgtctcgcaatgctctagttggaacaattcctgtgagtttgtcaaatgccaaaaatcttgaaacactgttgctagatcacaacaacctttccggggaaataccattaactttttctactcttgccaatcttgctcaactggatgtttcttttaacaatctttctggtcatattcctcatcttcaacacccaagtgtttgtgattcctataaaggaaatgcacacctgcactcttgccctgatccatattctgactcacctgcttctcttccattcccccttgaaatccagcgtacgcataaacggtggaaattaaggacaatggttattgctgtggtcacgtctgcttctgtgactctctgcacacttctggtaatagtattggtgatcttttctcgaaggagtaaatttggtcgtcttagcagtattagaaggcgacaggtagtgacctttcaagatgttccaactgaattgaattatgacactgtagtcacagctactggaaatttcagcatccggtatctaattggcacaggtggctttgggtcaacgtacaaggcagagctgtccccaggttttcttgttgccataaagaggttgtccataggtagatttcagggcattcaacagtttgaaacagaaataaggacattaggcagaattcgacacaaaaatcttgtgactcttgttggctattacgtaggaaaggctgaaatgttcttaatttacaactacctttctggtgggaaccttgaagccttcatacatgacaggtcagggaaaaatgtgcagtggccagttatttacaaaatagcaaaagacatagcagaggcccttgcttaccttcattactcttgtgttcctcgcattgttcaccgggatatcaaacctagcaacatcttacttgatgaagatcttaatgcctacctgtcagattttggcttggcgcgactacttgaagtatccgaaacgcatgccaccactgatgtggctggcacatttggttatgttgcaccggaatatgccaccacttgcagggtttctgacaaagcagatgtctacagctttggtgtagtgttattagaattgatgtctggaagaaagtcacttgatccatctttttctgagtatggaaatggattcaatattgtaccatgggcagagctgctaatgacagaaaggcgttgttccgagctatttgtatctactttgtgggaagcagggcctaaggaaaaattgttggggcttttaaagctcgc

SEQ ID NO: 68244 - DNA, 273 bp, Glycine max
  Peptide Sequence Number=SeqID_185022
atgtcgctgcatgttctctatctttatgcgttttctagatttcccccccggggatttccggggcaggatcaccttgggctaccttctggagtggagacaaaacatgaacggcagaaaccaatcaaggtacttaaggatgaacgcaagcggggatggggtcacgaccgaccgatcgttgcccttctctgtgcgaaacaagcagggaatgtcgccccaaggcagccccgtatcctttctattttgcagctttcttttactatttgtttgttttaa

SEQ ID NO: 68245 - DNA, 653 bp, Glycine max
  Peptide Sequence Number=SeqID_185023
agaagtacaaggattgtttgctgtactctggccctctatgtatggttggtttcacaccttttccgccaagagagaagaaagaggcaagttgggaccgactcttagcaagcaaagaaggagtgtctgtcaattggttccctcgatggaaagaaggaagaaccggggttctgatttcgtgcggaggatttccaaatgttcccttgatggggacaaggggttgcatcagttacaatctcgttcttgctataagacaacttggctaccctatgagaggggcaccattagaggaagagctcgcacctattattacacgaggtttcaataacaccaacgcggaggcacttcagaaggtccacaaggcatgggagatggtgcaaaagaaggacaaggaactcagaggcagtaacaacgggcccatcggcggctacctgccggaggaggacgaagaggtgcaggccctcagggcagaactcgagaaagccctaacaataaaagaaaagttcaaatcagcaactcttaagattcgaaaggagaatgccgaactgagagatgtaaatatagccaccaccaaggccttggaacaagaggccaaaagggcccgtagggaagaacatggcccggaacaaattccgaggggctctgtggggcagtaa

SEQ ID NO: 68246 - DNA, 231 bp, Glycine max
  Peptide Sequence Number=SeqID_185024
atggcattcttgggagagacaagcagtcagacagttgtgaactccacattaggttttatttttccaaatggatccattgttcacaacgacagtggtgtttccttccaagcttccactccagttcccattcgagtacctaacgggtgtgattttcaaacgttaaaaaccagaatacacaatacccttaagctaaccgacaagcaatttttggatgaaatttactactggtag

SEQ ID NO: 68247 - DNA, 203 bp, Glycine max
  Peptide Sequence Number=SeqID_185025
ggcgagccctggtgcagcgataaagttgtgccttgatggtaatacgtctgacctatctgctgaaaaactgacatccaactcgcctctgaagagtgattctagaatgcaagctaacatccaatctgaaaatgcacaagttgaagttgaaagtgctgctcttcacatccatcttccttcaaatttcaatccattccttcctaatg

SEQ ID NO: 68248 - DNA, 897 bp, Glycine max
  Peptide Sequence Number=SeqID_185026
atgcaaaatccttccgcccctgtggttgaaacgcgccagggcgcactgactggtttaaccgatgaaaatgtccaccgctggtgcggtattccctatgctgcaccgccagtgggtgactggcgctggcgctcaccgcgtccaccagaacgctgggatggcgttcgcgatgccactgcattttcggcctcaagctggcaaagcagcgaatattgtcaggagctgggcgggggcgatcccggccagttctctgaagactgtctctatttgaatgtctggtcccccgtcgaccgcccgggatcgcttccggtgatggtctggctgcacgggggcgggtttacgattggtgccggtggcttgccaccgtatcacggcaaatcgctggccgcgcgcggcgtggttgttgtcacgattaactaccgtctcggccatctcggctttttcgcccatcccgcgctggaaggcgaggaagggcgcgtggtgcataattttgcactgctggatcagatcgccgcgctcgaatgggtgcgggataacatcgccgggtttggcggggatcccacgaatgtgaccctgtttggcgaatccgctggcgcacgcagcgtgctctcgctgctggcctctccgctggcagcaggattattccacaaggcgatcgtgcaaagcggatacaccttaccggacacgccgcgcgagcaggcgctgcaaaaaggggaagcgctgaccgcccatttcgggctggaaaatgcgaccgccgggcagctgcgcgccattccgcccgaggcgttctggccgctcaccgcgccgctgaacgtcgccccggcgcctatcgctggagactgtgttctgccggaagccatgctggacgtctttttcgccgcccgtcagcatccggtgccg

SEQ ID NO: 68249 - DNA, 888 bp, Glycine max
  Peptide Sequence Number=SeqID_185027
gcggttgagatggaagaactatctctggccacaaaaaatttcagtgacaagaatttgattggagaagggaaatttggagaggtatacaagggtttactgcaagatgggatgcttgtagctatcaaaaagcgccgtggacttgctagtcaagaatttgttgatgaggagaacaatctgcagtttcttatatacgaatatgtgcctaatggaagcgtctccagtcacttgtatggcgctggtcaacaaccgcgagagaagctagaattcaagcatagacttccaatagctcaaggtgcagctaaaggtttggctcatcttcactctttgagtccccgtttggtgcataagaatttcaaaacagctaatgttcttgtggatgaaaacttcattgctaaggtggcagatgctggacttcgcaattttttggggagagttgacattgcaggctcctcttctcaagtggcaacagatgaaatattccttgcatcagaggtgagagagttcagacgattttctgaaaagagcgatgtatacagctttggggtgtttttgctggagttgttaagtgggaaacaagcaacagaatcaccatttccggactctaatcaaaatctggttgaatgggtgctaagtaatcaagaccgtggcatgatgtcttacatcattgatagaagattggagagtagttttacagctgagggaatggaagagtacatcatgctcataattagatgcttagatccttcaagtgagaggcgacctgccatgagctatgtggaaatggaacttgttcggatcctagacaaggaaatgaacttgacaacaatcatgggagaaggaacccctactgtgactcttggaagtcaattattcaaatcaacaaaataa

SEQ ID NO: 68250 - DNA, 1125 bp, Glycine max
  Peptide Sequence Number=SeqID_185028
atgctggaatgcgtttctttcaaatcatcgactccaacctccatctcttctccgcttcctcctccttctgaagaatattcgctttgtttcccagggaactcaaccgaggaacttgaagaaggagaaggcacttccgccacaagccctaacgtctcacgcgagttccaccgggccgtggaggcccactcctacaacgagatccggtccatggtccaagccccaccgcaggttcaccacatcgacgacgaagactcgcaccaccgccacgtcctctcccaggtcctccaacccgactcacacagcgtccgcgaagccctcgccaaagcgaaacctaagagcaatctcactcgcctcgtctccacctacttcgaccacagcgaaaccgcctccgacttctgcctccgcctcagccgcagcgttcaccgcgcccgctatctctacgcaccgctctctgacctcctctccgtcctccccgccgacgcgcctctgccgtcgctctcgcaaccgcaatgcaaccacgcctacgacctcttcctccaattcgaccgcgaggagaatcctttcgcgctcttccgcctccaccgcctccgcgacagcttctccgacctcaagcgcgatatccagcgcgacctccgcaagtgccactcgcgaatccgcctcttccgccacggcgccgcgggctgcgccctctgcttcgtcgccgccgctgccggcaccgtccttgtcgcctccatcgtcgccgtgcatgctgtagtagggtttagcgccctctccgcggcaccgttttgcgtccctcggcagaagaagagggagcttgcgaggctgaagcagcttgaggttgtggagaatggaactcatgtggtgaatgatattaacaccattgatagtctcgttgatcggcttcaaactgcggtggaaggagataaggcttttgttagatttgctttggagaggggaagggagagacatccgattcaggaagtgcttaagcaacttagaaagaaccaacctgttttggaacatttgcttggggatcttgagcaacatatatgcttctgcttttatagtgttaacaaggcgagatatgcgctcctcaaagagatatgcagtcatcaaacttcttag

SEQ ID NO: 68251 - DNA, 369 bp, Glycine max
  Peptide Sequence Number=SeqID_185029
atggatgcagggttccaattttttgaccaagaaggggctgtgcaagagaggaggggaggagaagaagagtattgcaacccaaaagggaagaaggaaggagaaggaggtatcctaagggagcaagggggtccgcctgaagggggaggtgatcgattctggtttgagaaatatttgggaaaatattttaagggtaatgtaggaaaaacaatcataaaattgggtaagggaggtgaggcgtgtaacacagaatggcaaaaggccattggttggtttactaagtgcaacccctacggcctcgactgctacaattctgaacggttcttgacttcttgtaatcatcatggtaatcatcatcaccccatcatataa

SEQ ID NO: 68252 - DNA, 939 bp, Glycine max
  Peptide Sequence Number=SeqID_185030
atgggttttgaagatctgctcttcaaaggtgttgtgcctcaacaaaggcagcagaaaccaaaagattcagaggttcaggtttacttcaaatcaatggctgtttcatatgttcacatgcttcaatgcaacaggggtttccacaagggtaacctctcctatcctaattgcagttacaaggcgaggaggagccaccgtttagtttttgcttctatgcacacaccagaacctaaggtagactcattactggacagtgtaaaatgggataccaaaggtttggttgtggcaatagctcagaatgttgacacaggggccatattaatgcaaggttttgccaacagagaagcaatagctacaactatatcttctcgaaaggccacattctatagccgatcacgatctacattgtggaccaaaggagaaacctctaataattttatcaatgttcacgatgtctttattgattgtgatcgtgattctataatatacctgggaaaacctgatgggcctacctgccacacaggggcagaaacatgctattatacatcagtttttgacttgttaaagcagcaagaggctgaggaaaataaattggcattaacctctttgtatgcattagagtcaacaatctcgcaacggaaaacagagttaataggagaaaatgaaaagccttcatggacaaagcgattattgcttaatgataagttgctatgctctaaaatcagagaagaggcaaacgagttgtgtcaaactctagagaacaatgaggacgagaaacgtactgcttcagagatggctgatgtactctatcatgccatggttctgttggcaaagaaaggtgtcaaaatagaagatgttttgcaggttcttcgtctgagattttcccaatctggtattgaggagaagaaaagtcgtgtatcccagaaatcagtggatgattga

SEQ ID NO: 68253 - DNA, 561 bp, Glycine max
  Peptide Sequence Number=SeqID_185031
atggaagctgctacatttcctcaccaacttcaggtgaagccattccactttttcaagatcataaccgctcaaaatctgcaggatggaaaactaatgatcccaaataagtttgtggagaaatatggagaaggcttaccaaatgctctatttcttaagactccaaatggtactgagtggaacttcaatctggaaaagcatgatggtaaaatatggtttcaaaagggttggaaagaatttgcagagtatcactctctagctcatggccatcttttggttttcagacgccatggaacttcccattttcaggtacacatctttgatctgagttccttagagatagattacccttctaaaggtacagaaggtaaaacgtcccccaatcatgaaggaaataaacaacctcgaaatgaagaaaatttggaatatcttcaaccatatcaagtgagaagtcataaaagtgttaaagttgagaacatgatgacattgccagaggaggctcagccacataccgacacaaagttcaaaggtataagatgtcaagtgtcttcaagcatttcataa

SEQ ID NO: 68254 - DNA, 1008 bp, Glycine max
  Peptide Sequence Number=SeqID_185032
atgtctctatggaattcaccttcttcaacatctcgagttcagagtcctcaaaatacccctataattcctgctagctgctctccaaaactcgtgaaacgaatgcaacaagaaacctgttacaaatgtgatcaacgaggacattggtcttattactgtccttacaaatcccccaaaactaaacccatctcaccctcacccaagcaagattccacagtttcctacaaaagggctcatggatcttgtgggtacggtgtgactgaggatgaattgctcaatggcaatagcaacagcattgctcgtttaaagcaaagcaggcaaagaactctacatgatttttgggatggatgccaaagccaaaatgatggttcgcaagaacagatcaaaaggatgagaatcacagactgttctgagaatccaaacattgaaggtgctagtgcaacacaaaatgctgccaatgtgaaacgtgatggtttttcagaattggagtctgctgcggatgatatagaattcatgaactcagtctcatgggaaactattgaggcagaagcaattctatcattatctcgtcgatcaacaccttcaaggatcccttcaaggatccgttggcgacaaattatgtttcagaagcgcattttctctgatgattcatttgaaatagacaagtccaaggaaaattcccttactatggatgagcagaataatctctttgaggagaacaaaatgagatttgctcaactccaagacgagtatgtcaagaccgaagcttcacttgaagcatcaaaccagcataagcaattgctttgtgaacaggtctctgatctcaagaccatgcttgatgaaaaacaaaatcaattaaaatgttgtgagttggagaccttgaagatagagactcgtcttggtgatctgaaaagaagaatgttggagacccattttacattgaaggaaagagttgaacaaacagaagaggcaaggaaacaaagtgaagaaagacaagcaaagctgcagtga

SEQ ID NO: 68255 - DNA, 1497 bp, Glycine max
  Peptide Sequence Number=SeqID_185033
atggggatgaagaaggcgacgatggatcacgtgctgctagcgtcgcaggagacgaaggaaacacgtgaggtgcggattcggagcctcttcgatttcttcgacagagagaatctcgggttcttggactactcccacattgaagcgggtctctcggcgcttcagattccgtcagagtataagtacgccaaagatttgttgaacgcttgcgatgccaacaaggatgggagagtggatttccaggagttcaggaagtatatggacgacaaggaacttgagctttatcgcatttttcaggccattgatgttgcgcataatgggtgcattttgcccgaggagctttgggaggcgcttgtgagagcaggcatgatagtgaattacaaatttaataaaaggaaagcagatttcaaccgggcacacggaattaagattgatgatgaagaactcgcccgttttgttgagcgtgttgataaggataataatggtgttataacatttgaagaatggagggattttctgctgctttaccctcatgaggcaaccattgagaacatttaccattatttggagcggatatgtgtggttgatataggggaacagactgttattccagcaggaggagtagcaggtgcagcgtcacgcacagcaactgcaccccttgaccggctaaaggtggtattgcaaatccaaacaacacaatctcatataatgcctgcaattaaagatatttggaaaaagggtggtttgttaggattttttcgaggcaatggcttaaatgttcttaaggtggcccctgagagtgccattagattttatagctatgagatgctgaagagcttcattacgagagccaaaggggatgaggcaaaggctgctaatattggagctatggggcggctgctagctggtggtattgctggcgctgtagctcaaactgcaatatatcccatggatcttgttaaaacaagactacaaacccatgcttgtaaaagtggaagaattcctagtcttggaaccctttcaaaagatatatgggttcaggaaggaccccgggcattttataggggattgattccttctcttcttgggattatcccttatgccggcatagatcttgctgcatatgaaaccttgaaggatatgtccaagcagtatattcttcatgatggagaacctggtcctctagtacaattaggatgtggaactgtatctggaactcttggagcaacatgtgtttacccgctgcaggtggttagaacaagtaacttaaacggtttcagctttctatggaaattagaaaatgaaagacatgttgatttcagaatgcaggctcaacgctcatataagggaatggctgatgtattcaggaaaacccttgaacatgaaggtttgagggggttctacaaaggaatatttcctaacttactcaaagttgtaccgtcagcaagcatcacctacatggtttatgagtctatgaaaaaaagtttggatttggagtga

SEQ ID NO: 68256 - DNA, 417 bp, Glycine max
  Peptide Sequence Number=SeqID_185034
atggatatctctaaagaagagtttggtgatggtcgtttaagtagaggtgtggaaatgtctttcagtgttgtggataaggtaggatttgatggaagtggtgaaaaagatgaggacgttattggtggtatggaggatctttattactggtatggtggaacaaatgaattttctgtgcgtgaaagcaaggtgcttagaaacagaaaaggtgaaaaaatgtcgcaaacctttctttgctctagaggaggagttagagattataggggtttgactattgaaaaccaaaagtgggaacaaaaaaatgagactagatgtgagtgcaaggcaaagtttcgagttcatattgattacttcgccaggagatggtatgtgtctaaatggaccgatgatcacagtcgtgaattgttggatgaatcatga

SEQ ID NO: 68257 - DNA, 1191 bp, Glycine max
  Peptide Sequence Number=SeqID_185035
atggatcatgcgatgaaagagtgcgaaacagaggcgaacacgcctctgccaccacccctctcatccacactctgttctcaactcacacaaaaccaaaacactcaagaaacttatccccgttactctcaacaagacttgaatgcaagaaagaaaaacggcacgtgcttgaggtgcaagcagcagggtcactggtactgggaatgtcccctcatcaaatcctcaacaacgattcccaatactccaagaacatatggtgtcgctgtggccatagccgttgcgaaagagaacctcaaagagtcagaaaaacccccgcagggaggtgaaagatgtaataacggttttgttaaatggtgcgatgatcgcgatgttgagagtgtttttttgcagcctccgccgtttaagtatcctgagtgtcagtgtggtgctggaggccaaggatcttgcggttacaaggtgtgggaggatgagctgctacataataataaaagccttgtgcagcaaagcttaagcagtaaaataactcttaatggttttggggaaggtgaccaaaatgatcaagatttggatgaggatggtaagttgctagtaaatcattccaaaaagatgagaatcatgggcaattctgaggatccaacatcgatggttgtatccgacgctgagctttcacagagtgaagatgaagtactagagaagaaagcatcgccattatcttgcctatcagaatcaacactttcaactatcggtggtcaacagcatgtgtttccaaggcacatttttgctgatgttggtgctgatccatcatttggctcttgtccattgggttggttaggtggccaattcagtctatcacaaaacttgaaatcaccttcacctcagtcaattttctgttgtggtttcccatcctttaatcccatagatgtcccaaaacaatcaagtattactaatgttccttgtggtgaacatagccagcttgatgttattggtctcagtcaacaaacccaactttcaagcagtgaaagaaaattaatgtcaaggacacaaaggcaaagacaaatggcctttgctgtagaacagcagctcctaattgatctagcaaccttggagcctcacgagcatgagtccatgaaagaggcagcacaagacacttttgctatatcagacaacttgggtgcaaatgacacaattttctga

SEQ ID NO: 68258 - DNA, 456 bp, Glycine max
  Peptide Sequence Number=SeqID_185036
atgatgatgataatgttgacgatagagataccaacgatggttatagtgacaatcaatagtggtgttagtgacagagatggtattagtgatgattgtggtgacaatgataaaggtgatattaatggttgtaacaatatcgatggtgttggttgcaatggtggtggggtggtggtggtggttgcggcaacattgatggtgattgtggtggcgaaggtgatattgttgatgggggtgacaatgacagtgacgatgacattgatggtggtagcgctgccaatagtaatgatattggtgacaatgatgattgtggtagtaacaatggtgacactaattatggtagtagtggtgataatagtaacaatgttgatagtgatagtgatatcggtaatgatggtggtgatgctagtgatactagttatgacagtgacaatgatggtaatgatgatggtgatgtag

SEQ ID NO: 68259 - DNA, 419 bp, Glycine max
  Peptide Sequence Number=SeqID_185037
atggccccgaggaagcttgcctcaaagaggtccaggaaggataaggcggccgaagggactagttccgctcctgagtatgacagtcaccgctttaggagcgctgtacaccagcagcgcttcgaggccatcaagggatggtcgtttctccgggagcgacgtgtccagctcagggatgacgagtatactgatttccaggaggagatagggcgccggcggtggacatcactggttacccccatggccaagggtcagtggatcccgtttgatgccgacactatcggccagctcctgggatatccgttggtgttggaagagggccaggagtgcgagtatggccagaggaggaaccgggaggcgagtgcggatcatgcgcaccaacatgatcaccctgacccagatatggatgacgttgctgctca

SEQ ID NO: 68260 - DNA, 749 bp, Glycine max
  Peptide Sequence Number=SeqID_185038
ttgatgctactgagtttagacaggtggttggggcactgagatatctctgcaacaccagacctgatattgctttcagtgtaggtatgattagcagagttatggacagacctagaacatctcaccttgctgctgcaaaacgaattctaagatatgtcaaagacactatggcatatggaattcttctacctagtaaatgcagagaaaatgagaaaggtctctatggtttcattgatgcagattggggtggtgataaaactgatagaaagagcactgctggctctgtatttctacttggatcaggtcccatttcctggagttcaaagaaggaatctgttgtggcattgtcctcatgtgaagctgagtatattgcagcttcaatgggagcttgtcaggccatttggttggataatttgatgcaggaactaatgataaaaaaggaaagtgttgtggagctatttgtggacaacaaatctgcaattagcttggccaaacatccagtagcacatggcagatccaaacacatagagactcgttatcatttcttgagagatcaagtcaccaaagggagattgaagctgagctattgcagaactgatatgcaggtagcagatatcttcaccaaggcagtgaagagagaaacttttaagaagctgaggaacattctgaatgttgttgacttgaagcactcaagctccaacatatggtatccagagcaagttgttgaagctttgagagtgaatccagtgtga

SEQ ID NO: 68261 - DNA, 360 bp, Glycine max
  Peptide Sequence Number=SeqID_185039
atggaagaaccatcgaaaaagcggaaaggcacttcgagtcggagtcaacggcattccggggcacaggaaacctcaatgccttcctccattccctctggatcattgttctcatcaaaggaacaacgtatacgcgaaggtgtaccatttgaaggtgcactgattgacgattggaagtttgatttctctatacatgatgaccgccgattggtttgtaccaatcaagcggatatgaccggaagacttcttgccggttcattggcttttgaaagccgcatcctccattaccttattgttcacatcttgcttcctagatcttcaaaccttgcccaagtttctgaagaagatctcattgtcatgtag

SEQ ID NO: 68262 - DNA, 189 bp, Glycine max
  Peptide Sequence Number=SeqID_185040
tcagaccccatcccatccaggccttctttgttggggacgctggaggattttcaaaagttcccacacgtgaaccactgcatgcagtgaacgtgggtggtctagtgcccccacattgttccttaaaatcggttgtctcggatgacgcttgccctggcgcttgctttgttcaacgcgatgctactactctta

SEQ ID NO: 68263 - DNA, 360 bp, Glycine max
  Peptide Sequence Number=SeqID_185041
atggaggccatgaaagagcaaatggccacaatgatggaggtcatgataagcatgaagaagataatggaagccaatgcggttgcagttgccgctaccagcgctattgctaaggtgaacccgatgcccccatctggcctcaaccaaatgaatcatccaacctcagctagggtaggcaaatatttgggaagtacgggcggcccccattatgcgcaaattcaaaacaagcatgccatcccgccatatggcttgcttcccaactatacaccacccaatgtggcatacattcctgatgaggatgtgaataactctgctcccatactcattgagagccgacaacctaattatgcacatgtctcttaa

SEQ ID NO: 68264 - DNA, 261 bp, Glycine max
  Peptide Sequence Number=SeqID_185042
atgaaccagattcaaccaaccacgaggcgggtgctcgcgggaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 68265 - DNA, 225 bp, Glycine max
  Peptide Sequence Number=SeqID_185043
atgacgttgattgttgagacaactagaggaaatgggagaaaaagacattatagaggagttaggcagagaccgtggggcaaatgggctgccgaaatccgcgaccctaaaaaggctgctagagtgtggcttggcacgtttgacacggcagaggctgctgctgctgcttatgatgctgctgctttgaagttcaaaggctccaaagccaagctcaatttccctgaacat

SEQ ID NO: 68266 - DNA, 357 bp, Glycine max
  Peptide Sequence Number=SeqID_185044
atggcttcctttcgcgaattggagcagaacatggtgtgcaaaggttggagctttgttggagcttcaatggtgaagaagaagaaaggaaaaagcaactccctcgcgtttctctgcacccgtcggggccagttttcgaaagtaggcaatatatatatcaaaacgctcagaatgaaaccccgagcgtggttcagaggatgtcacagtctctatgacgtgttgggcttgtttaagtctgcctctggtcatgggcccttcaagtgcttcatggtccttgcccttggttatgttcttatcagattcaacaagttgtgttcttcctgtcctcaccatcaaatcaatgagcaattgttgatctag

SEQ ID NO: 68267 - DNA, 525 bp, Glycine max
  Peptide Sequence Number=SeqID_185045
atggttggagcattcatgcaaaacagagtgaccttgactggtcttcctatgatttcacttagtgagccaacatatgatgagttccatgccagagatggaattcagccacctggtgggagttctcaaccaactaatagggtgtcacaggttgctggtagagatggtggtggtggtggtactcctgttgcacttgctatgccatcccaatgtgctaagtgtggtaagattggttattttgctcgtgggtgcccaaatagtgacgtgaattgtttcaattgccgaggtgtgatgcattcagttatttctcgcgtccgtgttgaaaaacttgctttgcctgtgtcttctttgagattttacttaattgtagatacacctgctagtatgagtgttgtgaccaaaacccccatgagcgatatacctttggtgagggagtttttcggggtgtttgaggaggtgtctggattaccacctgagagagaggttgagttttccatagacctatgtagaagcaaagcttcatggtga

SEQ ID NO: 68268 - DNA, 225 bp, Glycine max
  Peptide Sequence Number=SeqID_185046
atggctcccgttgtgtgtgctgttgctattgctgctgttgtggaccgggaccatacctcaagttcgaatgatctctccaaccatgattataggtgttggagtaaggattatattgctgttgttgaggagcacaacatataccatacaaccttggctgattggctgccatcacattcaattgttaaccaatggttagctgcctcacaagggatgtcaacgctgtaa

SEQ ID NO: 68269 - DNA, 237 bp, Glycine max
  Peptide Sequence Number=SeqID_185047
atggttccccgcatgtcatcgggcccgccgcctctggatgacaaaggtaaaaaagtgcgggaccaaatggttccccgcatgtcattgggcccgccgcctctggatgacaaaaggacgcagaatgaccataatttgtctctgcgtgccatcggacacgactatgtttggatggcaaaaggtgattggaatgaccataatttgtctctgtgtgtcatcgggttcgccgcctctagatga

SEQ ID NO: 68270 - DNA, 264 bp, Glycine max
  misc_feature (80)..(80): n is a, c, g, or t
  Peptide Sequence Number=SeqID_185048
ccgactaatcgagctttcatcaagaagtacttcgccctcaggcaggcgcacggcgatacaccacagcagtctggggatgnacggcagcaggcaacagacgcaccgccaccacctctagagttcaccttagctcatccacaaaaaggtagcaagataccttggacacgcatgtatatagcaaaatacctcacaaaaatacacatatgtttaggtagcaaaatacctcatggaaaaagaaaaagagagaaaaaagaaaaaaaataa

SEQ ID NO: 68271 - DNA, 1567 bp, Glycine max
  Peptide Sequence Number=SeqID_185049
atgatgcggtggcaagtcttggccatactgggattcgcgtggccctggatggtcgcgcaagctgaagagattacagacacgcgtgcacggcagcgcctggaaaaaactgaagggcgggcattggagacctatagccggcaaccaggggtgcctttgcatgatgcggttaagcaacagcaaaaccgcaaacctgcagtcactgtggatttgaaaagtgccttgaaaccgtttgatagcccggaaagtgacagcatactgccccaagtttccggtacgcaaatgaccattgcggatattcgccagcgggccctgcaaaataatttgcaactgaaggtggcaaagatggatcctgagcttgccaaacaatcattgcgtgaagagcaggccaagtttgaccaggtgatctttgcctatgccaaatatgcagaaaaagacacacccgccatgtcgggtgataaggtagtgatcaaatcggacaatccgctactcgatggtgaattggccaagttgaatctagatgcccagaaaaaggagttttgggatattgaggccggcgtaaaagtgccattgcgtactggtggcacggtgacgctgagtgcgccgctagagaaccggcagagcctgggtaaatttgccagtgaccagtaccgtagcgctttgcgtttttcattcagccagcctttactgcgtaatgcagggcagcaggtgaatgaagctagtatccgtgttgcagaactcgaccgtgacagcgtacaactgaaaaccaggttgcaggccataaggattgttgcgacggtggacaaagcttattgggagctctacgaggcttgggctgcactagacgttcggaaaaaccagtttgaatatgccagccaaaacctagagatggtgaaacgccgtgtgcaggaaggcttaacggctgctgtggaagtgaatcgtgcgcaaattggggtggctgaccgtatggaggcactgattgtcgctgaaaccaatctcaagctggcgcagcggcaattacaatttttgctgaatgatttgcctgatgaccaggagaggcagtctccctgggtacccacaacggtacccagcctggtcaagtttgaatttgaccgcgcgcacttgatccgcgatgcactcgatagccgtatcgaattgcttgaacaagaactcaagctaagtgctgacctgatccagattgattatctgcaaaaccagaccctgcctttgtttacactggattatcaatatggtgcgttgtctggatctggtggtcgctttggcgatatcgggcaagatttgtttgatggccgttaccgtgactggtcggtcggtttaaagtttgagatgccggtcagcaatgaggcgcgtaaagccaaactggatcgcgcgattgcccagcgtatgcagcgattgaccactaaaacgctgcaaagcctgaccgtcaaacgcgaaattcatgatgccctggataaggtggagcaaaactggcaacgcattattgcagcccgtcagcaggtgctggtggcgggcattaactacgaggctgagctcaagcagtttaatgaag

SEQ ID NO: 68272 - DNA, 267 bp, Glycine max
  Peptide Sequence Number=SeqID_185050
atgtataatagtataataacctatattggtctccactgcagtgcacattggcaaatggtcatcattttgcctaaggaaaatgttgtcatttggttttgttcgttgcataataggccagacaactacctcaaaggcataattaatagtgctttgaaaggacttgacgatactcaacaaagtaaatccaagcctcttactaggtggattgttgttaaatataatagacaaaaaggaagcactgagtgtggatattacgtcatgtactag

SEQ ID NO: 68273 - DNA, 492 bp, Glycine max
  Peptide Sequence Number=SeqID_185051
atggagcataatggggacaaagaaaacttccttctctggaatacaacatgtatcaagctgtttggtaagactgctggagaatgtcgagatgagttgatagcggctggggatgatattaaggtgtttccaatgtgtgttgatgaaatcttgtccaaaacttgggctgtcagatttaagttccgttcacaattacgccaatcatatgtgttggatgtgagtgaagaactccatcatattcaatcattgatagccacccttgggttgaaggaacaatcaagtaagggaaaaggaatagctgttgagacagaaagttcaccaccaatttttgttcccacgccatcgttgtcacagtcttctgattacgaccccggaaactccacctgtttaactccaaccaaaaggattagttgtcagcaaaccagttctgatttcgattctgatgagcatacacagtatcagttctcaactaacaaacatatcaaagctgagtaa

SEQ ID NO: 68274 - DNA, 1884 bp, Glycine max
  Peptide Sequence Number=SeqID_185052
atgtcttctaatgtttctgtcttctccgttggttctcagcaaaggtgtcttcgaaggttcaacaagatttcatcagagagcacttattttactatttctcaaggtaggaaaggggagggaaaaaagcctgagttggctgatacatcatatggaaatgccaagctctacacactaaagggaacggatgttacaccagatttgtcctcccacaattttgcaccagataagcacagaaacatgtatatgacaaagtcacactcctgtgagagttatgcaaagtacttccgggattcaccaacagaagaactgatagaaccgtctagttccagcatatcaggaaactcagttcaccctgatggtgcttcttcttacctgctaagagctagttcaggagcttctgtgattgttaataacccatttgacacttctatctggtctacaaggcatcgcgatgcctatcagtccaattctggatcagatttcgtggaaaacgggagtccggatggccttgacttcgatggtgaaatgagattaaaacttcaagaattggagagggctttgctttctgatgaagaagaggaggaggaaggcatgtttgagactgttcaaagcatggagattgatccagacatggtcgagtgggccaatccgcttcaagatatgttgctccatgactcaccaaaggagtcctcatcctcagattcttccaatcttaccagcatcagcagcacaaccaaagacacatcacaaaactcgccccaaacccctaagcaactgctttatgattgtgctagagtactttcagaaggaaatgaagaggaagccacatctatgataaacaagctccggcaaatggtctcaattcagggtgatccttctcaaagaattgcggcttacatggtggaaggacttgcagctcgtgtcgctacatccggaaaatgcatctatcaagcattgagatgcaaggaacctccttctaacgatcgcttagcagcaatgcagatactatttgaggtctgcccatgttttaaatttggatacatcgctgcaaatggcgcgatagctgaggttgttagagatgaaaagaaggttcacataatagactttgacatcagccaaggaactcaatacataactctaatacaaacacttgcttcaatgccaggtaggccacctcgtgtgagattaactgcggtggacgatcctgagtctgtgcagcgttccatcggtggcataaacatcataggacaaagacttgaaaagctggcagaggaactcagattgccatttgagtttcgagctgtggcgtcaaggacgtcaattgtctcaccatcaatgctcaactgtcgtccaggggaagcacttgtggtgaactttgcattccagcttcaccacatgcgcgatgaaactgtatcgaccgtgaacgagagagaccaacttcttcgcatggttaagagcttgaatccaaaaattgtgacagttgtggagcaggacatgaacaccaacacctccccttttctcccaagattcattgaaacctacaattactactctgctgtgtttgacacacttgatgcaactctcccaagggagagccaggacaggatgaatgtcgaaaggcaatgcctggcaaaggacattgtcaacattgttgcatgtgagggcgaggaaagaatagaacggtatgaagtcgccggaaaatggagggcgaggttgtcgatggctggcttcactccatctccaatgagcacaaatgtgagagaagcaattaggaatctcattattaagcaatactgtgacaagttcaagataaaggaggaaatggggggtcttcattttgggtgggaagacaaaaacttaattgttgcttcagcatggaagtga

SEQ ID NO: 68275 - DNA, 597 bp, Glycine max
  Peptide Sequence Number=SeqID_185053
atggtcatggcgatttttctgatcgaggtgccgaacacagtgatggtgcctccggtagaggccgtggtggtggccgttttgccaacttttagtgtcaaaatggtctcaactgttgttccaacatccaatcaacctagtgctatacttaccaattcctcctctcatgggaatgattctgctagctccacttggattccaaactcaggagctagcttccatgtgactagtgaatcacaaaatatcaagcagttcactcattttgatggacttgatcaaattgtcataggcaatggtgaagagactaataaagtccttcttcaaggggttgttggtgctgatggtctttactcctttcagaatctcaagcttcaagacaactctcccctactgttgtctacttcaacttcaatttcagataatggcttgcctagtatagctgctactgttaataaaaattctagtgtagtctccaattctgtcgtttcctctcctagtcctgctagtctttggcatgctagattaggtcatccttatagtcatgtaatgaagctagtcttcaatcattgtaacatttccccatcaagtaaatttttttga

SEQ ID NO: 68276 - DNA, 204 bp, Glycine max
  Peptide Sequence Number=SeqID_185054
atggggccaaagtgctgggtcagtggcctgatatggaagtcagccttagccaagtttcttggtctcaactctcaaataccagccaagtgtcaaagaaaggttttgatagataagttggttaaaccatcaaatgccatcactgattacaacacaagagccatacttgttgcttctaatctccccctcgaagggaacaacgagtaa

SEQ ID NO: 68277 - DNA, 5684 bp, Glycine max
  Peptide Sequence Number=SeqID_185055
atgtgcctagaagaacatgacacagcgtttgagactggtccagcgagcttccgatggctggcgagcggtgcgtggtcttcacgcgccgaaatggcacgagctggtggtggcgcgtggcggcatgtggctgggaatctggccacgcgacttgcaggggtgagtcgcgctcctcgaggcacactcaaccctgggtttgccgagaaaaatggcggccgggacagcgacggacgggcaccacttcacccgcgatgttgtttgccttcgtgggggtgctggtcgccgttcctggcctgtgctcgcgccgctgttcctaccggtgctcgcgccgctattcctaccggtggttccgccaccgttccttccagttgttgtgccaccgttcctgccgacgttggctgcgttcaaggtgcagtctgcagagggtgtcgcggctgggtgcagctgggtgcgggtgcgtgggaggggagggctaagcttttgaatgaattaccggggagagagaaagatcagagtgaaagaatcagagagagagtgacagagagagggagtgagagagaaagggaatggactacggtgaggaagagagggagaggtaatctgagagtagaatccactgagagaaaggatcctagacaaagctacgggggagttaggcaacgacaacatgccaatcatccatattcaaactggcggaacagagcggacataacctcattctacttcacgaggttcccagaggatgtacaagaggcggagctctggacccatttcaaaaaatggggggatgtgagggagatattcatatctaaacagaggaacaaaggaggaaggaggtatgggttcgtgagatttaaaggagtgtctgatgtgagtagactcgaaagacaacttgataataccatcatcgggggattgaagctgcatgtaaacataccaaagtatgcgagaggaaagctggaaaaaggcaaaatcaaccacagaaggcaggggatcagccaaaagaagaatgaagggacgaaggcaataccaactacaacatcccatatcacggcacccacaaggacatacgcggagatattggcgacacactcaaggaatgcagggcaacgcaagaacacagccacagctcaagtcagacaaggaggatcacattcctcggttcaactagacatcccgaaggaggaggacaaatggtacaaggacgcatgggtgggaaggttgaagaaactagagatattcgaaaggcttgaagacgaaatagtgtggattttagggtccgacatgaggcctatatacctaggagataacaaggtcattctccttggtcttccagacgcaaaggcagaagagttaaacactgaagaaatagacaagggtacatcgttgttttattccctggagagatggaagccagagacgagaccgggaaacaggctggtatggatgcactgttggggcataccgatcgccgcatgggacattagatatatccggaagattgtggcaacagtgggtgatttggtggacgttgacgatgaagtagaagaacttcggcggctcaacagggctagggtccttattagaaccccgtggagcccgacaatacaccattcagtaactgttgacatccatggtgtgtcgtccgtagtctacatggtggaggagacctccacggaagaaggcctgtacgagcgacgtcgccgacacacgctcagcccatcaaatgaaatatcgtctgacgatagcggcctcgacacaccgatctcgcgactgagcgacctctcgacgaggttaaccgccgaagaacataccggtggctgttttgaccctcggtctgacagggtctctagcggatgcataggaatcaatggtccactgggcaaagacccatatggcccaaccctcgaggatccaatgaaaaatggcacaaaacgcaaccaaacaggggtcgcaccagaccctctgtcggaactacctgcatgtagcagtgaaaaggaaacatgcaaccagcaagatacggacaaggctgataccaaactagaaagtgatgtcagcaggagggggagaaaggggagcacggaaggcatattacaggaaaacaaaagggcttgtgcaaatgcccaaaatgaggaaggcattaaatgcccccctgagacacggcacctttatttcaaaaccccacttgctccagctacggtatctattgggcctgaaaacaacataggcctcactagtgatgggtgcagaaagaaaggggcccaaacaagcagtcacacaaatgtatctgaagacatgacaactttgaccaagcaacaacagatacaaatggaactgcaaacatcaaataatagaggcacaagccaacagctcccatcggactcaggcccagaggaccttgactcacagcctgaaaaaaggaactcaatacaaaccaggaataatagcaataataacttgttagaagaggcaattgctcaatgggaaatggaaggaggcagcagtattgggaaagagaaccaccccaccatgaatattctatcctacaacatcagagggctggggagaggggtgaagtggccagcaatcagaagattagtatcacagcatcatgttgacttgctgtgtatacaagaaaccaagaaagaaaagatagacagagcagtatgtcaagctttgtggggagacacagcattgagttgggaaatataccctgccataaattcagctggtggactgttgtgtgtttggaatgacagtatgtttaagggtgtgtggactcaagagatgcagaaaatatttattgtgaatgtatatgcaccatgtgaggctgtcgtcaggagagcactatgggcatctatcaggcagcttaagcaacttcaaacagatggaacctgtatttcagagttcaacgagtggatatcaaaattagaagttgaagaagtgccaagaagtacacagtacatcttggatagaaatttctcggatcattgccctatcctactcagagcaaaaaatgttgattggggacacaaaccgttcagggttctagactccaaggggatggggggctattcgctgaaagaaaaaatcaagaagcttaaggaaaggctgaagcaatggaacaaagagcaatttggagatacatctaagagggtgcaacaacttcagaaagagctaaacaatctagaagctggcagcagtggcagacaactgaccccccatgagctgtcatctcataaaaagatacaggaggacttgtggactgctgctcaagcacatgaatccttgctaagaaaaatggctagaacaaaatggattaaggagggggactgcaatccaagatactttcacaagatcatgaactataaccacagacataatgcagtaaaagaaccaatcattgtgaaagaggaagttcgcaactttttccaactcaggtttagtgaatcgaactatgaaagacctgcaatgaatggggccagatttcgtgggatagggcagcagcaaaatcagatgctggtggataggttccaggaggatgaaataaaggcaactgtttgggattgtggtagtgacaaaagccctggaccggatggtctaaattttaagtttatcaagcactcctgggagctgctaaaacctgatatcagccgtttccttgacgaattccatgtcaatggtcattttccaaagggctataatgtatctttcattgccttaatccccaagatcaaagatccacaatctctcaacgagtataggcctatttcattaataggatgtatctataagatagtggccaagatccttgcaaatagactgaaaaaggtgctgccaaacatcattgatgagagacaaatggctttcataaaagaaaggcacctgctgcatgctgtactggttgctaatgaggtggtggaggaggcaaaaaggtgcaaaaaaccttgcctggtgtttaaggtggattatgaaaaggcctacgactccgtctcatggaatttcctaacatacatgatggggaggctgggcttttgcccaaaatggatacaatgggttttgggatgtcttcattcagcatcgctgtctattttgattaatggaagccctactaacgaattctatccacaaagaggccttaggcaaggggacccactagctcccctgctatttaatattgctgcagaaggcctaactggcttgatgagggaggctgtagacaaaaaacgctttagcagcttcctagtggggaaaaataaggagcctgttagtatcctgcaatatgcggacgataccatcttctttggggaggctactatggagaatgtgaaggctgtaaaaacaagtctcaggtgttttgaactagcttcaggattcaaaatcaactttgcaaaaagcaagtttggggcaatctgcaagtctgaacaatggtgcaaggaggctgctgatttcctaaattgtagcatgttgcctatgcctttctcctaccttggcattccaattggggtaaacccaaaccgtagggagatctgggatcctattattaggaaggttcccaataaaataatagagaagctagtcagtattcagcgcagattcctttggggaggaggttcggagcaaaaaaagatcgcgtgggtcaattgggaaacattatgtcttccaaaagacaaaggaggattaggcataaaagacctgaggatgttcaatacagcactacttggaaagtggagatgggaaatttttcaacatgatggagaggatcttaagttgcttaatcaacaacaacagacagcagcactcaaagggcacatacaatggagggtgggttgtggagacaagattaaattttgggaagtcacatggacaattgaggacagacaactaatggtaaaatatgctaatctgtaccagatctctaatcaacaacagcaaacaattagcctcatggggaatcataatgatgaaggatgggaatggaatttcagttggagaagaaacctgtttgataatgaagctacaacggctgcagagttcatacaggaaactgcaatgctaacaatacagcagcatggagcagactcatgggtctggagggctgacctgagtggaaaatattcgacaaaatcagcatacgacatactgtcagaagcaacaaggggggacatagataatgggcctttcgtggaattatggaaacttaggataccacctaaagcagcgacgtttgcatggaggctcattagagacaggctaccaacaaaggtcaacttgaggaggagacaagtggggataactgacttgatgtgtccattgtgcaacaatatggaggagaatgcaacacacctctttttccactgcagcaaaatactccccctttggtgggaatcactgtcatgggtgaaaaaagaggctgctttcccacagaacccgaaggaacactttatgcaacataccaatgggaatgttggtcgtattaaggctacaagatggaaatgctggtgggtagccctcacatggaccatatggcaacatagaaataaaacagtatttgagagccagcctttcaacacaagtaaagtgttggatgatgcacttctcctattatggtcatggcttaaggttatggagaaagactttacagtgcactacaaccagtggtcctctcagcagggagatgcctttgg

SEQ ID NO: 68278 - DNA, 273 bp, Glycine max
  Peptide Sequence Number=SeqID_185056
atgggttccttggaagccgaaaataaaactctccgtggcgccgaagaagaagaggattctacttctaccaagaaacgcggcaagttctacgacatttatggacccgaaggcaaggcggatgttgttttcaactcaccagaagataattcaactctcaatcttagtgatgttcaaggacttgtaacttgggtgctcggtgaaggatttatgccgtcatgggtttttattaagatgaatactgggaatgcaaggcaaatagccactgtggagtga

SEQ ID NO: 68279 - DNA, 267 bp, Glycine max
  Peptide Sequence Number=SeqID_185057
atggatgaagaagatcctaggcctacaagctccaatggagcttgcatcatttattgtagtgacaaagacacaatgattccattattgatgcatgagatggaccaagttgttaaggttattggcaagcccaagaaccccaagtggcacaacattgccaagaggaataatatcttgttgccacttcgtccacacccgatcacaatgcttatacataggacaaggatgttgttggcttggatccgtctacacatggtcaaattgccttag

SEQ ID NO: 68280 - DNA, 288 bp, Glycine max
  Peptide Sequence Number=SeqID_185058
atggattcgtcaagagtgactagagctgagccatgggtatttacacatctgcccattgttggctactcagaggtggatgattgtgctgtggatgatccagtagccaccaaatggaagctgttgaaaggttctaggaatgcccttctagtcagggagagattggatgacctacaaacaaatgttgtcgtgtggtgtccatatgaggaccacaaggcagtgaggcctttcgcacaacaatcatttttctttggcttcattagatgtggaacttacgtgaggccttactga

SEQ ID NO: 68281 - DNA, 549 bp, Glycine max
  Peptide Sequence Number=SeqID_185059
atgttacatcgtaactccacatggccttggccttctcccagagaacaaatttctgtgtcttgccaattgatgtctttggtagatcagcaaacaccacagtctatggagcataaagcaaggcaatcgattctgacaaaattggattatctcatcttctgtagcactgcacccctccttgagcttcacaaacgcccaaggtgtctctccccaataatcaataatcatcagttatcacggactcagactggtgcggagaaatgcactgaggcgcgcggcgttgcaacccaggtcacggtggcggggcgcactactgcggctgaggcgctgattagtgaagcgcgcgagttgagacgctgcaaagttacggcaatgctgcattccgtgattgaggttggtgcggcgagggtggtggtggagtgcggcgagagtgagaacgggttagcggcaagaatcacaagtgttccttctccaatacatttcttctgtgagggtgattgtgaagaagtgtactgtgaagaagtgttctcaactttagtattttttatctaa

SEQ ID NO: 68282 - DNA, 99 bp, Glycine max
  Peptide Sequence Number=SeqID_185060
atggtagtggaggcaatgatgaaaggttatagagatgatgatatggttgaggtgacttgcaaattaagcaatggcagtgaagatgataaaagtgatgag

SEQ ID NO: 68283 - DNA, 354 bp, Glycine max
  Peptide Sequence Number=SeqID_185061
atgactattttctttgccctacctcgccaggaggagttgcaacttgcactcaaatcgttaatggcagttgcaactcccctttctctgaaaaagcttccttgtcaacatgcctacgcctgcctacgactgactgcacctcctgcaaagcaaaaccgccagtttgattggcggtttaggaaagcatcaccagactcgccagcagaggtggcgagttccacctgccatcaactcgccaacaagagtggcggtttccctaccacgtgggctttgcgcagcaaactcgccattggcaatggcggtttggctgcatgccccatgcattttacgttaaaaattgccccctatcggaaataa

SEQ ID NO: 68284 - DNA, 591 bp, Glycine max
  Peptide Sequence Number=SeqID_185062
atgaagctttcagatgatgttgatctagagagaattgcaaaagatactcatggatatgttggtgctgaccttgctgccctttgcactgaagttgctcttcaatgcatcagggagaaaatggatgtcatcgatttggaagatgagagtattgatgctgaagtactaaattctatggcaatttcaaatgagcatttccatactgctctgggaacaagcaatccatctgctttacgagaaactgttgttgaggtgcctaatgtcagctgggaggatattggaggccttgagaatgtcaagcgtgagctgcaagagactgttcaatatcctgtggagcacccagaaaaatttgagaagtttggatgtggaaaaactttgttggccaaagcaattgctaatgaatgtcaagctaacttcatcagtgtgaagggcccagaattgctcactatgtggtttggtgaaagtgaagccaatgttcgagaaatttttgacaaggccaaacaatcagctccatgtgtcctcttctttgatgagcttgattccattgctactcaggtctatttttgtacttcgcatccatgcaggccaggttga

SEQ ID NO: 68285 - DNA, 324 bp, Glycine max
  Peptide Sequence Number=SeqID_185063
atggcaagacacaagggtttgttggtgatttggaggggagggaccaaaagcagctccagcggtccaccctcagcggatcgggtcgggactgggaccccgccgcttagccctcacagccaatccttttccccaggctgttcatcttgcacaccagaggcacctatgagtactacctgtggggggaggcactcggtcctccggattttcaagggccgccgggggcgcaccggacaccacgcgacgtgcggcgctcttccagccgctggaccctacctccggctgagccgtttccagggtgggcaggctgttaaacagaaaagataa

SEQ ID NO: 68286 - DNA, 1080 bp, Glycine max
  Peptide Sequence Number=SeqID_185064
atgaacgtttcacccgtaagtgtggcggttatcgataagaaaaccataaccaaagcggaagtgctgcgcgccggtaaagacggcaaagcagtgaagattcaggcaattaccaacggtaaatatctgctgacgcagaaccaggacggcaccgcgcctgaaaacatcaccgttaaacgcgcagggaaaaacctgctggtgatgctggaaggctcagacgccagcaagccggatctgattatcgaagatttcttcgctaaatccggcaccttagtgggtaaagcggaagacggcgaaatgcacgcttacgtcgcgacggacggcaatgccgaccacgaagcggccgcgctggccgacggcgaaaccaccgcgctggcgctgggtgaaggcagcgttgatgataattccggctacgcactggccagcggctttgaatggtcgccggcgctgattgcgctgggtggcctggcggctatcgcggcagcggcaggcctcggctatgtcgcggcgaaacaccactacgacaataacgacggcagccacagcggcaaaggtgaaggcggcggtggcagcggcggcggcgatatcagcaagcccaccatcagcgatgtgattgatgatatcggcgacgtaaccggttcggtagctaacggcggccgcaccgatgacaccatgcccaccttcaacggcaccggtacgccgggcaataccattgaaatatgggatggtgagacgctgctgggtgaagtgctggtggatgacgagggtaactggacctttacgccggataaaccgctggcggctggcaatcacagcatcgttaccgccgagcgtaacgccgaaggcgtggtgggtgaagagagcgatccgtgggaattcatcatcgatttgacggcgccagctaaaggcactattggcagcgtgatggacgatatgcaggatccgccggtgctgatcgaaaaaggcggcgtgacgaaagacaatacgccaacgctgaccggtaaagctgaagcgggctcgacggtagaaatctggaacgatggcgtgaagctgggcaccgctataggtggacgccgagggtaa

SEQ ID NO: 68287 - DNA, 321 bp, Glycine max
  Peptide Sequence Number=SeqID_185065
atgtctggccggtatggcagcgtgagggcgagtttttgcgcatcaaacccacgctttgcgcgtcgagcggcgaaaccctgcgccagctggcgctggccggccagggcattgtgcggctatcggattttgtcagccgcgaggatcgcgccagcggccggctggtacaggtgctggaaaatgacacgcgcgaactgcgcctgccgattcacgcggtgtactatcgcaaccagtcgctcagttcccgcatcacctgttttctggattttttacggggaaaaattcaggaaaatcatctgttataatcctgttctgtctgaataa

SEQ ID NO: 68288 - DNA, 195 bp, Glycine max
  Peptide Sequence Number=SeqID_185066
ggagaaagagaagggattgaagccttcattccaccttctacatgcgatgagtatttctacctcaaagacacttttttgaaaatctcaacggttatattgaatattggggatttcatcaatatacaagctcatgcatgcgttggaggtaaaagtgtgggagaagacataaggaaacttgagtatggagttcatgtg

SEQ ID NO: 68289 - DNA, 243 bp, Glycine max
  Peptide Sequence Number=SeqID_185067
atgtgggtgcaagccattggtctgtttgctcaagtgacctgtgctcctgagtttggacttccaagaccgctcaataagagattactcgtcttgcacgttggtgggggtgccgtaaaacaacaaggacaacccttcccttgtgctcaagaatcccctacaacaagagacccacggtctcttaatcccttttcggaaataagaagaagagaagaagaaatctctcgtaaaagaggtagattgtaa

SEQ ID NO: 68290 - DNA, 175 bp, Glycine max
  Peptide Sequence Number=SeqID_185068
catcagtcagcagagtcagggtttcgctccttttgcgtgccctactccagatcagttcaaggcgaaggtcgcatggtccggagattggcctgaggcccaggcaggggtggcgcccgcagaggatgagaagatgacatatttactcagtttcttaggagggagtggagccacatga

SEQ ID NO: 68291 - DNA, 489 bp, Glycine max
  Peptide Sequence Number=SeqID_185069
atgaccggcaaattacttgttgggtcattaacctttgattgctgcatcatgcactatattattgttcgtattttacttttccgttcttctaaccttgctcaagccttcgaggaggatttgattcttatgtgggcttttcttaccagtcgtcagatcgactgggctcacttgattcggtaccggatgcataaggcattacgggccaatgcacctctcccttatcctcacctcgtcaccctttttcttcatcatttcaaaattcctttggaagatgaaccatttgttcaagtaaaaaggtcttttgctattggtgttggtgcgattatcttgtttggttaccgtaaggatgatgatggtcagtgggttcgaaaacaagacttacctcagccaatccctgacgaacgtactctttctcctccaccgcaaagggttgattcctcttcacttctgaacgatgttctctctgaactccacagtcttcgagctttt

SEQ ID NO: 68292 - DNA, 474 bp, Glycine max
  Peptide Sequence Number=SeqID_185070
gaagccatagataagagcttgaaggtaggagaagatgaatggagggagagggaaagaaggagcacgaattttggtgcttcaaaagagggcataaggtggaatcatggaatgcaatgctacctcgtgattgagatttcagatctggatggtcgtgtgcccaaatatgtccatgaactttatgagggactcgtcatctgcttgtcgcagactggccaaggtggccgaggtcatgcggtgagacctactagtggcgtactgcacactaaatcattcgatgaaggtgttaaagatgtctatggacctgggttcacctgtgtcaagaagacgtctagatgctcatctggatcggttgtcccgtcgtatcgcttagggttgagtggcttccaccccaaaggggtgtggttccccttgggtgtgttcagccaaggtgtgggcgaattgctcattgccctggggaagtctgacacgatgtga

SEQ ID NO: 68293 - DNA, 735 bp, Glycine max
  Peptide Sequence Number=SeqID_185071
atgggaggtgcactgggaaagattgaatcacccaaaaagggatcagtgccagaaactaagctcgaggctaaaatggttgaagcaatgctgcgtagggaatctcaaggaagttccgtgaaatcattcaacactataatcttgaaattcccaaagattgatgagagccttagaaaatgcaaagccatatttgagcagtttggtagtataatggctaacagcagtgtgtttatggctttccttatagatgaggattctaatggggcaatagatcaagaggagttgaaaaagtgtttcagtaagctggaaatttcttttaccgaggaggaaataaatgatctttttgaagcatgtgatatcaacgaggatatggtaatgaagttcagtgagtttattgttcttctttgcgttgtctaccttctcaaggatgaccctgcagctcttcacgctaaatcacgaattgggatgccaaagctggagcgcacatttgagactttggttgatacatttgtattcctagacaagaacaaggatggatatgtcagcaaaaatgagatggtccaagctataaatgaaactacatcaggggagcgttcttctggaagaatagccatgaaaagatttgaagaaatggattgggataaaaatggaatggtgaacttcaaggagtttctatttgcttttacacgttgggttggaattgatgaagttgaggacgaggaaaatgaggaggcataa

SEQ ID NO: 68294 - DNA, 807 bp, Glycine max
  Peptide Sequence Number=SeqID_185072
atgctcaacactcagtctagcatcaaacgtgaaaaccccctcacggactcgcatcctcatccgaaagctatggcagacacaaacaccttaccacaactccaaaaccacataacagagatggagagacgccatgagaaagagttgacaaagctaaaggctgaccacgatcagctagaggctcgtgtcaatcagaggaaaaaaattgaggaatctcaggaaattgctagatatgccgctatcgctgctgaaacagacgtgagcccgctaagaggccttgggggtaaatacacccagtttaagtgctcctttaagcctatgttgatcccatgtggttggagcattctcgcaaaacagcgtgaccctgactgtatgtgcgatgaggacacaactaagggcaaggaccttgaagcacttgaagggcccatgaccagaggcagacttaaacaggcccaacacagtgatgaggacacaactaagggcaaggaccatgaagcacttgaagggcccatgaccagaggcagacttaaacaggcccaacacgtcatagagacaaggctgggtttggtggttgtggctaaaacctatgccttttcacctgcaccaatttatttcattttaggggttcctgttgaaccaaattctgacttatcaaggttgattccttgtggcgtcaccgtgacttatcttccatctctggaagtggcgtccttctccgtcaacattcttgtatcaaacgttccgtcccgtaaggttcacgtcaacgtgaatgttgtgaaaatgaatgagatgtgttgtgttgtgttgtga

SEQ ID NO: 68295 - DNA, 555 bp, Glycine max
  Peptide Sequence Number=SeqID_185073
gtgttggttcaacttggagatatactagatcgaggtgaagatgaaattgctatcttgtccttgctacaatcattggataaacaggcaaaaacaaaaggtggagctgtgtttcaggggaatttcagatatgttgactctgggggatttgatgagtgtaatgatttcttagaatatatcaatggtttcgaagacgactgggaagaaacttttactgcttgggttgatgtctctgaaaggtggaaagaagatcgaacaatgtcaaaaggttattggggaccttggaatttattggagatcagaatactggttttggaccctgtctttccactgttagacctgctaacattcatccaccagtctgctactggctactgggaaaaaacaaatagccaaatgaaaatgcaagaaactatagctggagaaataaactttgatgatcacagtgccaagaaagttatcatggctgctgttaaatatgcaaaaacatatccaagatgcgaggagaaccaaaaattttttgtccatgagttgacgatattgatcaaatactactga

SEQ ID NO: 68296 - DNA, 393 bp, Glycine max
  Peptide Sequence Number=SeqID_185074
gttgctgaattgcctaagtttgagaagcctaaagttcctgaattgcctaaagtaccaaaaatacctaacgttcttgagttgcctaagccagagtttcctaaaggaccagaattacttaagcctgagttgcctagagtacctgatattcctaaggtccctgagtttcctaagtcagtgatgtccaagattgagttgcctaaagtccctaaattgcctaagtccaagtcgtctaaagtatcaaaattaactaaacttgagttacctaaaatatctgagatctctaaggtcccagaattgtctaaaccagagttgcttaaaataccagaatttcctaagcttgaattacctaaggtccttgaattagaaattcaatttctacataggtttgcataa

SEQ ID NO: 68297 - DNA, 144 bp, Glycine max
  Peptide Sequence Number=SeqID_185075
atgggtggacttgggccttcgtattcgcacttaatgtgctctgctcactcagtgcagatgcatgttttcacgacgcgtgctgtgcgcttagcgccagtgcttgtttgcgcgcttagcgcgcctttggactgggcctcatgttga

SEQ ID NO: 68298 - DNA, 279 bp, Glycine max
  Peptide Sequence Number=SeqID_185076
atgaacaaagacgaaagcgataggaacgaaaagaaagcccaacatattaagctttggggagttttcatcttcggattaatcggcgccaccgtcactgctttctccctgtccaggttgcagtcaaaaggaggcagctctttccgaacagcatttcaagaagcatggaagaggtacaataagcgattgcaagaggagtatgaggaggagatggagagggtgatgtttaattggttggttaatgctgagcagcgtgtcttaagtctaggttgcttcttgtag

SEQ ID NO: 68299 - DNA, 375 bp, Glycine max
  Peptide Sequence Number=SeqID_185077
atgaccctttcatggcaaaataagctaaacatgcattttatgttcaagacccttgtgatgagaggtggtcagtggttctacacgagaaaacaattggtgttaatgttgaagatgatgattcatacattgatacttatgcaaatggctacaccacccagctctcatcttcctcctcctccttctcttactggtgcaacatcacagtcgccatctaccttgaagcggacaagaaaagccacatggctaagatcattggtgactagaccagttggggcagagagaccgcttgtccatgtcaatcttgcgaccaagaaggccgacggtccccacagaaagaagttaagaacatatttggggatcgtcgctcatgattag

SEQ ID NO: 68300 - DNA, 651 bp, Glycine max
  Peptide Sequence Number=SeqID_185078
atgggtgaaataaaggaggtgaaagagcagatgaaggccgatatagaggacatgaaagagcaaatggccacaatgatggaggccatgatgagcatgaagaagataatggaggtcaatgtggctgcagttgctgctactagcgttgttgctaaggtggacccgactcccccatctggcctcaaccaaataaatcatccaacctcagatatggtaggtcagggaggcaaagagttggaaagtatgggcggcccccattttgtgcaagttcagaacaagcatgccttcccgccatatggcttgcctcccaactatacaccacccaatgagatgcacactcccgatgagaatgtcaataactccactcccatactcgttgagagccaacaacctcaatctgatcatgcacatgtctctcaacccatgagggaggcacatgaaatacctcaccacaatctagacgacttcgagccttgccttggatacaccactaaggggcaagcagttggtggtgtacccttgccaaacactttggagggccctcagtttcgcccacaaccacaacccttgcattttgtggcggggagagtccctcctgctatagcggaaaaaagggaaattggattttatagaggaaaggctcagggccattga

SEQ ID NO: 68301 - DNA, 303 bp, Glycine max
  Peptide Sequence Number=SeqID_185079
atgccggtcaaagaaagaagtacaggttgccagtccactcattgctatctgatagcccttatcactattttcacatatagaataattatgctattcggacaatcttcttatagcgagtcaatgtcggataatctagcaagagcttctagcgcaagggagtaccagatagagcttcaacaagtgggaatcaatacagcaacaagtccgatgttgaatgagatagctttcatcttccaatctttccgagctaagaagtttgaaaggggcagtcttccatgtcactcggaaggcagatcaaggtag

SEQ ID NO: 68302 - DNA, 438 bp, Glycine max
  Peptide Sequence Number=SeqID_185080
atggccaaattcaggcattatttgttaggtcataagttcattattagaactgatcagaaaagccttaaggagttgttggagcaaacattgcagactccggaacaacaacaatggttaccaaaattccttggttatgattttaccatacggtataaaccaggtagggaaaatatctttggtgatgcattgtctagaagcttgttcatagcttgttcaaagcctactaatcattggttagaaaaagttgcaacagttactaaggaggataagttacaaagtgaactgatcagtcgtgatgctcattggggaaccattgatcctaagtatgatgtaaaggatggattaatatttagaaaaaatatctatcaacaagctaaggtggatcaagcagtacctgcaggattgctgcagccattacccattccacaacaaatctga

SEQ ID NO: 68303 - DNA, 297 bp, Glycine max
  Peptide Sequence Number=SeqID_185081
atgtgggctttccttactggtcgtcagatcgactgggctcacttggttaggtaccaaatgcataaggcattacgggccaatgcacctcttccatatcctcaattggtcaccctttttctccgtcattttcaaattcctcttgatgatgaaccttttgttcaagtcaagcgatcctttgctattggtgctggtgcaataacttcatttggttaccgtaaggatcgtgatggacaatggctgaagaaggacgcgctgcctccgcaagacgagtgtactccctctcctcctcctcagtga

SEQ ID NO: 68304 - DNA, 551 bp, Glycine max
  misc_feature (1)..(1): n is a, c, g, or t
  Peptide Sequence Number=SeqID_185082
ncgggcaatgtccagctgcggctcgctgaggtcgacgttgtattccggacgctgatgcagaccgcccagcgttttgccggcggttttcagcgtcatttcatagcgctgatccacgccgcgaatccgcaggcccatatcccagcggcgcagctggttgtcatcggtttcgtaatagatgttggtcagctcacgcgcggcgtggtgctgatgtggccaggcggcaagcgtctgcaccagtttttcggcggcttgcgggtaatgcaccgcaagcctgctgtctctgctttcttcgccatcgcaccggcccacgcggccgatgaaaaacgttacatctccgacgaattatccacctgggtacgcagcggccctggcgatcagtatcgcctggttggcaagctgaatgccggggaggaagtcacgctgctgcaaaccaataatgactcgcagtacgcgcaaatccgcgatgcagaaggcaaaactaactggattccgctgtcgcagctcagcgcctcccccagcctgcgcacccgcgtgccgcagctggagcagca

SEQ ID NO: 68305 - DNA, 198 bp, Glycine max
  Peptide Sequence Number=SeqID_185083
atgcacaattcgtcgacgaagatcaatttgcgaagcagtgatcaaagaagcgagaaaatgcagaattatttaaaaagcaaacgaagaaggaacttgtttggtttgaaagaaaaagcaggagtaacggattcgccacgtggcggacaccgaggcgccaacctctcaagtgcgtgtgatgcatattgtgtaaccgcttga

SEQ ID NO: 68306 - DNA, 206 bp, Glycine max
  Peptide Sequence Number=SeqID_185084
atggatattgctgctcttttaacttctgctggaattaatattgctgtgagactagcctctcagcattcaagacgcattgatctctgcttggaaagatttgttccctcccctagctggatattgaaagcatgggaaacatctgaggatgagatattggctattggtggcttggatgctgtggtttttgtgaggatacttgttttcag

SEQ ID NO: 68307 - DNA, 881 bp, Glycine max
  Peptide Sequence Number=SeqID_185085
atgaaacgccttaaagagttttttctcaagcgtttccgtatcaaagatcttggagatttgaaatattttttgggcattgagttttctcgttccaaagaaggtatcttcatgtctcaaagaaaatatgctctagacattttgcaagattcgggactgacaggcgctcgccctgataaatttccaatggaacaaaatttgaaactaactcccacaaatggagtggtactaaatgatccaaccaaatatagaaggcttgttggtaggttaatttaccttactgtcacaagacctgacattgtatattctgtccaaacattgagtcaattcatgcatgagccaagaaagcctcactgggatgctgcattgagagtcctcagatacatcaaaggcacacctggacagggcttactattttcatctgctaatgaccttaccttaaaggctttttgtgattcagattggggaggttgtcatgccactagaaaatctgttacaggattttgctttttccttggaaattctctcatctcatggaagtctaagaagcaagttgttgtctctagatcatcagccgaatctgaatatcgagctatggctaatacatgcttggagttgacctggctacggttcatattacaagatttaaaagtcccacaagatgctccaacaccattattctgtgacaaccaggcagctctacacattgcggcgaatcctgtatttcatgagcgtacaaaacatattgaaattgattgtcatatagtacgggaaaaactacaagctgggatgatcaatccttcttatgtgccaacaaaattccagctagcagatgtgtttacaaaagctttgggaaaagatcaatttgtgacattgcgcaacaa

SEQ ID NO: 68308 - DNA, 1029 bp, Glycine max
  Peptide Sequence Number=SeqID_185086
atgggcagggctccttgctgcgacaaagcaaacgtgaagaaaggtccatggtcaccagaagaagatgctaaactcaaatcctacatagaaaaacatggcactggtggtaactggattgctttgcctcaaaaaataggccttaagcgttgtggcaagagttgtcgtcttaggtggctaaactatcttcgccctaatctcaaacatggtggtttctccgaagaagaagacaacattatttgcagcctctatgtcagtattggaagcaggtggtcggtgattgcagctcaattgccgggaagaaccgacaatgacataaagaactactggaacacgaggctgaaaaagaagcttctggggaagcaccgaagagagccacgtaatagagggaattacaacagtgttaagcaagagattgatgttaatagagggagtagtaatgatggtgattcttcctccttatccttgcttcaggaaaatggcaacactactcaacaacaacaacaaccatgttggccacagaatattaataacatgcctgtgctaccactacaagtacctttgccatacacaaaccaaggtccatgtttcaatgaccaagattccataaaaaaactccttatcaaacttggaggaagattttcaggtgattattaccatcctaccctcgatgggttgaaccttgaattctcatcagatgggcaacaaatttatcaagaacaagttcatgttggctcttcttcagctgctgctgcttgcattagttccacaattaacaacaacaatgaggtgcaatttgcacaaactgatcagtactctggagttcataacttggtgcaagggcaaggtggtaattttactccgtcgtttgaggaaatggtatcttcttctaattatccagatgggttggagttcttgtataatgaggatatgatcgaccacaggataatagaatctcctactactactgttactgctactattaccacaaattggggcgaaactagcactccccctttatcaccatcataa

SEQ ID NO: 68309 - DNA, 225 bp, Glycine max
  Peptide Sequence Number=SeqID_185087
atgaaagggagggaaaaatgttgtgtatggtctgtgttggggccaagagatgagtggtccactgtggaaaaagaagaagcggggcttaaggtgatgactaagttggttgtggagaagtttaagttgattgggtcagctgaggagatgagagagctgattgtgccgactgaggtgatggttgacttgtctgggccgacacatttgtttgaggagtggcttgattaa

SEQ ID NO: 68310 - DNA, 411 bp, Glycine max
  Peptide Sequence Number=SeqID_185088
atggctgtacattctgatttggcttcattagagaagaaatctagtaatgaagcttcagattggggcttcctccaaaggcattccaagaactgttggcttagagataaactcctaatccctcataaaagcgtatattttgctgctatgttaaatacaatatatcaaaagccaccacacccaactcttcgttacgaggccgatgttacctttgaggacaatgtcagtgccacaacaacctcaaggttctcagaaaggcacccacacaccacgcggagctcaggggggagattcgggtgcagaggtgaaggtgctgtgagacgtagcgcaggaatttttcgaaggttctcagaaactcactcacgaggaagacctagcgcgagacagaaaaaagcttttataaaacatggttaa

SEQ ID NO: 68311 - DNA, 978 bp, Glycine max
  Peptide Sequence Number=SeqID_185089
atggattgtggagaaaattttaccctggtagtcaaaccggtgaccattcgcacgatgctcagtcttgctctttctaaggcatggcccattcatcaactggatgttaaaaatgcatttttgcacgatgaattaaaagaaacaatcaagtccaacaactctcttttcatttaccggaacaatactgttatggcttacattcttctatatgtaaatgatatcatcttaactgcttcttcttctagtactctttgcaagtctatcatgactcttctcaactcagaatttgctatgaaagaattgggtccactgtgttcttggaaaaagtgcacagaagaaattattgaacgtactggcatgttctcctttaagccttgtcctactctggttgatactaaaccaaaactttgtgttacgtctagcactccgtatgaggatccgtctcactactacaaccttgtaggagctttacaatatctcactttcacaagacctaatatcacttatgtgggtgcactacatcatgtcctgcatctttatccttcttcaataaactcttggatttcttatacatatgcagaatggggtggatgtgcagacactgggagatccacttccggttattgtgtgtttcttggagataatttgctctcatggtcttccaaatgtcaagccacattttctcgctctagtgctgaagcagaataccgaggcgctgttaatgtggtttctaagtcatcttggttacacaatctttttctcgagttacattgtcctatccataaggctacactggtttactgtgataatgttagtgcaatatacctttctagaaatgcagttcaacatcaacgcactacacacatcaagatggatattcactttgttagcgagaaagttgttcgtgggcaagtatgtgtcctatatatgtcccctcgcgctatcaaattgcagattttttcacaaaaggacttcctttag

SEQ ID NO: 68312 - DNA, 990 bp, Glycine max
  Peptide Sequence Number=SeqID_185090
atgattcaagccaatatatttcttgggcatcccttttcaaagttcaagcacgagttcataacgtgtttgatcacatcgtccctcctacggataagaagactaagaaagcgaaaaatgatgcaaaagcagtcaatcccaatctttggcatcgacttgatgcaaccgtgctacaatgaattgatagatgactcaagcgagcagtgttggaaaagaattgctgctattttccaagacaacaaacactcgagggctgtccacctcaaaaatcaattctcaaacacaaatttggaggattttcctacagtcaaagcctattgcaattgcctcaagcttttagccgatcaattggcgaatgttgatgctctagtctccaatacttgtttaggcttgaacatgattgtagtgctaaccaatgcctatgccggttttgtaacatacattcaacaacatgatccctggttgccatttgaaactgccaagtctagattggaactcgaagagtcaacaattattcaagagggcgctcgtgaatttggctcatcttcctttacgactgcccttgtttggtggtggcaacaaggtgctccttggattgtgttgccatgtccatatcccatatatagttgggccaagcccaatgcaactcaaaggccacaacaacctagtctccttggatccaggccacagcaggaaacatttaatgctaccacacccaacccgacaaatatcgaagtagcttgtcatactctaaatcttgctcaaccaaacctgtcgtggtatatggacactggagcaacatctcatatgacttcctcgcaaggtaatctcccatcctattttaatttgagcaaaaataatggtataattgtcgaaaatggccaatctattcctattcgtggttttgatagtgctaatttatcacctccacaccctccattagtgttaaaaaatgcttttcatgcccccaacttgattgaaaacttaacttga

SEQ ID NO: 68313 - DNA, 249 bp, Glycine max
  Peptide Sequence Number=SeqID_185091
atggttctgcccggtggtgtggatagtgctgctagccctcgctttgtggcgtcgagccctgactcgaggggtttctcatcctttcatcatgttctcggcaaaggcttagttgttgatgtggtgttgtggatgaattggcgtggagcggttgcggtgctcgtttatgccaccgcattgtggtacctcttcgatcgtgtcggttacaatttcttgtccttcgtcaccaaagtttttgccaacaagctttga

SEQ ID NO: 68314 - DNA, 123 bp, Glycine max
  Peptide Sequence Number=SeqID_185092
atggagggagttggagtgtttgaagtgtgggaagtaggtagagttggttcaactataggtgaggcagcggaagatgtttcgaaggtataccagtttgttgtgattgatgatgagatggtgtag

SEQ ID NO: 68315 - DNA, 1110 bp, Glycine max
  Peptide Sequence Number=SeqID_185093
atggattcctcaaatccatactatatccatccttcagatcaccctggtcatttgcttgtcccaataaaactgaatggcaccaattacccatcatggagtatatcgatgatccatgccctcacagccaaaaacaaaataggctttatcaatggatccatcaaagcaccatcagcagtagatcaatctgcagagcatgccctatggaatcggtgtaacagcatgattttatcatggctcacccattctgtagaacccgatttagccaagggagtcattcatgccaagactgcgcatcaggtttgggaagattttaaagatcagttctcacaaaagaatgctccagcaatatatcggattcaaaagtccttagcctctatatcccaaggcaccatggctgcctcaacgtactttacaaaaatcaaaggcctttgggatgaattagaaacataccgcactcttcctacttgcaaccagatgaaagcacatgatgaacaaagggaagaagatcgcttgatgcaatttctcatgggtcttaatgatacctacagcactgttcgcaccaacattctcatgatgtcaccattacccaatgtgcgacaggcctactctctagtcattcaagatgagacacagcgccagatgacttccgaaacaacggagaatttctccattgccgctgcaatccatagtcatccagacagcctctccaacaaatttgtcaaagacaaacactgtgagcactgcaatagagatggccatacaattagcaattgtcggactctaaaattttattgcgatttttgcaataaaaacgggcacacagaggatcgatgcagaattaaaaatgggacttacaacacaggaactcaaagcaacaagcacatccaatcacaacagcgacaacaagggcctcgaagcactgcacctaggactttctctgctgccaatgcagcagattcttccaaaaatgcacttgagctatctgcagaacagcttcagcaacttgcccgcgcattgaatatgatgtctccaaacaatacctctggtaatagcaatgctcatgcaaatgctgcaggacttggctacggggaagacgattggctcgggtga

SEQ ID NO: 68316 - DNA, 264 bp, Glycine max
  Peptide Sequence Number=SeqID_185094
atggaaatttgtgaggacttgaagaaagggattgtggagttaattggtgcaatgaaaatcctgaatgtgagagattgtgttgaatgggatatcaatcgttctagtatttataggcacaaaattagacagcagcatatgctagtgtgtccggggtgttgtgctgatatgagtcatttattcctaaacatatttgccacaaaagctaaagatgaatgcttgcatcgttttcttcctagaaggtacacgaaccatacattacattag

SEQ ID NO: 68317 - DNA, 402 bp, Glycine max
  Peptide Sequence Number=SeqID_185095
atggcttggaagtggcaaaaagaggtcacaaattaccaaatgaggagaatcctatggccaaagactcaagaaaataatgcagcaaaagcagagaagaagggtcactttgttgtgtatagctcagataagaggcgctttgtgcttcctttgctgtatttgaacaacaatatcttcagagagcttttcaaattggcagaagaagaatttggtctttctagcaacgtgcccctaacgttgccttgtgaagccacattaatagagtacgtaataacgtttatccagagaaacataactaaggatctggaggaagctgtgttaatgttcgtagctactagtcgatgccaatcatatgttgatcttcatcgtgaacgaaccaatcaacatttgctttacagctactaa

SEQ ID NO: 68318 - DNA, 133 bp, Glycine max
  Peptide Sequence Number=SeqID_185096
atgggaaggatgccatgctgtgagaaggtagggttgaagaaaggaccatggacacccgaagaagataagaagcttgttgcttatgttgaaaagcacgaccacggaaactggcattcagtgcctgccaaagcgg

SEQ ID NO: 68319 - DNA, 381 bp, Glycine max
  Peptide Sequence Number=SeqID_185097
atggtggggcactatggtcatttgagtttagagccaaaatctgtgcctcctccaaagcgaacagggtggattggaagaggaaagtgtcacatggaaaaggccaccatagatctgaagggcgatagcaaggatctgagcggtcgcgttcatcaactcccctactgtgtcaagcatgacagtcccgctctattttccactatttcaaacccaaacacaaaggttttgggggaagatgagggtttactattacaagaggctcattttagaggtaggttactccaaggaacaacacttcctcttccgcacgattactctggttttgtcttgagtaagaggtcacctcccacctccgacgaaaactcattcaaaattttaaagtaa

SEQ ID NO: 68320 - DNA, 210 bp, Glycine max
  Peptide Sequence Number=SeqID_185098
atgcaagcagtgactaacatcgtcacctgcacctttcccagagatgtcagcgtcttccagtcgagactaacatcgtcttctgcaccttttgccatccagggacagcgagtcgggtggcagacggagataccttatggtcagccgcacttttcgtcaaccgaggggaacgaattcgacggtatcaagatgatattggtcgttcggtgctga

SEQ ID NO: 68321 - DNA, 735 bp, Glycine max
  Peptide Sequence Number=SeqID_185099
gatgatggagaaattgaaggggatgtgaatcatcgcattcaagcaggatggatgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtaggtgtagcgaagatgaggatgttgcggtggatgtgtggtaagactcgacaggataaaattaaaaacgaagctatcagagaaagggttggagtagcgcctattgtagagaagatggtggaaaatagacttaggtggtttgggcatgtagagagaagaccggtagactctgtagtgaggaaagtagaccagatggagagtaggcaaacaattcgaggcagaggaagacccaaaaagactataagagaggttatcaaaaaggatctcgaacttaatgatttggatagaagtatgatgaatgaaatagatgtcaaagaggaagtggatgggttggatgaggtggccgaagggtttagcggcctaatgagagaagcaaaaagtttgaatctattcaaaggttactttgtggggaaggataagggggaggcaaaccttttacaatatgcggatgacactttatttgtgggagaagcatcattagagaatgtcaccaccattaaaaccatcatgagatgttttgaagttgtgcccgatttcaag

SEQ ID NO: 68322 - DNA, 237 bp, Glycine max
  Peptide Sequence Number=SeqID_185100
atggcagcgacaataggagcatggggaacgagacgatgcaataggagcacaatggacgacggacgaaactcttgttggcttgtcaaagtcacgcaacagagcactctattcactcatctcgacttctcatgcttccagtttcctgttgatattggttactctatagagtgtacatgtccggataatttcaagatcttggtcgcggtcccatcactcgttaccgagtcattgtattaa

SEQ ID NO: 68323 - DNA, 2793 bp, Glycine max
  Peptide Sequence Number=SeqID_185101
atgattttgagcagttttgagcatgactttgttgaagaagaaagtgccactgagcctagagactcctccaacaagcttttggtgggacaacctccaaattcattacaaggaaatacagtttggaatgctaaaataatcttgatgaatggacttagtaggtctgcgttggaggagctgtcatctgataaaattgtagatgatcgcattcctcatttttgcaatttccttagatttgcggttcttaagaaggatcattctttcatggcagttggtggtccatgggaacctgttgatgggggtgatccatctattgacaataactctttaatcaaaactgccctcagatatgcaaaggatgttattcaacttgacttgcagaattgtcaacattggaatccttttcttgagttacattatgatagaattggcaaagatggtttctttagccacaaggaaatcactgttctttatgttcctgatttgtctgactgcctcccttcgttggatgaatggcgtgacaagtggcttgcccacaagaaagctgtggctgaaaaagagcgtcaactttctttgaaaaaagagaaatcaagagataacaaggaagtatctaaagataaatcagataaaaggaaggattctactccatcaggaaagtcagatgtaaagaaaaaagagaaagataataatactgttaaggaagaaattgaaggaaagactggagtgaataacaataaaatcactaaaaatgaaggttctgacatgggtgaagaaggcaagagtgctgagaaaaagacgggggtaactgtcactggtcaaaccacaggtggtgtgaagtctgtgaaaaagaagattataaagagggttgtgaaacagaaagttgccactaaggcaaaggctactgccatcaaacaaacagacaaatcaggtgaaaaggatgttgctgagaaagtgacatccaatgttactgatcaggatggaaaatctcctactggggttgaaactcctgtaaaaaacttagttgctgaggatatgtctattgggaaaattgatagtgaagagggcaaagataaagaaataaatagttctgaagataaacctcaaaacaagccaaatccaacagtaaatgcagttgtgagtgatccttctgtgaaaacaacaaagaagaagaaaattattaagcgggtacctaaaaagaaggtggtgggtgaggcttctaaatctcttgtatctgaacctaaaaaggatgagaatcaaggacaagatagtacccagagctctggaaagcagactgcagatgcaaataccatagtgaccgaggagaagaaacctgggaaggtagttccgaagaaaaagataaaaacacctgtctctaagaagaaagatgaaactgctgattccaataaaacagaaacactgtctgacaaaaaggatgaagggaacgttgtggcagttcaagcacaagatgacacacagagcactggcaagcagactgccaatgcagataccacagtgacaccagaggtgaagaaaactgggaaggttgtccctaaaaaacaatcaaagacccccacgtctgaaaagcgagacaatacagctgattccagtaaaacagaaacaaagtctgacaaagatgacaaaaaggaagaaagagttactggtgaaaaaagtggggcaaagacagacaagctgaaagcctctgataaagatgttaccaatgtaaaggggaaagtgaaagatggggacaagtcaaaagatgagaaagtaacccaagagagggatggaaaggacgagtccaaaagcaaatctagtaaggaagtgaaagacaagaggaagtctaatgaacctcctcgacaccctggatttattcttcaaacaaaatggaccaaagattctaaaatacgttctttgtcattgtcactggattcattgctggattatacagataaagatgttgaagaatcaaatcttgagctttcattgtttgctgaatcattttatgaaatgcttcagtttcaaatgggttctagaattttgacatttcttcagaaactgcgcataaaatttgtgatcaaaagaaatcagaaaaagaggcagagggaagatgagcaagagaaggatgatgtaaaaaaatctcctgttaagcgtcaaaagggaaatgatccttcagtgaagaatgagcccacaaatatggacacgttaaatccaaccctactagatgatgagaaagctgttgctaggaatgataactctagtaataaggaggatgatgtgaagatggaagatggatcagacgaggaagaagaagatccagaagaggatcctgaagagtacgaggaaatggaaaatggtagtccccagcatgaggcatccaatgataaaaatgctgagcaagaggcgaatgcagatactaaatctgaaaatattactaccaatgataaaacagcagatgaaacttctaaagaggagattaaggttaaagatgaggtgcaagaatccaaggccgatctacaggtaaaagaagaaaaggaaggaaaggatgagattaagaaagaaactcctactgctaaggaggttgttgtggacagagaattgttgcaggctttccggttttttgatcgcaatcgtgttgggtacatcagggttgaagatatgagaataattatccataatctggggatgttcttttcgcacagggatgtcaaggaactagtacagagtgcattattggagagcaacactgggagagacgacagaattctttataataagctagtgcggatgagtgatatttga

SEQ ID NO: 68324 - DNA, 390 bp, Glycine max
  Peptide Sequence Number=SeqID_185102
atgtcgacggccaactatcaaaatgaagatgagagcgcttttggctcaacaaggattagaggatgctctggaaggagaaaagaaattgcccaccacactgttagacaagagaagaaggatattcttgataaagccgatagtgccttgattttgtctcttggagtcaaggttctaagggaagtttcaaaggagaaaaatggtgttgcaatttggctcaaattggagaacctatacatgaccaaatccttggccaacaagttctatatgaagcaaaaattgtacaccttcaagatgccaataggaagagcattggaggatcacttggatgatttcaataagatcattcttgatctagagaatattgaaatcaagattgatgatgaagattag

SEQ ID NO: 68325 - DNA, 378 bp, Glycine max
  Peptide Sequence Number=SeqID_185103
atggttttggccttagttgcacaagatatggaattggaacaacttgatgtgaggataactttcttacatgatgatatgctaattgcttgcagcagcaaggaagaaattaaaaaggtaaaggtgatgcttgagagtgaatttgaaatgaaggatatgggggctactaatttgggatatgccatgagtttggtcaacaggtacatgggaaagccaagaaaactgcattgggaagtggtgaaatggatttttagatatgtgaaaggaatatctgaagttggtttactgtatttcaagcacgaagacagtgatgttggagtgactgagtttgttgatttggattatgttggctatttggacactagaagatctttaatatga

SEQ ID NO: 68326 - DNA, 138 bp, Glycine max
  Peptide Sequence Number=SeqID_185104
atgtatctacgtgatcaaggtggccttgattgtgctcatgagctcagcgcaattatggaccgcttagcgcacattagtgaattttggcttagcgcgtgcctttctcgcttagcggatggactgaagcggtgcgcttag

SEQ ID NO: 68327 - DNA, 273 bp, Glycine max
  Peptide Sequence Number=SeqID_185105
atgtcaaatagaaagtatgaatctggttatgaaaaattgaagaaaaaacaaaaagttgaaaagctaattgaatctcaacgtggtgcccgtgataaatttgttattattcataaaaatgacgcagaagcaagttcaatagatcatactgacaacgaggaaaatgttatagaacaatcacctatagataatactgacaacagtgttgaacaaccacctagagatgatactgacaatggtaaaaacgtgatagaacaatcacctataaataaataa

SEQ ID NO: 68328 - DNA, 474 bp, Glycine max
  Peptide Sequence Number=SeqID_185106
atggggactacttgccccaagaatcatctgaatatgtattgtcggaagatgggggcgtacgcaaaagatgaaaaattgctaatgcatttcttccaagaaagtcttactggggcagtcgtcacttggtatactaacttggaaccttcccgagtccattcttggaaggacctaatggtttccttcgttaggcaatatccgtacaattctgatatggctccggataggatgcagctacaggatatgggtaaaaaggggcacaaatctttcaaagaatatgcccaaaggtggagggatctggcagcccaagcggcgcccccaatgatggaaagggagatggtgacaatgatagtagacatgttatcggtgttctactatgagaaaatggtgggttacacactctcaagcctcactgatttagtcttcgccggcgaaaggattgaagtaggtctgaaaaggggcaaatggagagaatga

SEQ ID NO: 68329 - DNA, 216 bp, Glycine max
  Peptide Sequence Number=SeqID_185107
atgaagaacgaacgaagaacggttgaaaatcttcgtgaaatcacccacggaaatgtcatggttgcttcctccgccttctggagaacttcctggaaggcccaaatgggcctgcatgtcacggaacttcacgaattgcctaacaatgggtgccaagtacctaaaagtagtcaaacgagagtcgcatcccaaccacggatggtccccggacgaaattag

SEQ ID NO: 68330 - DNA, 144 bp, Glycine max
  Peptide Sequence Number=SeqID_185108
atgttgagttgcggtcgtgaggacaagaagaaattgagttgtgtcacttatgtgggtttgcgggccaacccgcagaccaaacttgcacaacccgcggattatgcgagatgggcccagaatcctgcatcaccatggatattttaa

SEQ ID NO: 68331 - DNA, 195 bp, Glycine max
  Peptide Sequence Number=SeqID_185109
atgcataaatactccaggtgtggggtatcacggtacaaagtgaaggataatgatgagtgtagcagtgacgaaagcacaaagaaaggccccctagcgaaggtgttactgatgatgcaaaagaccttacatggcatgcaaatgggagaaactacgatggaatgctccgccatccggttgattcctcccagtggatga

SEQ ID NO: 68332 - DNA, 192 bp, Glycine max
  Peptide Sequence Number=SeqID_185110
atggcagaaatcaaccaaggtaagacgatgaccggtcacgattggtcgcatatcatttggctcttacttgcaggttcaagtgggcaaacgctaacacataaggaaggaggggacatggttaatgttcccctcaaaaaaaaaatgtggcaggttagctcgcctgggcgagctacccctgcattcaaaatataa

SEQ ID NO: 68333 - DNA, 285 bp, Glycine max
  Peptide Sequence Number=SeqID_185111
atggggaaaaaaaaaggaagtatagatgaggaagcattggaagttggaaagaaaacaattcaaaatggacatgatttcattgattacttcatgaagttcgcatggaagtactccggtgcaccgatgacgcataagtccagactcttgcttcatagtttcgcaccccaagagattgattcaagattgattcaaggcttcaagatcaagcatcaagaatccaatccaagattcaagattcaagagaagaaatcaagaagcaacaagtcaagacttcatataggataa

SEQ ID NO: 68334 - DNA, 192 bp, Glycine max
  Peptide Sequence Number=SeqID_185112
atgaagaatggtggaaaatcttcacgaaatcaaccatggaaacgtctcggaagtggtaaaagagggaggtggttgccgcccagcttacccaagcgagctgggttgcttccacctgaaggtctcgccttctgttggaacaccctggaaggtccaagtgggcttggttgctatttgcacacctctgtttactaa

SEQ ID NO: 68335 - DNA, 174 bp, Glycine max
  Peptide Sequence Number=SeqID_185113
atggcacatcaaaaccccccatacttagccttttgcactcctgggcaaaatgaaataaagaaaaaaatccaaggatatcaaagagagacaaacaaaaacatttacatatttctcaatgaacatcaaggagtgaaaggaatgggcagtcctatgtgcccaaagagcatcatctag

SEQ ID NO: 68336 - DNA, 246 bp, Glycine max
  Peptide Sequence Number=SeqID_185114
atgaagaagatccaaggcctacaagctccacatggagcttacatcattgttgatgctatggaaaagtacaatatgcacttggctaattcaatcatggaaagaactgaagttgcttgcagagacttgagcactactaataaactagaggctgacaccttggtcatgccctcttacacaagcttggaaaaaagggtgaccatgagagcgtttggagctgaattaatcctcattgatccagccaaatga

SEQ ID NO: 68337 - DNA, 210 bp, Glycine max
  Peptide Sequence Number=SeqID_185115
atgagggaacccgaaatacgttcacagaagttgttgtattgtaggcagattgcaaaccaattggcacctgtgtttccattgtgtgcaatgtacactatggatgttgctgcagaggctgaagctgtgaccagacccagcattaccttaacaacattaactcaaacttcatcagaaagttttagcaatgttaaaaataacgggttaacataa

SEQ ID NO: 68338 - DNA, 561 bp, Glycine max
  Peptide Sequence Number=SeqID_185116
atgagggaacttgaacccactaatatcactcttcatcttgctgattgttcaatggtccatcctagaggggtgatagaggatgttttggttaagattgataagttcattttccttgctaattttgtggttctagacatagaaacaaatgaaaatatccctatcatattgggacgcccttttctgcatacttgtgatttagtggtagtgtttaattttcctgatgacatgaaaaagcatgtttcctttgctacttgtaattttgtgcaagccaccaacaagatgaaaacaattagggctaagcatcgcccaagtgtaggaaaggaaaaccctctgaaaagggacattattctaaaggatcatcatggaaggggtataatagatgagaatattagagatggcatcaccattcaagctcttggctataaagtcgatgatcatactgaaggattatttcatgaagggattgtcaccccgttcgagggagcatttggagaaaaaaggctcaaacacatgccaaaaattgatgaagtaactctgactattcatcaaggcattgattag

SEQ ID NO: 68339 - DNA, 279 bp, Glycine max
  Peptide Sequence Number=SeqID_185117
atgaagggggtttcaattgaagttggagaagtctccaaggatgcatcccaaagaaaaggggtggcaagagggttgtctataatggactttattttgagaattattacagctgttgcaacactgggtagtgcattggcgatgggaacaaccaatgagacccttccatttgccactcaatttataaaattcagggctgaatttgatgaccttccctctcttgtcaaaagtgtagctaacacattggatgtgtgtgaacatggaaacccaggttttttgtga

SEQ ID NO: 68340 - DNA, 225 bp, Glycine max
  Peptide Sequence Number=SeqID_185118
atgattaagatatacaacaactggttcatcaatcttcaacattcaggctacggagtgcggattggagagttccatattgaggtggtgcattctagcaatgattgtgacttctgcccaaaactcagcatctccacttgtgacattcttaaggcacttcacttccaccactctatggtgatacgaatgcaacaagcatatgcagacttcatcacatacatagcataa

SEQ ID NO: 68341 - DNA, 510 bp, Glycine max
  Peptide Sequence Number=SeqID_185119
atgaaggctgacatggaggccatgaaggagcagatgacaacgatgatggaagcaatgatgagcatgaggaagatgatggaggttaacaccgctatagttggtgttgcaagcactaatactgaggtggacccgatccacccgtccgatttcaatcgagtgggtcgtccggtctcggatgtagtaggccaaggaggcaaggcagcagaaaatgcatgggggccccattatgttgaagttcagagcaagcattcttttccgccatatggtttgcctcccaattatacatcgcccactgttgtgtatgctcttggcgagaatgtcaacaattctgcacccatactcattgagaatcaacaaccccaacctgatcattcccatgcttctaaacccatagtggaaacacatgaagctccccaagaccacactctggccaattttgggccccaccctagatatgccactaaaaggcatgcatttcctggtgcccctgcgccaaacgctcccgggggg

SEQ ID NO: 68342 - DNA, 339 bp, Glycine max
  Peptide Sequence Number=SeqID_185120
atggttggagcattctcgcaaaacactgtgaccctgactggtctccctatgatattacctagtgagagtgacttgacttactattgtgtggtttgtcttgtcatatggctaggtgaagtgcttaaaggaacccttgtgctgaaggacatcgggacacaatgctctgataggatggtgtcacactaccagttcagcctcagtcagcaagggcagggtttcactccttttgcatgccctactccagagcagtttggggctgaggtcgcatgggccggagactggtccgaggcccaggcagggaggtgcctgcaggatcccccggcgatgcagaggaggccc

SEQ ID NO: 68343 - DNA, 123 bp, Glycine max
  Peptide Sequence Number=SeqID_185121
atgaaggaagggcatattccttttgagttgggtgctatgtttggtcataacactagtaatgtagttgataaaggaagtggacaaagatggaccaacaccaagaggaggatcatcattagatag

SEQ ID NO: 68344 - DNA, 658 bp, Glycine max
  Peptide Sequence Number=SeqID_185122
ggttcgtagtaaggtagttcctaagaccccttatgaactatggacaggaaggaaacctagtttaaggcatctccatgtttggggttgtctagcagaagtaaaggtgtataatccacatgaaaagaagtttggtgcaagaaccattagtggtttcttcattgggtatcctgaaaagtctaaagattatagattctattgtcctaaccatagcacaagaatagttgagtctggtaatgctaggttcattgagaatggtcaattcaatgggagtgagaaatcacaaaaggtggatattgtagagactcatggtgaatcttcttcacctatagtttctcatgaaaatgtttttcctttggttgtattacagtcaaacaacacccataggcaacgtaataacgttaataacccacaagatgaacacataggtaatgaaccaaaagacaatgtgcaagtcacaaatgaacaagttttaagcaaggaagattggaagtgcatcttgaaaggttgcgctcagcgcgcaatgttcactaagtggggggaatccactcaacaccaaggcaactcgcccagtgcgatgaagaaccctagagaatacaaagtcagagagcatcgcgcaaatagctcgcctagtgaagcttttgtcgcttctcgcgcttag

SEQ ID NO: 68345 - DNA, 540 bp, Glycine max
  Peptide Sequence Number=SeqID_185123
atgtcagctatttcaagcgattatgttgtgtattcacttgagcatgaatgtgaattgagcattgatgaagattcagtctcatttagacaagccatggaaagtgactattctaaaaagtggctcaatgagatgaaagaagagttgaaatcaatggatgacaataaagtatggaatctagttgaattgcctgaagagaacactgttgatcggtgtacctacatgaagggcagcgggaacaaatttgtaattttagtcttatatgttgatgatattttgcttgctactaatgatattgctatgctacatgatgtaaagaagtatctctctaataactttgaaataaaagatataggtgagacatcttatgtgataggaatagaaatatttcgtgatagatcacaagaattgttgggattgtttcagaaaggatatatcaataaagttttagagatattcagaattgaaaaatactttacaggattattccaatacaaaaaggggacaagtttagtcaaatgcaatgtcccagaaatgaattag

SEQ ID NO: 68346 - DNA, 420 bp, Glycine max
  Peptide Sequence Number=SeqID_185124
atgcaacttttgtctttccagcaagctctttgcctcagcttggttaacaacaatcaacacagtaacatattgcatataattaggtatcagcctccattaccaactgaccaggtgaaggctgctacagattttgattatgaaggagttaggtatacatgtaagaataaggatactgtgaatgctagttatgaaagaacaaggaacagtgcaccgttaatagctaatgatttacgggctgatttttttccagctactggtcttaagatagaagaatataagcctacagcctttggatattggcaatttggacttatggtatatgctactgagaatgaaagcaagtcctcatcatacgaagctgtacctgaaaggctgaaacacatcaaatacctgacaaacatgcaaagacggttcatgtaa

SEQ ID NO: 68347 - DNA, 394 bp, Glycine max
  Peptide Sequence Number=SeqID_185125
atggataatctagcagcaaagttgaatgccataaggatgaaagtatgtgagtcctttctagtacaatttattttgaactctcttcctgctgaatttggccaatttcaagtgaactattacattcttaaggaaaaatggaattttcaagaaattaaggccatgttaattcaagaggaatggagattaaagaaaatgaaggacaactcaattcatctcatggctcatgatagagccagtactagcaagagcaagccaagtaagaagggcaaaggaaaattcaacttaaaggttaaagatggaggagtctgtaaggaaaagaagtgctacttttatagagagagtggtcacttcaagaaggacttctcgaaaagaaagaaacagtttgaaaaggaag

SEQ ID NO: 68348 - DNA, 831 bp, Glycine max
  Peptide Sequence Number=SeqID_185126
atgctagttccattctctatatcttctggttttggtgttggcggacgtggtcatggtcgtggaggctctctccctggttcagggctgttcaatatcaatgaaagagctccagttaagcctaattccatactttttaatggtaaggatgatggaagtgatactggaagagaaagagaaaatagagggagaggtgggtttgatcgaggcaggggcagaggaagaggttcagagaaggggaaggggaaggtcagagagaaggatgtggatgaaaaggttatggatacagatgattttgctacagggctatataaaggagaagatgcagatggtgaaaaattagccagaaagattgggcctgagataatgaatcagttgactgaaggatttgaggagatgactagtagaattttaccattggcattggaggatgagtttttggatgcactagacatcaattatgcaattgaatttgagccagaatatttggtggagtttgataatccagatattgatgagaaggaaccaattccactacgggatgcacttgagaaggcaaaaccattcttgatgtcatatgaggggattcaaagtcaggaagagtgggagattgttgatcactacagtggaccagatagggtaactgcaaagaagcaacaagaagaattagacagagttgctaaaattcttcctgaaagtgcaccatcttcagtaaaacaatttactaatcgttctgttatttctcttcagttgtttccctcttatgttgataatcttattataagtatctctgccaatgatgttctattgcttgctcatgcagttcagtgttaa

SEQ ID NO: 68349 - DNA, 783 bp, Glycine max
  Peptide Sequence Number=SeqID_185127
ggagcaatgtcagatgctaaggttgaggatttgaagaaggaagaggaggttggtgatgattctcctaggaacgaagttgacagtgaaaaatctgcggatgatctgaaagattcggataacgataaaagcgatggaaaccccatgccctcatcccagcaggaggaagcagctgttaagaaaaagtatggagggatgttaccaaagaagcctccactaatatcgaaggatcatgaacgtgcttactttgactctgctgattgggctttggggaagcaaggagcacaaaagcctaaaggaccacttgaagcactccgcccaaagttgcagccaacacaacagcacgctcgttcaagacgctcagcttatgctccagcagatgataatgaagttgatggctgcaacagtgatgcatcagcagagcatcagagtgctactgaagaagctttgcttaaaaagtttcacccgccaagacctgattggtacgaggagttctatgcttcggttatgaactcggctgctaaggattatgaagctgagttcaagtttggggtgtttcctagtcaggttgcgatgtataagtctcaaatcttcagtaacttgaaggggaagggtctaagaatcttggagattggcattggaactggtcccaacctcagttattatgccattggttctgatgtagaggttgttggcattgatccaaaccagaagatagaaaagcatgctcggtcctcggctgtgtcggctggattgcctccttcaagttttgagtttatacaagtt

SEQ ID NO: 68350 - DNA, 171 bp, Glycine max
  Peptide Sequence Number=SeqID_185128
atgatagaagtctccgtcgaagccatcgcatccctcgctcaatattacgaccagtcgctaagatgcttcatgtttggggactttcagttggtataccaaggcagcgcttggaggaaagggccgaagctttggcagatcaaggagaatggacttcattcattgatatattag

SEQ ID NO: 68351 - DNA, 354 bp, Glycine max
  Peptide Sequence Number=SeqID_185129
atgcgcttagcgcgcgcccctcgcgctaagcgcccagggcaaccaagggacgttttccctggtgcgcttagtggccacatgcgcgctaagcgcgcacgtatcatcacgctaagccttgcacataggcttagcgggaacaaacaatgtgaagaacaaaacgaggagcgcgctaagccgctcgccgtgacgtgcccacaccaggggaagcgtccaactgggacttttcccgctttacatccgagatcgcttggcataggaattcaggaggtgcagatgggaccaggtgctgactcaactaccagagaagaggatcgatgtggctctggtgaaagagttttattcgaacctatatga

SEQ ID NO: 68352 - DNA, 339 bp, Glycine max
  Peptide Sequence Number=SeqID_185130
atggaggagaaagtaaagctgaaaactaatggagctttaaggagcacctacttgaagctcttgtgctctgataccacttgttggaagcttacttatgaagcttctatggaggctggatctttgagccatggaattgcagcgaaagataaaggagaagaggttagaggagacgtcatccacaagagaataagccatggaaggagaagcttcaccaccaagagattgccttggataagaagcttaaagaggaagcttcaatggaggaagagaaaacgagagagagagggggggggggggggcgaggtgtgggaattgaagaagattagagagagaagttga

SEQ ID NO: 68353 - DNA, 228 bp, Glycine max
  Peptide Sequence Number=SeqID_185131
atgacagaaacagtagtatcttttgccttaggagaagtttacaaaatcctaaatgacgaagcaaagctgataagaggcatctacaaagactttttagacatcaaagatcaactacaaagcttgcttcaagccttcctcaaagatgcagatagaagggctgcagatgaagcaaacaccaacaatggaataacaacttgggtgaagcagaatgagttccctttccattga

SEQ ID NO: 68354 - DNA, 447 bp, Glycine max
  Peptide Sequence Number=SeqID_185132
atggttaggactagaggcttaggtcgtgccttaggtcgggttattggcagaggtctggggagaggggatcatgatgattctaatgatgctccacatcggcacgataagccagcggtacctgcggactcgcctgtggtacctgcggctgaccctgtggtagctgccgatgagtcgatggctgctgtagatgagcctgagggatttccagatggaccgactgacccatccatgtttaccgagtatgctgagcatgttgcagctagcgaacgtcctgagttgaagttgtcctcccatgggaggaaggtgcataaattagttaggcctgtccctgcaattgaggggctagttgctgggacaagactaagtcctttgatcgcgtgttcagtagacaccggcgaccggggacatagtttctttacacatttgatattatcatacgattgttaa

SEQ ID NO: 68355 - DNA, 222 bp, Glycine max
  Peptide Sequence Number=SeqID_185133
agtttacaggtggtggcacctccaggatctattccttcagttgagcagttcagggagatggtacctcagcatgtggaggatgagtcatctgaggccaccatcccagagccatttgttataggagaagaggcagaggagacacagttgagacaggtagttgctgccacgcctgagcgatcccttgaggctacttcagagccttctgcacaaggggaggactga

SEQ ID NO: 68356 - DNA, 1021 bp, Glycine max
  Peptide Sequence Number=SeqID_185134
ccacttcttccttctttccctcagtcccaaattccgttccgttcccctaaaaccctccgttcacaaaacgacgccgttccccccaccaccctccgcggatgtcctcctcccaccgctcgcctcaaccccgcgcgtgtgcgatgctccaccgtcgccgtcgcggaacccaccaccgccccccaactcggcaagcggacggacataaagaagattctaatcctcggcgccggccccatcgtcatcgggcaagcgtgcgagttcgactactccggcacccaagcgtgcaaggccctccgcgaagaagggtacgaggttgtcctcatcaactccaaccccgccaccatcatgaccgatcctgaaactgccgaccgcacctacatcacccccatgacgccggagctcgtcgagcgcgtcctcgaatcggagcgtcccgacgcactcctccccaccatgggcggccagaccgccctcaacctcgccgtcgccctcgccgagagcggcgccttggaaaaatacggcgtggaactcatcggagccaagctcgacgcaatcaagaaggctgaggacagggaactcttcaaacaggccatgcagaatattgggattaaaacccctccctccggtattggcaccacgctcgacgagtgcctcagcattgccaatgatatcggcgaatatccattaattgtgcggccggcgtttaccctcggcggcaccggcggcggaattgcgtataacagggaagatttgttggaaatttgcaagtctgggattgctgctagtttgactaatcaggttttgattgagaagtctctgttggggtggaaggagtacgagcttgaggtaatgagggatttggctgacaatgttgttatcatttgttccattgagaatattgatcccatgggggtgcataccggggattcaattaccgttgcaccagcgcagactctgacggataaggagtaccagaggctgagggattattcaattgctataattagggagattggtgtggagt

SEQ ID NO: 68357 - DNA, 210 bp, Glycine max
  Peptide Sequence Number=SeqID_185135
atggaaaaatccaatcgggaaaataacaaatatcatatttcccagtcaagaaggtccgctcttgacggtgaagaacacgttggagaatggaagaatccaatcgggaaaataacaaagatcacatttcccagtcatgagggtccgctcttgacggtgaagaacacattggagattggaggattcaatcgggaaaataacaatctatgttag

SEQ ID NO: 68358 - DNA, 510 bp, Glycine max
  Peptide Sequence Number=SeqID_185136
atgggtccaaatgagccctactggcgaacaaattcaagtttttcgcctcctccgacgaggtgggatttcagatttcagtctgaaggtctgtcatatggtgtgaatgatggtgttcaactctatgggtcttctacatcggaaaacgataaagaaagtaggggttgggtcagaggcaaccacctatatgatcttcactattctgcttcagatggtactgggattttccttagcagtccatctgacctttctcagggtcctcagtggacgcctcctgcaatacaagaaatcagtattgacaattatgaaacttcgactaggaaagctttttgcaaattttcctttcaccatatttactatttggaaaaactggactttcaaatagaggggggactgcaagtcagcaatgtagtgttgagggtgaagtgtgtaattattccttcttacgatagccttcagccagcagtgtttgagaaatattggcttttaattaattggaatggaagacagtag

SEQ ID NO: 68359 - DNA, 174 bp, Glycine max
  Peptide Sequence Number=SeqID_185137
atgaagttaggtggcaggcggagatacccaagtggttatccgtataaacactctttcgctatccgtcagactaagagtccgttaggtggcaggcggagacacccaagtggttatccgtataaacacactttcgctatccgtcagcctaagagtccggtagcatgtagagactaa

SEQ ID NO: 68360 - DNA, 321 bp, Glycine max
  Peptide Sequence Number=SeqID_185138
atggacgccacctccactcttccggcaccggcaccaccgacgttgctttgcactcctccgggatcaagtcagaaaaagactgcatcatccagttatcaaaccagtcatataatatgtgacaagtgcgaccctcctcgacttttcaaaagtgaacaaggtttaaattctcattcaagaatccacaaaaggcctatccaatttgatatattggaattcaaatgtggtgaatgtacagatgtatttgaatcgcaacaagcattaagtggccatatgaggcttcacaatcgtgtaaggtataggccaccaaatgcacgaccatga

SEQ ID NO: 68361 - DNA, 975 bp, Glycine max
  Peptide Sequence Number=SeqID_185139
atgatgattcttcaaacttctcaaaaagaactgtttgacttcctcccttactctattcgactcctctacccaacaaccgccaataaaaatccccctcaacatgtttttgtgccgtttccaattgacagtcatgtggctaacgggtatgaaatattttcacagggaacatctgtgaatcactactgtgggggttcaacttcatctcaatcggaaagtagtgaatcagagtctactacaaaatcacatttatcctctgagaggaatttcgctaatcttcgttcattcatgtctaagcctattcaccctatgtcctttaatgacctaacaactactagggatgcctttgatcctgcagttacagattttacagagtttgatacttccactccactcagagatggccagcgttggagtagtgccagcagtagtcaggagtttgctgacgttaccgagtcatttgaattagaaacacctggtcgctcacattttctgtcagatggatttaaatgtggcttgtgtgaaagatttctctcacagcgatcaccttggagctcccgtcgtattgtgagaagtggagacatgcctacaattggggttcttccttgttgtcatgcttttcatgctgagtgtttggagcaagcgacgccaaagacccggaaaagtgatcctccttgccctgtgtgtgtcaaattggaggaaaattcccctgatcaacggagccatttgagattgaggactggttttccaaggcttaaatcatctcgtgacgatggaccgtcaagaccttggggatgtgtacaggtaggtgattgtgttgaaggggctctgcatgcaccaccaggcaacacaatgttgctgcttaatcgaaaccgcattaagaacccttctttgaaaggaatttccagtggaagctcagctgatggggaagcagttagttgctctaaggcaactgcaggtccaagtgtgtggaggtaa

SEQ ID NO: 68362 - DNA, 318 bp, Glycine max
  Peptide Sequence Number=SeqID_185140
atgtactccaatatacaagaatttcagattccaaaagcttttgacataaaaggacacgcaaggaaagctccaaaaatcttgcaagtggatatgtctccaacttgcaattgggtagagtacaacacggacgaggcaaccaaaggtgcaccagactcagctgcatgtggggggattttcagagacaaaaatgccacttttataggttgtttttcagctaatgtggctaatgtgggtaccaattttgctttcaacgctgaacttatggacgccatcatttctatagagattgcttatgaaagaggctggaccaacttttaa

SEQ ID NO: 68363 - DNA, 180 bp, Glycine max
  Peptide Sequence Number=SeqID_185141
atggcttgggaaactaggccatggggtcctattgctactaggttcgggggaatgccaggatactgtggtacactagttggtccattgagatctttcttctgcattgatgtaccatcttcatctgtggctaaggaccttagttactatggatgcatgagttatgtccaggaagtacattag

SEQ ID NO: 68364 - DNA, 426 bp, Glycine max
  Peptide Sequence Number=SeqID_185142
atggaagtagcgatgattggtggtgacggcggcaacggtagaatggtgacaatggaagtgataacaatagggtgtgatgacggtgacaatggaatggtgacattggaggtgataatgatcatgacaggagtggtggcccaatggattttctacgtggaatacgaagtgacaactgataaagaaggaagacctcacttagaagacataacttccgaggccgtaaggtatgtcccctttacctacgaagaaccttttcaatggtatagcatatttatttatggatggatgttaaaggagtgggtatgtagtggggcttggtattggtatgagtccagatacagttcaatcatcaaatacaccttgagattgagagatttacctaaaaacgtgacaagtagcaatgtgaaaattaaaaaaagggaataa

SEQ ID NO: 68365 - DNA, 924 bp, Glycine max
  Peptide Sequence Number=SeqID_185143
atgtcactcgctatgggtggcaagtactggagatgtaatggggtgcttttgcatacatgccactcgtcgtgggtgacacgtactaaagacatagtggtagaaggagggcttgttgttgggactaagctttcctgctcgaggatcttttctggcttcacctctaactcgccatacaaggtcaccagtctccttgtcgatggttcccctgacttcaacggggatcatggcgtttatgccatatataagttgggccctaaggatgactctgttagctgtctctgcctaatcgatgatctggggatgttcgacagagggctaaatggagcttggactatagagattcttaggaggagtgcacctcctggtaaagtcgagggcatcttccttgagtgtcacccagtagtagccggcttacaccactttggagggggtcatccagtttggttcctcctcttttctagtcataacttctcaatgtctatggtgggagtttggagtgtctcctggatgatagtcttgaggtgctcggccttcttggtgttggctagcttggagagtagtttagcaacattgtctccttggtctagtatttgttggcaacctgtccctggacaagttgcgagtccatgtaacattgtaagggccttcaaggatgattcttgccccgcttcattttacgtaggacgcaccgtcaacgtaaaggttccactagtctgggtggttgtcatttccagccaccatccttcctgtgagttcaggctttcacaaaacctgcttgatggggtagttcattttgactaccacttgatgactctagaagtagggcttgagtcgtcaggtcaagcacttctcggcgtcatggagtatacggttagtgaaatggatagggagttggtgcttccctttctcttgtacgaaggttaa

SEQ ID NO: 68366 - DNA, 2013 bp, Glycine max
  Peptide Sequence Number=SeqID_185144
atgacctcggctgccttggccagtccgcgacaagcagacgatgagtctctcaaaaacttcatggacacatttgggcgcactgttgtccagatccgaaatcttaacccagaggtagcgttgcattccatgctcctcaccctacgacccgacaagtttgtggacagtctatgcaaaaagcctcctagtagcatggacgagttacgtgaacgagccaagggctacatccaaatgaaagaaatttccagattcaggaaccaagtcagacaagctggacaaaagtgcgacaagcgagaaggaaacaccaagatcgacatacacaagtcggataagaggcacaagccagacaagtgccgacctcttacaaaaagggtcaggtacgagccttatacaccccttacagccaatcacaccataattctagaggaatcttccaacttagaggtactcatcaggctaccctcgacgaaacctcctaggttgaggttagacatgaccaaatactacaggtatcatcgtgatcggacaaccaccaaacaagagcaagacctggaggacaccgagaagagcaacaaaggaatcatgatgcagatagaagaagagataaaacaaaagatcgaggtagacagagacaccagcaatagcggcactagtgacaaactccataataacaagaacccgccaagcaaatttgaggacttcaagggtatcaaccctgtcaaccaggaggatcccatggttgtctccatcatcattgcaaacttcatggtgtccaaggttctcatcgaccagggcaactccactaatatcctatattggagaactttccagaggctcgaggtctccattgatactgaccaccgtcacaccagtccactccttggctttgaaggcgaaagggtagagaccaaaggctacgtggacttaatgaccacttttgatcaaggccagctctgcaggagtttcacaataagatatctacttattgatgcagatacatcatattttgctttgatcgacaataagacacttaacgaacttggagccatagtctctacgtcgcatttgaaaatgaaattccctaccctgactagggagattgtaatcattaaggcagaccaaaagcaagcacgacagtgctatgcagaaatactaaagttagcaccctatcctcccactagggagcctgccaagcttcaccccgcagcgcctgaaggcactcaagtcatgagcatggacgaagggtcttcaatccgagccttaaccgtctaccaaccaagcttggacgatgaatttgatatagatccgtgcgacaatacttctgacagaggcccgaaacccatcgaagagctcgtcaagttgcagctcagacctaaacctgggctcaataaggacctcactagaaatgagcaccggaacatcatcgatacaaaccgatataatagaagaaaaggaagatgtgagaagaacgatgcaaagctatcaaagaagaagtggacaaactcctcaatgcaaacttcattagagaagtcacatattccacctagcttgccaacatcgtcatggctagtcgatggagcgtccgagttccaggtgctacgcttcctggacgcttactccagatacaaccagatcaggatatacacttcaaacgaggagaaaataacatttatcactgaagatgctaacttttgctacaagatcggacgaaacgtcaaggtatatgtggacaacatggttgtcaagtctcaaagcatagcccaacatgttccaaacttggaagaagtctttgaggaacttcacaaatatgatatgcgcatcaaccctgaaaaatgtactttcggagtaggccgaggcaagttcctcaaaaaatgcactgtcgtactggagatgcgcagcccgaccaacgtccaagaagtccgaaaattgaatgatagactagcatccttgtccaggttcctcccgaagtttgctgaaaaggcgaagctgttttacaaaatgctcaagaaaacttag

SEQ ID NO: 68367 - DNA, 358 bp, Glycine max
  Peptide Sequence Number=SeqID_185145
tgaagatgactatgaatatgactctgaatctgattatgatgaatctagtgactatagtgaagatggctttggagatgaccttgaatctgattatggtggctctaacagcagcggtagtagcagtgaatgtgatgatgtagtacttgagagtcaccatggttatgagcatggacatggatatggctacaatgatgatctacttgagtatcacaatggttattggtctggccatgactactacagcagtgacattgaatgtggctacaactgtccatatgactttgaatctgattatggctatagtgaatatggatatgaagatgacctttgtggctgggatggtagtcatgatgattaa

SEQ ID NO: 68368 - DNA, 1726 bp, Glycine max
  Peptide Sequence Number=SeqID_185146
atggggacacttcttgccctcgctggagggcatggattttgctgcttctggggagcctgtcccggttattgtgatcctccctcttctgcttttggccgtatcgaccatgctgggtcaccgtcgtcctcacctaacatcgttggttataagtgggtgaagggcgacgttatgaaatacaagtccttttctcacctctgcgatgattgtccctgctcttcaacgccgggtgaagttggcaagccctcagaacttatgcaactgactggcaagattggttgggtctccttgaacaatgtgtccaagaagttgtttgagtttgactcaaatatctttcacctctttaaggatcgtttctttaacgtcttggctactgatgtcatgactgatggccattctgtctcttccctcgacgagcgaccccctcgctaccttggacggccactcatgaagcagattggacttgcgggtaggactgtgccatcgtctgctgctgcttctgttcttggagaagggggtcaacctactggtaaggtcacctttggtgccctttcctctattttggcaaagaggaaacaagatgaaagtgttgggtcgtctgactgtgaaaagttgaagtcccctatgagccttcgtgccctgaggcaagctgcggggttgatgcctggtgcgggtttcccttcaagtgtgcaagatgtgcctctagctccaccagctttcgaggctcttgctgccaatgttgttgttactgttacttctgctcctccacctcctcttgtcgtacctgttcaggaggccactcctactgtcgatgttaatatgtcaaccacttcggctagtcctgtcgtggttacgtcgtccaccatcattgcacccttgttgagtgtcggtatggcgactgctagtgctcctgtaatgtcacctcctccttctttagctccatcggttccatcctctactatattggtgatggcatcacctcctttgtcttcttggccccatgtctcattagatcacatgtacacctccaacaatgttcattcattgtgggctgcaagttataggccgaagcagaagaccccgactggctttgagaatggacaacaacaccaaaaggctttgcacaaggtggcatccttggaggcggaggtccccaaatggagggttattgctcgcactctctatagagtggagtgtcataaggtagctaacgccaccatcacctttgctgaggccataagcacaaggttagacggtgatgaactgttcgcatgctacaagagttttcaggatgagaaaaagaacctggatggcaagatggaaggcattgcgacggaaagggacgagcttgcaaaggagtctgagctgttggctgctagggaaagagaggacagtaaagagcttaaggaggagctgctcatttacaagatggaggctatggagcagcatgaaaagggcttcaacaaggccgttaggcaggccgggttcttcgccaaggaccttgacttgggtcttttagaccttttcaaggatgtgaaggatggtgttcttcttgacgaggagtattttgctgtggaggaggaggttgttgatgaggagcagggccatcatgatgatgagtctggaatctttgacgatgtagaccttgtcgatgaagagctttccctaacgcttgtgaggagtatgtttgacttgcccctagttgaaggtcttgccaaccaatctgggg

SEQ ID NO: 68369 - DNA, 273 bp, Glycine max
  Peptide Sequence Number=SeqID_185147
atgaggctggctatgacggttatgaacatgggtatgagcatggatatgaaaagacgaggtgcactgaattttgagattatcacagtgagagtgaatctgattatggtggctcgagtggagatgactctgaatctgattgtggtggctccagtgaagatgcctatgaatatgactctgaatctgattatgatggctcgagtgacaatgactaagatcttgataaatagtaaaatttatcttaaaaaggataaagatgacttaatgagaaattga

SEQ ID NO: 68370 - DNA, 621 bp, Glycine max
  Peptide Sequence Number=SeqID_185148
atggcagctagtgcagagaatattagagaaggtgaagaactaaattggataatgagaatgaggatagctatggggatagcctactgtctagagtatatgcatgagttgaaaccacccattgcccatagaaacttgcaatcttcctttatataccttactgaagattatgctgctaaaatatcagatcttagtttatggaatgacatgtgtgatacaaagaatgggtctgcaaccacacaattcttggaaacatcgtcagccgataccaaggacaatgtttacagctttcaaatagtattgtttgagttgattacaaggagaattcctctggttgggaacaaagaacttctagcagattgggcagcagaatatgtaaggtgggggaaatccttaagatatgttgtggatccaaggctgaagtctttgcaagaagaagagattgatgaatggtctgaagtgataagaaactgtgtacaaccagatctggagaaaaggccaactatgaaagaagttacatctagactcaaggaaatcacagctatggggcctgatggagcaaatccaaaagcatcaccactttggtgggcagaaatgacaattatatccactgattcaagttga

SEQ ID NO: 68371 - DNA, 147 bp, Glycine max
  Peptide Sequence Number=SeqID_185149
atggtaacaaacaacactcatgaggcaatgaagattaatggttgcagcaatcaagacttgattattatggagaaaaaagttaatagcataagcaggaatggatgcctgtcacttttttttggaagaaaccttttgattgccatttga

SEQ ID NO: 68372 - DNA, 420 bp, Glycine max
  Peptide Sequence Number=SeqID_185150
atgcaccatggttactttctgtggctgctaggatgcacttttgacagaaagattgtcaccaaggtgcaattgggcaatggggctatttatgggggagtttcaattaacacatttgatcttaagaaaaaattctatccactggtttacggtggtgaattggtgatatacctaatattgctggaggacataacagctccacatccagaggactctttggataaacattcagtgaagggaaagattgttctgtgtgacctaattcaggcttctgacgacgtggggattttatctgggccagctggtgttatatttggacttaattaccctcaagatttgcgcggaacatatgccctacctgctttgcagattgctcagagggaccaaagactaatacattcttacataacttcaaccagataa

SEQ ID NO: 68373 - DNA, 420 bp, Glycine max
  Peptide Sequence Number=SeqID_185151
atggtggtgggatctaggggtggcatcgtttgttttggaggggggtatttggggtttggacttggaaagataatgttcgagagaaaaaataacgtcgaagatgaagaagaaggagaggaagacgaagcggaagaggaagagaaagagaaagagaagggtgaggtttctggtaaagcacaagttattcaagtaaagggtgaatgggatgctggcaacctcaaactctctctaccaccacaaaatgatggcatcattcgcacagttcagagcataactgatcaatcacctggaagcaagaaggaaggcagaggcatcaagcaactacaaaagtcaatttcttgcaaatataagaatatggaaaactatgtctcagttgatcaggggtttgaaggagaaagagacaactacgttatttattga

SEQ ID NO: 68374 - DNA, 597 bp, Glycine max
  Peptide Sequence Number=SeqID_185152
ttcccggaagacgttttccggaagtcttccggaagaagtgttcttccggaagacgtttggttacttccggaagaacacttcttccggaaactttccggaaaaggttcttccggaacttccggaagaacccctaacgggtcttccggaagacttctccgtcagccttttccgccattttttccggcgtactctcgtcttctcccctctcgtcttctacccaaaggttccattgttatgctaaggttccattgctatgctaacagtgatgcacattacaagctaagggtaaggggaaggggaactaacctgttcgcggagaagaagaagaaagccttggcgcgcctcgcggagaagaagcttcacggagaagagaagaagaagcaggttccgggagaagaagaagttgttccgggagagaagaagctgtgttccgggagagaagaagaatctgtgttccgggagagaagaagaatctgttcgaaaaaaagtcttccggaaatgatttgcgttttttataattttattttaaagggcaaaatgctcaaccgtgggccaagcccaattgggaaagtatgcaacatgggaggtttcatctag

SEQ ID NO: 68375 - DNA, 252 bp, Glycine max
  Peptide Sequence Number=SeqID_185153
atggctaagtctaatggttcagacaatagttttggagattccacaaatgctgaagtggctcttatgtctagaaagttcaagcaaatgatgaaaaagaaaggaaagttccaacactcctctagaagaaaggacaatgattcttcaacagacgatgaagaagatataccctatgatgttcttcttctaaatcatcatatgactcttcttcagcgcaaaaagtataaagaaaattataaagcatttgttttttaa

SEQ ID NO: 68376 - DNA, 456 bp, Glycine max
  Peptide Sequence Number=SeqID_185154
atgtcttacaaaagactttgggaagtttttggaaatctcaaacacattaaccatgctttcaaaattccatcaacaccccatgataagtctggccttggattagagaaaaggccatcatcctccatgtcacagtctgactcggacaattgtgacctttgtggcaagtctggacattccaatttcagttgcatccataagaagaagcaaatgtctaagggtactaatgcttatggacctaaaaatatttggatatccttggtaggaaaaggcaagaatttaaggtggcacttcgatagtggatgctcacgacacatggtgagagaaaggtctatgttccttgacttaaagctaattgaacgaggaacggttgtctttggaggcatgggtaaagggaagattactgatatatgtaaagttggtattccctcaatagcctccatagacaatgtcttataa

SEQ ID NO: 68377 - DNA, 164 bp, Glycine max
  Peptide Sequence Number=SeqID_185155
agggtggtgatgacgacaatagcagcgatagtgacacttatggtggtggtgattgtattgttcatggaggtagtgacaacaacgattatggtgacagtgggcacgacgttcatggtggtggtggttgcgatgctcatggtgacggtgatagcaatggtcaatag

SEQ ID NO: 68378 - DNA, 320 bp, Glycine max
  Peptide Sequence Number=SeqID_185156
atgcctatctccatctgtggaagtgccagttgggatcgcgcccataagacacccaatggacccggagaagtccaacagggccctggggtttccagctctggttatgagtctctgtcagtcttaccgggtgcccgtccccccagcaaggtcatgccatcatgcatagggatcgcgcccgcaagacacccagtggacccgaagaagtcaaatagggtcctggggtttccagctttgattacgggcctctgtcagttctatggagtgcccatcgcccccagcaaagtcatcaggccccctactaaccgagcttccatcaagaa

SEQ ID NO: 68379 - DNA, 304 bp, Glycine max
  Peptide Sequence Number=SeqID_185157
aggagtcgtcccagatttccttactttcgagtccctgagcccggccattaacttggcctacataagaaagaactgttggaacccggttgatcctaccatcacatttcccaggtcccgtaaggccagggcttggggactttcagatgcttccacttctgcccctacctctaccccagctctagctccagcactcacaacaccctccggcctctccacttcgagcacaaacatgatagtgctgatgttgcagagcctccaccatggcttatgcctggtgatgcagagtatccatgacttggcttag

SEQ ID NO: 68380 - DNA, 435 bp, Glycine max
  Peptide Sequence Number=SeqID_185158
atggccatcaaggtccgaaaagagtgcgacaagctgagagatgtcaaccaacaacaagctcaagcttcgaaggaccgagagagaccagtcgaaggtatgatattagaggacaagttgaaggcttatcaaaggtcaaagaggagtttgtccgaacaattgagtaggatggaagaaaacatgtgggccatcattgacctatacaaagagaagctaaatctagcttcaacccatgagcaaaggctagaggacgagtatgcgaaggtatcaatcctacaagcagaaagggaagcaagggagagggtgattgattcattacacagagaagcaatgatgtggatggataggtttgctttcaccttgaatgggagtcaagagcttctaagactgctagccaaagccaaggcgatgacggacgtgtacttggatcccgaggaa

SEQ ID NO: 68381 - DNA, 153 bp, Glycine max
  Peptide Sequence Number=SeqID_185159
atggcaattttgatcgccaatacttcatcaacatttcatagggacgaaggactcgggaatacgcatgctatgcatggaaaattgaaatgggtttatgatcccaacatggttggctcatggtaccgaatatatgcaactaagaatgcagcgtga

SEQ ID NO: 68382 - DNA, 564 bp, Glycine max
  Peptide Sequence Number=SeqID_185160
acaatgagatcaagaactactggaacaccaatgtcaagaaaagattcataagaatgagcttagatcccattactcacaaaccaatgaaatccaacacgtttgaggcccatgatgagttcaaggacatcacaaatattggccacgtttctcaatgggagagtgctcgactcgaagctgaagcaagaggatctatgttgcaagtggggtctggatccttacatctccctaggttaatcttaagcaaaattccaactcaaccttgtccttcatcaaatttgctatcgactgaacataagcgagtgtataacatgtatgctctcgtgcttgcaacgaatcatgaccttcaatcatcagtatctactttgagcgttcccaagcttcctgcagtctctaccaatattggacaattcaccgacatggaaaacttactctcatataatggtgatggtaatgttgtagaaatcagtagccatattccaaaggtaatggaaggttgtgcatcaaacttgcaagatgacgacattatcatggctgtggaagcatttagaacgccaagaaacacaa

SEQ ID NO: 68383 - DNA, 1263 bp, Glycine max
  Peptide Sequence Number=SeqID_185161
gtggtcgatctcacccaggatcagcaggcgctgaaccacgttaaatccttaggttatcagcaagttccggtaattatcgccggagacgatcactgctcggagaacacccatcggttcgttgagaaactgggcctgccggcgatccgcattccgatcgccggcgcccgcagcaagctgctgatggaacacccctttatcttgatcgtacccagctatggcggcggcagcgccgtcggcgcggtgccgatccaggtgatccgctttctcaacgttccgcaaaaccgttcatacctgcgcggcgtcatcgccgccgggaacaccaacttcggcgcggcgtacggcatcgccggcgacatcatcgccaaaaaatgccagacagggagtaaccgcattttggcaacgacagaactgaccaggcccgaaacgggcgcgctggattaccattcgctcaacgcgatgctcaatctttacgatgcggaaggccggatccagttcgataaagatcggctggcggcgcggcactacttcctgcagcacgtcaaccaaaacaccgtgtttttccacaacctggaggaaaagctgcgctatctggtggaggaaggctactacgagccgcaggtgctggcgcagtacgaattcccgtttatcaagcagctgtttcagcaggcctacgccaaaaaattccgcttcgagaccttcctcggcgccttcaagtactacaccagctatacgctcaaaaccttcgacggcaagcgctatctggaacgctacgaagaccgggtgtgcatggtggcgctgacgctggcggcgggcgacaccgccctggcgcaggatctggtggaggagatgatttcgggccgcttccagccggccacgccgactttcctcaactgcggcaaacgccagcgcggtgagctggtctcctgcttcctgctgcgcatcgaagacaatatggaatcgatcggccgggcggtgaactccgcgctgcagctgtcgaaacgcggcggcggcgtggccttcatgctgagcaatattcgcgaggtgggcgcgccgatcaagcgcatcgagaaccagtcctccggcgtcattccgatcatgaaaatgctcgaagacgccttctcctacgccaaccagctcggcgcgcgccagggggccggcgcggtgtatctcaacgcccaccacccggacattctgcgttttctcgacaccaagcgcgaaaacgccgacgagaagatccgcatcaaaacgctgtcgctgggggtg

SEQ ID NO: 68384 - DNA, 312 bp, Glycine max
  Peptide Sequence Number=SeqID_185162
atgtcagagaaaaaccttaccgggcgcctaggagtacaagacaaaccacacaataggagactagtcagggtcacacttttttgcgagaattctccaaccatttgggatcggcacaggcttacaggagcactcaaatcaggtgtatttacccccaaggcctacactctgaagagtctgtcagggcctctccctcctaattcaggtccaacccagaaaacatttcaaaacacagactctatctatgaactgtataaaacacacgactcctcaattgttctcaaaataattttatctcattgtgcttgtgattaa

SEQ ID NO: 68385 - DNA, 1014 bp, Glycine max
  Peptide Sequence Number=SeqID_185163
atgggaaattcgttcggatgttcggcctccggcgaaaggctggtgtcggcggcgagggacggcgacttggtggaagcgaagatgcttctgaactgcaacccgtgtctcgccaagtattctactttcggtggcctcaattcccctctccattttgcagctgccaaaggccacaacgagattgtggcattgttgctggagaatggagctgatgtgaattccagaaattattgtggccagaccgcattgatgcaagcttgtagatatgggcattgggaggttgcacagacacttttactcttcagatgcaatgttataagagctgattatcttagtgggaggacagctcttcactttgcagctgtgcatgggcatgtaagatgtattagacttgttgtggctgactttgtaccaagtgcaccttatcaagctatacatgctggcacagctgttgacaggggtggtggatcaaatgtgaaaggcaaacatgagcatagtgccctttccaagtttgtaaataagactgctgatggaggaatcactgcccttcatatggctgcgttaaatgggtactttgattgtgtacaactgctgcttgatcttaatgcaaatgtgaatgctgtgacatataattatggcacatcaatggatttaataggggctggaagtactccattgcattatgctgcttgtggaggcaatttaaaatgttgtcaggcaagaattgctttagttttgattgtgatataccttatgatccttgttgcacacggtgcaagtcggctggctttaaattgcaatgggtggcttcctcttgatattgctaggatgtgggggcgtcattggcttgaacaattgctggcacccagttctgatgccacaatgcctacattctctcattcaaattacttgtccttgccccttatgagtgtgctcaacatagctaggtattttgcaatcctctatttctgtttctccaagtcaacccaactgtttttcatgtggcaatctatttag

SEQ ID NO: 68386 - DNA, 3390 bp, Glycine max
  Peptide Sequence Number=SeqID_185164
atggaaccaacttccgttgctcttgccatggaatggagcattcaactcgaaatgggtctccgttctaccaaacctggtgttcctgtcaaagccatatcagaaatggagcctcgccttcagcgatggagtagagagcctgaatttggcattgctccctatgccatgtttggtcttgttccaggtgaagataaggtatttgccaataccatcctcttgcgccttgctgatgcttttaggggaggtgacatagagaccaaactttcagttgtaagggttttcttgtctgaacggaaacaccgcgataaggagaagaaaaaacagtgtaaagggttgctgtcagaggccagagtagctaatcacttggagttgttgaagagagtgaaatctgtttttgatagtggggatttgaagtcgaagggactgactttggttctgtttggttgttgggctgattttgtgaaagacaatgctcagatacgatacatgatattttctagccttgtttctcctcatgattgtgaggttagagcatctttgtatgccactgggtgcatttgtgagatatcagatgattttgcatctatttcagtggagatgctatttaatataatgaattcatcttcagtgtctttgcctgtaaagttggttgcagctcgagttttggcaaaatgcaagtcctcttattcagttgctcataaagcatataagataggtatggagttggtactaaattcctcagatgaagattttttggttgccatgttattgtcactctcaaaattggcttgcattttaattccttttatctcctatcaggtggactttcttctttcttttctcaaccgagaaagaacttcacatgtacaagacatggcattaaaatgcttgcattttttattcagaagaggattgtatgagcactcagataatttaggtctaattcgtgggttattttccataatggaggaacctgaaatttcattggccatgcaatataaagctctaagggtcttgcataaggtccttctttcaattccaccttcttcacttcacatggaacttcgtgaatttgtcaggcttctaactgtggttgagaatgcaagtcaatatccagcctcaaggaagagttatttggcaattcgtattctggcagatttgtgttgtaggacaaaggatatagcagatattaacaatgttttttgttgttcttttccatcacatgttatctccctaatcaaagatcatatcaaacttttgttgatgccattgttggaaggttgtcaaaatgatttgacgatttgtcaagagctccagggtttgctaaagattcttctaaatattgttgaaagacatcctaatcttggttctttggtacttgatagcttaaaacaagtgattcaatatcttgtgactgttgcatctgctaattgtgcagtaacatcaactctttcggccataaattttataggaaaagagcgaaattcctttattttaaaacttctccacaagatatacagatttctgatagtcttccaagaaaatctttatatagttggtgctatcaatactaaattgtccagtgaagtgaatattttggttgaacttgtgtgccagtgtagcttaattgattgctatacatattcactataccatctgctatttcacagtcaacctatttgtgatggcttggtccatgagaatgatgaaacgcatctagccagttgttgcacaacatttgtaaacaaagtcttgataggaacaaatggctggactgcttataaggttggtgctcatgcagcgtgtcagggtgaatggttgctagctactaatatattcaggacattaatagagaaagtgaagtctgattcttgctgtagctggttaaaagcattatttcattatgctcattctgaaggaaaaatccaacttcttagtcaaccaaaacagggaaccacctcaatggagttgatggagactataaaatttcctttaaaatcatgtgattacaagggtgatacatgtccaagacttgctaggagtatcaatgattctaattactatgatcagcttactcagtctcatgtggcagtttgctcttccttgaaatttttagaagcgtctgtgacaagttctcaagcattttgttttcagaggtggtttttatcattaagagctagagtgttggaaaatttagtgggtgtgcttaaagctttgagggaagtttcattgaatgtagatcagaatttcaatcaggtagagattgagagtagtgataagcttcaatgcctgaagtcttatcaagatattactcaagtttcttcacaattgttcagactagtagaagagtttgatctacttagagcatctttcattgggatggacagtgaaagttctgcagtccttgcagctcatggtctgagttgttcaatattagcatttgcaactgcttttggagtgtctaacatagaccaacattctcagagaatttttattggtaacaaaacctctaatttacaggctttgacaatacaaaatttaaggaggctattttggagtgtggatcatgaaaccagagcaagtttctcttcgctgttgaattattttgacccaaataagaactgtttatccccactgcctagttaccaaaatttgaacattggttataaagacaaagaggtgctcaatgtttgtagttatgccgtctctggtgctgtccgcttgtttgagaaaattgctcctcagtttaccgagaacgctttatcactaacttccaatactttgataaaatggatgcacattcattttcggcttcccaagtacttcttcaaagtaaggccattcattgggtcggagctttttgtccacaataaggactctagtaatggggttgatatatctgtttcgcaaggttcccacctaacattgaatatttgtcttcaattgaagaatgtgccaccaaaactcctggttaagtcaactaagttgtactgcatccttcattgcagtacagttttccatgtcccatgtggacaaagaaaagccccggaaaactcactgtttggatatgaagcttggaaagatgatgaaattgttgaactgaaccagaagttgttttgccatgtcttggatagtgcggcaggccagagaagaattggcaggcatagtaggggccatggtaatagtagggctgtggagacatttatggattttagacctaatgagaaagggcaggggttttcacattgctcacttgatgtgtctaactttcccttaggttcttatagaatcaaatggcatagctgtttggtcgatagtcaagattcctattggagtctccttcctttgaactcaggacctgtattttttgttataaaacccagggttggctaa

SEQ ID NO: 68387 - DNA, 1853 bp, Glycine max
  Peptide Sequence Number=SeqID_185165
actgttacttgcaaatagttaggaaaagaggagatagttggagtgtgtggtttgctaatagaaatgaacctgttgacgcggaatccgcagttctgttgctagatcactctggtgtactgaaaatagaatcaaaacacagggaattacccatcattctttacttttcacctcaaccagccaacaacactatggccacactcttagatacaggcaactttgtgctgcaacagcttcaccccaatggaacaaagagtgtgctgtggcaaagttttgattatcctactgataatttgctccccgggatgaagttaggagtcagttacaaaactagtcataattggtcactagtttcatggctaacttctgaaatcccaaatcttggagctttcagtcttgaatggcaacccagaacaagagaattgatcatcaagcgacgagaacaattgtgctggacaagtggagaactgagaaacaaagagggattcatgcacaacacacactacaggattgtatcaaacgaaaacgaaagttacttcacaattacaacttcaaatgaagagcttacaagatgggtgctattagaaactgggcagctgataaatcggaatggaggcgatgacgttgcgagggccgatatgtgttatggatacaacacagatggagggtgccaaaagtgggacgagatacccatctgcaggcatcgtggcgatgcatttgaggacagttgtattgcatacagtgattatgatggtaataatgaaactggctgtacattctatcattggaattcaaccaaaggtactaatttagcaagtggcggcatgaagtttcgcttattggtaaagaacaccgatcgcaaagatttagcaactgcaaatagattctatgatgtcaaagatcttgaagatgagttcaagaagagacaggatctaaaagtattaaactatacatcagtactgtcagcaaccgatgatttttcaactgaaaacaagttaggacaaggaggctttgggcctgtttataagggaatcctaccaactgggcaagaagttgccatcaaaagactttcaaaaacatctacacaaggaattgtggaattcaaaaatgaactaatgcttatatctgaacttcagcacacgaatcttgtacagctacttggattctgcattcatgaagaagagagaattctaatttacgagtatatgccaaacaaaagcttggatttctatctgttcgattgcactagaagcatgttactagactggaagaagcgcttcaacataatagaagggatttctcaaggaatactctatcttcataagtactcaagactaaaaatcattcacagagacttgaaagctagtaacatactacttgatgagaatatgaacccaaaaatttctgattttggattggcaagaatgtttatgcaacaagagtccacaggaactactagtaggattgttgggacatatgggtacatgtctcctgaatatgccatggaaggaactttctcgacaaaatctgatgtctatagctttggagtgttgctacttgaaattgtcagtgggagaaaaaacactagcttctatgatgttgaccaccttttaaacctaattggacatgcatgggaattatggaatcaaggtgagtctctacagttattggacccatcactaaatgactcttttgatcctgatgaagtgaaaagatgcatccatgttggtctcttatgcgtagaacactatgcaaatgatcgacctacaatgtctaatgtcatatcaatgggaggcaacaatgaattagaggattgggataggaatagggaggaggtgttgttggttctcgttgag

SEQ ID NO: 68388 - DNA, 159 bp, Glycine max
  Peptide Sequence Number=SeqID_185166
atgaagccaggttgggaagaatttgcacaggtggtaggaatgtttggaaacaagggaagtggttgctttgtgtattcacaagcgaagagtgaattggggaaaagggttggagtaatattgctttatgcagcagaagaagtatgtagagggaccacatag

SEQ ID NO: 68389 - DNA, 864 bp, Glycine max
  Peptide Sequence Number=SeqID_185167
atggagaacccactttttgatcttccacacaccatatatatcaacattctgaggaacctcaaagggttaggtggtctggatgacatctactatgcaaccttcattaacaagcttttatgggatcaaggagtctatcattttttcaacaacatggatggggactccaagcataccttaatagttaaaggcttggtagttgctaaacaacaaaagtttagcaaaactaacctgaaggctatgaaggtggccttggaacagaccttgaaagaggctctagaaatggatgcggaagccctcaataagcgaaaacaaaagaaattggctaagtccattgctgatgaagaccatcgtctggaaaactttggaactacaaagaaaataaaaagatcaggactgaacaacaatagaagaagaaagccaagaaatagtcccaaatggatgaagaagaagaggagatgttggcaaaggagaaacataccaaaagaaggcatgagtctaccgtgtctgctcctgctgacaagggctaccaaagccaagccaaagattggtgacaaagaatgggtagtttccttcacagcaaacaaggaagatctagcctgttccttatcaaaaaatgagtccattgatgacacttctcacacgccactccacaagtttgcaccaatcccacaaccacattcatctctctcttcattacacattgataagttcagaagggtagctcctagggagccattgacggatgaacaacgtttctctctggcctacactcatggtaatcatgcaccactctctccatattttgaagtctctttcattgaaccaatggtaaggaaaaccacatttgctgaaacacccatttga

SEQ ID NO: 68390 - DNA, 243 bp, Glycine max
  Peptide Sequence Number=SeqID_185168
atggcctctacaaacaccctcgccattaaagccatctcaaccatgaaaatcgctaccatacacattgataatgagccttccattcatgtagaacactttttcgacattcaagaactcgaaaaaatcttcaatgaacctgatgtagctccatgtgaagcttataggccttggatcttctttatcaatgaagtcctttgcttcttgaagatcaatggcagtagaatggagaaggagaaaaggtga

SEQ ID NO: 68391 - DNA, 2643 bp, Glycine max
  Peptide Sequence Number=SeqID_185169
atgaggttcaacagtatcacctccgtaacaacactcttcctctttctcagcctctttacacacctccatgcgtacactcccgtggacaactttaccataagctgcggcactaccggaaaatcttacgacggggaaaggacatggacgggggacacaggttcaacgttcttatctcatcaagacggcaccgtttccgctaatgcaacaacacaatctccttctaccaatcaagtgccctacaccgccgcacgcttgtcccgttcccgtttcagctactccttcccagtctcccctggccccaaattcctccgcctcttcttctaccctgctgagtacgcttcctttcctagctccaatgcatccttcaccgatcaatccaaccaattcacccttctccacgttttcaatgcctctctaaaagcggaaaacactaaaaccatcttcagagaatatgtcgtcaatgtggacggcgacagtgagaggttgaacctcaccttcactccgtcacaaccaaactcctacgctttcatcaacggaatcgaggtactctccatgccaagcaatctgtattacacctcagcaaatgacaacggtttgaagctcgtgggaactgacacactgttccccataagaaccaacactgcactggagacagagtatagaatcaaagtgggagggcaaggaatctcgccacgaaacgacactggtttgttcaggaactgggctggtcaagatgaagattatttaattaaacaaaaaaatccacagaatagtgctataacaggaaacaccaatggtaagatgaacataacggtaaatccagattatgtggcacccaaggaactgtacagaacagctcgtgtcatgggcacaaacacgtctatgaacaaaagcctcaagttgacttgggagttccctgttgactctggcttccactacatgatcaggttccacttttgccaacttgaccccaatattactaacatcggtgacagggtgttctcactttacatagggagcgagtttcttgatgttatgagatggagccaaaaacagaaaggtgtcgctgtgtacaaagactacgccattttaatccccaagagtgatactcagaaacaggttaatctctcgctccaaatgatgaatccttatgaaagtgccaaggataaagaaaacaatgacccgtttctgaatggtctggagatcttcaaaatcagcgagtttaacaaccttgctggacctaacctgcagaacaacaacatgctcgtccaagaaggaaagaacagcagcagaacacttaaaattgttgtagcaggggtggtatctggcgttgttgttttcttcatctttttgtgggggagttgcaagttcggtcctctcttgccctcgcaggatgacgacatgctgaattacagccagaggtggccgttcaatctcctctgccagcgcttttccctcatggatatcaaagccgccaccaacaacttcaataacgaatccctcgtcggtgttggaggattcggccacgtgtacatgggctacattgacggcatttccatcccggtggctatcaagcgtctcaagccgggttcgaagcaggggtccgaagagttcctgaccgagatcaagatgctctcgcagatccgccaccgccatctcgttcctctcatcggctactgcaacaacaacaaggagatgatcttggtctatgatttcatgacacgtggcaatctccgtgaccatctctacaacaccgacaaatcccctttatcgtggaagcaacgtttgcagatttgtattggcgccgcccatgggttgtattatcttcacaaatgtgccgggaaatacatgatcatccatggtgatgtgaaaaccaccaacatcttgttggatgatgactgggtggccaaggtttcggactttgggctttccagatttgggcccacggactcatcccatgcctatggcagcaccaccgctgtaagaggcagctttgggtatatagacccagagtattataagcggcatcatttgacggacaagtctgacgtgtacgctttcggggtagtgttgtttgaggtactgtgcgctcgtccgcctcttatacgcaatgaagatcccaaacaggagtcgcttgctaagtgggttaggtactgttaccaaagtgggaccatggaccagattgtggaccccacgttgaaggggaggatcgcgcctgaatgcttccggaggttttgccatattggggtgagttgtttgtcagaggttgggacgcagaggccgtcgatgaaagatgttgttttcatgttggagtctactctgcagattagaatgcctgtgtacaggaatcaacttgcttctatctcttgtgaaagaagacaagtgcaaggttgtgtttactttgggctatccaggattgggcccacaggcaaatacaagacccatgttagcaccgatgtgaagggcagcttttggtatttagaccctgattattgtatacggaacacgttaacagagaagtctgacatgtactctttcgaggtagtgttgtttgaaatactttgcgctcggccacctctgatccacaacgcgtggagatgcaacatgtgtcgcttgctaactgggccaagcacaattacctaa

SEQ ID NO: 68392 - DNA, 2535 bp, Glycine max
  Peptide Sequence Number=SeqID_185170
atgaggctccttagcatcatcaccacctccttaacactattcttccttcttctctttctctccatacacctacaagcgtacaccccagaagacaacttcaccatcagttgtggcaccaccgggatagtcttcgacggccaaaggacatggacgggggacgaagacacaaagtacttatctggtggtcaaggcagcaccgttttaacccaagcagcaacacaagatccttctgtcaatcaagttccctacaccacagcacggttatccccttctcagttcaattactccttccccgtttctgcgggccccaaattcgttcgcctcttcttctacccggctgattacccttcctttccccgcactcatgcctctttctccgttcaatctaacggattcaccttcttaaaaggtttcaacgcctctctaaatgctgacgcggaagccaccaaaaccatcttcagggaatatgtggtcaacgtcaacgatggtgagattctcatcctcagtttctctccctcgcaaccaaactcctacgctttcatcaatggaatcgaggtacttccaatgccaagtgatttgtattacacgtcagcaactaactcaacaggattcatgttcttgggaagtaccacgctatacagcgtagaaaccagatttgcgctgcaggcagagtatagaatcaaaatgggagggcaagaaatatcaccactaaacgacaccggtttgttcaggaaatgggccggtgacgaaaaagattatttaatcaaacaaaatccagagaataatgatcttccagctgacacggatggtaagatgaacataaccgtgaatcctgattacgtggcacccaaggaactctacagaacagcgcgtaacatgggcacaaacgccactctgaacaaaatcagcaacctgacttgggagttcccggttgattctggcttcacttacgttctcaggctccacttttgcgagcttgaccccaatattaataaagatggtgacagggtgttcttcatttacatagcgagccagttggctgagaaccacgctgatgttatgcaatggagccacaatcagaaaggtctcgcactgcagagaaactatgccgttttaattccgatcgataatactcagaaaaaagttaatctctcgcttcagatgcatccttatgcaactaatgataaaacgacatacagcgacgcgttcttgaacggtctcgagatcttcaaaatcagtgaggctgggtcaaacaaccttgccggacctaacccggacccggttcagactccacacaacaacatacccgccccaaagggagaccgcagcagcaaaaccgcagcagcaacatacccggttcagagtccacacaacaacataccagtcctaacaggaaagatcagcagcgagagcagagggacaataattggcgtggtcgtgggggtggtatccggcgtcgttttgatcttgctcgtcgttttcttcgtctttttgtctgcgacttccaggtgtgctggactcttgttctcaatgaccaagtcaacaaagacgcataattcctccctaccgttggatctctgccgccgcttctcccttctggagatcttagatgccacacaaaacttcgacgacgtcctcattgtaggtgtcgggggatttggccaggtgtacaagggctacatcgatgacggttccacccctgtcgccatcaagcgccttaaaccgggttcacaacagggggctcacgagtttctgaatgaaattgagatgctctcacaactccgccatcgccacctcgtctctctcattggctactccaacgataataaggaaatgatcctggtctatgatttcatgacacgtggtaacctccgtgaccatctctacaacaccgataacccaactctaccgtggaagcaacggttgcagatttgcatcggtgccgcgcgtgggctgcattatcttcacacaggcgccaagcacatgatcatccaccgcgacgttaaaacgacaaacatcttattggatgataaatgggtggccaaggtttcagacttcgggctttccagaattgggcccacgggcacgtccaagtcgcatgtcagcaccaatgtgaagggaagctttggatatttagacccagagtattataaacgttaccgtttgacagagaagtctgatgtgtactcttttggagtagtactgtttgagatactatgcgctcgaccgcctctgatccgtaatgcagagatggaacaggtgtcgcttgccaattgggccaggcgctgttatcaaaatgggaccatggcacagattgtggacccctcgttgaaggggactatcgcgcccgagtgcttcgagaagttttgtgagattgggatgagttgtttgttagaagatgggatgcacaggccgtcgataaacgatatcgtttggctgcttgagcttgcgctgcagctgcaagaggatgcggaacagcgtgaaaatgctgatattgttacagatgaaagcaatgaaataaaaagaggaaattag

SEQ ID NO: 68393 - DNA, 2460 bp, Glycine max
  Peptide Sequence Number=SeqID_185171
atgatatcaaccgtgagattctacagcgtcacctccttcgtactcgcctttctctttttctccatagagctccaagcgtacaccccagaagacaacttcaccatcagttgcggcaccaccgggatagtcttcgacggccaaaggacatggacgggggacgcagacacaaagtacttatctggtggtcaaggcagcaccgttttaactgaagcagcaacacaagatccttctgtcaatcaagctccctacaccacagcacggttatcccgttttcagttcaattactccttccccgtttctgcgggccccaaattcgttcgcctcttcttctaccctgctgattacccttcctttccccgcactcatgcctctttctccgttcaatctaacggattcaccttcttaaaaggtttcaacgcctctctaaacgctgacgcggaagccaccaacaccatcttcagggaatatgtgatcaacgtcaacgatggtgagattctcatcctcagcttcactccctcgcaaccaaactcctacgctttcatcaatggaatcgaggtactttccatgccaagtgatttgtattacacgtcagcaactcactcaacaggattcaagttcgtcggaaataccacgctgtacagcgtagaaaccagatttgcgctgcaggtggagtatagaatcaaaatcatagggcaagaaatatcaccactaaacgacaccggtttgttcaggaaatgggccggtgacgaagaagattatttaatcaaacaaaatccacagaataatgatctttcagctgacttggatggtaagatgaacataaccgtgaatcctgattacgtggcgcccaaggaactctacagaacagcgcgtaacatgggcacaaacgccactctgaacaaaatcagcaacctgacttgggagttcccggttgattctggcttcacttacgttctcaggctccacttttgcgagattgaccccaatattaataaagatggtgacagggtgttcttcatttacatagcgagccagttggctgaggacaacgctgatgttatgcaatggagccacaatcagaaaggtctcgctgtgcagagaaactatgccgttttgatgccgaaggataatactcagaaaaaggttaatctctcgcttcagatgcatccttatgcaactccggataaaacgatatacaccgacgcgttcttgaacggtctcgagatcttcaaaataagccaggacgaatcaaacaaccttgccggacctaacccagacccggttcagactccacatagcaacaaatcagtcccaacgggaaagatcagcagagggagcggagagacgataattggcatgatcgtgggggtggtatccggcgtcgttttgatctcgctcgtcgttttcttcgtctttttgtctccaatttccaggtgtggtccactcttgttctcaatgaccaagtcaacaaagacgcataattcgtctctgccgttggatctctgccgccgcttctcccttctcgagatcttagctgccacccaaaacttcgacgacgtcctcattgtaggtgtcgggggatttggccacgtgtacaagggctacatcgatgacggttccacccctgtcgccatcaagcgcctgaaaccgggttcacaacagggggctcacgagtttctgaatgaaattgagatgctctcacaactccgccatcgccacctcgtctctctcatcggctactgcaacgataataaggaaatgatcctggtctatgatttcatgacacgtggcaacctccgtgaccatctctacaacaccgataaccccactctaccgtggaagcaacggttgcagatttgcatcggtgccgcgcgtgggctgcattatcttcacacaggcgccaagcacatgatcatccaccgcgacgttaaaacgacaaacatcttattggatgataaatgggtggccaaggtttcagacttcgggctttccagaattgggcccacggacacgtccaagtcccatgtcagcaccaatgtgaagggaagctttggatatttagacccagagtattataaacggtaccgtttgacagagaagtctgatgtgtactcttttggagtagtactgtttgagatactatgcgctcgaccgcctctgatccgtaatgcagagacggaacaggtgtcgcttgccaattgggccaggcgctgttatcaaaatgggaccatggcacagattgtggacccctcgttgaaggggactatcgcgcccgagtgcttcgagaagttttgtgagattgggatgagttgtttgttagaagatgggacgcacaggccgtcgataaacgatgtcgtttggctgcttgagtttgcactgcagctgcaagaggatgcggatcggagtgaaaatgctgatattgttacagatgaaagcaatgaaataaaaagaggaaattag

SEQ ID NO: 68394 - DNA, 243 bp, Glycine max
  Peptide Sequence Number=SeqID_185172
atggaggtgtgtaaagaggctgagaaagaggaagagtgttgttacggaggtgatactgttgaacctcatgttttagtagatgatgctaggaagcaactgagagaggaaggttcagagtatttgttagggaaactggaaggcaactgcggagtgaagcggaaaaactcgtaccttacgcgtttggatcaatccaacattcttatacacctttcgatgcatctgatagctgatattaaaagctaa

SEQ ID NO: 68395 - DNA, 1068 bp, Glycine max
  Peptide Sequence Number=SeqID_185173
atggtggccataactggattggcatctatagttgttcattacatatatgatccttcaaggaggtataaagcatatattagaaagacaattaaggatggacaacatgaacctgatatcaaaatacttgtttgtgttcacaatgaagaaaatgtatatccaatgatcaaccttctccaagcctccaaccctacaaatgttacgcccatttcaatctttgtcctacatcttatagagctctcaggcagggcaatttccactctcacaaaaaataagagtactaacaagtcatctcaacacataaagaacgcctttgatcaatttcaaatgcataacagagggtgtgtcatgttgcaatatttcaatgcaattaccccatatttaagcatgcacgatgatatatgctacatggcaatggactccaagtctaacattgtgattatgccatttcataagcaatggtccatcaatggaaatgttgagtactccaatgcttcaattaggatactaaaccaaaatgttttaaggaaagctccttgctcagttggaatctttatagatcgaagccaaatgaatggcaaactcttagtcatatatgagaagtcattttgtgaaattgccatggtcttcttaggtggaggtgatgaccaagaggccttggcttatagtttacgcatagctcaacatccaaatgtgagactaacagtcttttggataacatttaaaatacaaggcaacaaaaggaaaacaaagaatccttacattgacttgatggagcacatacgttatagtagttaccatgaaggcaaagtaacattcaaggaagagattgtggaagatggagaaggaacaacacaagttattcgaagcatagaaggacaatataagttggtcgtagtcggtagacattacattaaagactctccatgtacactaggcttgacagaatggtgtgaacttcctgagcttggtccacttgggaacctcttagccacatcagattttacattttcagttttggttgtgcaacaacaacccccctttaatcatgaatatcggtatattaggtga

SEQ ID NO: 68396 - DNA, 1026 bp, Glycine max
  Peptide Sequence Number=SeqID_185174
atggttccttttccctgtctaccatgcttcaccacaaaatccaacaccacaaaccacttcaccccaatagaacaactctgccaccgcttctctcttgcacagcttcaagcagccacaaacgggttcaacccaagtttatttcttggtggagaaggcccatgtcaggtctacaaagcccacctcaaagcccatggagacgttgtcatcaagcgcttcaagactagaagcccagctggggaaatagaattcagggccgaagtcaagattctgtgtcaactacaccacccaaacattgttcctttgattggtttctgtgagcacaaaaatgacaagttcgttgtgtttaattatgtccctaatggaagcctctatgattgcttgcatggcaccaacaataacaatgttcttgttcccttgtcatggaaacaaagacttcacatctgcattggtgtggctcgtggactacactacattcattttggaaccaagatacctatcatgcatcgtgcagtgacatcaagcaacattcttttggaccataatttggtgcctaaagttgcagattttggactctgcaagaagcaacccgaaggcaaaggggagtctaggccaaaaccaccaagagttgagttgagggagaacttggagcttagtttggaatatttagagccggagtatagaattactggaaggttatcacataaatctgatgtgtactcttttggggtggttatgttggagattttgtgcaggaaggaagcgtgtttttcgaccccgggtagagactgttgtgagtatcttgtcaaatgggcctttgatgatgaaaggaagggggttcctgagaagattgttgatccatctctcacgggaaaaatagcacctgcttgttgggaaatgttcattgagatcgttcagagatgtctggcttcagttgaagagaggccaaggatgggtgaagtggaggtggttcttgaaaatgcattgctgttgcaagagagagcagatgctgtgaaggagctagtgtga

SEQ ID NO: 68397 - DNA, 471 bp, Glycine max
  Peptide Sequence Number=SeqID_185175
atgggttcttgctactggcacccttatatatgcggcttgttccttgttctccataatgtgatagcagacagttgtgtagctgtaaatgaatggatccagtatctgactgcacatacggctatggacgatatttttccctgtgtggacaatgccactgcacaagaaacattgtcacgaagcaaagaagtaacttctgaactagtaaatttgatcaaacaggttatctccaatgtttccaacttaaatttcgcctccaatttcactacactatactacaatcaatctagcgcagcattttcaagtgttagagggaaggagaaaagattggagtctcaatttcacggttaccgtacaaggggcatttctccctctacatacagcattttgcaaatcccaacaaatggaaatgtgtgcaaatgggtttcaaaggttaacgagtccaaaatcctagtcttacttggacaagtttag

SEQ ID NO: 68398 - DNA, 1047 bp, Glycine max
  Peptide Sequence Number=SeqID_185176
atggatattgaaaggaaagatcaattgagttcttatggaatgattggcaatgagaaattcgtatgccaatatgttttgaaacacacaagcagaggtgtttggtatggagacaatccccttcatcatgacacatctgtcttatttatcgagattattgttatgtatattgtcggtagaatcacttatctcttgttaaggccttgtcatcaaacctttcttatttcacagattgtggctggaatcatactgggccctttatttctaggtcaacacaattcaagttatgagatgatatttccaacagcaagcaaaatgacactcacaacatttgcagaatttggcatgataatccatttctttcaaataggggtgcaaatcaatcccatgctaatcttaaagatagaaaagcaagcaatagcaattggtctaataggaaacatatcttctatagcacttggtggtataattttcaatattgttaaaggaatgtaccctgaagggatggaaaacactggtattcatgttttagtgatatcatcttcagtgtctacatttcctgttattagtggcttccttgctgagatgaacattcttaattcagaaattggacgcatggctatatccatttccatgattagtgatttatgcatgtgggtaatgtattttgtggtaatcaatagtgctaaagcagtggaacaacaaacatataaacctattacagaaatagctgtgacaatttgttatttctccatcttattcttttttctaaggccgttggttatatggatctccaaccgcaatccacaaggaaagcctatgacagaaagtcatttcttatcaatcatttgtatattactatttgttggattctctgcaagtatgttaggccaacctccattccttgttgcgttttgttttggcttgatcttaccggatggtcccccattaggttctgtcctggcagaaagacttgacactgttggttctacttttatggttccatcttattgtactattactggcctcagactgatgttccttcattag

SEQ ID NO: 68399 - DNA, 1609 bp, Glycine max
  Peptide Sequence Number=SeqID_185177
atggttcggttccgtctgagcttgggaaattgtaagaatttaaggtctgtgatgctctctttcaattcactttctgggtcactgcctgaggagctttctgagcttcctatgttagccttttctgctgagaagaatcagcttcatggacatttgccttcttggcttggaaagtggagcaatgttgattctcttttgctctctgctaaccgtttctctgggatgattccacctgagcttgggaattgttctgcgttggagcacctcagtttgagcagtaatttgttgacaggtcccattcctgaggagctttgtaatgctgcctcacttttggaggttgatcttgatgacaactttctctctggtgctattgataatgtgtttgttaagtgtaagaaccttactcagttggttttgctgaataaccggattgttggttctatacctgagtatctttctgagcttcccttgatggtgctggaccttgattccaacaattttagtgggaagatgccttctggtctgtggaattcatcaaccctgatggaattctctgctgctaataaccgtttggagggttctcttcctgtggagattgggagtgcggttatgctggagaggcttgttcttagcaacaatcgactgacaggtactatacctaaggaaattgggagtctcaaaagtctttcagttcttaatttgaatgggaatatgcttgaagggagtattccaactgagcttggtgattgtacttcccttactactatggaccttggaaacaataagctgaacgggtctattcccgagaaactggtggaactaagccaattgcagtgcctggttctttctcacaataaactgtctgggtctattcctgccaagaaatcttcgtattttcgacaacttagcatccctgatttgagctttgttcagcaccttggtgtgtttgatctttctcacaacagattgtctggccccatacctgatgaacttgggagctgtgtggtggttgtggatctcttggtcagcaacaacatgctttctgggagcattcctagatcactctcgcgcttgacgaatcttacgaccttggatttgtctggcaacttgttgtcaggttccattccccaagagcttggaggtgtcctcaaactccagggtttgtatctgggacagaatcagctatcaggtaccatccctgaaagctttggaaagttgagtagtttggtgaagctgaatttgacaggaaataagttgtctggtccaattccggttagttttcagaacatgaaggggctgactcacttggacttgagctctaatgagctcagtggcgagcttccatcctctctttcaggagtgcaaagtcttgttgggatttatgtgcagaataacaggatttctggccaagtaggggatctcttctcaaactccatgacttggaggattgagacagtgaatttaagtaacaactgtttcaatgggaacttgccgcagtctttgggaaatctttcttacttgacaaatttggatcttcatggaaatatgttaactggagagattcctttagaccttggggatctaatgcaactggaatactttgatgtttcag

SEQ ID NO: 68400 - DNA, 550 bp, Glycine max
  Peptide Sequence Number=SeqID_185178
atgtccgccatggatatgattaagtccctttccagtaagcctgaaaaatttacgggtgaaaattttttctgttggcaacaacaaatgaaattctggcttactgaattggatttatactctgtgatttctaaaagagaaataaacacttcaacttcctctactgatatagttcaaactgatgcaaccattaagcatgatgtttctgataaagatattttatgtcatggacgcattttaagtgctttggctgataacatatataagattttttgccataccaaaacttctgttgagttatgggaagcacttgaattgaaatatggatctactgaaaaaggtttaagtcgttactcttgtgaaaaaatgattgagtttcaaatgattgatggaaaatctatttcagatcagatccatgaatttgaaaacattgtttatgacatgaaattgaaaggaatcgttttgcctgacattatgcttgtggctttcatgatatcaaaattgcctccttcgtggactgattttgctcaaagcttgaaacataaacatgaaa

SEQ ID NO: 68401 - DNA, 417 bp, Glycine max
  Peptide Sequence Number=SeqID_185179
atgaataggtggatgactatgaaaaacctcatgctagaggacacaggaacacaacgctctgataggatcaccacttttaacactccaccatctgcatataatccaccaccattgaactcttgttaccgtccatcattacctactcaaatgtgtgacatgggtcatgaagatgagaagaatgatgatgataacaacaataccaacaatggcgatgatgataatgatgatgacaatggtggtgatcatgtttctcaacaacaacacacaattatttgtgaacatcctagaacaagaggaggtaaaggttgtagaacaagaagacaacaaacacatgcaaatctagtccaacaagatgagagactgaggcacatgtctagaataactagttgtgggacatcatctctattaattttttaa

SEQ ID NO: 68402 - DNA, 2685 bp, Glycine max
  Peptide Sequence Number=SeqID_185180
atgacgttcctcagtatcacctccttaacactattcttccttcttctctttctctccatagagctccaagcgtacaccccagaagacaacttcaccatcagttgtggcaccaccgggatagtcttcgacggccaaaggacatggacgggggacgcagacacaaagtacttatctggtggtcaaggcagcaccgttttaacccaagcagcaacacaagatccttctgtcaatcaagttccctacaccacagcacggttatccccttctcagttcaattactccttccccgtttctgcgggccccaaattcgttcgcctcttcttctacccggctgattacccttcctttccccgcactgatgcctctttctccgttcaatctaacggattcaccttcttaaaaggtttcaacgcctctctaaacgctgacgcggaagccaccaaaaccatcttcagggaatatgtggtcaacgtcaacgacggtgagactctcatcctcagcttcactccctcgcaaccaaactcctacgctttcatcaatggaatcgaggtgctttccatgccaagtgatttgtattacacgtcagcaactgactcaacaggattcaagttcttgggaagtaccacgctgtacagcgtagaaaccagatttgcgctgcaggcggagtatagaatcaaaatgggagggcaagaaatatcaccactaaacgacaccggtttgttcaggaaatgggccggtgacgaagaagattatttaatcaaacaaaatccacagaataatgatctttcaagcaacacggatggtaagatgaacataaccgtgaatcctgattacgtggcacccaaggaactctacagaacagcgcgtaacatgggcacaaacgccactctgaacaaaatcagcaacctgacttgggagttcccggttgattctggcttcacttacgttctcaggctccacttttgcgagcttgaccccaatattaataaagatggtgacagggtgttcttcatttacatagcgagccagttggctgagaaccacgctgatgttatgcaatggagccacaatcagaaaggtctcgctgtgcagagaaactatgccgttttaattccgaaggacaatactcagaaaaaggttaatctctcgcttcggatggatccttatgcaactaatgataaaacgacatacagcgacgcgttcttgaacggtctcgagatcttcaaaatcagtgaggctgggtcaaacaaccttgccggacctaacccggacccggttcagactccacacaacaacatacccgccccaaagggaaaccgcagcagcaaaagcggaacgtcgataatcggcatcgtggcaggtgtggtatccggcgtcgttttgatctcactcatcatccttttcctcatcgtcttcttccgacgcaagacaatcactacgcccaaggactacaacaagtccaagtcctccgcgacctccaagtggggcccactctccttcacaacgaccaagtcaaccaccaccacgaagtcctccctcccctccgatctatgccgccacttctccctcccggagatcaagtccgccaccaacaacttcgacgacgtcttcatcgtcggcgtcggcggattcggccacgtgtacaaaggctacatcgacaacggctccacccccgtcgccatcaagcgcctcaagccgggttcacagcaaggcgcgcacgagttcatgaacgagatcgagatgctatcgcagctccgccacctccacctcgtatctctcataggttattgcaacgagaacaacgagatgatcctcgtctacgacttcatggcgcgtggaacgctacgcgatcatctatacaacaccgacaacccccctctgacgtggaagcagcgcttgcagatctgcatcggcgccgcgcgtggacttcattacctccacaccggcgcgaagcacacgatcatccaccgcgacgtgaaaactaccaacattttgttggatgataagtgggtggccaaggtttcggacttcgggctttcgagaatcgggcccacgggcaacgccaaggcccacgtcagcaccgttgtgaaaggcagcattgggtatttggacccggagtattataaacgacagcgtttaactgagaaatctgacgtgtattcctttggagtggtgctgtttgagttactctgcgctcgtccgcctctgatcagaactgcggagaagaaacaggtgtcgcttgctgattgggcgaggcactgctgccaaaatgggaccataggccagattgtggaccccactttaaaggggaggatggcgccagagtgtttgaggaaattctgcgaggttgcggtgagttgtttgttggacgacggaacgctgaggccgtcgatgaacgacgtcgtttggatgctggagtttgcgttgcagttgcaggagagtgctgagcagcgtgaaaatactaatattgttgataatgaaattaatgagagaagagaggaggaggctagtgatgatttgtttagtactggaaccagtgtgggccaggtttcggattttaacaagagtagcggtgtggtgagtgtgagtactgatagcgaagagcttagtagtagctacaaagagagtgataagttgatgtctgggactgttttctctgagattgtggatccaaagccacgttga

SEQ ID NO: 68403 - DNA, 2460 bp, Glycine max
  Peptide Sequence Number=SeqID_185181
atgatatcaaccgtgagattctacagcgtcacctccttcgtactcgcctttctctttttctccatagacctccaagcgtacaccccagaagacaacttcaccatcagttgcggcaccaccgggatagtcttcgacggccaaaggacatggacgggggacgcagacacaaagtacttatctggtggtcaaggcagcaccgttttaacccaagcagcaacacaagatccttctgtcaatcaagctccctacaccacagcacggttatccccttctcagttcaattactccttccccgtttctgcgggccccaaattcgttcgcctcttcttctaccctgctgattacccttcctttccccgcactcatgcctctttctccgttcaatctaacggattcaccttcttaaaaggtttcaacgcctctctaaacgctgacgcggaatccaccaaaaccatcttcagggaatatgtggtcaacgtcaacgacggtgacattctcatcctcagcttcactccctcgcaaacaaactcctacgctttcatcaatggaatcgaggtactttccatgccaagtgatttgtattacacgtcagctactgactcaacaggattcaagttggtcggaaataccacgctgtacagcgtagaaaccagatttgcgctgcaggcggagtatagaatcaaaatgggagggcaagaaatatcaccactaaacgacaccggtttgttcaggaaatgggccggtgacgaagaagattatttaatcaaacaaaatccacagaataatgatcttccagctgacacggatggtgagatgaacataacagtgaatcctgattacgtggcacccaaggaactctacagaacagcgcgtaacatgggcccaaacgccactctgaacaaaatcagctacctgacttgggagttcccggttgattctggcttcacttacgttctcaggctccacttttgcgagcttgaccccaatattactaaagatggtgacagggtgttcttgatttacatagcgagccagttggctgaggaccacgctgatgttatgcaatggagccgcaatcagaaaggtcaagctgtgcagagaaattatgccgtttcgattccgaaggataatactcagaaaaaggttaatctctcgcttcagatgcatccttacgcaacttgggatataacgaaatacagcgacgcgttcttgaacggtctcgagatcttcaaaatcagcgaggctgagtcaaacaaccttgccggacctaacccggaccaggttcagattccacacaacaacaaaccagtcccaacgggaaagatcagcagagggagcggagcgacgacaattgacgtggtcgtgggggtggtatccggcgtcgttttgatcttgctcgtcgttttcttcgtctttttgtctccaacttccaggtgtggtccactcttgttctcaatgaccaagtcaacaaagacgcataattcgtctctgccgttggatctctgccgccgcttctcccttctggagatcttagctgccacccaaaacttcgacgacgtcctcattgtaggtgtcgggggatttggccacgtgtacaagggctacatcgatgacggttccacccctgtcgccatcaagcgcctcaaaccgggttcacaacagggggctcacgagtttctgaatgaaattgagatgctctcacaactccgccatcgccacctcgtctctctcatcggctactgcaacgataataaggaaatgatcctggtctatgatttcatgacacgtggcaacctccgtgaccatctctacaacaccgataaccccactctaccgtggaagcaacggttgcagatttgcatcggtgccgcgcgtgggctgcattatcttcacacaggcgccaagcacatgatcatccaccgcgacgttaaaacgacaaacatcttattggatgataaatgggtggccaaggtttcagacttcgggctttccagaattgggcccacgggcacgtccaagtcgcatgtcagcaccaatgtgaagggaagctttggatatttggacccagagtattataaacgtaaccgtttgacagagaagtctgatgtgtactcttttggagtagtactgtttgagatactatgcgctcgaccgcctctgatccacaatgcagagacggaacaggtgtcgcttgccaattgggccaggtgctgttatcaaaatgggaccatggcacagattgtggacccctcgttgaaggggactatcgcgcccgagtgcttcgagaagttttgtgagattgggatgagttgtttgttagaagatgggatgcacaggccgtcgataaacgatatcgtttggctgcttgagtttgcgctgcagctgcaagaggatgcggatcagcgtgaaaatggtgatattgttacagatgaaagcaatgaaataaaaagaggaaattag

SEQ ID NO: 68404 - DNA, 2051 bp, Glycine max
  Peptide Sequence Number=SeqID_185182
atgaataggtggatgactatgaagaacctcatgctacaggacacgggaacaccatgctctgggtgtcacaccgtttccgctaatgcaacaacacaatctccttctaccaatcaagtgccctacaccgccgcacgcttgtcccgttcccgtttcagctactccttcccagtctcccctggccccaaattcctccgcctcttcttctaccctgctgagtacgcttcctttcctcgctccaatgcatccttcactgttcaatccaaccaattcacccttctccacgttttcaatgcctctctaaaagcggaaaacacgaaaaccatcttcagagaatatgtcgtcaatgtggactacggcagtgagaggttgaacctcaccttcactccgtcacaaccaaactcctacgctttcatcaacggaatcgagttccccataagaaccaacactgcactggagacaaagtatagaatcaaagtgggagggcaaggaatctcgccacgaaacgacactggaaacaccaatggtaagatgaacataacggtaaatccagattatgtggcacccaaggaactgtacagaacagctcgtgtcatgggcacaaacacgtctatgaacaaaagcctcaagttgacttgggagttccctgttgactctggcttccactacatgatcaggttccacttttgccaacttgaccccaatattactagcatcggtgacagggtgttctcactttacatagggatcgagtttcttgatgttatgagatggagccagaaacagaaaggtgtcgctgtgtacaaagactacgccattttaatccccaagagtgatactcagaaacaggttaatctctcgctccaaatgatgaatccttatgaaagtgccaaggataaagaaaacaatgacccgtttctgaatggtctggagatcttcaaaatcagcgagtttaacaaccttgctggacctaacctgcagaacaacaacatgctcgtagaagaaggaaagaacagcagcagaacacttaaaattgttgtagcaggggtggtatcttgcgttgttgttttcttcatctttttgtgggggagttgcaagttcagtcctctcttgctctcgcaggatgacgacatgctgaattgcaggcagaggtggccgttcaatctcctctgccagcgcttctccctcatggatatcaaagccgccaccaacaacttcaataacgaatccctcgtcggtgttggaggattcggccacgtgtacatgggctacatcgacggcatttccatcccggtggctatcaagcgtctcaagccgggttcgaagcaggggtccgaagagttcttgaccgagatcaagatgctctcgcagatccgccaccggcatctcgataatactcagaaaaaggttaatctctcgcttcagatgcatccttatgcaactaatgataaaacgacatacagcgacgcgatcttgaacggtctcgagatcttcaaaatcagccaggacgaatcaaacaaccttgctggacctaacccggacccggttcagactccacacaacaacatacccgccccaaagggaaaccgcagcagcaaaagtggaacgtcgataatcggcatcgtggcaggtgtggtatccggcgtcgttttgatctcactcatcatccttttcctcatcgtctacttccgacgcaagacaatcactacgcccaaggactacaacaagtccaagtcatccgcgacctccaagtggggcccactctccttcacaacgaccaagtcaaccaccaccacgaagtcctccctcccctccgatctatgccgccacttctccctcccggagatcaagtccgccaccaacaacttcgacgatgttctcatcattggcgtcgggggattcggccacgtgtacaagggctacatcgacggcggtttcaccccagtcgcaatcaagcgcctcaaaccggattcacagcagggtgcaaatgaattcatgaatgagatcgagatgctctcacagctacgccaccttcatctcgtgtccctcattgg

SEQ ID NO: 68405 - DNA, 456 bp, Glycine max
  Peptide Sequence Number=SeqID_185183
atggcactaaaatgtcacgacgatccaacggtgaacgagtctgagatcgtcatttttctgaaaaagatttggtgggctgcgagtaaaagaaagggttttgagaggagaaggagaaaaaatgaaaatgagggaaagaagagacaccgtcaattttccggtagtgccgcagctgatggtaaagttgtccactggaatgtacgcttggaggtgtgtaaagaggctgagaaagaggaagagtgttgttacggaggtgatactgttgaacctcatgctttacagtgtcttttagtagatgatgctaggaagcaactgagagaggaaggttcagagtatttgttagggaaactggaaggcaactgcggagtgaagcggaaaaactcgtaccttacgcgtttggatcaatccaacattcttatacacctttcgatgcatctgatagctgatattaaaagctag

SEQ ID NO: 68406 - DNA, 900 bp, Glycine max
  Peptide Sequence Number=SeqID_185184
atgtttgagcagcctcttctgaagttaactttggtggatatccttgaagcaactgacaacttcagcaagacaaatataattggagatggaggttttggaactgtgtacaaggccactttacctaatggaaaaacagttgcagtgaagaagcttagtgaggctaaaacgcagggtcatcgcgagttcatggctgaaatggaaaccttgggcaaggtgaagcatcaaaatcttgttgcattgctcggatattgctcaatcggcgaggagaaactccttgtttacgaatacatggtaaatgggagcttagatctttggttgagaaataggactggggcccttgaaatccttgactggaacaaacgttacaaaatcgcaaccggtgcagctcgaggattagctttccttcatcatggcttcacaccccacatcattcacagggatgttaaagctagcaacatcttgctcagtggagattttgagccaaaagttgcagactttggactggcaagacttatcagtgcctgtgagactcatatcaccactgatattgctggaacatttggctacattccaccagagtatggacagagtgggagatccacaacaagaggagatgtctacagttttggtgtcattttgcttgaactggtgaccggaaaagagccgacgggaccggattttaaagagattgaaggtggaaacttggttggatgggtttgtcagaagatcaagaaggggcaggctgctgatgttcttgatccaacagttcttgatgctgactcgaaacagatgatgcttcaaatgctgcaaattgctggtgtgtgcatatctgataatcctgcaaacaggcctaccatgcttcaagtgcacaaattcttgaaggggatgaagggagagtag

SEQ ID NO: 68407 - DNA, 1399 bp, Glycine max
  Peptide Sequence Number=SeqID_185185
caactcagtaacgacgatgctggagttggtgttgttgtacaagaacccattgctccacacatccctaaccctaatcctcgctttcaccttcgccttcttcaagatccccctcttcttcctccacggcctccagacctacatccaccccgactcccaaccccaatccaacaatggcctccgagccgccatccgccgccccggcagcatcgacagctaccaacccttgtcttccaaaaccgccgccgaactgaaaaagcggaacaagtccaacaacaagtccgatttcgatgaaaacaatgctcagatcttcagaatcacgctcgaccacgcccacctccagtcccgtctcttcatcgatcagtactgcgtcgctttcactctctccttcgctgccctttccacccttttcctccacaccttcctcgattccccccagaatcgtgggttcttctccaacggcgttttcgttcccgttctgttatcaattttgagtctttactcgtggggctcgctgctcgccaagaccacgttcgagagatccgcgtccaggaggttcgagaagcaattgagtgttgttttggggggtttgggtttttttttagggcttttgtttgttcctgagggtttggctttggttttggagtttcgttttggggttcagtttgatgggttttggagggttttcgttgctgcattgatgggttgcctttctgggtttttgttcatccctgcttctagaagtgcacgttgcttttggcttgggactgatcagattcgttgcaatttgtcgatgataacttgcgggaggtttacttgtgcgattctttatgtaaatcagatgcttgttatatttgtggctttgttgtggatcacccctttggctgagatttttgtaaataagggaaatggtgtggcaaagagtggatttggtaatgccgagaaattggtggggaatgtggggttcttgccttctgattttggtagcttcaggaagtggtgcttgttggggtctggtttgttgcagattgtggctttgaggcctaacctgcagatgtatctgaatgaagctttgttgtcttggtaccaaaggcttcatgctagcaaggttcctgacttggattacagtagggcgaagatgtttctgcataatcactacttgtgccttgtggttttgcaattccttggccctcctgtgctggtgcttctctttcttggattgtctcagattgatgatggtgtttcctttggaaattttgcgatgttgaatgatttactgcccggctttgctttcttcaaggaggtggctttctttttggcttggtgggcaacctttctctgggcattgttctcttcggtgatccttatgctacatcgccattgtgttttatatgtttcttga

SEQ ID NO: 68408 - DNA, 486 bp, Glycine max
  Peptide Sequence Number=SeqID_185186
atgaaacggagggcaagaggttttataggaaagagggacgtgccagggggcccaccactagtggacgcgcctgacaggctaccactagtgatcgcgcctggggccccaccactactgatagcgcctggcaggccaccactagtggtcgcgcctggcaggccaccacttccacccctgtcccatcgtcctgtcaagtcacgccacgtgtcgcgttctggtggaacgcgcccctcaggaacccaatttggtgattttgccgaggataaagacaaccattttggcaaaagcaaaaggaacaagaataaggtgaatgaaacgggaaaagatgaacatgaggaaaacttggagcaagaagacagggagataatatgcaagtgggtcatctccaaaccaaattcccttggagtttatttgattaactgtgctgtggcatatgaaagaaccaacgtgtctgccttggtaattccagcatgcatgacattgtga

SEQ ID NO: 68409 - DNA, 301 bp, Glycine max
  Peptide Sequence Number=SeqID_185187
gttgccgtcccttgtgacggacgtgtggggtgctaataccttccccgcgcgtaaatataactcccgagcctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaagggtaggttgcgacaatgcgcaagattcttctctgctaggcagggacaatcgagttcgatagcatgtggaaacgtcatggttatcccgttttag

SEQ ID NO: 68410 - DNA, 336 bp, Glycine max
  Peptide Sequence Number=SeqID_185188
atggaagcctccttcgtccgcacaatgctccaccactacgtcgtcgtttcaccccaacccctccgcctcgaccgctacctccccgacacctccgaatccaccttggattccagaaccaagaaacatgcaccagcagattcagtgggtcgtagcaggggcagaagaaggaagaggagatcgtcaaaaaatcaggtgcagaattcatcagcggtggaggagcagggagtaacgggtgatttacgtatgtccccacagggtgtctcagacctagaaaatggaagagaaagtgttgcttgcggtgaaggaggggatgataaagaaccaattgagaattaa

SEQ ID NO: 68411 - DNA, 465 bp, Glycine max
  Peptide Sequence Number=SeqID_185189
atgtctttccctaaaccccaggctaatgttgttaccattggtgttacctctaattccccatctgataggaatcaaatgtattgtgagcatagagaatgggagtatgtcacatctgttagaagaaggcttggacatgtgcatttgaattctatcagaataatgatgtttcttaatcttattcctaaatcttccattgatttaaaacaaaagtatgaaacatttattcaagcaaagcaacctagaaagggttttactacatgtattgaaagagaaactgtcgcaacctacccttcggcgggagggcgacgcgagactcgcgggatgcgtgttccacgaaaggaatgcgcgcggagtcgccaccaacgtttatttgaggaaaacgtcggaaaaaccggaaaagacgcgatctacgaacttttaagtgaaaggttcgggagttgtatttacgcacggggaaggtgttag

SEQ ID NO: 68412 - DNA, 219 bp, Glycine max
  Peptide Sequence Number=SeqID_185190
atgtttgttaacgctcgcaaacaaatatcaactagcttaatcaagttcaaaggatgcaaattggttgctagatgtgatgtgatgccaaaggtaaaagacagaagggagtgggtggaaactttgagagcaaaatgggggagggaaagggaagggtggtgtagggaaaggaggaggggggtgaaaatagcaaaagtgggtgtgaataggaatccaccatag

SEQ ID NO: 68413 - DNA, 471 bp, Glycine max
  Peptide Sequence Number=SeqID_185191
atgaagggacgtgtaagatggaatgaggataatattggagaaattgaagcaaacaagcccgtgaggcaaaaaatcactgaacctaagaccccgtatcatcctatgattgatgatgacagttctccgtcccctgtacaaggagattttgacgaatataatggtgataaagatcactcagcaaatgctgaacaaactggttttaagaatggggcatgttgtaacagaaaaggaactagacaatctgatggctggacatcatctgaggatgaggcagaagaaactgaagaggatgaggaagatagaagtttgagttttaaagagcacagaaaggcccactatgatgaattcctgaaagtcaaagagctgcaacaaaaggcttctctggaggatggaagtgacgaggatgataatgctgagcttaccatcgaggagaagaaaaatgactcatcttctccaataagtgctacgtga

SEQ ID NO: 68414 - DNA, 210 bp, Glycine max
  Peptide Sequence Number=SeqID_185192
atggcaaacaaaggcggctcgttgtggtcaccggtggtcagtggaggtggaggaggggatgttaggggagggtttaggggaagaggaggaggaagaagatggctcttttacactgctggacgtatttgtagactgcaacattcgcccagttcacatcggtttttatacaaaaccgatgttaacttatacattaccatcgattttctataa

SEQ ID NO: 68415 - DNA, 525 bp, Glycine max
  Peptide Sequence Number=SeqID_185193
atggttgcttctaatcctgcttccacgtcttcaaatgtgaatttcaccaacaaaccgctcatctcatgtgaaaaattaatcgagacaaccaactacaacacatgggccactattggtcagctttggttccaagaccaaggccatgctgatcacttgaccactcaggtcccttactccatcttgtaccctaaacaagctttatacactgtccctctcggtgtctttggctacacttgttacgtccatgatcttacactagaggttcaccctggtattccacctattgttccaacctcaactgttgcccctacaacacctcctctaatggtctaccacagacatccacaatctccaacagcaatgtcatctcctgatccgccagcatcatctcctactccaacctcccctccaccaacgttgtttgtacctggccttcccattgctcttagaaaagtcatggctgatccacgatggcaacaagcgatgttggaggaaatggttgctttaggcgcaaggggaacttag

SEQ ID NO: 68416 - DNA, 777 bp, Glycine max
  Peptide Sequence Number=SeqID_185194
atgtcaggcatctgtgatgaagcggggggtatatcccttgcgaggatttctctggtggattacgtggatatacttactccctattgcttcccaaggatgatttacaatgatggtcgatcaaccagagtgaccaatgccccaactatgttcatggactacatgatgaatcaaattttccatgaatacttagataagtttgtggtagtcttcatcaaagatatcttggtatactcgaagaataaagaagaacacgaggagcacttgaagatcatgttgactttgcctttgactaagttaacacacaaggaacaacctttttggtgggcagaaaaatatgaacatagtttccaagagctaaagaaaaggttgacaacaacacctattttgattcttgtcaacccaacaaagaaacaactgaagacgcttgaagtcaactatccaacgcatgatttggaaggaaaatttggaggcattatctctatggcacaaggttcaagaaagcctttacacgcctcaatgatgatggtgaaagagatagaattgataaacaagttccgagacatgaatctagctgtcaaggaaacacaaaagagcatgttcgtgggaatgctcaagatctctaatgatttcttgaagatgctcaacgagaacaccaatttttgcaaggaaacctggaaaggcaatgagaaggaaaatcttttcacaaaggatctgacggaatcattcattttcaagaatgaatttgtgtacctgataacaaggagcttagaaagctag

SEQ ID NO: 68417 - DNA, 438 bp, Glycine max
  Peptide Sequence Number=SeqID_185195
atgaaacagcttccacaacaaggccaatggacaaaccaagttcaactacaacaaactaattcagctttacctagagttgatataatgagtaatgacattagaagaactcaaagccaaaccaagttcaactgcaacaaactaattcagcttatgctcaaccaaagcaaagagagctattttaggctttcaagattgctccccaatgatgtaagccatgtctccacagctccacaagggtctctagggtatcttgacccaaaaggagaacttcagaacgaactcaaacctatttactcaagtacaactagtacactttcaaattttacaagaagttgttgcagagctaagggccctacttccaacagctattttcttggggacatttcaaacttgaagcaagcttttgaagaaagagaagaagagacccaactgtcataa

SEQ ID NO: 68418 - DNA, 369 bp, Glycine max
  Peptide Sequence Number=SeqID_185196
atgggtaggagacaatgcaatattcgcttcatggctgccaacattcccgaaggacgtggcactcatgttcgtccttttgtaaagctaaacattgacggaagttcttctggcaactcgagtactactaatttttggggcgtgatttgtgatcatatgggcaactggatctctggtttctcgaggaagcgtgggtgtaggcattggatcttcttcatcaatggaatctattgtttcttgaagatcaatggtagtggaatggagaagtcacagtatgcatcttcccacttatcggacctagcagaggaagctaagcctaagggagaccttgttgcaatagaggtagttaaggctgaagccaagaggatggag

SEQ ID NO: 68419 - DNA, 1327 bp, Glycine max
  Peptide Sequence Number=SeqID_185197
atcattagcaaaagaggagctcactgttgcctgccgagctgcctggaataactttcttacggacttcagtaaacactatgctgagttccaagctgctgttcaagcactagctgctttagattgtctgcattcacttgccattctttcaagaaataagggttatgtttgcccagtgtttgtagatgatcatgagcctgttcagatacagatttcttctggtagacatccgtgtacagaacctgaatactctaccctcaacttttggggttgctatacttttgactttgactcagttgattcaagttcctcgttgttgattggtaaccggaggcttattattgttggttcctttgtaccagcatcatcagcaaaattgcatgtcctggataggatctacacccggatgggtgcatctgacagtattcagctagggagaagcaccttcctagaagaactaagtgagacttcgcatatactcaatagttgcacagaacattcactggttatcattgatgagcttgggagaggtacaagtacacatgatggtatggccattgctcatgcgacattgcattatcttctgaagcaaaaaagaagcatggtcctctttgtcactcactatcccaagattgccagcctggcaactgaatttcctggctctgtggcagcatatcacgtgtcacatctgatctcacatgatgcaagtaaaaattccaacttggatcatgatgtcacttacctatacaagctagtacctggtgtttcagagaggagttttggatttaaggttgcccagcttgcacagttaccatctcattgcatcagtcgagctattgtcatggcttctaaattagaagcactagtaaacagtagaatacatggtagatcaacaaaggagctattattggacacgctggtgattggtcaagaaaaagaacagcttatggctcaatcacttgatcgtccacataaagagtttgatatggcttacaaagatttctatttaaacttaaaagctgcaacagaagatgatgactgggcaaaaagctttcatctattggaacatgccagaagcattgcaaagaaattaattggcaggctcccttggtcattctgtgcggcttatggtcgtcctcaggctcagggtgaccctcgtagtgtttctttgggctttgtaaaatattttctcgaatttaactggtcactgattgggctaatagaactgttagtaggtaaaatgtctatttctccaaagattaattggttgaaaggaccaacagtagctcatgcaaaggaagcttcaacccaaagtttcgaacggtgttaa

SEQ ID NO: 68420 - DNA, 168 bp, Glycine max
  Peptide Sequence Number=SeqID_185198
atggtgtcgtcgcaggttgtgaatacgtacccgttgtcgagctacacgttcggcacgaaggagcccaagatggagaaggatacctccgtcgcggatcgtctcgctcgcatgaaagtcaaggagggaaatagcgacccaaaggggaaggaactttcactggagagttag

SEQ ID NO: 68421 - DNA, 1113 bp, Glycine max
  Peptide Sequence Number=SeqID_185199
atgttattgctggattttgctggacctgcctcaaatgttcgtgtggagcgtttttcacgagattgcttcattgatgggggtgctcttgctgaagttatgaccttgtacgagaacatgcacatagacagtccatcagattcaatacaaagcaatgatttgactgagaacagaagtcagaagttaataatcaaggaggtgatgaacatgccagatttggctgtccaagctttggccttaactattcgtcatttaaaggaatttggttttgaaagaattctgtgttcgggagcttctattaggcctttctcaagcaatacggaaatgaccctctcagccaatgcacttcaacaactggaggttttaaaaaataacagtgatggatctgaaatcggttctttgctgcaaattatgaatcgtactcttactatatttggctccaggcttcttaggcattgggtatctcacccattgtgtgatcaaaccttaatttctgctcgtcttcatgctgtatctgaaattgcacagtccatgggatcttgtaatagtgtgaagaatcttgtacgtgttgaggaagatcctgacgtagcaattgtgcaacctgagttagcatacacactttcactggttttgacaactcttggccgagcacctgatatacaacgtggaattactagaattttccattgcactgctaccccatctgagtttgttgcagtaattcaagctattttgtctgctggaaaacagcttcaacaacttaacataggagaggggaataataacacattgcgccctaatctgttaaaaaagttaattttgactgcttcctctgacagtgttattggaaatgctgcaaaaatgttgtcatctttaaacatagactctgctgatctaggagatctaacaaaattgattattgcatctgagggacaattcccagaggtcattagagctcgggaggctttcaagctggcagtggaacaactagattcaatgattgacttctatcgcaaacagcttggaatgaaaaatttggaattcattagtatttctggaacaacccatttgattgagttatcaactgatgtaaaggttccttcaaactgggtcaag

SEQ ID NO: 68422 - DNA, 696 bp, Glycine max
  Peptide Sequence Number=SeqID_185200
atggttacagagcacggcatcaaattcggcgtccacctgatcaccaagcacttcggcaagatcgttgctaaagtatgcgaaaagctatttagccatggacctctcactttggatcagttggttcgctacactgactttactaaggaccaagtcagaaactccctacttgtcttagttcaacacaattgtgcccaagcatttgtttctgctcctcaagatgatgatgatgatgcagacagactgagagttagaactcagtacctggtgttgtttgataacataatccatcggctgaggtttcccaaattcttggacattgtgtcgcggaagcttgatgaagaatgtgtgaagctgcttgtcggattgcttcgtgatggtaggcttaccctcaaacaaatggttgacagagaaagccaaggaaaaggcaagtgttttgtgatgcataaaactactactaggaagccgggtgctaagtctgccaagatagcagcatctacactggtagagaaaaggaaagcttcaaagtttctaaaagagttatggaaggataactacttgcataagaagacagtacctgtgacgggaggcaggccatcaaatatttgtatgtggaaagttaataagcctctgctttggaaatatgtactggacgagatgtaccatgctgccttaaatttgagcctaagaatgacttag

SEQ ID NO: 68423 - DNA, 498 bp, Glycine max
  Peptide Sequence Number=SeqID_185201
atgtatgagggtgtgacaataagattgttaactttcgacctggtggtcatgacttgtgaggtacaagagcacaatcatcctcatatacttcttctgcaaattggaaacacattctgcaaactcccaggtggtcgtctcaaaccaggagagaatgaaaatgagggcttgaagagaaagttgactagcaagcttggtgctaattcaccagctcttgtgcctgactggcagataggtgagtgtgtagcaatctggtggaggccaaattttgaaaccataatgtatccatactgccctcctcatataacaaaacccaaggagtgcaaaaagcttttccttgttcatttatctgagagggaatactttgcagtgcccaaaaatttaaaactactagctgttccattgtttgaactctatgacaatgttcagagatacgggccagttatatccaccattcctcagcagctatccagattccagtttaaaatgatcactaattga

SEQ ID NO: 68424 - DNA, 150 bp, Glycine max
  Peptide Sequence Number=SeqID_185202
atggctaccattcagcattggcctcttgaccagctggacatcaaaaatacattcttgcatggtgagttgcaagaagaagcttatatggatcaaactcctagttttacagcttcaaattcaacttataggtcaagtgtaacccaatcatga

SEQ ID NO: 68425 - DNA, 312 bp, Glycine max
  Peptide Sequence Number=SeqID_185203
atggagaaattaatgaggatgtcatgcataggatacaatgagatgactaaaatggagaaatgcatcgggggatacgaaatgattgtatatagaggaaagattggtgtagcaccaattgaggaaaacataatggagaatcaactaaggtggtttggacatgcacaaagaaagccccaggaggtaccaatgagaagagtagattgtagggtttttagtcctatgaagagaaggagagaaaggctaaggacattggagaaagtggtcaagagggatttcgtggtaaataacattgctgaaactttggtcttttaa

SEQ ID NO: 68426 - DNA, 661 bp, Glycine max
  Peptide Sequence Number=SeqID_185204
aggactacacgtcctcgcctttagaggactacacgtcctcaccatcagaggactacacgtcctcaccatcagagggctgcacgtcctcacctttagaggactacatgtcctcaccatcagagggctacacgccctcgcctttatagggctacacgccctcaccttcagagggttacacacccttatcttcagaggactatacgtcctccccatgagagaactacacgtcctcgccttcggagggctacacgcccttgcctttagaggattatacgtcctcgccatcagaggactacacgtcctcgccttcagaggacttcacatcctcaccttcagagggttacacaccctcatcttcagaggactatacgtcctcccctttagtgggctacgcgccctcgccttcagagggctacataggattacaagtcctcaccatcagaggactttacgtcctcaccttcagaggtcttcacgtcctcgccttaagagggctgcacaccctcgccttcagaggactacacgtcctcaccttcagtggactacacgtcctcaccttcagagggctccacgccatcgccttcagaggactacacgtcctccacttcagaggactacacgtcctcgccttcagagggctacacgctctcgccttcaatag

SEQ ID NO: 68427 - DNA, 664 bp, Glycine max
  Peptide Sequence Number=SeqID_185205
atggcccgcacgaagaaaacaggggagatgacgactgaggccgcaaaggaaatcactgagaagatcgatgttctcaccgctgctattggacgtccagagcaccttggacgtgtccgtgctgttggagccggtgtcaccatcaagcaatacttcagattggctccacggatgtcccacagctcttccttcctgcctcctgaagaattgaaacagccagatgcagtcccagtttcagtcctagatgcaatctcagagactagcactgccttcggagcctctggaaacaatcctgagacgggtgactcagataggtgcggcttgtatatcgaagcaaatcctgcccgcctggttgcccaagggagagtttatgagagatccactattgttcataaaactcctttgttgcctggccaagtaaaggtgggcaattcacaccttccttgcttgaccgacacatctggtcaagtctttatcacaacagcaaaaccacctcaaaagccggatccagaggttgatgatccgctttatctgatgacattgaccatcccagtgcttttcttgaggccttaccaggttacatgggatgccaccgtgtttggggtctttaatctagacttcccgctctacataaagcacgaagacctctccgaaatcgcacacagcg

SEQ ID NO: 68428 - DNA, 852 bp, Glycine max
  Peptide Sequence Number=SeqID_185206
atggggtaccagccattggaaaagggaaaaccaaaacataagaaggggttatggtcacctgaagaagacaacaaactcagaaaccacatccttaaacatggtcatggctgttggagttctgtccccattaaggcaggcttgcaaaggaatggaaagagctgtagattaaggtggattaactatctaaggccaggattaaagagagggaaattcagcaaacaggaagaggagacaatcctcacccttcaccacatgctaggcaacaagtggtcacggatatcacagcatttgcctggaaggacagacaatgagattaaaaactattggcattcatatttgaaaaagagagtggccaaagctaaggaaatggaatctcataaccaaattaagtatgctagctcaagctcagatactatggactcttcacattctctccaaaatcttgcaactcaatgcccactgaattataacttcaccaaagaggcttctcaaagttccttaccaaaactgttatttgctgagtggctttcactggatcatttaaactctgcaaattcagttgactctttgggtttgaggaatggatttgatcaaaattcatcttttcatgaagctgcaattcatgacatgtcagaggtaccctttggtggagagtataatagatgtgtaagtaacatttcagcccctgagatgttcaattcacagcttaagtatggaaatcaaatggtggaaaatggttacattcattgtatgcctggggttgacttaagtagcaatttcagcataagcaatgatgcaataatagctgctactactgatggttgcaaaatgctaaaggttcatgccacctaa

SEQ ID NO: 68429 - DNA, 387 bp, Glycine max
  Peptide Sequence Number=SeqID_185207
atgtttgatggtcgtcctagtcatactcttatggatcctaacgtgaagcttctcccaagtcaaggggagccattggaagacttggaaagatattgttgtttggtggccaaacttaattacctcactgtcactagactagacatcatttttgcagtcgttgtgcttaagaaaggaaaggtcaaagttgtttgctactctgatgttgattgggcaagatcaccatcagacaggagctccacttctagatattgtgtccttattagagggaacttgatctcatggagaagaaagaagcaaaaaaccattgctagatccagtgccaaagttgagtatcatgccatggaagtagctacatgcgagatcacatggcttaggaaacttctctaa

SEQ ID NO: 68430 - DNA, 417 bp, Glycine max
  Peptide Sequence Number=SeqID_185208
atgtttttgccatatttccttgccaaaaaagtcacaatttctttgtcagatggtataatcgcaaacattagcagacaatacattgatacaagaactcaggccaacctatcaaaacttaacgctaaccggaaacaagatttagatattgccactgaagacatttacaaaattttagaaaggaagagaaattcagaaacaatgagaagattaccggttactcctcaacctgaatccacaatatggtgctccccacaacttgagatggtatccatctccggtgtgaggggaaaaaataaaggtatggagtggcccattgccatcccttccccagcacataatccagggaaaacagagaaagagagatacagattgaagaaaaactctgatttgtcacggaatttctactctctaccttga

SEQ ID NO: 68431 - DNA, 183 bp, Glycine max
  Peptide Sequence Number=SeqID_185209
atggtaaagagacctgcttttgttgatgctgcttgcatgttcgctgttcttttaactgttaagaaacctgtctttgtcctgtttctgtggctgatgtatgcagtagatgaaataaatggcagcaacagtgaaccagataagcgtgaagaatctacaagcgggtgcatgttgaagttgctatag

SEQ ID NO: 68432 - DNA, 414 bp, Glycine max
  Peptide Sequence Number=SeqID_185210
atggttaaggtaactatagttggaagggtaagcgatggattgcctctagcacaaggactgagatacatgaatgaagagtatggatatctttcatgttacaggcaacaagcagagttcatactccgagaattttcaaggggagcattaacagctcccaagatgactattcatattgataatttctgcttcaactacttggtcgagaacggagttgttttcattgtgttgtgtgagtccacgtacccaagaaaactggccttccattacctacaagatatacaaaaggagtttgagaagtttgataaaaccctcataggcaaaatcacaaggccatacagctttgtcaaatttggtaattcccttgaaccattagtctgccacaatgatatatcattgtcaagcaattggtgttaa

SEQ ID NO: 68433 - DNA, 162 bp, Glycine max
  Peptide Sequence Number=SeqID_185211
atggggtcagaaggggagcttggacacccgaagaagaccaagctttggttgactacatccagaaacatggccatggaagttggcgttcactccccaaacatgcaggtattagttagtgaaaactttgagcttgctcttgaatcaacttcaatctcaatgtga

SEQ ID NO: 68434 - DNA, 936 bp, Glycine max
  Peptide Sequence Number=SeqID_185212
atgaagaacaacaacaacaccaagctcatcctcctccacaaacaaaccctaacacccaacaccgccgcttcaacactcttctcttcccaccgtctctggctctttttcttcttcctcctcttctccaccctcctcttcacctggaccctcatctcaaccacaatctcctccacttcaaccagctcctccgccgttacctcccctctcccaccctccgtcacaaaggcactcctccactacgccgccgccgccaactcctccaccaaacccatgtcccccgccgaaatctccgccgtctccacctccctcctccgcctccccccgcgccccaacctcctcgtcttcggcctcacccacgagtccctcctctgggccgccctcaaccaccgcggcggccgcaccgtcttcctcgacgagaacgaatacgccatctccaagttcgagtcttccaaccccggcgtcgaagcctacgacattcaattcacgacgaaagtcagcgaatacccaaaactcctctcccaggcccaatcccaggcccaaaacgactgcaggcccgtccagaacctcttgttctccgaatgcaagcttgcaatcaacgacttacctaaccacatctaccaggttgcgtgggatgttattctcgttgacgggccaaaagggtattttccggcggccccagggcggatggcgccgatcttcacggcggcggtgcttgcccggagtaaaatatccggcggcgagacccacgtgttcgtgcatgacttcgggagagaggtggaaagggttttcagcgaggagtttctgtgcaaggaaaatttggttgagttggtggattcgttggggcacttcgttgttaagagtgaggctcacgacggagaaagcgctgttttctgtaaaaactcgtcgtcgaaggttgtcggcgacgaagaggactag

SEQ ID NO: 68435 - DNA, 1136 bp, Glycine max
  Peptide Sequence Number=SeqID_185213
atggtgtctttggtaccagatgatgttgggaagccaacagtgaaactagagaaaactgctgtccaagatgggacctgctcatgggagaatccagtttttgaatcagttaaacttgttagggattcaaaatcaggaaaaattcatgagaaaatctaccatttcattgtttcaactgggtcttcaaaatctggctttcttggggaagcctcaattgattttgcggattttgttgcagaaaccgagccaatgactatttctctacctctaaagtttgccaattcaggcatagttttacatgtgactattcagaacgtcgaaggatatgctgctgaaagaaatggggaagataatgaagccgagggactttacagtgaaggaagcttgaaacaccagctgagctatggcagtacggatcatgaaagttataatgttgatgaaaatggggacgcggcaaggaccagatctgagtattccgaacaagatgcatccaatggcatcagtgctgtggcagcttcatgggaggatccgtatagcttcagacaaaattcaattccatcaagaggaactgttaaggccattgcaactgaaacccaagtgcataagaggtcaaacacaaactggtcaactggttcagcatcagatggaagtttaggtgactggactaacagcctggaagagagtattccaagagaaagattacaagagccttcgaataattccactgatagcctccaaagtgaaattgcttctttgaagaggcaggcagaagtatcagaaatagagttgcaatcacttcgaaggcaggtagaaaaagaaagcaataggggacagaatttgtcaagacaaataatcagtctcagagaggagagagatttgctcaaaaccaagtatgagcaactcaagtctcagcagaatttcaacaatgagagcaaaaccacaaaaaccttgaagtctgagattgaagatacaaggcttcagttagaggcaataaaggatgagcttgtttatgaaaaagatatgaaggccaatctccaattgcaattgcggaagactcaaaactcaaactctgaattacttttggctgtgacagaccttgaagcaatgctggaacaaaagaataatgaaatattggatct

SEQ ID NO: 68436 - DNA, 1100 bp, Glycine max
  Peptide Sequence Number=SeqID_185214
agagcatgatgatgccacagaattagatctcttaaggcgaaaaattgcagaccaggatgatgaaatagacaattactacaagcaacatgaagagctaagtgagcaaataaaagaactcaccttagagtatgatcttcttaagaaggaaaatgtggatatctctttgaggttaaagcaagatgaagcacaacacatcaagttacagaatgagcattcgtcttctttggttacaatacaacaacttgaatcccaagtagagagattggaagaaaagctaaaggtgcaggaagatgaattttcagcatctctgctctgcatcaaggaacttgaaaatgaagtcaaatctttggagaaagaactgaaactacaggcagagaaatttgaagaagatcaccatgctatgcaatgtgcaaaaactgagcaggaacaacgggtcatccaagcagaagaggccttgagaaagacaagacacaataatgctgtcgcatctgagcgtttccaggaggaatatagattgctttctgttgaaatgtcacaaaaagttgaggaaaacgaaaagatgactattaaagcagttgcagaagctgatgaattgcggcaccagaataaacttatagaagaaatgctccataaatgcaatgaggagctcaggcttatcacagatcagaatgaattgaaaatgaaagagcttttgaaccaaatggattctaaagccgaaacaatagaacagatgtcgcaagaactagaagttaagtcgaaacaacttgaggatgcacaaaggcaaaaggatgaaaagaatgcttcattttcaaagcaaattcaaatgctgggatctcaaattaagatgttgatggcagatggttcattgtctgaaacgaagctaacaaagaacacgactgagacccagaaaggacaacgatttatgacatcaaatgatgaggagaagatgcttgtaaccctactgtcggaagtagaaacctttaagaaccagcacaatgaaataaaacaaagtttgcgcaaagaacaagtggagaaagaaaatatgaagaaacagatatctcaattagaaggagagctgaagaagaaggaagcagagttaa

SEQ ID NO: 68437 - DNA, 1617 bp, Glycine max
  Peptide Sequence Number=SeqID_185215
atggattcaagagtagttcaaagtgtagtgcatgagaacgatgaacattacccccacattgttgccttagagcaagtgacacacggtgcagaagaagaccactttgatcatgagaagaagtctgttctgaataaggtcaaggcaaaggctaagaaaattaaggacacgattaagaagcatggccatcaagtgcttgatcgtggtcatgagtataacaatgaagatcagcatacccttgatgatcatgacttagacgaggatgatgaaatggctgaagacccacaagttcataaaacaccaattcacgaaagtgaagatgttaaaactgcaacacctacatctgagcaagtcgaaaatttggggaagtcaggaattgattctggaggcacaagaggtacaacagttatgggagaggaaccccgtcatgatgcactacttggaggtgtttcttcaactactgaaattgatcaaaacatagccactgactcggccaaaacattttctgtggaagaaaaggcagggccaccaaaggacaatttggagaagtcaataggcttggacttggaggaagagcctcacgctccaggaagtagacctgaggcatatccccctaccaattatcaaaccaaaatcactgatccaagtgtgataggaaaggatgaaatagaagaaatcacaccagttgaggaatcttttgcaaaaatgaatatgcatgatgagccaaaacctactccagaaccaaatatccaagcaactgttgttgattctgaataccctcctgttggaaaccacgatcagtttgtgccacacctctctgctgcaacacaaactcagtatccttctgctgaaagtcatgatcagttcaatcaggaaacaacatccacaaatatcaacagaaacctggtaaatcccacagaaactggacaaactttcaacaccatcacaaccacaattgaagaaaaaccactctatgaagcaaagactgatgaagttatctctcctaaagatgtcatagcttctgaggctggttcaggagagaaagatgccataaaggacaaggtggtaacaaataaagagcaacaaaaaattggggatgcttctaacatgtctggctcaactgcacaacatggaaagaacattgctcactctctgactgagaaattagctccagtttatgataaggttgcagtggtaggaagtgcagtgaagtccaaagtgactggaactagcactggtggtgttggaactgagacaaagaatgaggtttctgtgaaggactatttggctgagaagctaaagcctggtgaagaagacaaggcactttctgagttaatttcagaagctttacataagaaaaaggaagagccagtgaaaaatgaggatggaaacttggatgacggcaatgataaaatgtgtgaagagatcagtgtgaagagtccagggaaaggtgtggttggcaagcttaagggtgttgttggctcttggtttggcaaagccgaggaaaaaggaggtgaagatttatccaagaatacaaattctggtgcagaagtggaacaggttcaccaggttgtaggtgaaatcaagagtggtccaattgaagaacaagggactggctga

SEQ ID NO: 68438 - DNA, 1404 bp, Glycine max
  Peptide Sequence Number=SeqID_185216
atgaattcggtaacccttttaggttcaaagagggtccataaatgttcccattctttgattattttgcggagattatgtaaccatccgtttgatggtgatgggttcgaatttattgaggaacctttgaaaaaactgggttcagattatgattccaccgtggatgaaaggctccatgtgaacgaggattggggttttaagcaaaagcaattctcacttagaaaaggattcttagaaactgttaagttagatgctaagagggtccttgaggttctccggcaagatggtcccggtctggatgcgaggttggttttaggtgagttgcatgtaaggccatcagggcttcttgtgagggaggttctctttggaattttgaagaacataaattgtcagaataagaccagtcagcaagagggttaccagcacactgtgaatgcgtatcacctagttatgagcatatatgctgagtgcgaggagtttaaggcattgtggaggttggttgatgagatgattgagaaagggcttccggctactgctcgtactttcaatatattgatccgtacttgtggtgaggcaggattggctaagaatttggtggagaggttcataaaatcaaagacatttaacttcaggccttttaagcactcctacaatgcaatcctgcatggtcttcttgttttaaaccagtacaagttgattgaatgggtttatcaacagatgttgcttgatggatttccttcagatattttaacttataatattgtcatgtatgccaagtacagactaggaaagttggatcaatttcacagactgcttgatgagatgggtagaaatggattttctccagattttcacactttcaatattcttcttcatgttcttggcaagggggacaaaccgcttgcagctctcaatcttttaaatcacatgagagaaatgggtatagaaccaacggtgcttcatttcactacattgatagatggactcagcagagctgggaatctggatgcttgcaaatacttttttgatgaaatgataaagaatgaatgcaggccagatgtggtggcttacactgtaatgataacaggatatgtagtggctggtgagattgagaaagcactggaaatgtatcaagatatgatttctagagaacaagttccaaatgtttttacatacaattcaataattcggggattatgtatggcaggaaaatttgatgaagcgtgctcaatgctcaaggaaatggagaccaaaggttgtagtccaaattctgttgtctataatacattagcgagttgtttgaggaatgctggaaagactgccgatgctcatgaagtgataagacagatgacggagaaagtgaagcatgctgacatacattcaagattcaaaggacataaagcttag

SEQ ID NO: 68439 - DNA, 393 bp, Glycine max
  Peptide Sequence Number=SeqID_185217
atggctgttattgatgagtgtaaattaaagttcctggagctaaaggcaaagaggaactaccgtttcattgtgtttaagattgagaactatgaagtggtagtggagaagcttggaagccccgaagaaacctatgacgactttagtgcatctctgcctgccaatgagtgccgctatgctgtctttgattttgatttcaccacaaatgaaaactgtcagaaaagcaagattttcttcattgcatgggctcctgatacatcaaaggtgagagagaagatggtgtatgccagctcgaaggacaaattcaagagggaacttgatggcattcaggttgagttgcaagcaacggatcctagtgagatgagctttgatatcataaaagcacgggcattataa

SEQ ID NO: 68440 - DNA, 603 bp, Glycine max
  Peptide Sequence Number=SeqID_185218
atgctttctgattcaacttatgcttcaacttataaaatcagcattccctttgaagcagcaggccctgaattacatcataagagttggatgtatgttattgatctttcaagtaacagtttgtctggaacagtgcctttagagatatttatgttgaccagattacaatccatgaatttgtcgcttaaccaattagttaggacaataccaaaagaaattggaaacttgaaacagttggagtccattgatcactcaagcaataacctgtggggagaaattcctcaatccatgccgggcttgtcttttcttagtgccttgaacctgtctttcaacaattttgggggggaaaacccatcacggactcaaattcagggatttacaaatcttagctatataggtaatcatcaactttgtggacctcttacaaagatatgctcaaaagatgaaaactcccacaacacaaagccgattgtagaagatgaagaagatgatgatacatctgcattttgttcattgttctatatggacctcggaatcggatttgctgtggggttttggggagttttgggtgccattctcttcaacaggaaatgcaggcttgcttag

SEQ ID NO: 68441 - DNA, 1008 bp, Glycine max
  Peptide Sequence Number=SeqID_185219
tagattcccaaatccttgaaactccatcaccaccacccgatccaacctcactggtccccaacattttaaacttcatagaccagaggctcgcacaggtcttcccaatcatccaaaccttcaagaacacaataacctcagaccctcgtggagtaacatcaacatgggttggtccaaacatatgcaactacacaggcttctattgcgacaacccaccggacaacctcactgccacaaccatcgcctcgatcgacttcaacggctttcagctcaccgctccaaccctagatggcttcatcgaccaactccctgacctggctctcttccatgcaaactccaacaaattttccggcatcgtttcgccaaaaattgcaggactcaagttcctctacgagctcgatttgagcaacaacttgttctctggggcgttccccacatcggtcctcaacatcccaaccttatccttcttggacattaggttcaactccttcagcggcacattgcccccacaaattttcatgcaaaccttagacgttcttttcctcaacgacaacaatttcatgctgacacttcccaacaacctaggcaacgccccagttgtttatctaacattagccaacaacaaattcaccggccccattccacgtagcattggcaaagcctcgtccacgttgatcgaagtgttactattgaacaaccttttaacaggttgtcttccttatgaaattggtttcttgaaaaatctcacattgtttgatgttggtgggaacctcttaactggtccaattccatggtcatttgggtgcttgaagaaagtggagcagcttaacctagctaggaacttcttgtacggacaggttccggaagtgatgctgattcaaaggggtgttcttgatgtgaggaagaactgcattttcgggcttccggatcagagatcggtgagggagtgcatggcattctttttgattcctaagtcttgttcgcaccctgcgttgtttaacttcgtaccgt

SEQ ID NO: 68442 - DNA, 1263 bp, Glycine max
  Peptide Sequence Number=SeqID_185220
atgcgtgagattcttcacatacagggagggcaatgcggaaaccagatcggagcgaagttctgggaggtggtgtgcgcggagcacgggatcgattccacggggaggtaccagggggacaacgagttgcaactcgagcgagtcaacgtctattacaatgaagcgagttgcggaaggttcgtgccgagggcggtgctcatggatctagagccagggaccatggacagcgtcagatctggtccctacggtcagattttccgacctgataacttcgtcttcggccagtccggcgccggaaacaactgggccaaaggtcactacaccgaaggcgctgagttgattgactctgttctcgatgttgtcaggaaggaggcagaaaactgtgactgccttcaagggtttcaggtttgccactctcttggtggtggaactggttctggaatgggaacactgttgatctcgaagatcagggaagaataccctgaccgaatgatgcttacattctctgtgttcccatcccctaaggtttctgacacagttgttgagccttacaacgcaacattatcagtgcaccagctcgttgaaaatgcagatgaatgcatggttttggataacgaagctctctatgacatatgcttccgcacccttaagctcaccaccccaagctttggagatctgaaccatctaatttcagccaccatgagtggtgtgacatgttgtcttcgattccctggtcaactcaactcagatcttcgcaaactcgccgtgaatctcattcccttccctcgtctgcacttcttcatggtggatttgccccactcacttcccgcggttcccaacagtacagggctctcactcttctgcgatgttccgtggaagatgagcacaaaggaggttgatgaacagatgatcaatgttcagaacaagaactcatcgtacttcgtggaatggatccccaacaatgtgaaatccactgtctgtgacatccctccaactgggttgaaaatggcatcaaccttcattggcaattctacctctattcaagaaatgttcaggagggtgagcgagcaattcacggctatgttccgcagaaaggccttcttgcattggtatactggagaaggtatggatgaaatggagttcactgaagctgagagcaacatgaatgaccttgtgtctgagtaccagcaataccaagatgcaactgctgatgacgagggctatgagtatgaagatgaggaagaacctcaggaagatgaggcttaa

SEQ ID NO: 68443 - DNA, 1545 bp, Glycine max
  Peptide Sequence Number=SeqID_185221
atgcagcaagctccaaccacactcaccggattgctccatcgcgtcgccggaatattcccctcccgccgcgccgtctccgtctccggcaagttcgacctcacgcactcccgtctccaccacctcgtcgaactcgccgcctcgcgcctcctctccgccggcatcaaacccggcgatgtcgtcgccctcaccttccccaacaccgtcgagtttataataacgttcttggccgttattcgagcgcgagccacggcggcgccattgaacgcggcttacaccgccgaggagttcgagttttatctatctgactcagattcaaagctgttactaacctcaaaagaaggaaacgagccggctcaagccgcggcttccaagcttaacattccgcacgcaacggcatggctcgcggaagccgaggagctgagtctctctctgagttccaccgagtcagcaatcgactcggtctccgaaatcgccaacgacgcttccgacgtggcactgttccttcacacttccggcaccacgagccgccccaagggcgtgccgttgacgcagcacaatttggcctcttccgtggagaacatcaagtccgtgtacagactcactgagtctgactcgaccgtgatcgttctcccgttgttccacgtgcacggcctgctcgcggcgctgctcagttcgctagccgccggagccgccgtggttcttccggaggcggggaggttctccgcctccacgttctggagcgacatggcgaggtacgacgccacgtggtacaccgcggttcccaccgtgcaccagatcgtgctggagcgtcacttaaaaaacgcggaaccggtttacccgaagctccggtttatccggagctgtagcgcgtcgcttgcaccggcaatattggaacggttggaggaggcgttcggtgcaccggttttggaggcgtatgcgatgacggaagcctcgcatttgatgtcgtcgaatccgttgcccgaagatgggcctcaccgagccgggtcggttggaaagcccgtgggccaggaaatggtgatattaaacgagaatggtgagattcaaaagaatgaggtgaaaggtgaggtttgtattagaggacctaacgtgaccaaagggtataaaaacaaccctgatgcgaatgattctgcgtttcaattcgggtggttccacactggtgatatcgggttttttgattcggatgggtatttgcaccttgttggtcgcatcaaggagcttattaaccgtggaggggagaaaatatcaccaatagaggttgatgctgtccttctatctcatccagacattgctcaggcagttgcattcggagtaccagatgacaaatatggcgaagagataaattgtgcaatcatcccaaaagaaggatcaaacattgatgaggcagaggtgcagagatttagcaagaagaaccttgcagccttcaaagtccctaaaaaggtcttcttcactgattctttgcccaagactgcaactggcaagattctaaggcgtcttgtagcagaacactttgtttctcaaacttga

SEQ ID NO: 68444 - DNA, 186 bp, Glycine max
  Peptide Sequence Number=SeqID_185222
atgagcttgaacaactttttgttctttgtggcacaaggtctaaatgctcgtcgaggaatggctgaactgaaaagctctggtatcgtggcaccgggacctgtgcacggtgtgcagttcacagctactcctccgattaaccctgtggagctcacaattgaacctgccgttgccccatcaccaaactaa

SEQ ID NO: 68445 - DNA, 489 bp, Glycine max
  Peptide Sequence Number=SeqID_185223
atggcctctaacttcagcttgagaactttgatgatatttgcccttgcattttctctcgccctgcaaggcactcttggagggatagaatgtgagagtctgagccatgacacatgctcattcgccgtgacatctgctggcaaacgatgtgtgcttgagaagcaggtgaagaggactggtgaggaagcatacacatgcaggacatcagagattgaagctgataaactgaaggaccacattgaaactgaacaatgcatcaaggcttgtggtttggacagaaagtcccttggaatctcatcagactctcttcttcaatctagcttcacgcaaaagctctgctcccctatctgctaccagtgttgcccaaacgttgttgacttatacttcaatctggcagctggtgaaggtacacgcatattgatacactcccccatcttaaatataagaaaaaatcacactattttcttaatctcaaatataagaaaagtttaa

SEQ ID NO: 68446 - DNA, 876 bp, Glycine max
  Peptide Sequence Number=SeqID_185224
atggttggggaaggaaagccaagggcagtgattgttggtggtagcatagctggtatattaagtgcacatgttcttactttagctggttggaatgtcactgtgcttgagaaaaccaatgcacctcataggggaagtccaactggtgcaggtcttggacttgaccctctttctcaaagaatcagagtcatggcttccatagccacaactcttccacaacatcactgtaccgctaactatagatcaggtgccaccctctttaaccaggcaattgataatgagaagaaggtcagttggacattggcaagagatgagagtttcaacttcagagcagtacattggtctgatcttcatggtcttctatacaatgcactgccatcaaatgtatttttatggggtcatctttttctctctttccatgttgcacatgacaagggttctgtcatagtaaaggctaaggttctagaaactggcaaggttatagagatagtaggggatttgcttgttgcagcagatggttgtctctcttccatccgccagaaatatctccctgattttaaactcagatatttgggctattgtgcatggagaggggtctttgaattatcagaagctgaggctttagaaaccatcaaggtcataaaaaaggcataccctgatttaggaaaatgcttgtactccgacttgggctcatgtacacacagtggtttctatgagcttctaaacaaaaagatcaattggatttggtatgtgaatcagccacagcctgaagtcaagaaatcaagaaacaaggaatatagagaaagagtaactatatttcgtttattgaaagccaagaaaatacagaaggatagaaatatcctagagctaggctcctaa

SEQ ID NO: 68447 - DNA, 831 bp, Glycine max
  Peptide Sequence Number=SeqID_185225
atggacactgagttgtcctattatcctgacagtgaagtcaacccaaatgctactgggcctagagagtccttgatccaagaagagaaaggtaagaataggtgggggcagggtgaaacaatgccaccaaggaagaacattgcctcgggagaaccagcagctaagaagcacggagacatgagagtggagtttgtagcaggagaggggcaaccgagtacgaagacaggtaaatctggtgggaatccgagactgaaaccagtcgaaggtgatgatttgacgaagttttgtcaattgatgaagaaaattgaactaccgtcattttatggtgatgacccagcagagtggattgcgagggccaaaatctatttcaacgttcaagaaatgcgcgaagctgttcgtgtgagccttgctcaactctgtatggaaggagttatgatacacttttttcattctttgttgaatgagtatgaaaatctgtcatgggaggatttgaagagggagatgttggagtcgtatggtggaaggggagaaggaagtgtttatgatcaattggcatcgttgaagcaatcagggagtatggaggattacattcgtagcttcgaatgtttgattgcccagggattgaaggacgaaattcgtgcgagaatgcgaatcctgcacgttgtgaatcctttgtccaggggacgaatgatgaacattgctcgtgcaattgacgtagaaatctctggacaaagcaaagtgtggcagggaagaggcgaaatatgtggagatggtagggcccaacctggaaaccgacccatttctagtattttaggtaaaactggcccgcggtag

SEQ ID NO: 68448 - DNA, 2562 bp, Glycine max
  Peptide Sequence Number=SeqID_185226
atgattaatgaggagattcgagttgaatgcaaagaaaacaaagaaaatatcgaaggagatgctacagaggatgatagcgatgtcgaaagggcctgtacaacattgagtctttgttcgatgaagaaggagaaggaggaacaaccacgaacgaggaagttgcgaggtaaggtgggtggaattccaatgctgtttctggttgatagtggggcaacccataattttatatcacggaagctaattgaagctctgggttggaagtgggagagaacaaaacaaatgagaattttgatgggggatgggcacaaatctgaaacgcaaggcgtatgtcgtgggattaaggtggagtttgatgaaagggaatttgtaattgatgcttttctctttgaattggaggacatggacgtgatattgggaatgtcgtggttgaccaccttaggggaaaccatggtggattggaaaaatcaggtgatgaaaattaaaacagatcaaggagagaggtggttaaaaggagtaccccgtgaagattcgttgttggtgtcaatgtttggcctattggaggaaaaaggggaaagtgaagaaaatggattgatccaagaacaaagatgtgtcctggatgaggtgttgcagaattttgttgatgtatttgctgaaccaaaggggttgccacttgtatgtgcaaaggaacacaggatcatccttcaaccaaggcaaggtcccattaatgttagaccatacagagcactaaataaagccaccatacccgacaaatttcctcttctagtgatagcagagctcttggatgagttacatggggccaggttcttctcaaagctagatctttgttcaggctaccatcaagtaaggatgagagaggaggatattccaaaaatgacttttagaacacatgagggtcactacgaatatctcgtaatgccttttgggcttatgaatgccccttctactttccaagcactcatgaataaagtctttcgtgctttgctaagacaaggagtattggtggccaacatgtttgctaacaaggaaaagtgcacctttggacaggaaatcattgagtacttgggccacactatatcaatacaaggagttgcagttgatcctatcaaggattacagtaagatagccaaacccctcactgagttgacaaaaaaagacggtttcggttggaatgaaaaggctcaagcagcttttgaggagcctaagaggaagattaccacagcaccgatgttgcaattaccaaattttgatgaagatttttctttggagtgtgacgcgtctgagacaggaattggggctattttaatgcaaaacaagaaaccagttgcttattacaacaaagtgttgagtccccgtaatttaactaagtcagcttacgaacgagaattgatggcgaattggttggcaaagctcttagggtataattttgagataatttataagcctggaaaggagaaccgaggagcttatgctttgtcccgtagtagagatgaaatggaactgaacaatatgatttacttcccagtatggctgcattggcaagaaatcaatgctgaggtgcatgcagatgagaagttgagaaaaataatcgaagaagtgaagaaaggacagggggagaagatcaatgctggatatgtatataaacaagggggagatgtccaacagtttgtccaagcttgtgacacgtgccaaagacaaaaatatgttacatcagcccttagtggtctcttgcagcaattaccaattccggagaggttttgggaagacattagcattgacttcatcactggtttaccaagatctagaggatttgaagcaatcttggtggtagtagatcgtttgacgaagtatttccattttgtgccccttaaacatccttatactgcaaaggctcttgctgaaattttcgtgagggaggatcttatcgagagggatgaagccttaaggcagttgaaatctcatctacttcgagctaaggacaggatgagagctcaagcaaataagcatcgtaaggagaggtattttgttgtgggtgatttcgtatttctgaagctgaaacagaacagacaacaatctgtaatgaatagggtcaatcccaagctgagtgctaaatattatgggccttctgaggttgtggagaagataggggaagtggcatatcgtttgaaattgccaccatctttgaaaattcatccggtgttccatgtgtccttattaaaaaaagttgtggggaaatacaaggtggaggaggttcttcctattgagctgggggatgatagagctgaattaatgacacctgaggctatcttggctactagaatagggcaagttgtggatgaggctacatgggaggatgaggttaccattcacagtcagtttccagaatttggccttgaggacaaggctctatttcaagaagagggtattgatacagacccaaatgctactaggcctagagagtccttgatccaagaagagaaaggtaagaataggtggggcagggtgtatgtgaggaaaaggcctaggaatgatgatgtggcacactag

SEQ ID NO: 68449 - DNA, 447 bp, Glycine max
  Peptide Sequence Number=SeqID_185227
atgtacactttattcacatttccttttattgccaaaccagctagtgctgattgcatctttgcatttgggaccaaaacttttcagggaacctcagtgaccatgaaagtaagtagtgatatgatccaaaaaatgcaccaagaagcagaaaaagtttggactcctgagttgtttaaggttttgaaagaaacaaagaaacccttcttaaatgtcatatatgatggtgaacccttaggagagacattttgggacaatgtggtattggtaggagatgttgctcaccccacaacccctcactgtcttagaagcacaaacatgtcaatattagatgtagcagtcttaggaaaatgccttgagaagtttggagcagaaaaactgagattagctttggaagaatatcagttcatcaggctaccagtaacttccaagcaagttcttcatgctcggtga

SEQ ID NO: 68450 - DNA, 642 bp, Glycine max
  Peptide Sequence Number=SeqID_185228
atggttacagagcacggcatcaaattcggcgtccacctgatcaccaagcacttcggcaagatcgttgctaaagtatgcgaaaagctatttagccatggacccctcactttggatcagttggttcgctacactgactttactaaggaccaagtcagaaactccctacttgtcttagttcaacacaattgtgcccaagcatttgtttctgctcctcaagatgatgatgatgatgcagacagactgagagttagaactcagtacttggtgttgtttgataacataatccatcggctgaggtttcccaaattcttggacattgtgtcgcggaagcttgatgaagaatgtgtgaagctgcttgtcggattgcttcgtgatggtaggcttaccctcaaacaaatggttgacagagaaagccaaggaaaaggcaagtgttttgtgatgcatatgacttttgaaactatgaaaacaaagagtatctttggagtgggtcaagaaaatgctgtgcctacaaaagtggtacgagagacactctgtaaactttggacggctcgatttgttgaacgttgccctgcccctgagccatttgtttctacctcatttaaggatactactactaagaagcggggtgctaagtctgccaag

SEQ ID NO: 68451 - DNA, 258 bp, Glycine max
  Peptide Sequence Number=SeqID_185229
atgaccaaaccacctcagattggtggaacctctacatggatcatccttgaagggaagtggggcaggcacatgaagggaagtggggaagacatcatccttgaagggcctgacaatgtcactttagagaaagctctcaagctcaatttcaaagcatcaaacaatcaagctgaatacaagacacttatagcatgcctaaagctagcaaaaaaagttggagctaagaagctaaggtgctacactgactcgcagcttgtctaa

SEQ ID NO: 68452 - DNA, 446 bp, Glycine max
  Peptide Sequence Number=SeqID_185230
atgggagttgctggtgtattgggcgcggcactactatgcgctattcatggtgccaccgtagaaaatactttatttgaagatgtaactggtttatggatgagtgctcttggggtagtcggtttggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaaccttatattccctgaggaggaaactaccggtttcgcttggtgggccgggaatgcccgacttatcaatttatccggcaaactactaggagcccatgtagcccatgctggattaatagtattctgggccggagcaatgaacctttttgaagtggctcatttcgtacccgagaagcccat

SEQ ID NO: 68453 - DNA, 228 bp, Glycine max
  Peptide Sequence Number=SeqID_185231
atgacgaacaaggccaaaggaaaaggcaaggaggtcgccggaaaaggttctaccggcaagcgcaagggtgccttcgacgatgacaagaccggtggcggtcgcaagagaaacaagcgaggccctgttcgaatgaaccggtctctaatgttattttttttggattctttgacgtgcaaacatgagacaggccacctatggagactctcacgcctttcccagataatttaa

SEQ ID NO: 68454 - DNA, 321 bp, Glycine max
  Peptide Sequence Number=SeqID_185232
atggcctatggtggtgatgaattcgttcatcctgacaatgcggtaccagtttctctcactcggtccggttaccctcggatcattccgtctcatcataggcgtatgattctgaagaaggatgagaaagcggacatgctgatcattactttggcaaagaaggttgataaatcaacgttttctagtataatatccccacccgataatattgacgaggtggtggggctggttggttcgattaaggagaactttaatcgacttatcagtcgctatgctccctggataaaacgtatacccctggaacaaacaagggttacggtttga

SEQ ID NO: 68455 - DNA, 301 bp, Glycine max
  Peptide Sequence Number=SeqID_185233
ccctcttcgctcggtgtatggggtgtgtcataccctaatttcgtccggggacctttgcttgatgacatgcgacctttctttggtccttgtgagaaggctgttgcttctggaggaagcaacctggctcgcctgggcgagctgggcggcaaccacctcccctattttgctataaataggggaggaagtgaagaagaaaaggccgaggcgcttccgaaacgtttccgtaacgttttccgtgaagatttcgcaaaggtttcaaccgttcttcgacgttcttcattagttattcgatcttcaacgg

SEQ ID NO: 68456 - DNA, 370 bp, Glycine max
  Peptide Sequence Number=SeqID_185234
gctagtatgcaagagaagactagctccgtgaagtgctttaaatgtcttggaagaggacacattacttctcaatgccccaccaagaaaaccatgattatgaggggccaagacatttatagtagccaagatgaggttactacttctccttattctagtgaaagtaaagaagcaaaaagggaagaatctagtgatgaaatctacccccaagaagaaggacaacctttaatggttaaggagaagtgtaaggagacacttgttagcattgccacacctcttaggcttgagtttattcctcaagtaaaggagttgttggatgagggtttggttcgcaagagcttaaatccttgtgctttgttggtgcccaaaatag

SEQ ID NO: 68457 - DNA, 564 bp, Glycine max
  Peptide Sequence Number=SeqID_185235
atggcctccaggaagaggaaagccacaacctcccaacctcgggaaccttatgacaccactcggttcgtttctgaggttgcgtcggagcgatattcacagaatgttcactcccggaacatccttccagagagggacgttaacctctttgtgactgtgtatcatgaattcagaagagagctgatcagaagaaactggcataaggccttgactcagcacatagacgggcacattgatgtggccttggtcaaggagttctactcgaacctgtatgaccctgaagacaaatcaccaaaacaagttagagggatgctgattaagtttgatgcgacatcactgaatgcctttctggagacaccaccactcattcagccaggggagcagtacccctcttattctattttttgcaggacgcgcactgatcctcaagagcttgcctccaagctttgtattctagggcgcatgttcgttttaaatgctgaaggagcgccttggaagctcctgaggaaggatctgaatacactagcccagacttggagtgtgttatcatactccaacctcttctga

SEQ ID NO: 68458 - DNA, 351 bp, Glycine max
  Peptide Sequence Number=SeqID_185236
atgggtattggttgtactgtatggtatggcttcgtacctggcgatggtatcaatatgccaattgaaggattaaataccctatttagtcctattgagaattatgatactatctttactaatcctgatgctcatgttataccgggctttaataaaatgactttaattgagggcgtaaataatccagcagcatcgctgtcacaggcatttgctcaagataggcccttcatggatatggatattgaaataccggattctaataaatctattattatcggtgttagcttaggactagcagttgccatcttatttacatttgggattaacccatgctgcggagaagttatagtatga

SEQ ID NO: 68459 - DNA, 405 bp, Glycine max
  Peptide Sequence Number=SeqID_185237
atgcagctgaccgggatcaaagtgcccgattttgccagcgcgcagcgcgccgccgaagtgctgcaccgtaagggcgcgcgtcaggtgattattacgcttggcaccgcgggcgcactgctttccagcacggagcagcagctgcgtattccgctgtttcctgcccagccgctcgacaccaccggtgccggcgatgctttcaacggcgcactggcggcgcgcctggcgtccggcgatgcgttaccgcaggcggcgctgtttgcagcggcgtttgcctcgctgtgcgtcgagcgttccggcgcggccaattccatgccctcctacgccgaagcgctggcgcgcatccaggcccatccggagtgtgaagtgacgccgttaaatgccccggaaataacgcacatggcgtag

SEQ ID NO: 68460 - DNA, 657 bp, Glycine max
  Peptide Sequence Number=SeqID_185238
atggctcctcctgttctggtgcaggcgcgtcctgagcgggtcagggatctcaagtgctttgcgttgctatcatatcagcttcataatctgcgtctgcagcaccatcctcctcatcagagaccttcaatactggtgtcgcataagccatggtggaggctctacaacatcggcactgtgagatctgagctcaaaacggaggtgttggaaggaactagagcttatggtggtggaacagagggaactggtgctagagaaagagcaggagtagaagaagaaggtgctgaagaatctagtcccctagtcctagctttgcgggcccctagaatagtgatcgtgggattatccaggagcgaggttggagtaggaaaggacactccatgtctatgcaagagtggtgagggtctacacgcgtccgacagaagagggaatatgaggtatactgctcctctggctccagaatggggggcgtctctaggaatgtgttcagttcgagtagaattccttgaccagggccacgtcagtgtgaccatccatgtgctgggtcaaggccttgtgccagttccgcctaatgagctcccgacggaactcattatactccgtgacgaaaaggttaacattcctcttcggaagaatgttccaggagtgaatgttctgtga

SEQ ID NO: 68461 - DNA, 285 bp, Glycine max
  Peptide Sequence Number=SeqID_185239
atggtgttttcccctcatcctgcaaagaaaagaattttaagttacaactgtaaatcagcacaacacaagtttcgtgaagctaagcagaaggttgataggaaaaaatggaataaatgcacatcagcaaccatatccaaactatttttggagccatcagaccatttgatgcaatcctaccccgcaagggcattggatagaaaactccaagtagattgggccagagatgcaagagaaggccctagggttcttttgagccttagggtagatttcgggcccatgggctaa

SEQ ID NO: 68462 - DNA, 579 bp, Glycine max
  Peptide Sequence Number=SeqID_185240
atgtatgggctgttagctctgtatctgcttctctgtctgtctgtctctcttctctctctcttgtacagttgtgaaattttattactattccaatgtaatcgagaatttgtttgcagaatgtgttctgatctacttggatccagattcaagtcgtgcggttgttggttaggcttcacaagtgtttttgatagcaatatttttctttatgagcaggttggaggttgcagcatatgtgggggagcccatgaatccagactttgtattcccttagatgacacagctcaagaggtgaattacatggggaatcaaaacaggcctggatttaatgcaagaggatattcaggttaccagcaaggtgcaaattacaaccagaaccaggggcaatggagatcccacccaggaaatcaattcaacaaggaccgaggtggaccatccaataggccacagaaccaagggcctagcctctacgacaggaccaccaagctggaggaaatattggcgcaatttatgcaggtttctatgtctaatcataagagcaccgagtttgccatcaaaaacctagaaatccaagtggggtag

SEQ ID NO: 68463 - DNA, 222 bp, Glycine max
  Peptide Sequence Number=SeqID_185241
atggcccgcaccaagaaaactgggcagatgacgtctgaggccacaaaggaaatcgctgagaagattgattctttggaggagcaggcgtcacagggttcgtttgtcccccatggtcgtcaagatgtcctgactgttgccattgggcgaccagaacacccttgtcgtgtgcgtgctgctggagccgatgtcacaatcaagcaatacttcggctttgctccatga

SEQ ID NO: 68464 - DNA, 219 bp, Glycine max
  Peptide Sequence Number=SeqID_185242
atggcttcctatggtggtgagcttcttgacttatcttctcctttaagtggcgtctccaatcatctttcttccatctccaattccgctgccattgatcttcaagaagcaaaggacttcattgatgaagaagatccaaggcctacaagctctaatggagctacatcaccttatttccattatttccatattttctttattcccgtaattccgttattttaa

SEQ ID NO: 68465 - DNA, 213 bp, Glycine max
  Peptide Sequence Number=SeqID_185243
atggctgatatcactatgatggtaaaagagatcttcgcccaacctattgggaaggagtacgttctgccatctccttgcaatgagattcatacacccattttggagggctacgctgatgatgttagtgatggggagaaggatccttttgtagatgtgagaaatgtgagggagtcatcagggatccaagaagacccatatgaggattcttcttag

SEQ ID NO: 68466 - DNA, 318 bp, Glycine max
  Peptide Sequence Number=SeqID_185244
atggagaccgaacaacatagtttggatcccaagaaagatcttgcaaaatatgttatgccaacaatagagtgtggaggaagcatggagacattaagtactctgtgtggttctttaaacaatgattgtgcacttgaaggagccaccaacaggagcttcaagctcgaggagcctagagcttatgccttgataatcatgtcactgtacgaatctctaaactccattagaaatgtttttgaagaggaggcatccctagcgaagagtggcgataaaaaagtgcctaaacttgtaagtgagtgggtggatacagttgatacctag

SEQ ID NO: 68467 - DNA, 1083 bp, Glycine max
  Peptide Sequence Number=SeqID_185245
atgggagtcacaaagactcttgctcgtgtcaatgaaaatttcacatggattggcattaaagacgatgtttgccagtttgttgccacctgtgtcaatttccaacaaactaaatatgaccactgcaagcaacctggattgcttttccccctgccagtcccttcgagaccttgggaagacctatccttagaatttattggaggattacccgcttttaggggtcacactgcaatcttggtggttatagatcgtttttcgaaaggtctacacttgggcatgcttcagcctcattatacggcatctacagtagcacatttattcatggatattgttggcaagatacacggtatgccacgcaacttggtttccgaccgcgaccctctatctgtaagtcgtttttggcaagagttattcaaatttagtggtatgaagctgcgcatgagctccgcttgtcatcctcaatctgatggtctgaccaagtatttggctggaacatccaacatcgaagcaattgatgatttcctagtcaatcacgaagaaatatttagaagccttgggaagaaaattattaaggcacaacaatctatgaagcacttcacggatagcaatagacacgaagtcaactttcagaagggcgattgggtgcttgtcaagcttcgatctcgccatcaaacctcagtcactggtgctacttattctaagttagccaaacacttttacgggccatttcaaatactccagaggataggtctagtcgcctatcaactacaattaccacctgaatcgcatatccatctagtgtttcattattctcttctcaagccatatcatcaatctcctgacttgggaatgtcccctgacaacacttcatgggaaagttgggacaagcttaaagttgagtatcaccttgaggacaaggtgcttttggaaggacaacgggatgttatgacagaaataaatcagcaacaatgtacacagcaggcaggcacaagtaacattagacaacaatcagacaaagtgctagacacgaatcagaggcctaaaaggaaaatcactaagcctcagcacctcaaggattttgtataa

SEQ ID NO: 68468 - DNA, 948 bp, Glycine max
  Peptide Sequence Number=SeqID_185246
atggacatcgagcagaagcaatcggagctcatcgaccacttcgtcaagcgagcctccgcggcctccgacgccgccgcactcgcgtccgtcctcgtcgaagccacttctcacccttctctcttcgctttctccgagattctcgctctccccaatcttcttcagcttgaagctactgagaattctgcttatcttgatatgcttcggttgtttgcacatggaacatggagtgattacaagagtaatgctgaccgtcttccacaattgatatctgatcagatcctcaagcttaagcaacttacagttcttacactggctgagacatacaagaaaaggggagatattcccgtgagagttgcacatcaggtactaccctatgaccaactgatgcaggagttagatgtgacaaatgttcgtgagcttgaagattttctaattaatgaatgcatgtatgcgggaatagttcgaggaaagttggatcagttgcggcgatgctttgaggttcaatttgcagctggtagggacttgaggcctgatcaactggggaatatgatacagactctctctagctggttgactacatcagaaaatctgcttgtttcaattcaagagaagataaagtgggctgatgctatgagtgaaattgacaagaagcacaggaaggaagtggaagagaaggtagaagaagtaaagaagtccattttcaaggttatcatatgtgaggatttggagtggtatcagatagaagtatctgccttaattatatacacacataattgcctgctgttctttatggttggaatatattggtcgacgtgtcttacttacttcgtggcagaagttacacactgtaagcaggccgacatcgacttcagaggccatgaggagatctgctctgaatctggtggagtgatggattatgaagaagatcgaagccgtccaaagaggtaa

SEQ ID NO: 68469 - DNA, 462 bp, Glycine max
  Peptide Sequence Number=SeqID_185247
atgggtcaggatggcaaaaagtgtggggcggtcgacaaaaacggggcttttgctcctacgtattctcaatttgagatgaggaattcagacctacgtagttctagcgaaagcaatatgaccacattggcctctgcttgtcaatcgaatttggggtctccgaatgacgaggtgcagataaccataaggtgtctccgcatgctaccgaactcttgggtcatgatagcaaaaggtggggtggtcgacaaaagcggggcttttgctcctacgtatcctcaatttgtgatgaggaactcagacctacgtagttctttcaaaagtgagactaaaatagtctcgggcaaggataggcattctcaccctgggtcaaggtttatggtgacttgggattctagctcaaagcttgtagaacggctggacatgatatatgtcagagtgttggtttggccagcggttcaaggataa

SEQ ID NO: 68470 - DNA, 315 bp, Glycine max
  Peptide Sequence Number=SeqID_185248
atgctctcctacaacctaagacaaggtagatggggattacagtttataggctcagggttaaagtcaatcaatcaaactttcagctcaacatgggtgcaagggataatttattcatgcccaagaaaaataaatgaaagtcttgccaacaatcatcctgagcagcagtgggctcatcctgagctggtgcaggctcgccatgaggccagggatcctaggtactctacaccgcctgtagatttgctgcatagtcggtgtccttggctcttgggctgtggaagcctcacctccccccaaaggagaaggctgaactcttag

SEQ ID NO: 68471 - DNA, 231 bp, Glycine max
  Peptide Sequence Number=SeqID_185249
atgatggtggaaggagggggaggtgaggaagctagtgacagtggcaaggacggtggtagaggaggaggaagtagtgttgtcatcgtcaatggtgtagttcacgggcatttggacgtcaatggtgtagttcacgtgtttggacatactaatagcaacaaggattctaatagaattcagacaagaatgacactaccttccttagaggaatcttcaataatagaaagggaataa

SEQ ID NO: 68472 - DNA, 600 bp, Glycine max
  Peptide Sequence Number=SeqID_185250
atgtcaccttattcaccctcgtgttacgcatatgaccttcaccaaaccactacgcaacctaaaccattgtgcaaccttcagatttatcttttcgcattggcttccattgctagctcggatgcctctgctagggttggctttcacaaaggagtggtaagcttggacgaaggtggtgtttggggttttggggtcatgggagaaggaggaagaacgggaaaagaagagaagagaggaagaatgaagggaaaaaaaatggctgcaagcaaatggccacatactatttaccatggccaagcatggaatttctctgagaagttcaccacaatcgtggtcacttcaccacgactgtgggaaaatagcattgtgagagaacttgtggctatgaaggagcgtggagattgcaacagagaagaagatagaggagatgaggttcaccacttcaaggacaccgaacattgtgatgtgaagagtagtgagaccaaggtgttgttaagagacgggggttgcttacagcaaagctatgaggtagtggaagcggtagcagaggaatgcatgacgaagatgaggtataatttggaaagtaacaatatggttagctaa

SEQ ID NO: 68473 - DNA, 1197 bp, Glycine max
  Peptide Sequence Number=SeqID_185251
atggattttatcactggattgcctaactctagtggatttactgttattgtagttgtgattgatggattgacacattatagtcattttgttgcaatgaagtcggattacaccagtaacacttgtggaagcaattccttcaaaggttattttgatgatgccaaagaattcaagaatcaaaagaaagattcaagagaagtttcaagtttcaagttttcaagaatcaagaataatcaagaacaacattcaagactcaagattcatgaatcaagagaagacttaatcaagaaaagtatgaaaagatggtacatctacttgggtttggctgagaacaagagagggtacatctctagtggatcagttctagtggagggtacatccactaggttcaaagagaacaagggagagtacatcccttgtggatctttgcttgccactcgatccaacaacactgtggctgaagcttttatgtgccatatagttaagttacatggtgttcccaagtccatcgtcttagatagagataaggtgttcactagtaattttttgctacacctattcaaaatacaagggactaccttagctatgagctccgcttaccaccctcaaatgtatggacaatcgaaggctcttaataagtgcttggaaatgtatttgtggtgttttacttttgataatccaaaggcttgggctaagttgttggtatgggtagaattctggtacaatacctctttccacaatagtttaggaatgacacctttccagactttgtatagaaaggaacctccagttttacttagatacaatggcaactttcaagatcctccaacagtgcgggaaatttacataaaaaaacaaatgctattggacatgttgaaagggaatttgatcaaagaacaaacaactacgaaaatccaggcggataagaaaaggctagatagaaagttccaagtgggagatgaattgctagtaaaactccaaccatatagacaacattctacagcactgagggagaataaaaaactgcccatgctttattttggtccattcaccaggcttgagaaaattggcgaagtggcttataaattgcagttgcttgatgccacaaagatttaccttgttttccatgtttctcaattcaaacaattccaaggagttgccacaaagccttatgtgtcactaccgcttaccacattttaa

SEQ ID NO: 68474 - DNA, 513 bp, Glycine max
  Peptide Sequence Number=SeqID_185252
atgttgcaacttacagatgatagtgatctttatgaagaaactaaaccacctgacatagacatcactcttgctgaaatgccacatggggcacaccacctatctcttaatgctatgaagggattccagcgtgttggcactctttggtttactggttatattggaaacatttcagtgcaaattttgctaatgcaacatgatagtcctgatgatagtctcattgagttgcatgtggatattgctcctgggatagcgaccttgttgcatacctatagcgtggtttttcaaacgcctatgggttttccttctaccagggatcagagccatgccattcccttccaccccaatgcaaagtctgttaaagtaaggccatattggtaccctcatagtcaaaaggagaacattgaaaaaatggtggaataccttggtcataaagtctctggagctggagtagctttggatgctgggaaggtgcaagcggtgttagattggccgaagcctaccaatgtcaaatag

SEQ ID NO: 68475 - DNA, 276 bp, Glycine max
  Peptide Sequence Number=SeqID_185253
atgtgggtgcaagccattggtctgtttgcccaagcgacttgtgctcctgagtttggacttccaagaccgttcaatcagagattactcgttttgcacgttggtgggggtgccgtaaaacaacgaccacttcccgtgcctacgtccagtcctcaagcaactcacttgagattttccactctccttgtaaaactccttttacaaagtctgaactacacagggacaacccttcccttgtgttcaagaatcctctacaacaagagacccacggtctcttaa

SEQ ID NO: 68476 - DNA, 123 bp, Glycine max
  Peptide Sequence Number=SeqID_185254
atgactgtggctgaatatgcagccaagtttgaggagctggtgaaacaagctgtgaattaccaaggtgttcgtcagtttccacttttggtgaacatgtgtcggatttgggatgaagactcctga

SEQ ID NO: 68477 - DNA, 765 bp, Glycine max
  Peptide Sequence Number=SeqID_185255
atgcagggggcgggcaacgacttcgtggtcattgacgcgacacacgccccggttcatttgtcccacacgcaaatccagcagattgccaaccgctattttggcatcggctgcgatcaattgctgatggtggaaaatacggatacaccaggcgtggatttccgctaccggatttttaatgccgatggcagcgaagtggagcagtgcggcaatggtgcgcgctgctttgtacgttttgtcgttgataaaggcctgactgataaacgcgaaatccgggtggaaaccgccagtggcatcatcacactgacattacaggaagatggccaggtgactgtcaatatgggcgcaccacgtttcgtcccggcacagattccatttgatgtgggcacacaggccacggtttacgaattgccactgcaaggggaaacggtgactatcagtgccgtgtccatgggcaatccgcatgccgtgatgctggtagagaatgtgcacacggctgaagtggcgaccctgggcccacaaattgaatcccatccgcgcttcccgcaacgcgtgaatgccggtttcatgcaagtgctcaacgcgcatgaaatcaacctgcgcgtgtatgagcgtggcagcggtgagacgctggcctgtggcaccggtgcttgtgccgcagccgtgagtggtatccagctgggctcattgcaaaagcccggtaaaaagtccatacgcgcggtggcatcctcaccatccagtgggaaggtggcgaccatccggtcatga

SEQ ID NO: 68478 - DNA, 354 bp, Glycine max
  Peptide Sequence Number=SeqID_185256
atgaagggaattacaggagcgccctaccgggcacattgtgatgctttgacggtcacagacgtgtgttggttgccttatagtgaccatcgaggggttagggggtttgagctaatttcatcgttccaaggtcagttgagatggggtcctattgtggtcacagttcgaccggagagggtggtatctgcggattacatcgagtggtttttccagatatctcacccattcatcataccgacccaggcaggtgatgagcccagacatccacctgccccagagcatgatgactacatccagctggatatcccagaggttccaatggcatttaacccccctggacatgcattggtaagataa

SEQ ID NO: 68479 - DNA, 651 bp, Glycine max
  Peptide Sequence Number=SeqID_185257
atggatcgattattcacaatgatactggggtttacttccaaacttcaactccggtgcccattcgagtaccaaataggtaaccaaattcgctttgagtgtatcaaattgataaatgatgacgatgtcaacacaatgttaatgtgtaatgatcaattttcttgtgttggtccgattgagttattatgcaccgttggaagaacaccagatggaataataaacttacttgaacgcactatgcctcgtattcatgacgcgatcctgtattacaacggcaaatggaacatgccaccgcagaacaaatttgttggttgcgcgttcacaggaaaaaatcctaagaaatttcaaattccttcaacatgtaccatcgatgaactgaagaatttaatcaagcaagttgcacctaaagggattccccctcttggaattcacgaatcacaaacggtaagacgattgtttttccgccaaccagctcggtttgagtattcagatacggttataaaatatgaaataaatgagctgatcaccaacgaagaactgctgaaggtgttagtacaatctaactactggaaaaaatatggaccaatagaaattttagctgtctttactaaatatgttgaagacgaggtcagtgggacgtcgctaaagaactga

SEQ ID NO: 68480 - DNA, 207 bp, Glycine max
  Peptide Sequence Number=SeqID_185258
atgtgtcctcctccgtcaaaggtcaacactaaaggtgcaccgaagaaaccgatgaacagaaaccaaagatcaacaaagcgtgatctgtcttattgggagtatgttgatgcttttcattttgttcaaaatagcaactcttcaatgaaatgtagtgcatcatcttctgacccgccgaagccaacaaggatcatcccgttgttggattaa

SEQ ID NO: 68481 - DNA, 108 bp, Glycine max
  Peptide Sequence Number=SeqID_185259
atggtaatacaggatcgcgtcatgagtacagggcatagtgcgttcaagcttgcaaaatcacagctatttggtactcgaatgggcaccggagttgaagtttggaagtaa

SEQ ID NO: 68482 - DNA, 447 bp, Glycine max
  Peptide Sequence Number=SeqID_185260
atgaagttaggtggaaggcagagatacccaagtggttatccgtataaacactatttcgctatccgccagactcagagtccttcaggtggcaggcggaggtaccgtatggttatcctcatctttcgtcaacaaggggcaaacgagcccgttgatgcgcagagactaacgtcgtcttctgcacgttttgtcatccagggacagggagtcaggtggcaggcggagataccttatggtcgtctgcacctttcgtcaaccaaggcgaacgagttcgacggtatcaggatgatgtcttttactctcatcgtctggagacattcaagcccgatgacgcatgagattcttctctgctgggcggggacaatcaagtttgattgcgtgtggaaacgttgtggtcccgctggttgggatattggttggccaaatgatgttccgcttgaacgaaattag

SEQ ID NO: 68483 - DNA, 258 bp, Glycine max
  Peptide Sequence Number=SeqID_185261
atggcagacgtggaagtaagagcagcacacaacgtgctggaagcatgtgctcagacagaaactatagataaagtgattttcacttcctcagctaccgcagttgtttggagggaagatcgcaagaccatggaactagatctagatgagagacattggagtgatgttaatttctgtcgcaaattcaaggtactactccttactcctgtgtctaatacaaagaagaagaaaaatctattcaccctagttaaaaaaaattag

SEQ ID NO: 68484 - DNA, 363 bp, Glycine max
  Peptide Sequence Number=SeqID_185262
atgaggttactacttcaccttcctcttctgaaagtgaagaagcaaaaggggaaaaatctattgaagaaatctacccccattaagatggacaaccattattggttaacgagaactgacaggaggaataatcaacataaaaatacagaaaaaggtacgctttattgcattactttccttaattttttaaatagtgatcaaggggttcccacggaccctaagagaataaaggtcattcctgattggccccctccaccaagtgtcgagggaatgagcctagagtatgaagaacctcgggatttgaggtcaaatcctttccaaggtggaggggatgatgcaatcctaccccccaagggtattggatag

SEQ ID NO: 68485 - DNA, 339 bp, Glycine max
  Peptide Sequence Number=SeqID_185263
atggccgcaatgatggaggccatgatgagcatgaagaagataatggaagccaatgcagttgcagttgccgctaccagcgctgttgctaaggtgaacccgacgtccccatctggcatcaaccaaatgaatcatccaaccttagatgtggtaggcaaagatttgggaagtacgggccatgatgtgcaaattcaaaaggagcgcgccttccctccatatgacttgcctctcaactatacgccacccaatgtggcatacactcccaataagaatgtcaataactccactcctatacccattgagagccaacaaccccaaactgatcatgcacatgtctcttaa

SEQ ID NO: 68486 - DNA, 427 bp, Glycine max
  Peptide Sequence Number=SeqID_185264
cgtgactcaaaagtcagtatgacagatcttgtgagcgcggaagatgacgcttttcgtcttacagatagcaaaaaggtttatatggataaccactcgggtatctctgccggtcagcgtgactcaaaagtcagtatgacagatcttgtgagcgcgaaagatgatatagaaaaaaagaatgtttatacggataaccactcgggtatctccgcccgtcagcgtgactcaaatgtcagtatgacagatcttgtgagcgcggaagatgacacaggaaaaaagaatgtttatacggataaccactcgggtatttccgcccgccaacgtgactcaaatgtcagtatgacagatcttgtgagcgcggaagatgacgtaaatctccgcgtgtcaacgggcttgtcagccgcgattgacgaagggcgcagaagacgac

SEQ ID NO: 68487 - DNA, 321 bp, Glycine max
  Peptide Sequence Number=SeqID_185265
atggagaattgcactaggcaatcattcgcctggctcgagactcattggtggaggatgcatgaacgacaatcaattcatgaggctccaaataaaagtggagaatggagaattgcactaggaaatcactttgcgtggctcaagactcattggtggaggatgcacgaacgacaatcaattcatgggactccgaataaaagtggagaatggagaattgcactaggcaatcattcgcctggctccacactcattggtggaggatgcatgacccataatcaattcatggggctccaaataaaagtggagaatggagaattgcactag

SEQ ID NO: 68488 - DNA, 354 bp, Glycine max
  Peptide Sequence Number=SeqID_185266
atggatcctgcgccctttatcattcaggaacaacaagctgagtgggtaaatgcgcagagacagattatgtgccctttatcattcaggaacaacaagctgagtgggttccgctggcagggaggttcactagccgaatggtgtttcgctcaaacgaaattagtgtcttatttttacttcccttttatctccaataaaagacaagtaaagaggggcaactgtcataccctaatttcgtccggggaccatccgttgttgggatgcgacccttgtttgactacatcgaggtacttggcacccatcgttaggcaatccgtgaagttccgtgacatgccggaaattaaaaggaagtgttag

SEQ ID NO: 68489 - DNA, 150 bp, Glycine max
  Peptide Sequence Number=SeqID_185267
atgagtaaggtaggaaggtttgggaatggagggacgtcgcaaggtggaagaggctgcgcaggggtttctgaaaaacgtggtggaggcagcctactggtaatcgattacatgaaggctataatcgattacaggccatctgttctagtgtaa

SEQ ID NO: 68490 - DNA, 338 bp, Glycine max
  Peptide Sequence Number=SeqID_185268
atggatattgaagaggattcttatattccttttatacttggacgcccattcatgtctaccgcaagctgcatggtagacatgggaaagaagatgctgcaaatgggcatagaagatcaaaaaatcagctttgatttattccatgaggataaagatccgcctgaccaaaatgtttgtttgaaggttcatctgatggatgaaaagagacctgagaaaaaggttctggaagtaggaaccttaggtggtgctaagcgcatgagccttaaacccaaacgtcatgttgtcgcgctaagcgcgtgtcgcaacctacccttcggcgggagggcgcgtgaggctcacag

SEQ ID NO: 68491 - DNA, 351 bp, Glycine max
  Peptide Sequence Number=SeqID_185269
atgactgggttgcctcctagcaaacactcttttaatgtcattagcttgacacatcttcctgttatccagggtctaacaaggttcctacttccagaacctttttctcagcatcttctttcccatgtctaccatgcagcttgcggtagacatgaatgggcgtccaagtataaaaggaatataagaatcctcttcaatatccattacaacatgtcgcaacctacccttcagcgggagggcgacgcggggctcacgggtgtgtcttccaagggagaaaggcacgtggagttgccaccaacgtttattcgaggaaaacatcagaaaaaccaaaaatgtgtggtctatgaactttaa

SEQ ID NO: 68492 - DNA, 801 bp, Glycine max
  Peptide Sequence Number=SeqID_185270
atgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcggggaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 68493 - DNA, 417 bp, Glycine max
  Peptide Sequence Number=SeqID_185271
atggcgccagaggatatggaaaagactaccttcgtcaccttgtggggaacattctgttacaaggtgatgtcctttggactcaagaatgccggggcaacttatcaacgggctatggtagctttgttccacaatatgatgcaccaagagatcgaggtcttcgtggacgacataattgccaaatctaagaccgaggaggaacaccttgtcaacctgtggaagttattcgaaaggcttaggaagtatcacttgaggttaaaccccgctaagtgcacttttggggtcaaatcagggaaattgctaggtttcatcgtaagccagaaagggatagaggtggaccccgaaaaagtgaaggccatccttgaaaatgccggaaccccgtattcgagaggcaggttcaaggtttcctgggacgtttga

SEQ ID NO: 68494 - DNA, 270 bp, Glycine max
  Peptide Sequence Number=SeqID_185272
atggtggaggcctctggtaatcgattaccagcctgtgtaatcgattacacagaggaatgggtcactggtaatcgattaccagcctctggtaatcgattaccaaggctgtgtaatcgattactagagatgaaatgccttaagatacccgttttacttgcatgtagtggttatgaaacgtattttgcggcggcacagttagattcttgtgaaagagtctgcccctttcttttctttcttgtatatcgtgatggcggcgcagctaatccgtga

SEQ ID NO: 68495 - DNA, 222 bp, Glycine max
  Peptide Sequence Number=SeqID_185273
atgactaaagcacgtcaaaaggggcacgcgaaacaaatgaggacctctaagggtacatggaatgaattgaaaagttcgatttcgggaacttaccggttgaagaccgaagaacgaacgaagaacgtcgaagaacggttgaaaatcttcgcgaaatcacccacggaaacgttacggaagcgcatcggcttggattttcttcacggaaacaatttttctcactaa

SEQ ID NO: 68496 - DNA, 213 bp, Glycine max
  Peptide Sequence Number=SeqID_185274
atggctccacctaaagaaattgcgaccatcatttaccaaaatggtcacattgtagacgatccagttcaaggatcgacgtacacatctcaactattcgacaatgatgatcttagaggcgcgatggaaacaattctcctgaatccacaattgaattctgccgaattctatgttgttactgagcttattcctcaaccacaaacatcatctccataa

SEQ ID NO: 68497 - DNA, 493 bp, Glycine max
  Peptide Sequence Number=SeqID_185275
tgtcacaccttttcagatgggaggtaggggtgtttctgtgatttcgaccacaaaaggattcacaagacctgcgatgactgaagtagtattagttgagtcagatgggcagttcctcccatatgactggcttgcgtgtggctatgtcttcaacatgtcttctttgcatattcgttatctcctcccgaagcactcctatggcttcaccatgatcttcactgagatatggagatggggagatggggttctaactcttggagtttattcaatcatcagttgtggagctgcttgttgtgcctccgccatcgatttggtagcaaccatgcttttttcggggcaagaaagaattttacccaagccctacggtgggtgccaaatgcatctgcacgagagtagacatgcaggggagtatccaggtattcggcctgggcgaatactcgtgatggaagcttacttgtggggcttctatggtggttggatctttgagcttcaatga

SEQ ID NO: 68498 - DNA, 507 bp, Glycine max
  Peptide Sequence Number=SeqID_185276
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgagactacgagtataataggagcatccgtcaacaaaaggatcaccctaagatgatcatctcgtggctattgagaacgaatcgtgggatcctctag

SEQ ID NO: 68499 - DNA, 162 bp, Glycine max
  Peptide Sequence Number=SeqID_185277
atggccgaccagcaggctaccaagtccaaagccaaaggtgaatgctgtgaaaattttctcggacgcccgaaatggacttggatgaatgcacaaatggataaaagaacatattttggaaacattgggttgactaaaatagaggaaatgaatcctgagccctag

SEQ ID NO: 68500 - DNA, 963 bp, Glycine max
  Peptide Sequence Number=SeqID_185278
atggctgaatccactcgctcaaagacaagcctggaacatatggaggaagccacaactaagcttgcctccaatcagcttcataccaccacaaactttgatgaactcctccaatgcatcacagcgttggaaaccaactaccaaaatccacccaccccctcttcttcctcagccaaccctcaaccatcttcccctcacccatcattacctcgcatgaagctcgaagtccctcgatttgacggctctaacccttctgggtggaccttcaaaatcagtcaattcttcgactaccacgccacgccagaacccgaccgtctagtcatcgcctccttcaccatggaaggacctgcgcttgcatggttccaatggcttacgcgcaatggccaaatctcctcctggtctgctcttctccatgctctggaagcgcaattttccccttctcagtataaggattccacgagggaggttcaggcgcttcaccctttgaccctggtccaagctgtagggctcgcgcgccttcaggaggaaaagctagccgatcaatgtcgcggtgtctccaggggtttccgtagccgcgcccaactcgcccttggcttttccctaccaccagcaccactgccgccacctattccacctttattgccttccccagcaaagccaccacctctgaatgttcgtcgcttgtccccagaggagataacaatgcgtcgagaaaaaggactttgtttcaattgcaacaagaggttttcacgagggcataagtgctcctctcgcttctcccttctcttcgcagctgctgaggaagaggatgaaccctcctgcaccaaccctaatattacccccaatatttcagacccacccgacccaggcccaaataagcctctatgctcttgtgcgtcatttggcgcccgaaacgctgcgtttgatgggccgtgtcacccaacattgtgttttcatcctcattga

SEQ ID NO: 68501 - DNA, 1359 bp, Glycine max
  Peptide Sequence Number=SeqID_185279
atgaaggaggaagacattggaaaaaatgcattctgcatgcatcacggtcactatgaattctgtgtgatgccattcggcttatgcaatgccccgtcatcattccaagctactatgaactgcatttttggcccttatctatgcaagttcattatcgtcttcttcgacaatatactgatttacaataagacctttccagagcatctagatcaccttgcaaaagatttcacagttttgctcgaaggaaacttcttccttaagttgtctaaatgcacttttgcccaacaacaagttgagtatctcggacatatgggctatgcttccattgttgctcctttgactcgcctcttagtcaaggaccaatttcagtggtcgccggaggcacaaatagcctttgacactcttaaagacacaatctacagagcttcagttttgaggctgccggatttctctcaaacatttattgttgagactgatgcttcaggcgtgggaggacatatggggatttccaagaccttggctcgcattaaccagaatttcatgtggcacgggatgagagatgatgtttgccactttgtgaccacttgcttattgtgtcctctgtcggtaccatcacgaccatgggaggacttgtcgcttgatttcattggtggcctcctggctttccaaggtcacaccgttattctagtggtggttgaccgcttctcaaagggagtccatttggggcttactccatttgagattacttttgggaagaagccccccaccatccctcattatctcaccgacacttccaccattgatgttgttgatgattttctggtgcatcgtgacgcagccttcatcagcttcaagaagaaattactaaaagctcagcaaaccatgaagaagtttgcaaacaacaacaggcgcgaagtccactttcaagaagttgcatatcgcctcaagctccctccagactcaaagatacacccaatttttcattgtgcgctccttaagccatttcaccactcctctgacacagatacatgtgcagttgacttaccgccgcagtcaaaggacaatgatccgctaattacaccccttgtgattcttaacacgaagtgggccacaactgacacaggccctgaattacaagttgtagtccagtggcagggattgccacctgaggacacatcgtgggagccttggaccgaactgaaagaagcctatcaccttgaggacaaggtgcttcttaatgtgcagggggatgttatgaagcagccttcagacaagccaaaccaagaagagacaagcactaacctgagaagcaagaggcagagcgtgcgccctcagcacttgagggatttcatcacagaatag

SEQ ID NO: 68502 - DNA, 186 bp, Glycine max
  Peptide Sequence Number=SeqID_185280
atggaggaaaacactagcactgtcagtctgagttatgcgacgaagctggttgggggtaacggtatgaagccattgaacgccaaggaccaaatcgacaccgcaaagaggaaggacgtgaagatcaactatgaacgtctggtcctgaatgtgaagctcaacacctggacagagttgatgacaagctag

SEQ ID NO: 68503 - DNA, 354 bp, Glycine max
  Peptide Sequence Number=SeqID_185281
gcgaaagctaacaatactaaatgtgagcctattgtcaatgaggtcagtctgaagaaggagttgtttgagcatattattgttggcaaggattttggactattttcaaatgtagagcctcttcactatgcaacatatgatggaatgactactactatagacattccaatgtggcttccaatgacttttaggtctccaccaaagatgattttggatgaggttcactcacttgtagctatctacatcttcggtaggaacaaggatgacaaagatagtgggaaggaaatcttggtaatgaccatggctaaaacatttgcagacatgaaagcattaaggagtcttgagcctaagggttag

SEQ ID NO: 68504 - DNA, 234 bp, Glycine max
  Peptide Sequence Number=SeqID_185282
atgactgaaaatgttagtcaatttgttagattgattgtgaaggaatgtattggccgtatcccatggtttttgcatgaatctctgaagtatggacttgtcgcaatgtgcccttttgcgggcgtgcgaggcgaggcttacgggtgcgctttccaaaggaggaaagatgcgcggagtcgccaccaacgtttatttatggaaaacgtcggaaaaaccgaaggaaaccggtcaaaatga

SEQ ID NO: 68505 - DNA, 1065 bp, Glycine max
  Peptide Sequence Number=SeqID_185283
atggcaacagagcagaaggaattaccagaagtttcaagtttgataagcattttatcaaagatgttgaaggaggttctaggggggatttggtatctttggaatgagagacattgggaggttgaggtgaccacctcatcctctcaattcgttgatatcaaggttgctagagggcaggacataccttggttcctcactattgtctttggatccctttacttttcccgtagacaatcccttttgaaggaatttgcaaaaataactagtgagattgataaagcctgggcaatggctagggatttcaactctgaatgtgaccttattgatgtaggcttccaagggtaccccttcacttggcaacaaggggatcaaaaggatagattggacaagattctcataagtcctaatggatttcaagcctggttttaccaaaaccaatgggaggtagtaggggacactcttactagactggttgtgaacatgttttttatccttcaaagagtagctttgtcccgaatacacaactctgaaaacatcatcattgctcaagaggtgtttaattccatgaggagcaagaaaaggaaggtgggttggatgactataaagattgatttagaagaggcttatgatagattgagttggtctttcatccaagatattcttattgatattgggctttcgacgagttttgttgagctagtgtggtattgcatatcttcccctaaaatgaaggtgttgcaaaatggcaaagcattagaggaatttttacaagctaggggaatttgtcaaggtgattcattgtccccttatttatttgttctttgctttgagagacttttacatgtgattaatgtggtcgttgataatgggttttggcaaccgattcaattggctagagaaggggggcagaaggttaacgaagcaaagacaagagtttacttctctgcaaatgttcctagccaggttaaggaagagcttagtcaggctttgggatttcaaaagacggaggatatggggaagtaccttgggattcctatccagggctgtgcaagacgcaaggcaaattag

SEQ ID NO: 68506 - DNA, 201 bp, Glycine max
  Peptide Sequence Number=SeqID_185284
atgggtgccaagtacctcaaagcggtcagacaaaggttgcacgccatcaaacaatggtccctggacgaaattagggatgcacgaacagcgctaggcaatcaattcatggggctccgaataagatttaatggtggaggatgcacgatcagtgctaggcaatcaattcgtggggctccggactcgatggcggaggatgcatga

SEQ ID NO: 68507 - DNA, 868 bp, Glycine max
  Peptide Sequence Number=SeqID_185285
gtcccaaaatgtctgtacacggaaggcgaggctattgtaaggcgaggctattgtcctatcctacataaaaatgttaatcacaatacttaccagtttgcagttgataagagtagcacaaaatttgtccttcaagcattgtcatcgtatgttatgcaaacaactgtgattccaaaagctgtttgtgatacaattgatcgaaggtggagggagtttgtgtccggtggtactagccaaagaaggcggattaatacaacgttcgggccgtcattgtgtttgccgaatgatcaaggtggattgcgactcagagagatgaggaaggtgaatcaagtggatatgatgagggtggtttggaaattaataagcaataaagaggatctttgggtgaagactgcgagtggggtgcatggatggcaaggttttccaattcattggacaagcacttttgcagttgctttggactctatatggaggagtaggaatgattttattttcaacaacagacaagaggaagctgcgggcttggtcggtgaaattcagatgaagattgaacaagtactagagagtctcgaattattcaagaaggtaaacattgatgctgcactgtgcacaatgtatggaagagctgcttgtggagggttgttaagggatcatgatgctcattttgtggcttgcaacttgctttgtgatagagggtttgtgcagattgaggtggaaggttctctatatctttttctcatgtattttgagaagccaataatgaatgtggcgaatgcattggccaagcatggtcttgccatttcggtggacatgaggttgtttgatgttcaactcagttttatttccttgtatttgttagcagaatctgctg

SEQ ID NO: 68508 - DNA, 432 bp, Glycine max
  Peptide Sequence Number=SeqID_185286
atggcaaccataatcgattgctcctcttctcctttccgtcactcccaactcaacacaaatcccaagttgaggcccgacaagtccacagggaagtcgaggagagcatgtcattttcgattccataagagaaaggaatccatgagtaaagggatatcaagagaagtgaggggttgctctgaagatatgaaattggttcttattttaggaagctccataaggttgcagtcttcatcaatggaacgcatgtatgggtccaaaacttctaaggtagtttctggtttaaaagggtcaataaaagaaaaagacgagttattcatggtaaagggaaaagggatgaagattcttccctcaatcttttcttcttgcgctgggaagatgggaactggtggaataaaggccattgagaaaatcgtagtcgttgttgattcttga

SEQ ID NO: 68509 - DNA, 522 bp, Glycine max
  Peptide Sequence Number=SeqID_185287
atgtggcagcttctacgcgaaagcgtcaatggtggtggcgccatgcatgggcttcacctggctaactcacgagaatgcttagaggaatatgtggaacacaacacgagagtggtcacggaattatacaaagccctaacctctaaagaccccgaaacgcttcatgggattgtggcccaagacttggagtggtggttccacggcccatcatgccatcggcaccacttggtcccctggctcacgggctcctcaccctcctcaaaggctttggttccgcaacatgtggtgggctttgggccattggttattgctgaagggtttgatgaggcccatttggtgtggtgggtgcatgcatggaccatcagaacttctgatgggctcataacccaggtcaaagagtatgtgaacacatccgtttccgtgactcgtttatcacaaatgcttccaaatgcttccaattgtcaatgcatttggcagagtaggctttgtgatgaatcagtgcctggacttgttctggcaatctaa

SEQ ID NO: 68510 - DNA, 492 bp, Glycine max
  Peptide Sequence Number=SeqID_185288
atgaagaccatccccggcagcaaggccgagccggagaaactctccggcacggcagcggatcacgaaaaccgcaaccgggagacggtgaaaatggtgtacaaggcattgcgtgacggcgacacggagaagctggcgaaggtggtgagggtggagttggaatggtggtaccatggacctcctcactgccagcacatgaagaaagtgttgaccggggagtcaacggcgacgcaaaaggctttcaagtttaggcctcggaggatcagggccgtcggtgaccgcgtgatggttgaagggtgggagggggcgggggagtactgggtccacgtgtggaggctcaagcacgggattattgcccagcttcgtgagtatttcaacacgttgatcacggtggtgcttcgggttttggaggacggtgatgaggctcggttgtggcggagcaccgaccgggttcgggttcaagggtcgttaccggatattgtgctttccatttga

SEQ ID NO: 68511 - DNA, 579 bp, Glycine max
  Peptide Sequence Number=SeqID_185289
atgagtgaagaagaagacaaggtgcaagagcggataaaggttgacatagaggccctgaaagagcaaatggccacaatgatggaggccatgatgagcatgaagaagataatgaaggtcaatgcggctgcagttgtcgctaccagtgtcgttgctgagagaggcaaagaattggaaagtatgggcggcccccattttgtgcaagttcaaaacaagcatgccttctcgccatatggcttgcctcctaattatacaccacccaatatggtgcatactcccaatcagaatgtcaatgactccactcccatcttcattgagagccaacaaccacaatctgatcatacacctatccctcaacccatgggggggacacatgaaacaccccaccacaatctagccaacttcaagccttgcctcgaatacgccactgaagggcaaacagttggtggtgtacccctgccaaacactttggagggccctcagtttcgcccacaaccacaacccttgcattttgcaatgggaagagccccttctgctatggctggaaagggaaagttggatcagatagaggaaagattaagg

SEQ ID NO: 68512 - DNA, 1215 bp, Glycine max
  Peptide Sequence Number=SeqID_185290
atgttgcggtcacttgcgagagccgtagcgaccaatcatcgatgtcacgccacgttctcatctctcagtcactcttctaggcccccaaagcccacaccacccttcaaacccgatcccaaaaaatccgcccccaacgccgccgccgccgccgcactcatcgacgagcaggaacgtcgccggcagctcgacgccgacgataaaaatccttctctcgatgtggggcccaacggccgccctctcttctccgccgccccttccttctcccacctctcccgcaacgacgtctgcacctacttcaagctcacgaaggatgccctgaacaaggttttgccagagggattgccagtgggtatggtcaacgagtttcaggactccctgcgaacggctttgcttgttcgccagagcttcttggatcttcgtgataacttcaggcgcgtggttgatcccccaatgtggtcctctaatggagttaaagttaggaagcaagttgtgttagatggtcccgttagctgtgggaagagcattgcgcttgcaatgcttgttcagtgggctcgagaagaaggttggctggttctctatgttcctaaaggcaaggattggactcatggaggatttttctataagcacccacaaactggtttatgggacacacctgtccaggctgaggatgtcctcaaggcaagattgaattttaatgattttttgaagtacaatgagtcctacctaaaggaaatgccatgccaaatatttgatccaatcctattaggtgagggtgctggtgttggatggttgaaagatgttgattccttggcaatacctgaaggcacaaatttatacgagctggtgaagactggcattgagcagacacatgcagccattggagtagttgttcgtttgaggaaagagttatcacttgttaaagacaggcctgttcttattgcagtagatcaatataataactggtttacattcagtgaatatgaggagccagtcactatccgttcttgccggccaatacatgctagggaacttgcaatggtgaaggcttttagatcaatggtgcatgatgatatgatggtaggtgccttttctcattcaacagcggtaggaaaacttcgtaaagacttaccagatgttccagtagatgctcgtgttatgtttcctcgatacagtttagatgaagccgagactgtttgccattattatttaaggtag

SEQ ID NO: 68513 - DNA, 1215 bp, Glycine max
  Peptide Sequence Number=SeqID_185291
atggcaaacctaaagacaccccttgtccttaatatgaaggatgttgtgatagttaaaccctctaagccaacaccacctgaacttcttgcactgtccaccattgacagtggtcaaaccatttatgtctacgaaggaaatcttgattcaccaaatggccaactagacccttctcatgtgataaaagaagccctctcgaaggcctttgtttactattatccacttgctgggaagatagtgacatttgatgatggaaaacttggaatcaactgcaatgctgatggaattccatttttggaggtaactgcaaactgtgagctctcttctcttcactaccttgaagggattgatgctccaactgcacagaaactagtgtttgctgatgataaacctaataattctcatgatcaccctttggttttcaaggtgaccaagtttctctgtggggctttcacccttggaatgggcttgtcacacagtgtttgtgatgggtttggtgcatctaaattcttcagagccttggctgaacttgcatgtggaaaaagtgagccctcagtgaaacctgtgtgggagagggagagactaatggggacactacttcttaatatggagccagtccaatttcccatagatgagacttcaagggcagaaagtgatgatattgtgaaagaaagcttcacaactgttgaagcacttggtgcatatgtttggaggtcaagggctagagctttggaactgagctgtaatgggaaaaccatgctgtgtttagcagttggagtgcggcacctattggatccacctttgccagaagggtattatgggaatgcttttgtgggttcaaatgtagtgctaacagtaaaagaacttgatgaaaaaccactctcagaggttgtgaagctcatcaaagagagcaaaaagcttccttctaaaaatgagtacatcagaaacacaataaacatgttggagacaatgagacaaaggaacattagggttgaaggaacatgtgcatctgtggtgttaacagattggaggcagctgagtttgatggaagaagtagattttggatggaaggcttcagtgaatatagtaccagttccatggaacatgttagggtatgtggacttgtgccttttcttgcctcctagtaacttgaatccttcagtgaaaggaggagttaggggaggagatggaggccctcaaaaagcttatgagaggtga

SEQ ID NO: 68514 - DNA, 309 bp, Glycine max
  Peptide Sequence Number=SeqID_185292
atggaggttgtttgctcaaaaagaggaattgttgtttcccaacatgagtatattctagacctcttggaagaaactggaatgagcggttatagactagcagatacccccatcgatcccaatgggaaactgtgggaaaaaggaagtgttcatgttgatattggaagataccaaaggaaagtgtttgtggaagcaatgttttccaagtttattttgatgatgtcaaagactcaagtcaagaatcaagagtcaagcaagtttcaagaatcaaagagtcgttcaatcaaaacaagtttcaagaatcaagattaa

SEQ ID NO: 68515 - DNA, 471 bp, Glycine max
  Peptide Sequence Number=SeqID_185293
atgcagatggcagacagaggtagaggtggtggtcgtagaatatttaatcgtggtacaagacgtggttttagtttgggagctccaattaccaccaacccttccccttcatccattcacatatcaagctcagagtcaatggttcatgttgttgcacagactccaaacacacttcctacaactcaagaccaaccaaatcctacctttgtaagggagtcaattcccactacccctgttagagatgcttcaccttcagcaccagatgattctgttacacctgagtacccaccagatccaaattgtgaacatattgttgatgaaaggcctttcattcgtgcatataaaggagagtttcaaccaacatatgggtgttctaatatcatatgggcaaaatttgatgaaccagctccaagttggttgaaggtgtcagttgacctttgcgataggtggtttggagagtttaagaaagagtag

SEQ ID NO: 68516 - DNA, 419 bp, Glycine max
  Peptide Sequence Number=SeqID_185294
atgtgtcacaaaatttccaaatcatctaatactttacaaagtaaccatcattgttatagtacccatgatttctttcaagctgctcaccataattattgttggtaccaagaaatggtttatccaagtggtactagacaagaatcccttaagcatgtagtaaagggtttgaatcctgacgaatgcatatatggagaaaatcttgttgagagggagatcccacttatgagtgccaacagaacattctataaaaaggttgaatatgtgcttgaagattgtattgaggttctcgtcaaaatcaacaaatttttcatcaacaaggaaggcttagtatgtgtggaaacgttgtgtatgcctgttactaaaccagaaagatttgagtttgatgcttttgagttagatgaacctgaagatgctggcag

SEQ ID NO: 68517 - DNA, 312 bp, Glycine max
  Peptide Sequence Number=SeqID_185295
atgcgaccccatccacatgagaacccaactctaaccccaccagaacccaaatccacaccaaaaaggaagaagcttaccttcaatgatgaaagagaaagggaacaaagatgtgtggcttcgagacaaagaagaaggggagaaaccttcgcggaagagagacgtcatggggaaatatatgatacaatcctcccaaggaggggacccatcactagagccatgtctaggagactccaggaagattgggctagggatgcaggagaagatcctagggttctcttgagccttagggtagattttgggtccatgagataa

SEQ ID NO: 68518 - DNA, 273 bp, Glycine max
  Peptide Sequence Number=SeqID_185296
atgtcgctgcatgttctctatctttatgcgttttctagatttcccccccggggatttccggggcaggatcaccttgggctaccttctggagtggagacaaaacatgaacggcagaaaccaatcaaggtacttaaggatgaacgcaagcggggatggggtcacgaccgaccgatcgttgcccttctctgtgcgaaacaagcagggaatgtcgctgcaaggcagccccgtatcctttgtattttgcagctttcttttactatttgtttgttttaa

SEQ ID NO: 68519 - DNA, 231 bp, Glycine max
  Peptide Sequence Number=SeqID_185297
atgtatgtcattggcttgttcgctcaagtgacttgcgctctcgagttgatctccaagtctgttcaatcagaaattgctcgttctacacatttgacaacaatagatacctcagagccctacattggggcaatgagaggcaccatgcatgagcctcaagcaaacctagcggcagatcagaagttctcacccggtaggtcgaaaacccgaaagggtggcctaggcaaaaattag

SEQ ID NO: 68520 - DNA, 666 bp, Glycine max
  Peptide Sequence Number=SeqID_185298
atgaatctgtctaaggtagagagtagcaattggctttcaggaatatcaggttctatttcagctgagttgggtaacttcacttctcttcaaacacttgatttgtcttcaaattctctttctgtctccatcccttcagagctgggtcagcttcaaaatctaagaatattgcaactatactcaaatgatctcagtgagaacattcattcagagataggtaacttgaggatgttgcaagttcttagaataggagacaacatgctgacaggtgaaattccacttagtgttgccaatataagtgaattgaaagtgttggctctaggctactgccacttaaatggaagcataccctttggaattggtaaattgaagcatgtaatatctcttgatgtacaaatgaacaacattaatggccacatacctgaagagattgaaggttgtgaagagctccaaaactttgcagcatcaaataacatgcttgaacgagacttaccttcctctatgggatctcttaaatctttgaaaattgtgaatttggccaataacatgttgtctggatcaatccctacagctttgagtcatctttctaacttgacatacctgaatttggttggaaacaaactacatggagaaattccttctgagcttaatagtctgataatgctctga

SEQ ID NO: 68521 - DNA, 1164 bp, Glycine max
  Peptide Sequence Number=SeqID_185299
atgcacacgtcgtcgtttcaggccaccaccacgcccgcgtcaccgcccactttctctctcctcccccgttccgttccctttccgatactctctctccctcttcaactcaatcccgttccccatcgtcttcgccttcaactccctcatccgctgccacgccaaagcgaactcttcaccctctctttctctttctctctactcctcaatgcgtcgccgttttctaaaccccagccagcacaccttcacttcctgggtgttcacattcacgcgcacgtggttaagttcggttatgcatgccacgtgtttgttcggaacgctctgattcaattttattgtgattgttcccgtgttggttctgccaaaagggtgtttgaagaagacaccctttgcagcgacgtggtgacatggaactccatgttggcgggttacgtgagaaacggagaagttcgttttgcggagaagatgtttgatgaaatgcctgagagggatgttgtgtcgtggagcaccatgataacggggtacgttctgaacggtctcttggaggatgggttggagtgttttagagacatgagggagacaaaggtgaggcctaatgaggctatattgactttgctttcggtttcggcgcagttgggtttgcttgggtatgggaggtttgttcattccaccattgaggggttgaggtttccaatgactgttcctatggggactgctttggttgacatgtatttaaagtgtggttgcgttgaaaaagctaggatcttgtttgatgggatggcaaagaaggatgtgtggatatggaatgtcatgatttgtgggctggcttcacatgatcatgccaaggaggcactcgcgctgtttcagaggttcgttggtgaaggttttcagcccgtgaatgtgacgtttgtgggtgtgcttaatgcttgtagtagggctggtttggttggtgatccgaggcattactttaagttaatggtggatgatcatgtgatgtgggcgacgctgcttgatgcatgtaagcttcatggttatgtggagatgggggagaagattgggaataagttgatagagttggatccaacccatgatgggcattatgtgcagttggcaggaatatatgcaaaagcgagaaaatgggaagatgtagttaggattcggggataa

SEQ ID NO: 68522 - DNA, 162 bp, Glycine max
  Peptide Sequence Number=SeqID_185300
atgctcaatggaatgccttggaactcccccatgataagcgtatgtcacattggagttgtatcctatgggaaatggaggttgaggaatctttgttgggcttatggataccattacattattgagcagatgcggagggtggtgtttggtcttagtagcaggtga

SEQ ID NO: 68523 - DNA, 258 bp, Glycine max
  Peptide Sequence Number=SeqID_185301
atgaagcttacctcgaacccaacaacgataatggcagcgacattggcagtgaaacgtacctcaggtcaccacgacactggtaacttgctgatggacaaccaaaaagcgagttgtcacggtcttcagcgtaatggagaacaacaagcttcgatggagaacaaccttagatgcagagggtacaaggagaagaagaaagccttagatgcagagggtacacggagaagaataaagcgcgagcaaaataggtcgcgtctataa

SEQ ID NO: 68524 - DNA, 1212 bp, Glycine max
  Peptide Sequence Number=SeqID_185302
atggttataactagagctctcgatcgggctttaggtcgagcaataagaaaagtcctagggactagagatgatgataatgatgcccctaacagtgaaggcctacatctgtccacaagcagtgacaacatctcagaacaagcaataggaaaagccctaaggaggagggaggctagtgacgatgataatgatgcccccagtagtgaaggcctatcgcatctgcctgaatttaacgaagagcaacaacaaccacctgttgaagaaggtgttattgatgttgagggttttctaggcggaccccataacacatcagttttgagagattttgaaaatcacattgctttgagagtttggaatgaagagttatcttcccatggaatgatgatggctaagttcgtgaggcctgctctagagattgaatgtcttgtagctaccaacggactaagtcctttgatcgcatgttccttagatacgggggtgactatcaccttggatgatgtggcattgttgttacatttgcctaacgtaggggcattctgtagaagcaagcttcatgatgatgaaccaaacaattttgatgatgccaaaagcccaacgtacatcatttatagtacaagtagagcgtacatctacttgggttgtgatactaagaataagagagggattttacaaggttattggaaatctcaagaaccggtggttgcttggggactggatcaacttcatgtcgacgatgctgtcgatatgttggtggaattactcgaggtcagcgttgcagaggcaagagctgagacgattcaatgtcatggatcttatgttcgactattatggttgcgagatgtgtatcagacgaaaattgaggcatgtcactggatcgtagtagtgcgagcatatttgttgcatcttcttggacgcacactatttgctaataagagtgccacatacatgcacgtgggcattgctgctcttgtgcatatgtatgataatttaaatgaagcgccaaagagcacagagaggaaacttgtaggatatatcactctgttacaactgtcgaggattatgtcgagcggagaccacgtgcatgctgagggacctctgaccattctaccacatccagttgtgctttcggcttttgttgaaaaaatagatgctagatggatgcagtttggtgactatattgcacctatagagcaaatttgtgtagtgcctggctag

SEQ ID NO: 68525 - DNA, 273 bp, Glycine max
  Peptide Sequence Number=SeqID_185303
atgagtctctctcgccccatcgcctcaaccttcaaccgtgtcatggcgactccatgtcacacaaggggcttcttctcacacctcttatgctatttggttagggttttcacaaccctactttgcattctttgtcacaccatcgcgtcgtgcctcgtcactgatgtgttgcgtctcattgtcgtcggtcctgcggcggcctcatgccaccaagcccttgcctcccttgtgccaatgctacactcccagtgttgtttagggtgttgctggacctag

SEQ ID NO: 68526 - DNA, 1539 bp, Glycine max
  Peptide Sequence Number=SeqID_185304
atgccttctactactcttcaatggctaagcctagttggcatcatttggctccaagccataattggcacaaacaccaatttccctgcttactcttctcagctgaagcaacttctatctatttcccaagttcaactcaataaccttgcttttgcatctgatgcaggcaagctttttggctggttttctggccttgcttctatatacctccccctttggttggtcctttttattggttcaactcttggattagtaggttatggtgtgcaatatctcttcataaccaaccaaatttgttctttgtcctattggcatgtgttcttgctaacttttcttgccggcaatagcatttgttggatcaacacagtgtgctatgttgtcaccataaggaacttcttttctgatcgcctagttgctgtgggaataacaactagctaccaaggactaagtgcaaagatttatgccaacattgttgatgctgtttctcctcacaagaaggctagaacgtttctcttcctcaactctctcttacctgtgatagttggtttaatagcagctcctctagtcagagaaattgatgaagtaacaagtcctaataggtacacacgtgttggttttgctgtgatgtttgttattacaatttcaactggaacatatgctgtgttgagcagcttgcaatttgtcacaagcaaagcatcctcactaggtatcttgattggtattctactgtcctttctattgcctctgcttgtccctctctcaatgaagatcaagaagtttcaggaaaatagagaaaaattgagaatctaccactatactatggaggagaatgctactagtgaagagagggtggagagcgaggtgaaagagggtgaagtagttcaagaagagtttggtattatagaagaagttggagtgaagttaatgctgagaagaataaatttctggttatatttctctgtctatttttttggtgcaacagttggtttagtatatcttaataacttgggacaaatagctgaatccagaggttgctctaatacttcatctttggtgtctttggcatcgtcatttgggttctttggccgtctcatgccatctcttatgcactacttctacaggggaaaatgtagaatttcaagacctgcttctctgatggcagcgatgattccaacaacaggtgcatttctgttactcctcaacaaatctgacattgctctttacatcagcactgcagtgattggagtgtgtactggagcaatcacttctattgctgtttccacaaccactgagttatttggtactaagaatttctcagtgaaccataatgtggtggtagccaacattccaattggctcctttatatttggctactctgctgcacttatttaccataaggaagggaatgaacatgggaaatgcatgggcatggaatgctacagaaacactttcatcatgtggggtttcttttgtttccttggaactcttttggccttgattctacatgctaggactcgcaagtttttctcactaaaacaatag

SEQ ID NO: 68527 - DNA, 2280 bp, Glycine max
  Peptide Sequence Number=SeqID_185305
atggaagaaaaagaaaatcgaccaaagtcttctataggaggagatgaccaatctcagaagaaaaggtcatcatcatacgatcttaatcccaacgacaaccttagaagtgtgatcgcgcaagtccagctacggggtgaaaactatgatgaatgggctcgagctatgaagacttccttaagagcaagaagaaaatggggtttcattgacggaaccataacaaaacctgaagaaggatcctctatgatggaggattggtggactgtccaagccatgttggagagatttttagttgtgaatggtccatgcattcagcagctgaaatcatacttggcccaatgcaaacaaggaggtttgtccatgatggcttattacgaaaagctaagggctctatgggatgacttggccaactatgaacaactgtcgatctgtacttgcaaaggttgcacttatggtctattagcaaaacttgaaaaacacagagaagaagaacgatgtcacatatttttaatgggcctagatgatgggctctatggaacaatccgttccaacttgctggccacagatcctatgccatctttaaacaagatgtactatattctagtacaggtgaaagggcgtgagaacaagaacaaatttatttgcacgaattgcaacaaatctggtcatgatgaagcaggttgtttcttgttgattggatacccagaatggtggggtgattgtcccagaaatgatgacaaggcaggtggacgaggaagaggtcaaaatcacactggaggtactggatcgaatagtggacatgcacagaagggtccatgggaaactctggtagcattacttaacaattcgaaggtcactccaaatgaaagcatgactgtgccctgttggacttcttatggacatactttcacatctactaaagaaggaaccataaggcttgctggtggtttaacacttggaaatgtgtttactactaatctatgtgcgatacatggccacacttcgaagatgttgattggagtgagtgaacgaagggatgaactctacttttttcaagaaattccaaaagtgaaggcttgtagagttgaagggataactcaacttgaagggggtactgacactatggaagatgttgtaacagatactactatgtttccagaacctccagatatacaaatcccaaacgctcacgatgagaatgaaccactgaggcgtggttgtcgtgtcaaatatccatccacttggttgcaagactacgtcatacacacgattcaaaagttgagtccttccactcgttcatcaactcaatctcatttttcatgtgcaccttatcctatcacgcattatatgctcgctgaaaagaagcaatgcaatttgagattcaagctcttgagcaaaatcgtacgtggaccatgcagggactaccgcccgaaaagaaagctctcggggatcaattacactgagacattcgcaccggttgctaaaatggtcgcagtgtgtactattttagcagtagcaatagcaaaatcttgggaacttcaccaaatggatgttcataatgcctttttggatggatattttcatgaagaagtgttcatgaaaatgcctccaggcagcttcacaatcagacatgacactgaacttgtggttcttgtgtatgttgacgatttgatcattgctggcaatactccttctgccatcaagcattttaagctctacctcagtacatgttttcatatgaaatatcttggtgttttgaagtattttctagctggtctccttggtgctaaacccgctgctactccattagagcagaaccatcacttgtcactcactgctggccaacttcttttagatcctgatcaatatcggcatttagttgggtgtttgatttatttatgtttcactcggcctgagttgtcatacagtgtccaccttctgtctcaattcatgcaacaaccccgaatagaacattgggaagctgcactccgagttgttcgattcttaaagggtaattcaggacaaggaatattttttgctcgtgaatgtgacttacaactttatggttggtgcgactcagactgggccagttgccctttgaccagacgattagctgagtataggtctatggcaaccactaaatgcgagttaaaatggttgaaagggatcctttccgacctaggggttgtccatgacaaacccatgaccattcgctgtgatagtcaggccgctttacacattgccaaaaatccagtgtttcatgaacgcaccaaacacatcaag

SEQ ID NO: 68528 - DNA, 204 bp, Glycine max
  Peptide Sequence Number=SeqID_185306
atgattcaaatatttgtggttgagctttcagtgctagagcttgtctccaatgaaggaggtcctgaaacattttgtggaatttctatttgtgcccctgcaattcttgaagcagggctagaagttcaagtgctacctgattatcttgtaccttttagcagattgttgagttttgattcctctattgaggaccaaatagttggttaa

SEQ ID NO: 68529 - DNA, 564 bp, Glycine max
  Peptide Sequence Number=SeqID_185307
atgggttggttggatcgcatcatgtcacagattcttagggtgtcattccaactcccactagttattggagggtcacatcctcacttaaatggggcgtacgttaggtttcggtcaccgccattcttgagttttggttcatcttctgtaatctctttgcatcttgtatgtggctcgtgcgatttccttctctccttcgatcgtcttcctcacttcaaggaggagacacaccacgaagcttctgacgacaagtcctcttcctccgagaggttggtggacctgggctatgttagcgggggtacctctcatcctcataggagggtaaggccttctactactcctttagatgaagagcatgtttctgttacccaagacgaggtgtttagacgttgtagagacatgttgaaagagaggaatgaattggcaaataaggtggagtgtactgctgaagagaaagaagatcttacagcgataatggccgaattcgctaaggcatgtcgggttttacaagaaggaggccatggagcaacacaaaaagggattttacaaggccgtcaaacatgttga

SEQ ID NO: 68530 - DNA, 229 bp, Glycine max
  Peptide Sequence Number=SeqID_185308
atggctggcgatgatcgactggtaacgggctctggttttcaggcggcgctcggtctcaatggcgaccacggtgccaccggggagggtgatcaagccgtccggccggtgattaacctggtaacggctaaggaaggtcgtgcgatcgccgtttatccacccggatgcgcctttttgctcaaggatgatccgggctgcctgattatcaacgtgatgctccagcgtccagccg

SEQ ID NO: 68531 - DNA, 288 bp, Glycine max
  Peptide Sequence Number=SeqID_185309
atgaacaaagaaactgaccgacttgcgaacgtactgactgaaatgagtgccaaagcgctggtcacgtggatgacgcattccgcattgcagaacataccgcgcgaagcattactggttcgcggcaacgactttgtgtacgccctccacgcaaattttgtgctgctacgtgatgtcctgtcagaaacgctggaagatattgagcagcaaagccatgacctcgaagaaagattggatagcctggaacagcgccttcaggtgcttcagaaagatactgatgatttgtattag

SEQ ID NO: 68532 - DNA, 762 bp, Glycine max
  Peptide Sequence Number=SeqID_185310
atggaagcaaatccaacagaaattgtgaccatcttcattgaagactatgtgacatctccccaagggcttaccaaggtgtttaatgcttctgggttgagaaagtattggttcccagtatctagaatgcctaagaatggtgaagattggccaactgtcgatgacatggttcatcaaaatcaacgtttggtcgttttcacctctaaatcatctaaagaagattctgagggcattgctaaccaatggaaatatgtagtagaaaaccaatatggagatgatggaatgaaaggtggttcttgtccaaatcgaggtgaatcatcaaccatgaacacaaaatcaaagtcattggttttgatgaactactttctcactagtgctaatgcaagctcagcttgtgctgacaattcaactccattagttaacatgttgaagacttgccataatgcttccagcggtcgatggccaaatttcattgctgttgatttttaccagaggagtgatggaggaggagcccctgaagcagttgatgtagcaaatggtcacttaacttgcggatgtgacaacatttcctattgcaggccaaatgccacatatggcacatgtgatgtgccaccaatttctccaccgccacctgctgttgctcccccaaccatcgtagaagaagcaagccatcagccggtacaagaggaatttcatgtggacacccctctaaagttggtgaagtttttatgggtaatgtggggagtgaaaaatttcctgacttga

SEQ ID NO: 68533 - DNA, 402 bp, Glycine max
  Peptide Sequence Number=SeqID_185311
atgaaggtacatttctctaagttaagacacattgtcgcaacctaccattcgacaggagggcgaggggaaatgccaaaggtgcatcttccaaaaaggaaaatgcgttggagtcgtcaccaacgtttattcgaggaaaacgttagaaaaaccaaaaagaggtctgcgaattttgaaaataagggttcgggagttgtttacgcatggggaagacaactttacggtgctaatgatcggttaagattaaactttataaaagaaaagagattaccgatgatagaaggaggagatgaatatgcacaaaacaacaaaggggacccctatgggtgcatagatcgcattcaaatcataaaaacaaaactaatcaatgatcgcatgagaaacaccgaaccaagaacgatgtag

SEQ ID NO: 68534 - DNA, 213 bp, Glycine max
  Peptide Sequence Number=SeqID_185312
atgaccgaatccaagtatattgatatgatttctatcatatcttctccttgttggatgtcacatttgagtgatgccttagatgatgaggatattgaggaggacccacctatggactctactgagtgtatagaggaagatcccgaggaggatccttctaagggtttttatgatgagggttttagaaatattgattttcaagtgtggtttaagtaa

SEQ ID NO: 68535 - DNA, 120 bp, Glycine max
  Peptide Sequence Number=SeqID_185313
atgtgttggaaaggatcagaggtgaatgaaacccgatcaccagacaagggtgagaatgagtttaatttctggagcccaattggaggcgggagcaggagtgaagaggacttagggagttag

SEQ ID NO: 68536 - DNA, 318 bp, Glycine max
  Peptide Sequence Number=SeqID_185314
atggcgaagggtgcagatgaccataatggtctctgcatgccatcggacttgatgtctctggatagcaaaaagggtgcggatgaccataatttgtctccacgtgccatcagactcgcttgtctctggatagcgaagaagggtgcggatgatcataatttgtatccgcgtgccatcagacttgattgtctctggatagcaaaggtggcgaggactttgagtcctacgaaaatggatgatgaggactttgagtcctacgaaggtggggactttgagccctccaaaagcataaaagcgaggactttgagtcctataaaataa

SEQ ID NO: 68537 - DNA, 291 bp, Glycine max
  Peptide Sequence Number=SeqID_185315
atggactcgggaaggttccaagttagtgtaccaggtaacagctacccaatggttcttgagacaagtagtccccttgtacttgtcaaagtccagcaccttgaacttgggaatgaccatgtttgggtattaggaacaactttcctagtcatgagggtttttaaccgccgctgtggaatgcaagaggtgcagttgtgggtgatactgagggcctctccaaagggttttgtagggtataccaccaactgcttgcccttcagtggtatatccgagccaaggctcgaagtcggctag

SEQ ID NO: 68538 - DNA, 252 bp, Glycine max
  Peptide Sequence Number=SeqID_185316
atggtgggttacacaccttcaagctttgcggatttggacttcgccagcggaaggatcaaagttggtctgaaaagaggcaaatttggtcatcctgctttgataaaaactggggcaaatgaagagggtgagaatgagggagaagcccatgctgtgactgccattcctatatggccaagtttcccaccaacccaacaatgtcattactcaaccaataataacctatctccttacccaccacccagttatccataa

SEQ ID NO: 68539 - DNA, 207 bp, Glycine max
  Peptide Sequence Number=SeqID_185317
atgttggccatcatcagcaagtaccaagaggaactaagtctagccacgacccacgagcatagagtggcggatgagtatgcccaagtgtacgcggaaaaggaggctagaggaaggcatgcactgtatgttggtctcgggaagccggaaggtccatatcaccttcttaactgtaaacatggggcactgtgcccccaaatgcgcaagtaa

SEQ ID NO: 68540 - DNA, 231 bp, Glycine max
  Peptide Sequence Number=SeqID_185318
atgtcaggatttacacgcaattctcctcaaatttcagccagcccgcatcaattagaccttgcaccttacgcttcagagccctacaatgctcaatggaacgccccagggctcctccacgatatgcacatgttgcgttcgagtcgtatcctcagaaaaatggaggtggtcttcgtcatcggaagtgcggtagacagactttgtggttggtttagggatggcctttgtggataa

SEQ ID NO: 68541 - DNA, 396 bp, Glycine max
  Peptide Sequence Number=SeqID_185319
gaagttgctcaatccagaagcactaacactatgattgatcctccatctcccatcagacgacacatgaaatggaagatgacccgcaccaagaaaactgggcaaatgatgtctcagacagcaaaggaaattgctaacaagattgaccagacctcacagggttcctttgtcacccatggacgtcaagatgtactaactgctgtcattgggcaaccagaacaccctggtcatgtgcgtgctgctagagtcggtgtcacgatcaagcaatactttgaaacgactccaaggacctcccgcacaaaaagtgactcgacagctaatgttatccttcaaccagatgcagtcccagtttcagttgcagatgcaatcatagggactcacattgcctcccgagcctga

SEQ ID NO: 68542 - DNA, 171 bp, Glycine max
  Peptide Sequence Number=SeqID_185320
atgagcttgctaagcgagcatgctgcgctaagcgagttcatcagtactcattgtgtatataggcgttctcagaagaactcgctaagtgcgcctactgcgctaaagttggtgccgctaagtgcagcctttaaggagcttagcgcatatccttgcggtagatgttcagcttag

SEQ ID NO: 68543 - DNA, 261 bp, Glycine max
  Peptide Sequence Number=SeqID_185321
atggttgtgatcagtcatcacagtcgtgatcaacctggaagtcaccaaggctatgatggtttgatcatggcccaacattggaaaatagttgacgattatccaagccatgatccttcgatcacggccaaatgcaaaattgagtacaaaaaagtttcgaagagcaagagcgagtccttagccttagcaaagcttgaagatttccatttggaaatttcatcacctagattccaaccctcttggtatgtttacatttctagttag

SEQ ID NO: 68544 - DNA, 423 bp, Glycine max
  Peptide Sequence Number=SeqID_185322
atggtggcacctccagactctattcctttaatagagcagtttaatgagtgggtagcctggcccgggactcagtcttctcttcatagggaagatgaaggtcccacagcccaggtaccactgcagatggaggatgagccatctgagactaccactccagagcccttggtcagaaggaagaaggcagatgaaacacaagaagctgtagccacttctgagaaacctcttgaggccacttctgagccttcagaactagtggtagatacaacttcacctcagcaggcaacagacccttccactcctgaggatctaactacaccagtcctatctctgaacacctctcctacagctacccctgtgcttcacttaacaaacgaggaagatgttcagacacaggaaactcaggaccaatcacagaatttttaa

SEQ ID NO: 68545 - DNA, 297 bp, Glycine max
  Peptide Sequence Number=SeqID_185323
atgtatgtggacgcgatgtttggtgggtggttatggttggctaaggttggtggtggttgtaactccccttattgtcgacttctcgataactctcacactatgatacttcactcaacttctcgttggttagaaccctccactgatcagaacccaacgatcaatgattgtcctcacaaaccaacacaagaattttcagcgtgctttgtcctcactcgttttttgagaaacttcctagaaggtcacctatcacataactactccaagccaagcacggttaactatggagttcttaagtga

SEQ ID NO: 68546 - DNA, 237 bp, Glycine max
  Peptide Sequence Number=SeqID_185324
atgtcctctcaaccgcgcaaaggaaatccatttccggaagaagctttttccggaaacattccggaagactatttatccggaaacttttcggaagaagcttcttccggaagaagaattagtgattccgaaagtactcagaaactatttccggaagaaggtcatccggaatttttccggaagaagcttcttccggaagatatccttttactttcggaagaagggtcttccggaagttag

SEQ ID NO: 68547 - DNA, 237 bp, Glycine max
  Peptide Sequence Number=SeqID_185325
atgtggtaccattttggaaaccactgtgaatgtagcctagaagtccatgtagtcgatgaattgccacacaatgggcaacccgacactatcactctcactgagatgacatcgtctggtgtcaatgtcttccaagattattttgatgatgtcaaagaatcaagagtcaagcaagttccaaagaatcaagagtcaagcaagtttcaagaatcaagatcaagattcaagattcaagaataa

SEQ ID NO: 68548 - DNA, 187 bp, Glycine max
  Peptide Sequence Number=SeqID_185326
atgttggaaaattggacaacattatttgacggtgttgtcgtcggtggaattgtggttgttacattgttgttgaatagggtggaagcgctggttgttgatgaggagcttcttccacttgataacaaatcggtttcttgttttcactatgtccacatccatgaaagagaggagaagaagaatggggaag

SEQ ID NO: 68549 - DNA, 744 bp, Glycine max
  Peptide Sequence Number=SeqID_185327
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgattttcacccggcagtcggtagctcagtacataggcggtatacccgttggcattaagccagcgcgcgaccggccaggcttcgcgccccatgccgataaaacggtagccaccaccagccgcaacgatcaccgcttcgccgttgggattctccggacgaaagcgctgaatggctggagaaacgatattggtccatatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 68550 - DNA, 210 bp, Glycine max
  Peptide Sequence Number=SeqID_185328
atatttgaagcaccagagacattagaacaacgcgttgtagatgcagcagtgcctggggatgtaatcagattttcactcactgcaaatatgggatctaatgttgacagagaaacaaattcagacgatgttccaatgattagtgttgaagaagatgttggtaaagactattctcacctcattaatcagatcaacttagtagttctcagttaa

SEQ ID NO: 68551 - DNA, 360 bp, Glycine max
  Peptide Sequence Number=SeqID_185329
atgaaggagattgctaagatagcagcatctactctggttgagaaaaaagaagcttcaaagctgctatacaagctatggaaggacaactacttgtatatggagaaagtaggtgcaacggcgggagccaagcaaataactattttgatgtggaaagtgaataagcctctgctttgggaatatgtactggacgagatgtaccatgctgccttaaatttgagcctaagaatggcttttgagcaggaaaaggatgaagagcttataatatctaaagcatgtgttagttattgtgcaaatctcgatgtgacgggcgagaaggaaggatgtggttgtggttccccatcttcaatgggcttcttctaa

SEQ ID NO: 68552 - DNA, 225 bp, Glycine max
  Peptide Sequence Number=SeqID_185330
atgacagtttcagctgggaggattgagttcccccattgtttcacttggtctgatccttggaaacaaaaatgtttatcgtggttgcttttaaaggttcctaaagacaagcttagggagccagggccactgcagaagaaatacaaacggctactaaatgtccggttactcatgggatcatcattgctgaaactcgatgatgctctgatgcttttccatgacttttga

SEQ ID NO: 68553 - DNA, 286 bp, Glycine max
  Peptide Sequence Number=SeqID_185331
atggagttttttctagggctatgtggggttcttgttgccttctcagcagcactttgcctcttgttgttctcgatactaacattgtattggtgggttttccctaaccaaaaacttaagaagcttaagaaatttgggttgggaggtccaaccccaagttttccacttggaaatattggagagatgaaaagaaagaatagcattcaatcttcagttgtatcctcaaatctctcacacgatatacactctaatgttttcccctacttttccagctggcagaaatcacatg

SEQ ID NO: 68554 - DNA, 426 bp, Glycine max
  Peptide Sequence Number=SeqID_185332
atgaagtgcgtaatgaatgaagtcctaagactatacccaccagcaccgaatgtgcaaaggcaagcaagggaagacattaaagttgatgatataagtgtgcctaatggaaccaacatgtggatagatgtggtagcgatgcaccacgatcctgaattatggggaaaggatgccaatgagttcagaccagagaggttcatggatgatgtgaatggtgggtgcaaccacaagatggggtacttgccttttgggtttggagggagaatgtgtgttggtaggaacttgacctttatggagtacaagattgtgttgacactgcttctctctaagtttaggtttaagctttccccaggttaccatcattcaccatctatcatgctctccctgaggcctaatcatggacttcctctcatagttcagcccctttag

SEQ ID NO: 68555 - DNA, 258 bp, Glycine max
  Peptide Sequence Number=SeqID_185333
atgacaacacaatatgaagtgatgtttgataatggtgtagcctgtgtttgtagtgtgagactgtcaccaataaagtgtgggtcacatggtgaggtaaatgctgatttggactatcaaaactttgtcttctttgttgcaaaatgtgttttctacgtttcctccgttcagcagaattttccatttaaacttccagttgtcaataaattctacaatattgtgtcacactttgaaaatgagaatttaagatcaacatattaa

SEQ ID NO: 68556 - DNA, 1230 bp, Glycine max
  Peptide Sequence Number=SeqID_185334
atggagtttctagggctagctggggttcttgttgccttcttggcagcactttgcctcttcttgctcttgatattaacattttcttggtgggttttccctaaccaaacacttaagaagcttaagaaatgtgggttgggagggccaaccccaagttttccccttggaaacattaaagagatgaaaagaaagaataacattcaatcttcatcagttgtacaatcctcaaatttaacacatgatatacactcttacgtttttccctacttctctagctggcagaaatcacatggtaaggttttcgtatactggttggggacggagccatttttgtacgttgcagagccagagttcttgaagaaaatgtcaacggtggtgatggccaagagttggggaaaaccaagtgtgtttagaactgacagagaccctatgtttgggagtggtttggttatggttgagggcaacgattgggttcgtcacaggcacattgttgctcccgcattcaatcccattaatttgaaggccatggcaaacatgatggttgaatctacgaatcaaatgattgaaagatgggctacccaaataaacaccggcaaccccgaattggatgtggagaaggagattatagcaacagctggagagatcatagcaagaacaagctttggcatgaaagacgacaatgctagagatgccattgctaaattacgagccttgcaaatgactctctttaagagtaatcggtatgtgggtgttccctttggcaagtatttcaatgtcaagaaaaccttggaggccaagaaacttgggaaagaaatcgatgagctcttgttgtccatcattgaatctcggaagaattcaccgaagaaaaattctcaacgagatttgttaggtttgttgcttcaaggaaaccatcaggttgatggccggtcaggaaagacattaacatctcgagaagtggttgatgaatgcaagaccttcttcttcggaggccatgaaaccacagcacttgccatcacatggaccttgttgcttctagccatgcatcaagattggcaaaaccagttgagagatgagataagagaagtggtggggaacaccctagaacttgatatttctatgcttgctggtttgaaaaagaaagaaaacggctatctgtggcaggcaacatgtgtacctccctatgccctggggctaatcccactacgcatgagatacccacaaaacacgacttaa

SEQ ID NO: 68557 - DNA, 270 bp, Glycine max
  Peptide Sequence Number=SeqID_185335
atgggtaccgaagatagcgatgagagcaccgcgaccatcgtagtgtgggtgagaatggaggaatcggtcggcgccaatctccgtcttgggcatgagggaagccaggaagagagaagtgcaatgcattggcaatgccttggggacaatccaattgcttcttctggtggaggaagtgggagtgtgtttccttcttgtgcttttgagctttgtctttgttgtggggcgaaggatggtgagagagtgagagggcaatgtggggaatctgcgtaa

SEQ ID NO: 68558 - DNA, 450 bp, Glycine max
  Peptide Sequence Number=SeqID_185336
atggctaaactgttagcaagaagactgaagagggtgatgtcagatatcatagagaagagacaaactgcctttatagaaggcagacacatgctgcacaatgtcctcattgctaatgaagcagttgaggaagcaaaaagatctaataagagttacatggtgtttaaagttgattgcgagaagtggatgaagaatgttgcaagatacttaaattgcagtttgttggttgtaccttttccttacttgggtatttcgatcggggcaaacccaagatgtagtgcaacttgggatcctattgtcaaaatgataccgaagaaggtggtagataagttggtgaagttacaaaggtggttattgtggggggtgactcagagcaaaagaagatcacctggattggttggggctcagtctatttatcaaaggagaaaggagatttgggaatcagagacttga

SEQ ID NO: 68559 - DNA, 402 bp, Glycine max
  Peptide Sequence Number=SeqID_185337
atggggcttcatttactggagatgctgtgttcactaacaaggaaaattgctgtaaaatcaggaaggaattgggttaatttacgggcttttgtgtttcatcagcattttcatacaacaactcttcatttcaaagggcaaaagatttgggaagccattattcgcgaccttttaccactgggtttgggaaaggcacggaaggctttgctttcaggttgctcagcaggaggtttagcgacctttcaccattgtgacaacttcgccaagtatttgccaacgaatgctagtgttaaatgcttgagtgatgccggtttttttcttgacgagtatgatttgtctatcttgactcatttcaacataattataatattcatctgcatttcttcttcaaaatctaagtattaa

SEQ ID NO: 68560 - DNA, 183 bp, Glycine max
  Peptide Sequence Number=SeqID_185338
atgagtaacaaaacaaatatatccttgaaaggacagactggatgcttgttgaaccaccctgcattacacttatgcctccaccaactaggcgaggttccgtggggtgcaactcaaggtgttccaccggggcaccaagagagggaaatgtgggaagaacggatagtggaggatttaatcgaatag

SEQ ID NO: 68561 - DNA, 318 bp, Glycine max
  Peptide Sequence Number=SeqID_185339
atgtctggtcaggaaaaccatttgaagagttataaccttgagaaaatctttgagaaaaccattggaagagttacatctcttaactttttattcagaacacgtcactgtttaaagcttttgaaatcaaactttgccaatggtaatcgattacaggtttatctgaaagagcattgtcctttaccgcctgtagcattgttgtggtcaagcaattgtcttcctcgggcaaagcagtggccaactgcatatattggtaggatacaacaatacatgagcctaatgacaattagaagagaatatgtggacctaaatgaagactga

SEQ ID NO: 68562 - DNA, 165 bp, Glycine max
  Peptide Sequence Number=SeqID_185340
atgggtggtatccccaattccccattgagcgcaccgaaagcaaagtgtctctctaacctctgcaaaagtccaaggaatgaaaatacttacatgtgcttacaagttccatttgctatatgcaggttgcacggttttaactgcttaggtttttgtcttcaaaattaa

SEQ ID NO: 68563 - DNA, 201 bp, Glycine max
  Peptide Sequence Number=SeqID_185341
atggcgggactgccaacgtgggcagtcacgccagtaccaatggcgacatgcagtgagtcagcatgtctcgccagtctgaatagcggcatgggcgcagtgagtcagctttggttccgctgctgccaatggcgatacaagtgtaccgctgatgccaatgacgatacaagcttgccgccagtaggaatggcgaaatccacgtaa

SEQ ID NO: 68564 - DNA, 243 bp, Glycine max
  Peptide Sequence Number=SeqID_185342
atggaaaaaatgtttatctttttccttagagaaaaatggaggatgacaatggagtgtttatttattgggcaacaagaccaactccaaccatatagatccaaattattgaatgcattcaaggacttttcgcatttcacaccgagacaagtcagcacactgacaatcgcacgctcttgtacatgcgccaacacttctatcctctatgttcagcctcaagtagaggaacatccacccaagaagtag

SEQ ID NO: 68565 - DNA, 402 bp, Glycine max
  Peptide Sequence Number=SeqID_185343
atggattggatcattcatctggacactgatgagctgatgcatccagctggaacacaagagtactctttaagacagttgttagctgatgtgcctggaaatgttgatatggtcatttttccaaattatgaaagcagtgtggaacgagatgatatcaaggagcctttcagtgaggtttcaatgttcaagaagaactatgaccatcttcccaaggatgtatattttggaaattacaaagaagcaactcgtggcaatccaaactattttcttacttatggaaatgggaaatcagcagctagaattcaggatcatctccgtcctaatggtgcccacagatggcacaactatatgaagacacctaagtatgttggtcctgcctgccattcatttatgattgtgcattag

SEQ ID NO: 68566 - DNA, 183 bp, Glycine max
  Peptide Sequence Number=SeqID_185344
atgagcaagaggctccaagagaattgggctagagctgttgaagaaggtcctagggttctcatgaacctcatgggtaaaatgaacgaacatgggtggcgaacgcatgatggagttaaagaggcagatatatatgttgggagttcggagtgtggccctatactcagtgggaaaaacattctctaa

SEQ ID NO: 68567 - DNA, 162 bp, Glycine max
  Peptide Sequence Number=SeqID_185345
atggctgaggaatcattgaaagagaagtggatgacaaataattggtacattgggggatgttctgagcggacttactcccatgttttaccattttcagagattgaagaatgtcctcgtgcaagtgttagagattgtgggaaagagctacgacaagcaatgcgg

SEQ ID NO: 68568 - DNA, 147 bp, Glycine max
  Peptide Sequence Number=SeqID_185346
atggcagtttcaggatacatgttaatcctagtgaaggctattactccttgtattacctgttgggttgtgaaggctcaagtcattaagttatggaaaacagttaaccaggttaatggaaatgcaattgagaggttatttgtgtcttaa

SEQ ID NO: 68569 - DNA, 663 bp, Glycine max
  Peptide Sequence Number=SeqID_185347
atgttttgcctgagatctttgtctcaacacattggagggtacatcctttgtggtacaagtagagggtacatctacttgggtttgactgagaacaagagagggtacatctcttgtggatcagttctagtggagggtacatccactaggttcaaagagaacaagggagggtttcgcgtggatgtcagagttggtcaacctcatgagtctgcaatttttacactatgggatcgtgaatgttatgctctgataaaggagactgtgactgagattaagcagaaaatgattgatatggatggagtatttgatgcaagagctatatcggaagaacttgatcatgttctgggcaaaagattaacattcagatttaagttatccgatgatgatgctttcatcaagtttgttctttcaaagcttccaaccttacaacatcatgatgaagcttcgccttctatatcaatgatgaatgagattaatgatgttagcgagagtcaatgtttctcagccactgctgagtctgatccaactctcttgggatccatcacatcggctaagtgcattttaccactatctcatagtcaactggatggaataccattcgaagatttatcatccatacaactatcctcaactaggctgggcaaaaagcatatcaagattgaatga

SEQ ID NO: 68570 - DNA, 234 bp, Glycine max
  Peptide Sequence Number=SeqID_185348
atgagtaaacattggggagcaaaacgaatattattggattacaacaaagggttcgagtacaagaatggtcccaaagagaccacaaagtcgttgccaatgtggaggtcgcatagggccaatgacgaggaggaatgtggtggtgatgatgatggaagagatgccagtatcgatcgtcagataactcattctgttgattctgacagcaaggcaaacatggctgaatatgatgaatga

SEQ ID NO: 68571 - DNA, 1149 bp, Glycine max
  Peptide Sequence Number=SeqID_185349
ggatatgatatcaacaactattcattctacacaaagtcacaggatgatagaagtagcatgcagaacagtgaggtcagtgttgaggttgattctgaacacttttgtagtgcatcagataacaacccaattcgagaatccatgccttactttggagtgattaaagaaatatgggagcttgattatagtgaatatagagtgtttgtcttcaagtgtcagtgggctaacagaaatattgatttagtggttctacaaggaagaacaagtggtatcagttacctaaataatgcttcagccctagatatttctgagatgcctactttctcccaaggaatgccttccataaatgaagaacatgaggttgatgatgagttgacaatcgactcagctaagaagcttgactgtcagaagcttggatcagccaaggccaacgcttcgattgccaagaagatgatgtcgacagttgccactagatggaggcaatttaagtcttccctgaccactaaatacatatatgctgccaatgaggaatctcatggaagagaagaggaagtgacgacaacaggaagatatgaatactggggatttagcaatgattgtcgaccctccatcctccattgcaagacatgtgaagtggaagatgacccgcacaaagtgcatctaggtcgtgttcatgcaacagggattggtacgaccattagtcaatattttggacagaaaagtttggagaaaaccagaaaagagtttaaggaggcaatcaaagttgagttattccaaatgtcattacatcactctcccccggttgaggcggatatacaattattaggtgcacatatcagcaccaagggtagttgtgttgaagttgcggcaaatccattaggggaagagccttgtgttgttgatcttcatactatggggttgtacgtagtaagtgatcattgtacatggctgatggtattgggaaaagtatatgatgggatgtctaccacacacaacatctcttatgcagatgatgtgaaacctgtatcccatgacgattcacagattcctcaaaagaaactgggtgaacctgaagaaaggtccaatattgttgatgtagaggattcattggctgaattgattaagaacttgtataaactagaagcctgttga

SEQ ID NO: 68572 - DNA, 246 bp, Glycine max
  Peptide Sequence Number=SeqID_185350
atggctggtcttggtcgactcttggaggaaggtcttaaatttgaaaaatttactctggatccctataagaagtttgtaagtcaacaacttcatgagctaatagcatttcctgaagttcctgaaccttcaaataatgctaagacaattgttaagaaaaaacctgataccaaagtaactaaaaaggacaacagtgaatacaactctgatttttcagataagcagactgatgaggaagagagtgattag

SEQ ID NO: 68573 - DNA, 180 bp, Glycine max
  Peptide Sequence Number=SeqID_185351
atgaacgcagaggcttcgttggaagttgttgtcttcaatcaacaaactaaagctggtgaacctcaaagcggtgaaggcgatgaagaggctattgatgaaggcgcatttgggcgcaacggcggtggagaaggtgctgaaaattgtggaaagtcacgagagaatggaagagtgaacagctag

SEQ ID NO: 68574 - DNA, 402 bp, Glycine max
  Peptide Sequence Number=SeqID_185352
atggacttctcaacaaatctaggctctagcttgcaaaaactcaggacatggaggttcttatcttggattgaaacagaagcttcagaagctgggcactgtcaacagcttgagcaagaacaaataccaaaaggggagtcaccaaacaaggaattggtagagaaagcagttgaagtcaagaaagaggtggaagaggtgttgaaatcaactaagttgaagattgttggagtaatggagagaagtgtgaccatgaatgaaattgatagagtggtaaatgaggaagatcttaagggcaaaatcaaggagttggagagtaagatagctcaaggctcaaattctgaggatatggaaaagataaaggtgttaaagagagtattcttgctgcattggatgtctcaacactaa

SEQ ID NO: 68575 - DNA, 460 bp, Glycine max
  Peptide Sequence Number=SeqID_185353
atggagcggcaaagacgacgacaagggaaacaccatgagtctgcgagtgcggcgcttaggtttgcgacgaagaggcatgaggtcgagaagcacgtgagcattgtggagggaagggaatgtctcagcgaagtgcagcacatgagaaatggaacacatggagtgcaacgccatcatcgagagagagaagatgagagtcccgaagatgctggtttctttgatctccctcgtgccttgtttagtaaaaacttatcacataggaagttggtggaatgccatgaaaagggtgttttggatgaaagttttggccatcgatggcttatatttatttctattttgacccagaagttcttgcagcttgtggctaagccactggtaggctttgggagtttcgttgagaattttctcaaccttggtgccctcaatggaggtgtttctgggatcgtccttaactttttcagag

SEQ ID NO: 68576 - DNA, 330 bp, Glycine max
  Peptide Sequence Number=SeqID_185354
atggctccgaagaagcttcctgctaaaagggataggaaggcaaccacagggaagggatctagtgcagccccgcaactggagattgagtttgacggacaccagcccatggctaagtatgaccctgagatagtcatagagttctatgcaaacgcttggcccactgaagaaggagtcatgaataagcgctcctgggtgcggggacaatggatcccctatgatgaagatgctatcaaccaattcttggggcatccattgatcttggaagaaggacaacgtgtgaatacaccgaaagaagaagccaagtgtcaggttttgatgaagaggccatag

SEQ ID NO: 68577 - DNA, 498 bp, Glycine max
  Peptide Sequence Number=SeqID_185355
atggctttgaactgctcgggagtaggccacagaagctatcgttcaactgcacctgacctctatggtttgctgcctgctggtcagccaaatgttgcatgcagtggtgatgcatctactgccggcttctactgctggtcttgccccggctgttgtgcctgccttggcatgcagtacttctcaatgaaggacttgttaatggggggtcggatgagctttgtgggcgagaccggtaccccgtacaattggcagaggcctgtgatcaatgttggaaatcccagtgccctattggacttctttgggtccactggtgtctcggaggatagcgtagaccaactagcatttaggcattgggagatcaaaattatggtcactgggaaggatgttgttgatcagaagcgtcatccagatctgggtcaaagtggtcatgctagtgcgcatgatccgcacctgcctccctatcacgctccgtgcaaaatccaatcacggggagcacagtag

SEQ ID NO: 68578 - DNA, 587 bp, Glycine max
  Peptide Sequence Number=SeqID_185356
gtcgtcatattgttgagatgcttaatctactggcagtgttacagaaaggtaggtttaatccaagattctacattgctgctgctactgataatatgagtcttcaaaaagctcagttgttggagaattccctggctgctgagtacgttcatgatgaatcagaaactttatctgatattgatgatgaagaagttgatttgtacattcatgatgaggaggggaagcatatcaagaagatactgtgggaaacagcaaatagggagtatcttgaggagcaggcagccaaggaagcagctgcagcagctagcaagaaagcttttgaggcaaaatttgaaaactgttcggaggatatactagcggcaagagagcttgctgcatcttctactgaagctgtggcaaaatccaaaaaggagcaagcagccaaggaagtagctgcagcaattaacaagaaagcttttgaggcaaaatttgaaaactgttcggaggatatactagcggcaagagagcttggtgcatcttctactgaagctgtggcaaaatccagaaaggttagaggtgttcatgttagaggttatggtgttcatgtttga

SEQ ID NO: 68579 - DNA, 186 bp, Glycine max
  Peptide Sequence Number=SeqID_185357
atgctgcaggtcactctagaggatcccaggcttaaggcgaaccacaatgcacttccaaaatcgattcccaccctttctgggactctttcctttcctagatttcttcgacctgcgaaatcacggaagcgcaggccagtttgcgacaaagacgaactcaggcagaaggagaaagaagaagaaagatag

SEQ ID NO: 68580 - DNA, 243 bp, Glycine max
  Peptide Sequence Number=SeqID_185358
atgtcgtcttctgcaccttttgtcatccagggacaacgagtcaggtggtgggcggagataccttatggtcatccacgcctttcgtcgaccgagcgaaacgaattcggcagtatcaggatgatgttggtcgttcgagaagtaaagaggggcaactgtcataccctaatttcgtccggggaccatctgtttggtgggatgcgacctttgcttgaccgcttcgaggtacttgacacccatcgttag

SEQ ID NO: 68581 - DNA, 279 bp, Glycine max
  Peptide Sequence Number=SeqID_185359
atggagcggcaagaaacattagctagacacaatgaagaatacaaagaagcattgcagagggctaaaacattagatgttccacatgcttatacaccagtgtcacaatatggaacttttgacgaggagggagagggcagttcaagaaggtcacaaggtaaatcttctttcggttcaacttatagaggtacagtggatgaaacttgggatgaaatgattgagcatctttttgataaggatgagcttatgtggccaagagataatgttgtagctcaaggatga

SEQ ID NO: 68582 - DNA, 303 bp, Glycine max
  Peptide Sequence Number=SeqID_185360
atgccaattgccaaatcttgtattttgaaattaactgctcttttccttgatcaggataactttttacctaggacagccaatccattggaagatatattcaagtctcttttctgtttgccatgcttattgtgcttgaggtgcatgaaggatacatgtataccagaggagaagatgctgaaagatccaaggagactctatgctcccggtcgcctttatcatattgttgagagaaagcctttcagaaatcaccagcagtttaaggccctggctacaattgttttccctttagacggcatacagtaa

SEQ ID NO: 68583 - DNA, 1494 bp, Glycine max
  Peptide Sequence Number=SeqID_185361
atgtcgcggcttgggaagctcctaaagaacgacacatgcaaggcaatgaaggaagaagttgttggtgctgatccaaaatctggagtcgtgacattaggaaagatggctttagtggagagaaaatgcattaacgatccccaacaagcatccactattatatgcaacatggaacaactctctcaaccatcatttcaaccccatcaagtctccgaccatcttcttcattcggatagagtcccttgcattgaagtgattttgagagaaaaacaagaagaggagttggagggaaaggaagtggagtatttcaaagaaagagttgagagattggagagtgagagggaagagagaaatggggtcatgtttaaggctttggaatctctcacttcaacgaaggaaagcttgtctagtgtcatagaggggttagagggagaaaaggatgaaacttttgtagaaaatgttactggggagtggtcaggagtggaatcaaggatgttgttggaagaggcaagattgatatcaaggcttgcaattgaggtggagacaaaggtggataggtacaaggagatgaggaggaaggagaagagagaattggagagtagtttgatcagtttaactgaggagaatagggatgtccataacttgcttagaattgcgttgtcggagaaagaggcattggagaagagaataaagggacatgaccacaaaaggatgcccctattgcagtttggattgcagaaagttgggtttgggttcatgatgatggggggtgggaataatgaacaatcaacagagcattccggggttaaatcagatagcagtgagtgtgaagaggaagtcattagtctggcctcaacagtggaaaggataatgaagaatctacgccttgaaaccactcaattgaggagatctttggaagaatctaggtcagacacagagcgcctccagtgtctcacagagaaacaggccaaagaaattgaagaaaacaaactctacattaaggagttagaagatagagagagaattttggctcaaaatgtagaggagttttttatggaaatcaaagcagcggaagaagaagttgctagatggaaggaagcttgtgagttggaagttgaagctggaaagaaagagattggagagcgtaacaaagtggtggctgctttgaaacaagaactacacaaaacaaaggctgctttggacatatccaatggaaaattaaggctcaaagaggaacttgcaatcactgcaatagctgcacaggaagcagcagagaggtctttgcggctggctgatactagagcagttgaacttcgtcgacaggttgaagaactaaccagacaactagaagaagcagagaaacatgaaggcaatagccataaagtgagacgcatatgttggccatggcaagttttcaaaatgagctctagcaatatagcaagcactagagttggaaatgccaaaaggatgctaccagaaatgcaagccttaatttaa

SEQ ID NO: 68584 - DNA, 195 bp, Glycine max
  Peptide Sequence Number=SeqID_185362
atgcaggtagctgagagcagtgtgattctggggtggcaatatatccaagatatatcgatcctatccggtgcagctaggagctaccgagctatgggaggtcacattgtacctgctgacgatcgagacatcatttttgacaataatctgcattcaatcattctgcttccaataacagatccattatctaatttctag

SEQ ID NO: 68585 - DNA, 1038 bp, Glycine max
  Peptide Sequence Number=SeqID_185363
atggtaatggcggaagaaagtgaaagtgtgcccaagaagcgttggagttgcaacgcgaaagaggaggctcttcttgtccaatgcgcagagcttgtgttaccgtatctaacccagtcagaactcgccaacgtctcttccacctgcaaatccctcctcaaactctcacgcgccatcaccctgcgacgcgcctccgacgcttccagagccttcgagacccttccggtcccgtttctcaacaccatcgacgcccacccctacgcgcacttcctctacacgcgctccctcctcctcccctccccgctcccgctcctccctcgccagccctggggctcttccgtgatttccccctcctcgccgactcaccttcgtgccgaatcggtgggcttcgttgatgcctctggccgggccgcgtcgggctgcgactgcgaggcgtgtgcgggccccacgtgtccctgtgctggcctggatggcatggatgacgtgggccgagagtgtgggccgggctgccgctgcgggcccgagtgcgggaaccggttcaccaggaatgggcttgcggtaaaggtgaggattgtgagagatgagaaaaaaggatggggcttgaaagcggaccagttcattgctaaaggagagttcctatttgaatattcaggtgaactcttgacaaccaaggaggcacaaaagagacatcaacattatgatgagctggcttcacggggtggtttctcttctgctcttttggttgtaagggaacatcttccttctgggaaggcttgtctgagattgaatatcgatgcgacgagaataggaaatgttgcacggtttgtgaatcattcatgtgacggtggtaatttgagcacaaagctagttagaagttcaggagctttgttcccccgcctctgcttctttgcttcgaaagatatccaagtagatgaagagcttacttttagctatggagaaatcaggaaaaggcctaatgggttgccatgcttttgcaatagcccttcttgctttggaacattgccctctgaaaacacttga

SEQ ID NO: 68586 - DNA, 1605 bp, Glycine max
  Peptide Sequence Number=SeqID_185364
atggctccaaattgcttgcaccaagtggcattccttcttgtgttcttaattgtggtttccagtggctatgcttgggttggtgtgaactggggaaccatggcgacccaccagcttccgcccgagaaggtggtcaagatgctgaaggaaaatgggttcagaaaactgaagctgtttgatgcagatgagttcattatggcggctctgatggggaccggtatcgaagtcatggtggcaatacccaacaacatgttggacaagataagcaacagtcccaaagctgcagattcttgggtgaatgataatgtcaccagctacttgttcactggtggtgtcaaaatcaagtatgttgctgtgggtaacgagcctttccttaaagcatataatggctcctttgcaaagaaaactctgccagcactcaagaacatacagacatcacttaataaggctgggttgggttcaaagatcaaaattactgttccattcaatgctgacatttactattcgcctgattcaaatccggtgccatcagccggtgactttaggcctgaagtgcgagacctcaccgttgaaataatccaattcttatacgcaaacaatgcacctttcacagtgaatatctaccctttccttagtctttatggcaacgaagatttcccttttgattttgcattttttgatggaaacaacaagcctcttagggatggtaagacactttacaccaatgtgtttgatgcaaatcttgacacacttctgtgggctttagacaaggcagggtaccctgacatggaggttatgattggagaaattgggtggccaactgatggtgacaagaatgctaatgccaagaatgctaaaagattcaaccttggtttgcttaaacatgctctaagtggcaagggtacccctaaaaggaaaggcacaattgacttgtttctattcagcctcattgatgaggacaccaaaagtgttgctcctgggaattttgagaggcattgggggatttttgagtttgatggcaagccaaagtatgaattagacttaacaggtcaacatcagcaaaagggtcttgtcccagtggaaggtatcaagtacatggaaaagaggtggtgtattttggatccagatgttactaacttggatgatttggctggtaacattgactatgcttgcactttttctgattgtacttcccttggctatggctctacctgtaataatcttagtgtccaagggaatgcgtcttatgccttcaatatgtattatcaagtgaacaaccaacagaattgggactgtgatttctctggtttggctgtcataacacataaggatccatcactaaatggatgccaattccctgtaatgatctctagtagttcttctttgctactgcatggagggttttcagacatccttaagaaagcactgaggatcatgcactacctcaccgagcactgcaacatcgtggagctcaagggagcttacgaggactgccactccccaacctcatcatggagctctatgatggtggcaagctcttcgattagatcatcaccaagggccactactccgagcgcgccgccgccaatctctgtcgctagatcgtga

SEQ ID NO: 68587 - DNA, 2073 bp, Glycine max
  Peptide Sequence Number=SeqID_185365
atggagatgggtcgggctctgttcccgttcgggtcgggagttgtgggagtgggagtggctggaattcttcttctttcagggcttgcttttgctgccttgtttgtcagcagacgaaacagtgccagacaaatgaagcccctgactacacatcaggaagtgcttttgtcttctgatgaaatagaacatataaatgctggcaacgaggtggatcaaggaaatggtaatgtggaaggtcggatagatgtatccagggattgttcatctcctgagtctgataagattcccgagtcccatagaatcattgatgatttcaatgtaggatctcagttggtatatgatattcataacaaggacattgatactgatgccacgaagcacaaatctgttcaagaagaattaaagattggatcagctgctgatgaggagtcagttccccgtcagagtgcaatggtgcttaatggttctgaatctgaaaatccagttgattcatttgatagcagcactgctgtagattcacagaactctattgctgaacttaaggagaacccatcctttgttgaaccaagaaaagtgtccaactttgatgctgaacccctacctgttataagtgagcagcaggatgaaattactgattcaagtggcaatagaagttctgacgagcaggttaaaaatgataataatgaggttgatatatgtagatccgaaactccaaattttggagctttttactcttctcctggtattcctgctccatcagcagtttcttcagctgtacaggtgcttactggaaaggttatggttcctgtagctgtcgctcagggacaagcattagctgctttgcaagctctaaaggtcattgaacctgatgttcagcccagtgatttatgcacacaccatgagtatgctcaatggttagtgtctgctagtagtgctctatcaaggaaaacaatctcaaaggtatatcctgccacgtacatagacaatgttactgggcatgcatttgatgatatcacccctgaggaccctgatttttcttgcactcaaggcctggcagaagctggacttattgaaagcaggctttcaagatgttgtgatagaccgttgtctacagacgaagactatggcccattttacttctcccctgaaagcccttcatcacatcaggatgttgttagttggaaaattgacctagagaaaagacagcttccagaagcagatagaaacaatttgtttgcttcaaatatgatgatcgatgggcagatgctgtgccaactttctggttttatagacactgataagatacacactgatgcatgccctgcacttgtagctgatgtatctgctggggagcacggaataatagttcttgcatttgccatagcccttgctgctggaaatgcttttgacctagttaatgaagagcttgcatgcactgttgcttctcagagtgtcttagtagttcaagttgagaaggatatcaatgcaaagagggaaaagatcaatgctgttgaaagaatggctgaagaggcaagatgcgagttagaaaggttgagagatgatagagaaaaggatagaatttccttgataaaggaacaagctgttattgaatcagaaaggaatgctttttcttggttaagacatgaggtggaagatcaactacaaaaccttattagtgacaaggtaaaaatagcttatgaaaaagacaagattagtaagcttcaggagctagcagaagttcaaaacaaggaaattacacaattgcagtatgagctagaggttgaacgaaaagccttgtcaatggccagggcatgggctgaggatgaggccaaacgagtaggcgaacatgcttcggacttggagagcgctagtgatagttgggagaggaatgaaagcaaagtggcagttgatgatgacttccacgagcttgaagctgccatctcaaaggcaggtaagtcagctcaggaggagcagcaaagtgctcatgaattcggatttactatcaaagaaggggcaaaccgatttgcaggtgattgtagaggagttgagaagctcactcaaaagttcaagacgtga

SEQ ID NO: 68588 - DNA, 1947 bp, Glycine max
  Peptide Sequence Number=SeqID_185366
atgccagaatctgaggaagaaaaccaagactatgttcccaggtcaaagccatcagaggaagctggtggtggctgcaccatggacttcgatctggacttagaaacttcatggcctttggatcacatggcctttggctccaaccccatgtcaccttttttgttctccacttcctctgaccaaccttactctcccctttgggctttctctgatggagaagaccccaagcttccagcttctgccttctctgattgccacaagatcttctcttgtgattcaaattcaatagctgaaaagccagtggagaatgatgacaacaaaaaacttttgccaccacttgttcctatttcaccagtggaaaatttggatggttattgtgtaatcaaggaaaggatgacacaagcacttcgttacttcaaagagttgactgaattgaatgttctggctcaagtttgggcacctgtgaagaatggtaatcggtatgtgcttacaacttcaggtcaaccctttgttcttgatccacatagtaatgggctctatcagtatagaacggtctctctgatgtacatgttttctgtggatggagagaatgatggaagtttgggactccctggtcgggtttttcagcagaaattaccggaatggactcccaatgttttgtattattctagtaaagagtatccacgccgagatcatgctcaacattacaatgttcgtggaacgttggctttgcctgtgtttgaaccttcaatacagtcatgtgttggtgtattggagttgataatgacttcacagaaaattaactatgctcccgaggttgataaaatctgcaaagcccttgagattcatcaatcacctgctgtcagtttccttgcagacagtaaatttgaggagttcggaaattttggatcatccacacactcaggttatattgctgttgttctttatcttaccctctattctcacagatataacttggtaatgcttttaaaccagatttgtaatgaaggtcgtcagaatgcattatcagagatcttggagatattgacagtggtatgtgaaactcacaatttacctctggcccagacatggattccctgtaagcatcgaagtgttttggcccaaggtggtggtgtaaagaaaagttgttctagttttgatggtagatgcatggggaaagtttgcatgtctacaactgacatagcattttatattatagatgctcatttatggggttttcgtgaggcctgtgttgagcatcacttacaacaaggtcaaggggttgctgggagggcttttttgtcccacggcatgtgcttctgttcaaacattacccaattctacaaaactgattaccccttagttcattatgctctcatgtttgggttaacaagctgttttgcaatatgtttacgaagctctcatacaggaaatgatgattatgtattagagttttttctgcctcctagaataacacacattcatgaacaaaagactttgttgggatccatattggcaataatgaaacagcatttccagagtcttcatattgcttctggtgtagaacctgaggatggttcaattgaaattattgaagcaacaatcgaaagagttcatacgaggcttgaatctattcctattgcttcatctattaaatcaccacctagacctgatacctcaccaaacatgggggaggaagtgccacaggatccatcagaacaacaaatattgatgtactgtaatgacatcaataatggagggagtcttggtgaaaatgcagccagaaacattgatcacatgccctccttagagactaaaaacataaataaacccttagagaggaaacgtggaaaaactgagaaatcaattagtcttgaagtcttgcaacgttattttgctgggagtctaaaagatgctgcaaagagccttggtggtatgttcatactctaa

SEQ ID NO: 68589 - DNA, 432 bp, Glycine max
  Peptide Sequence Number=SeqID_185367
atgtctgcaaaggacatgtgttggagtacaagtgtgagagtgagaaggaaagagagaaaactacatgctctattttggttctggctcttatttctggcatataactgttctactgacagaaatctctctgggtatgaaccaaaagaccatgcgatcaaagcattccaggagcatggaaatcaaaaagtgcatgaacttctagaccaatacattctcactctggtcccagcaggggtacgagcctacaaattgttgattgagatggatgatattgagaaaggaatcacaaaagctattgctcaacacaatattagatggcttgtaatgggagcagcagcagcagacggatataacttggggtatcaattccaaacctcagtagctttaattttaatctatgttgcacagatgcaatatgtggatcagatatga

SEQ ID NO: 68590 - DNA, 363 bp, Glycine max
  Peptide Sequence Number=SeqID_185368
atgccttgttcaatcttgctgcttacatcggtccatgatcaagttctttatcagttagcccttttaaatattgaatacaggcatgttgaagaacatcttgagcattcttgtgaagcacttctcataatcactcggattaattgctatatcaattcatgtctaactaaagctatagcaagacttttgcttaaaaatgtccagcagggagcagcaacaacatgctatgtagcactgcacccacaagtgaaggaaattagtggcaagtatttttcagccagtagtgtggccaaaacaacctcacaggggactgatgctgatttggccaaaaaactacgggatttcagcatgaatttgaccaagtaa

SEQ ID NO: 68591 - DNA, 354 bp, Glycine max
  Peptide Sequence Number=SeqID_185369
atgtggtatccggacattatggtaacaggagcatccagtggtattggtgctgagactacacgtgttctttctttgcatggtgtccatgtgattatgggtgtcaaaaatatgtttgccgctaaagatgtcaaagaaacaatacttaaggagattccctccgccaaagttgatgccatggagttagatctctgttcgatggagtctgtcaagaaatttgcatcagactttaagtcctctggtcttccattgaacatcttggttttaaatggggaaagggaaggctggggaaacattttggcacttgcagaagtttctagggagtgtaggccatgtgattcgtatctttctgattaa

SEQ ID NO: 68592 - DNA, 1056 bp, Glycine max
  Peptide Sequence Number=SeqID_185370
atggtaacaggggcatccagtggtattggcactgagactacgcgtgttcttgctttgcgtggtgtccatgtgattatgggtgtgagaaatatgcttgctgctaaagatgtcaaagaaacaatactcaaggagattccctccgctaaagttgatgccatggagttagatctcagttcgatgaagtctgtcaggaaatttgcatcagagtttaagtcctctggtcttccattgaacatcttaataaacaatgcaggaattatggcttgccctttcagtctctctaaagacaaaattgaactacagtttgccacaaatcacataggtcattttctcttgacaaatcttttgttggacactattaaaaaaacttcacgtgaatcaaagaaagaaggaagaattgttaatgtttcctctgaggctcaccgatttgcatattctgaaggaatctgttttgacaaaattaatgatgaatcaagattttctgtgagtattggagaatatgccagatctgatgcaaaaaatctgttgataggatttagtgctcatggatataattgtagacctatacttatgtacatcttagttgcatttagtagaattaagaacggagacatgatttttgtattacttgctgaaagaagaagcggtgtatatttgattacgcttgcttgtttacagctaaaacgttacaacaactggcgtgcatatgggcagtcaaagcttgccaacattttacatgcaaatgaacttacaagacgtctcaaggaagatggggtggatatttctgcaaattctcttcatccaggaacaatcaccaccaatcttttccggcataacagtgcagtgaatggtctaattaatgtgattgggagactggtgcttaaaaatgtccagcagggagcagcaacaacatgctatgtagcattgcacccacaagtaaagggaatcagtggcaagtatttttcagacagtaatttggcaaaaacaaccgcacaggggactgactctgatttggccaagaaactatgggatttcagcatggatttgactaagtaa

SEQ ID NO: 68593 - DNA, 1068 bp, Glycine max
  Peptide Sequence Number=SeqID_185371
atgggacgtaagaggaagaatcgatctaacagtgccacagattcagaacctatacctgtcctgtaccaataccagtacctataccttcgttactttaatatttccattatgagtgtgtactctactgctggtagcatccctgaagccgctccaagtgaggcaattgaaccttctagcagtgctatcaggggctctgaaaatagggtacctgtgccattggatacttccaacagtcaagaagtaaagaaggctgtggacaaaaaatccctgtctatgctgaacaagctatattacttttgtactcgtcgaccaaaggcacatgaggaattgagtgtcttggttagcatgtttggcgtttacttaaaccgcaaggatggctataccatgaaaccaaaaggatgggtcaatgatatggtgattttagctgctggaaagataatgatggaagaggagaaggcaacaaatggggttgtcactcgtcatatgtttagcccacaatttgtgaataaggtgatatgcgatttaaatcaatctaatgaagatagctacaagccttggtgtattgaggatgtatctctattcatcttgccgagtaaactgggttatgatattaatcagtgcaaattgatttttgcaccaactttgtttgaggagcattggtcttgttatgcatttgagcccaaggacaaaattttgtatgtgttagattcgatgcatgataaattctcaaccagaaagaagaacttggatgatgcaatgaaacgtcgttttgaggagctgctggtattgatgaatcctggtttgaccaaagagaatgcatcaataacacttcttcgcgttgatgttcctaggcagcaaaacattcatgattgtggcatctatgtgctgaaatacatggaaatttgggatggatcaataaaatggcaagacaaaaccatgcctgattatcaacgcaaagaaatcttgaagtttcggcaaagccttatatgtggatgggttcaacatcctaaaaatgaggttagagaagagcttttgaaggctgcaggactatgggggaaattatgctga

SEQ ID NO: 68594 - DNA, 2175 bp, Glycine max
  Peptide Sequence Number=SeqID_185372
atgcttacatggtggggaaaatcatcatcaaaagaaaccaagaagaaagcaaataaggaaagtttctttgacacactgcaccgaaaacttagaatttcatccaaaggtaaagtaagcattagatctggaggatcacgtagacattgcaatgacacaatttcagagaagggagatcattctccatgtggatcaagatcgccttcaccttccaaagtggcaaggtgtcaaagttttattgataggcctcatgctcagccacttccacttcctggtctgcatccttcaagtgtaggccgagtagattctgaaattagcatatcatcaaaatcaagattggaaaaagtctccaagccattatcgtttcttacgcttccaacacctggatgcatacgttgtaggccaaaccctgcagatttggatggagatatggtcactgcttcagtctttagtgattgctctgctgacagtgatgagccggcagactcacacaatcgtagtcctctagcaattgactgtgagactgggactagaactgctgctggcagtccttccagcttaatgctcaaggatcaaccacctgctgtttcccaactgaattcaacgggagtaaagaaaccaggaaatattctaagtaatcatatgtcttctacttcaccaaaacgtaggcctttacgcaaccatgttccaaatcttcaggttcctcctcatggtgccttctatagtgctcctgatagttccttgtcaagtccatcaagaagtccattgagggcatttggcacagatcaggtgttgaattctgcttttttggctggaaagccatatccagagatcaattttgttgggtctgggcattgctctagtccaggttcaggtcacaattctgggcacaattcaatgggaggggacatgtcaggaccgttactttggcaaccaagcaggggtagccctgagtattctccagtacctagtcccagaatgactagccctggtccaagctctagaattcagagtggagcagtcacacctattcatcccaaagccgggggaacacccacagaatcacagactcatcgattgcctcttcctcctttgtcagtttctaattcctcactgttctctcattcaaattctgcagcaacatctccgtctatgccaagaagtccagctagagcagataatccaaactctggctcacgttggaagaaagggaagctgcttggcagcggctcatttggacatgtctatcttggcttcaatagtgaaagaggcgaaatgtgtgcagtgaaggaggttaccctgttttcagatgatcccaagtctatggaaagtgcgaagcaatttatgcaggaaattcatttattaagccgcttacagcatccaaatattgtccagtattatggttctgaaacaatttctagttactgtatatttgtttctggtggtttatctgataacatagaagtgggaatttctcaacggtatttgttattgtggttccttatagaggcttctaaatcaccccttgaacaggtcgataacaagctttacatataccttgagtatgtatctggaggctccatacataaacttcttcgagaatatgggcaatttggtgaactagttattcgtagttatactcaacaaattttgtcagggcttgcttatttgcatgctaaaaatactctccatagggatatcaaaggagcaaatatactggtagatccaactggtcgggtcaagttggcagactttggcatggcaaaacatataacagggcaatcgtgcccattgtcattcaagggaacaccttactggatggctcctgaggttataaaaaattctaatggatgcaaccttgcggtggatatatggagtcttggatgcacagttttggaaatggctacaaccaaacctccttggtttcagtatgaaggggttgctgccatgttcaagattggtaatagcaaggaactcccaaccatccctgatcatctctcaaatgaaggaaaagattttgttaggaaatgtcttcagcgtaacccacatgatcgtccttcagccagtgaattgttggaccacccctttgtaaaaaatgctgcacctttggaaagacctattccggctcctgaagctttggaccctgtttctgggattacacagggagcaaaagctctg

SEQ ID NO: 68595 - DNA, 3192 bp, Glycine max
  Peptide Sequence Number=SeqID_185373
atggattcgagcgacagtggtcgcggttactcgaagcgcgagcgggacgacgaggattgggagtttagtgataagcggaaggataggtctcggaagttcggtgccaatggcggggacgagggcgagggttccgacggaagcgcgagaaggaagcgttctagcagaaccaccaccgatggcgacgattacgattcgcgctccaagcaagtggccaagaagaggctggaggagagcaccctggagaagttgagcagttggtatgaggacggggaattggatgataaggccgcgaggaagcgcggcggtgacggtgagtttcatgagagtgtggtgtgtaaagaggacggtaagggtgagggcggcggtggcggcggtggtagggagaagggtgggcatgagggtaagagttcgaggaggaagtgggatgaagttgatgttggtagtgtgaggaaggtgcaagatgagaaggtggatttgaggagtgggaagcatgacagttctagggatagggagaggggtggatctgctaggagtgagcatggggagagtaaaacctctggtggtggtgatagggttgtgaagtctactagtaaggaggatagaagaggggattctgagagagggaagagtaaggggaagtcggattcgggggatgttggtcgtgaggagagggttgagaagcccaggcaccatagggcggctgctggttatgatgtggctgaaacctgggataggtcgttgaatgcagaggaggatggacatgtgcgggttagggataagagtaccagggaaagtgggaactcaaacaggtcgaggacgccggagaagagtggaaaacgccatcaagatttggagaactctgaggtggattatgaaagaagtagtagctttaaaaggaaggagcatgaaggtgatggctataaggatgatagatccaaagggaaagatgatacttggaatgataggaggaaggatcgggaaagttctaaagaaagttggaagaggaggcagccgagcaacactgacaaagattcaaaaaatgaagagagtgcttttgatgacaacagagattgggagttgcctagacatggttatgagaggatggataatgaaaggcctcatggacggtttggtggtagaaaagatgtgagcaggggggaagctgttaaaacatccactaagtttgggatttcgaatgacaactatgatgtgatagagatccagaccaagttttatgactatgggaaatcagaatctatgtccaaccataccaagagaactgaaactcatcagcagtacattgctaaatcaggtgctaatgatgaagaatgggcataccatcaagatgaaagaggaaggaagagtgatttatctggttctgggacacctggtgaagacctgaaggagagatatgctgatgatgactatgatttttatgggggaagaggaagaggtcagaaaggtggtgtatctgcccgtggtactggtggccaaagttctagtactggtggctcacagcctcaatatggaaatccagagtctggatcctttaaccgagctggtgcacaaggaataaaagggaacagggttggaagaggaggaaggattaggcctactgggagagacaatcagcaagttggaataccactgccaatgatgggatcaccctatggacctcttggtatgcctccgcctggggcaatgcagcctctttcacatggtatatcacctgctcctggtccaccaatttcccctggagtcttcatgtcaccatttactcctggtgtttggcctggagcacgaggtgtcgatatgaatattataggtgtaccacctgcagtgtctcctgtacccccaggtccacgatttaatgctgctaatatagggaacccaccaaatcctgtaatgtattataaccaatcaggccctggaagggtaatgcccccaagcatttgtactcctggttttaatcctacaggatcaattggtcgaggagccccacctgataaagctccagggggatgggctcctcctaaaagtagtggaactcttggtaaagctccttccagaggtgaacagaatgattattctcaaaactttgttgacactggtctgcggccacagaatttcattagggagcttgagctcacaaatgttgtggaggactatcctaagcttagagagcttatacagaaaaaggatgagattgtggaaaaatctgcatctgctcctatgtattataagtgtgatttgaaagagtttgaactatctccggagttctttggaacaaagtttgatgtcattcttgtagatcccccatgggaggagtatgtgcaccgcgctcctggtgttgctgatcacatggagtactggacatttgaagaaataatgaatctcaagattgaggctatagcagatacgccttctttcatcttcctttgggtgggtgatggtgtaggccttgaacaaggtcgtcaatgtctaaaaaaggaacactgcttgatgggcataaaaggaacagttcgtcgaagtactgatggacatataattcatgccaatattgacacggatgtcattatcgctgaagaacctccttatggttcaactcaaaagcctgaagatatgtacaggatcattgagcactttgcccttggaaggaggagactagaactatttggtgaagaccacaatatccgagccggttggctgactgttggtaaagaattgtcatcttcaaattttaataaagaggcatatgtgaaaagttttgctgacaaagatgggaaagtttggcaaggaggtgggggaagaaatccacctccagaggcacctcatctggtggtgactactcctgatatagaggctcttaggccaaagtctccaatgaagaaccaacaacaactgcagcagcagaattcagtatccatttcgttgacgtcagctagtgcatcaaacagaaggcctgctgggaattcgccgcagaacacaactgcactaggcgtcaaccaagacgcttctagctcaaacccttctactccagctccttggggttcacctctggagggcttcaagggacgtgaaggctctgtattgccttcagatgataaagtaatggatatgtacgggtttcatggaccagcatcagcaaactatctagattttgaatcatacagacaaatgaatctgttgtag

SEQ ID NO: 68596 - DNA, 801 bp, Glycine max
  Peptide Sequence Number=SeqID_185374
atggcttcttcatcaatgtcatgtccgaagctggggaattgtgcagtgtcacatacaaagttccaagcttttcatctctcttcaatgttctctccactggatcgaggccttttctcaccttggagtggtttaaagcatctgggtatctcagctaaaccaaaacctcttcttcacatagatagaaagggagggtgtaagggtaaagtggtatatgcttctctctttggggttggagctcctgaggctttggtaattggggtcgttgctttgttggtttttggccctaaaggtcttgctgaggctaagcttactgggaatgtctacaatagaggttttgactttgtgggattggataaggttgctcgaaatctgggaaaaacattgcgtgcatttcaacccaccattagagagcttcaggatgtttcaagggaatttaagagtacacttgagcgggagattggtcttgatgacaatttaagtcctacccagaacacatacaattccaatgtacgtaataccacaccaacttcatcatccactgttgaccccaatggcacgctagaccctactaaagcatacagctctgaggagtatcttaagattacagaggagcagctgaaggcatctgctgcacaacagcaggggcaaacacctcccaaggaaggcgagaatgggcctcaaatccagcctcctgctgaggaaacagctactacagtgcctccacctctgaagccagaaagcactactattggcacaagagatgagaagggtcaggcaattttgttaccaggtagtcattag

SEQ ID NO: 68597 - DNA, 771 bp, Glycine max
  Peptide Sequence Number=SeqID_185375
atggaggcactgttcattctccaagggcaattccaacaactctttcatgacatgcaaccagatttcatagtcactgacatgttctacccttggactgctgatgctgccgctgatttgggaattcctaggttggtttatgtcggtggtgcaagttatgttgctcactgggcaatgaactgcgtcgaacagtttgcactgcagacaaagggagcttacgaggagcattacaagaaagtcatgtgtaccaagagttggagcataggaccggtttcgttatgggtgaaccaagatgattcagataaggcttgtaggggacatgccaaagaagaaggcaaaggaaaagaagaagggttgcttacatggcttgattctaagaaaagaggaatctgttctctacattctggccatgatttcatctgggtggttaggaaaattgatgaaggggctactagggtttttctggaagaatttgagaagagagtgcaagaaagcagcaagggttacctaatatggggttgggcaccgcaacttgttatactagagcatcctgtcactggaggtgtggtgactcactgtgggataaacactgtgtttgaaagtgtcatcgcaagtttgccaatggcgaaagaatggagaaacttgaatgagtttggaagtgaagagggaggacataggaaaggctattgctttgttgatgggtggagggaagaatatgtagaaattcggagaagagtcaaaactctaagtgatgctacaaagaaaacaattcag

SEQ ID NO: 68598 - DNA, 366 bp, Glycine max
  Peptide Sequence Number=SeqID_185376
atgacggtctggaagaaactagagttaaagatccaggggctcgaaagtggcactatagacagggtcaaatgtttgataaacgtgaaaatacccaaatcggatactatgttagatgccagaggtataggcgaggcacagacagcaacagagagcgcaaagaatggaagcggtaagccctctggaaagggcacggtgaataacttggaccccagctatttgaagaagaaaagtaagctccaggtaggttgcatgttaggcaactctatatctaggaatcataccaaggaaggtagtgaattgttggtgattaagtataacactcataaggaggtggaaaggatatgggaatcgtaccaacgaaggtag

SEQ ID NO: 68599 - DNA, 762 bp, Glycine max
  Peptide Sequence Number=SeqID_185377
atggacgacgtcgttcggcgtgaagattccaagtactatccagcactttctatgatggcttccaaagcatcctacaataacgaggcttaccttaaaactacagtggaaaattactggaagatggaatttgtgaagttttcaatgtatcaaggaaagccaacaactcaagtcttgattgccttggataagcatgaggatcgccatacatatgttgtagccttcagaggaacagaaccctttgaagctgatgcatggtgcactgatcttgacatatcatggtatggtattcctggcgttggaagaatgcatggtggctttatgaaagccttagggcttcagaagaatgttggatggccaaaggaaattgaacgagatgagaatcttccccccttagcctactatgttattagggacattctaaggaaaggtttgagtgaaaatgacaaagcaaagtttatagtgacaggacatagtttgggaggagcacttgcaattctctttgggacaatcttgtgtttgcacaatgagacattgttgttggagaggttggaaggaatctacacctttaggcaaccaagagttggggatggagcatatgcaaattatatgagacaaaaatttaaggaacatcatgttaggtattgtaggtttgtttattgcaatgaacttgttccgaggttgccctatgatgacaaggaaatgatgttcaagcactttgggacatgtcttttctttgggacatgccctatgaactcgaggtaa

SEQ ID NO: 68600 - DNA, 399 bp, Glycine max
  Peptide Sequence Number=SeqID_185378
atgtcacattttatagtaagtgatatcgtagcgacgaggcaggtcgctacagtgactactcgacatttggtgtactcatttggcacgggcttcaatactatgttttttgagttgggagatgaggggttggtgtacgatgtatccattgtatgcattaactttgtttttactattgcttgttttttgtggaattcgaggagtgaaggaatcacccctacaacaaccaactttcaggcattgatgatgccaagtacatcaaggcatctacaggcccaatgtagctcacaaacagagagggacatttcgtctgaggagatggaggagtatcgggaactactaaggcagttggaatcgatgtctaaggaggagagtgacgattctcccgacaacatgccttag

SEQ ID NO: 68601 - DNA, 177 bp, Glycine max
  Peptide Sequence Number=SeqID_185379
atgatgggagagaagaaagaattccctaaggaagagttctcaagctttaggtttgctggagtggacttgggcctacatactcgcgctaagcttgcactactcgctgagtgcagctgcctgtattcgcgcttagcgctagtacatgttttcgtgcttagcatgcctcatcgtgcttag

SEQ ID NO: 68602 - DNA, 171 bp, Glycine max
  Peptide Sequence Number=SeqID_185380
atggatcgattattcacaaagaatctggtgtttatttccgaagtcccactccaatacccatgtggaacatgtcacgccaaggcgactttgtgggttacttgttcacaagaaaaaatccaaaaagatttgacattccttcgagatgtagcatccacagactcaagtatgtga

SEQ ID NO: 68603 - DNA, 237 bp, Glycine max
  Peptide Sequence Number=SeqID_185381
atgtgtgaataccactccgtgagaggccaaagtctacacctaagggatgagatatacggtgaagtttggtggttttttgtcggcggagaagaagagatggacgaagaacagtggaggtatgatattgtcatgtctgaagaagttgatatgaatgttgaaaataagaaagatgctggcgtgaaagtagaatacgttgattgctctgatgtctttaatacttcttacatatttgtctaa

SEQ ID NO: 68604 - DNA, 285 bp, Glycine max
  Peptide Sequence Number=SeqID_185382
atggacaaagatacactgaggtatagtgagcagagaggttcaaagaacctgggggaatttgcgagtggtgattacccaacatttggtgcactcatttggtacggactggaagagccacaccatgatttggaatttctgttgactctagtggagtacgatagatggggcaacattcatcgatacatcatggagcaagtgcacccaatggaggttacaaaggaccaaggagaccattcagacatgtcgtctgaggagatcgaggagtaccgggtgtttctgaggtag

SEQ ID NO: 68605 - DNA, 264 bp, Glycine max
  Peptide Sequence Number=SeqID_185383
atggcctctaatagtgaagaggtcaactgccacactgttgcttcaaaccctccacatggccttcctcaaggttacacaccacatgtggctaataaccccaacaccttcatcttcgcacctccagaccaaacccaaacccaagaacctgaaaccaattccccagatagtcttatggggggtcgctctgagctggtatatgaacctagagcaagtatgaattcacacatggaaagacttggcaaaggttttcttgaaacaatataa

SEQ ID NO: 68606 - DNA, 1272 bp, Glycine max
  Peptide Sequence Number=SeqID_185384
atggcaaccgattgcaattgcaacaagggcttcgctgatagttacatgttgttgaagcccgaagatgcgagtttctttgatctctttcgtgtcttatttaagggaaacttatcacagaggaactttgtggaaagccatgcagatgatgatgctttggacgaaagtttgggccatcgatggcttatagttatttctattttggcccagaagcttttgcagcttgttgccaagccactctcactctttgggagttgcgttgagtttttgctcaaccttgtagcccttaatggaggtgtattcagcatcgtccttaattttctcggaggtaaattggtcttgcccaatcctgaatcagaaaattatttatcctttattggaaatttggacattcgagcaaagttggaagacgccgtccagcgcgaagattccaagtactatccagcactttcgatgatggcttccaaagcatgctacaataacgcggcttaccttaaaactactgtggaagattactggaagatggaatttgtggggttttacaactgcttgaatgagtatcaaggaaagacaacaactcaagtcttgattgccttggataagcatgaggatcgccatacctatgttgttgccttcagaggaacagaagcctttgatgccgatgcatggtgcactgatcttgacatctcatggtatggtattcctggcgttggaagaatgcatggtggttttatgaaagccttagggctaaaacagaatgttggatggcctaaggaaattggagaacaagacgagaatcttccccccttagcgtactatgttatcagggacattctaaggaaaggtttaagtgaaaatgacaaagctaattttatagtgacagggcatagtttgggaggagcacttgcaatcctctttgggacaatcttgtgtttgcacgatgagacattgttgttggagaggtttgtttactgtaatgatcttgttccgaggttgccctacgatgacaaggaaatgatgttcaagcactttgggacatgtcttttctttaacagacgctatgaactcgaggagcaccgttgttgttcggatcgatttcaacgtcgggtgtcatttgggcccgacgttgtttcagaaatctataaagacgggtggaagatgcacccgttgttgcttttaaaaatttcaacatcgggcttacgcacacccgtcattgttgaaggaaggtataaagacgggtcttggaacgaccgtcgttgttggagaacgctataa

SEQ ID NO: 68607 - DNA, 141 bp, Glycine max
  Peptide Sequence Number=SeqID_185385
atggagaggcatctgaggatgaggagaaatgcgatattggcaatgcaacataaaagtggtgtcagaccttcagtctttgacaaaactagcaaaggtccaccctttgggtgtgacaccctctaccccaacatgaaaatgtaa

SEQ ID NO: 68608 - DNA, 501 bp, Glycine max
  Peptide Sequence Number=SeqID_185386
atgttgcgaaacgcgagagagagaagagaagatataaaggaaactgaccgcaacgggatcgttatacaccgacggaaaaatgcgagtaaagccagacagagaataagaggaatggaagctggagaggaatcggtgggaatcgacgtctccgaggaggaccaagcaagagagagaaacggtggcgaagaagaaggaggcggcgacggcgcgccggagggggatggttttggccttccgaagcatgtcggcggaggaatcaccggcggcaaggcggtgcgtcgtcgtcctctggcggcggcgcgtgagaggtcatgttatcgttatggatgtggattgaatgaacaggaatggaagtgtgtgagtgagttgaaaaggctcgagattcgaggaaaacgactcaacactccacccagcgtctttgtgcaacaattcccatctatccgacttttaaagggcatcatctacaaccagagtttctctgcgcattcaatcagttggtaa

SEQ ID NO: 68609 - DNA, 159 bp, Glycine max
  Peptide Sequence Number=SeqID_185387
atggctgcattgatcttggttggttttattttcacactggtggctaatggtgggggcgattctacacgaagtctggtgatgccttctttggcaattccaaagatggatggagacatggccagtttctctgcattaatgcgaatgggacaaggttggtag

SEQ ID NO: 68610 - DNA, 1035 bp, Glycine max
  Peptide Sequence Number=SeqID_185388
atggggagtgcaactgagacactctgtggacaagctttcggagctgggcaggttaatatgcttggtgtttatatgcaacgctcatgggtgatattatcggtgaccagtatcttgctcttgcctatatacatttttgccgctccaattttgaagcttcttggtcaacaggaagatatagctgatcttgcagggagtttctccattttagtaattccacaatttctttcacttcccttcaattttccaacgcaaaagttccttcaagctcagagcaaggttaaggttattgcatggattgggttggtggctttaattctgcacattggaatgctctggttcttaatttatgtgttagattttggcttagctggtgcagctttggcatttgatatcacgagttgggggatcacagtggctcaacttgtttatgttgtgatctggtgtaaggatggatggaatggattgtcatggctggcttttaaggatatttgggcctttgttaggctctctcttgcatcagctgtaatgctttgccttgaagtttggtatatgatgagcgttatagttcttgctggccaccttgataatgcagtgattgctgttgattccctctctatatgcatgaatatcaatgggtgggaagccatgctcttcattggagtaaatgcagctgtcagtgtcagagtttccaatgaacttgggcttggacatccaagagctgccaagtactctgtctatgtgatagtctttcagtcacttttcttgggaatctttttcatggctattattttggcgactagagattattatgccattatttttacaaacagtgaggttttgcataaggccgttgcgaaactaggatacctcctttctgtgacaatggttctaaacagtgttcaaccagtggtttcaggtgttgctattggaggtgggtggcaagccctggtggcctacatcaacataggttgttattacttatttgggcttccactggggttcgttcttggttatacagtatatttgggggttgag

SEQ ID NO: 68611 - DNA, 963 bp, Glycine max
  Peptide Sequence Number=SeqID_185389
atgggcaaacagactagcaatgaatatccacttgaaaagatcctgaatgaggctgccatgaaagacagaactgtaattttgaccacgttaaatgaagcatgggcagctccaaattcagtcatcgatcttttccttgagagctttagaataggagatcgtaccagtacttttttagatcatttggtaattattgcattggaccaaaaggcatttgcacgctgtcaggttatacatacctattgcttttctcttgttagtgaagaagccgactttcatgaagaagcgtattttatgactcctcgctacttgatgatgatgtggaaaaggattgatttcctacgtactgttcttgagatggggtacaattttgtgttcacagatgctgatatcatgtggttcagggacccttttccactgtttcaccttgatgcagatttccagatagcgtgtgatcatttcacaggtagatttgatgatgtacagaacagacccaacggagggttcaactatgtaaaatccaataataggtcaatagagttttacaaattctggtactcttcacgagaaacctatcctggataccatgatcaagatgtccttaactttatcaaggttcatcctttcattactgatattggcctcaagatgaggtttttggacacaactaattttggtgggctttgtgaaccaagtagggatttaaaccaagtttgtacgatgcatgcaaactgttgcttgggtatggatagcaagcttcacgaccttagaattatgcttcaggattggaaacattatttatccttgccaaccagtttgaagaggttgtcggttgtttcctggagggttcctcagaaatgcagtggaactattttccgatcctcaaaagtcaacacccaccgtgccttcctctcttccctcaatgaagtacagaaacggaggagaatagtcaaaactcgaaagtga

SEQ ID NO: 68612 - DNA, 318 bp, Glycine max
  Peptide Sequence Number=SeqID_185390
atgttgttgggaagggaatgggtccatgaagttggagttgtttcatcgacagtccatcaaaagttgttcttttggaatgaggatggcaaactcgagatggttgaagtggatcaatcatcatatggaatttacactacctttgcgagtgaaggcgatgaagcaatggcgaggacctctctgttcgaaatcgaagattcattttatgtgaataacaaatcaggtgacgaaaaggacaagttcttttgctgggatgtgaatagaggttttttgccgattaacaaggccgttgagaaaacgaccaaagttgaagaaccatga

SEQ ID NO: 68613 - DNA, 201 bp, Glycine max
  Peptide Sequence Number=SeqID_185391
atgtctggactcaatagagaattgatggaacacatattgcctatttgtgaaggaaaaactaatgtgtttgaaacattattcagattaaagaatgaagttgaatttcgatgggaaaaggaacaccaagaagcctttgatgacattaagaaatatcttgtcaatccaccaattccaatgcctcctgggaaggaaaagacttga

SEQ ID NO: 68614 - DNA, 375 bp, Glycine max
  Peptide Sequence Number=SeqID_185392
cctatccctcttaagttattgaggccacaaggtctaacactcagccttgcattatcaaggactttagagtcaaaccagtttccactcttgaatgaccctaacaaagcatgcatctacgtgatcaagctttccataccaggaagccttcttaacaacaaagagaagaacaagatgaaagattgcaaaaatacaagtggtgaggatgtctccttcacctctaggatctcacaatcactcacaaactcatctcaagctctcaaatcggctcctgcttcaagctctggtctctgcagatcttcacacagcaaaatctctcaaaactcttggaacttggacctttctctctttagaaaccctagacatgcaaagctctga

SEQ ID NO: 68615 - DNA, 333 bp, Glycine max
  Peptide Sequence Number=SeqID_185393
atgacgacttcattttgtggggacgtattggggacaacggtggcctatacgcgcgtccccgcaatcccaggggaaggtttccggaggtcggagagggtggagaaagagagggaggaatggggccgaagaatttgtttgcggcgagggagaggttggagaggaatgggaggtgggcaacgtgttgacaaagagcatgttggagaggtacaagttggtgtggttgagggcggtgacatggtgacaattgtcataggtgacactgaaccacgagcaataagggatggaggcatttcacaaagagagaacgagtggtgtggtgtcggtaatgactga

SEQ ID NO: 68616 - DNA, 1794 bp, Glycine max
  Peptide Sequence Number=SeqID_185394
atgtctgttacaggatttagtgatgaaactccacgggactaccactgcaatttaggtccagatggtcggcgtagagatgctgatgaaagacctgagctgtgtagaggaacggttgagtttgttgctacaaaagaattcatggtccgtgatccaatgcctgctgtatacttctttctcattgatgtatccatgaatgctgttcaaactggtgcaacagctgcagcttgcagtgccataactcgagttattaaagacaaagaccttcctgagggtcctcgcacattggtgggagttgcaacttttgattcaacaattcatttctacaacttgaaacgtgcattgcagcagccactgatgctcattgttcctgatgtccaagatgtttatactcccttgcaaactgacgtaattgttccactatctgaggcggctttccttgcaatgaaggacactggaggaaagctgttggttttccagtcagtcttgccatctataggcattggtgcactttctgcacgagaggctgaaggtagaacaaatatctctgcaggtgaaaaggaagcccataagttacttcaaccagcagacaaagcgttcaaggaactggcagttgaatttgctgagtatcaggtttgtgttgatgtgtttgtgactactcagacttatgtagacatcgcttccatatctgctatcccacggactactggtggacaggtctattactattaccccttctcagctctttctgatactgcaaaactttacaatgatcttagatggaacatcactaggccacaaggttttgaggctgtaatgcgtgtgaggtgcagtcagggtatccaagtgcaggaatactatggcaacttctgtaaacgcattccaactgatgttgacctacccgggattgactgtgacaaaactttcatggtaactttgaaacatgatgataagttacaggatggatcagaatgtgctattcaggtatttgggaggtttactgctcgagtatattccaagggttttatgatctgtgcccttctttacacaactgtgtatggccaaagaagaatacgtgtcataaccttgtctctgcccgtcactagtatgctcagtaatctgttccgtgcagctgacttggatactcaattttgctgtttcttgaagcaagctgctagtgagattccgtcaaagccactcccacttgttcgggaacaagtgacaaacctttgcatcaatgcactattttcataccgtaaattttgtgctactgtatcctcatctggacaacttattcttccggaggcattaaagcttttgcccctgtacacacttgcattaactaagagtacagggttgcgaacagaaggaaagatagatgaacggtcattttggataaactatgtatcctctatctctgctccattagcaataccacttgtgtatcctaggatgatggctatccatgatcttgactcaaaggaagatgatgactctgttattcctccctttcttcctctttctagtgaacacatcagtgatgatggaatatatcttcttgagaatggtcatgattgtttgatatatgttggagactctgtgaatccagacatcgtgcagaaactgtttggtgttgctacagttgacaaagtccctaccctgcagtacgacaatccactatcaaagaagttaaatgaagtggtaaatgagatacggcggcaaagatgttcctacttccggttcaagctctgcaggaaaggagatccatcaggtcagtgcattagaatgattgtgtaa

SEQ ID NO: 68617 - DNA, 333 bp, Glycine max
  Peptide Sequence Number=SeqID_185395
atgacatcaacagtgacgacgacgatagagataccaatagtgatcacggtgataatggtggtgacaagtggttgtagtgatgtcgatgggggtgatgtggtgttggtagttacaatcagtggtgatgacaatgatagtgacaaaagtggtgacattgatgacaatggtggtgatggtgatagcaacaatgatagtgttggtggtgacaccattgatggtgattgcggcaacgttgatggtgattgtggtgacgataatgatgatgacaatgttggtgatattgatggcggtaatgtagataatgatgatggtgatagtagcaatcagttataa

SEQ ID NO: 68618 - DNA, 529 bp, Glycine max
  Peptide Sequence Number=SeqID_185396
actgtggaggcctctggtaatcgattaccagtctatgtaattgattacacagaggaatgggtcactggtaatcgattacacatagctggtaatcgattacacagtgcctttttcaggttttcatgtcctgaagctatcgtgatggcagcgcagctaatccatgatcgagtggagatggagtgcctagagggagcttgggagaccctcgaaggcaacgcgaggtgccgatttcggggcacgattagatttacggctacttcattggtgcatccagatgaacccgcgcgcacgcttcagcgtactgtggagtggatactacccatgcctacgccataccgtctagtggagccaatccaagtgatcgaggtaacgtcatccgaggaagaccctgaggaggatctcgaggagctacctcctgagcctgttgtggatgctcttgactttctagagggtgatgaggacccactccctgaggtggattctcccgaggacgtcatgtcggcatccgaggcagactctacggaggata

SEQ ID NO: 68619 - DNA, 1140 bp, Glycine max
  Peptide Sequence Number=SeqID_185397
atggtcacacacaatacaaaacctaatcactccgcagaaacccacgtcttcgtctcccacttcctctacgacgtcgtccaactcctccgtggaatccaccagttccaaacagtccctaacggaggccgcgatcgcaatttcagaaggcagaattcggatcaacgcttcgtcaattgcatggtttccgcgctcaaatcgcggatgaatcacgtcgagtgtccaccaccggtagcggaattgttcagcatagaacacgccgagtcaactcagttactattcgaacactcgctcttcttcaaggtcgcgcgcatggtcgccaacatcgcaatcctcgaatccgcattaaccgagaacgggaagctgtgcgtgctggatttcgatatcggcgacgggaaccaatacgtgagccttctccacgagctttcggcgcggcggaagggagctccatccgccgtgaagatcgtcgcggtggcggagaacggcgccgacgagaggctgaacagcgtgggattgttgctggggagacacgcggagaagctagggattggtttcgaattcaaagtgctgattcggagaatcgccgagttgactcgcgagtcgctggattgcgacgccgacgaggcgctggcggtgaactttgcgtacaagctttatagaatgcctgacgagagcgtctccacggagaacccacgcgacgagcttctgcggcgtgtgaaggcactcgcgccgcgcgtggtgacgctagtggagcaggaggcgaacgccaacacggcgccgttcgtggcgcgcgtgtcggagttgtgcgcttattacggcgcgctgtttgactcgctcgagtcgacgatggcgcgagagaactcggcgcgagttaggatcgaggagggactgagtcggaaggtggggaactcggtggcgtgcgaaggaaggaaccgcgtggaacggtgcgaggtgtttgggaagtggcgagcgcgtatgagcatggctgggttcaggttgaagccgctgagtcagcgagtcgctgagtcgatcaaagcgcgactcggtggcgctgggaaccgagtcgcggtaaaagtagagaacggtgggatttgctttggctggatgggaagaactctcaccgtcgcatctgcttggtgttaa

SEQ ID NO: 68620 - DNA, 135 bp, Glycine max
  Peptide Sequence Number=SeqID_185398
atggatgaaacaggagagaagttagaatgcgaagggagaagaaacatgtcagcgaagacaagtgcgtgcgagaggcgcgtgggaaggaaaggaagtaatggatctttattcggaagcgatcagcagagagactga

SEQ ID NO: 68621 - DNA, 270 bp, Glycine max
  Peptide Sequence Number=SeqID_185399
atgaaaaatctaaggtcccaaaaagaaaacaatgatttggtcgagaaagaacacaaaaccaacagttcttcagactcatcaatttcgctgtttatcatggatccaggtaggaccaacgaggtaaaggatgctggctttccttcctgggtcgacaaccacactctgtacttccatcgaagaggtcgaggtgacactgctaccgtgttcttccttgcttcctcccacactatctttctctatctgacatttaaggttaggttggtgttgtag

SEQ ID NO: 68622 - DNA, 231 bp, Glycine max
  Peptide Sequence Number=SeqID_185400
atgtatgaaacatgggcaccatcaatgcacttaccgtggataataagcgcaattccctcttgggttggaattgcgcttagcgcgcccttggcgcttagggacacatcaaaagttgttattttcaaaatcccaatggtcagactgtggaagaatgtcttaggaagctctaggcaaaatctgaagatgatccaacggttaaagaatccaggaatcactattttattgaaatag

SEQ ID NO: 68623 - DNA, 500 bp, Glycine max
  Peptide Sequence Number=SeqID_185401
atgggtggtgcagtgaccttgttggatatccctggtgggggaaataaagtggttatgtgggatgctaccttgtttggcctgtttaatgaagacttccccttgtacataaagcatgaagatctatctgaaatagcacatggtggtcaatgtctcaacatctctattacacaattgcatatgactaggacaagtatgcgagcggggaatgctgatgtgtatggatacctcgagccacagtctatccagagatttgaccaatcacaatttgaatcaaaaagttaccttaagaactggatgcaaaattcaaaacgagatgcgtacctaggagcttacctgaatggtgcacattggcaaatggtcgtcattttgcctaatgaaaatgttgtcatctggttttgttcgttgcataataggccagacaactacctcaaaggcataattaacagtgctttgaaaggacttgatgatactcaacaaagtaaatccaagcctactgctag

SEQ ID NO: 68624 - DNA, 147 bp, Glycine max
  Peptide Sequence Number=SeqID_185402
gcgcctggctgccctgcgctagtcgtagcgcctgcagcaggggcgccaccagtagtgcctgatccctgggcactaccaaaggcgcctgcgtcaggggcgctacctctctgtgccacgtgtcacgtggtggggggcgctttgcaataa

SEQ ID NO: 68625 - DNA, 3257 bp, Glycine max
  Peptide Sequence Number=SeqID_185403
gtctctcaccggagatcaaacgcgaggtgctagccttacaaccaatctcactaccgcaagcaacagctctcgcaaagcttcaagaagataaattgcgagatcgacgttcagcttcttctcgtcctttcaaccctcctccaccttccaataacccttccaacccatctccgaaacctagacaaccatttgtgcagcgtactcccgaagaaatggcattcagaagagacaagggtctctgttataactgtgacgataaatggcattccggtcaccgctgcaagggcaaaatccagttgttcattgttgagaactcagcctcagacctcactgaacccgatacagtagacacttccgatataactgagcccgtctccgacgaccccgaaactcactcttctcatgtcagcctccatgcattatccggtctttcatcgccggaaaccttccgtctctacgggacggtcaaccacgcacgtctcaccatcctaattgacagcggaagcacgcataacttcctccaacctcgcgtggcgcagttcctccaccttcctacaaagcccaccctccctctccgagtccttgtcggaaatggctcggtcctcgactgcaatcaggtatgccccaatacccagctatctcttcagggtcatactttcgagattaccttccacttgcttcccattagcggcgcagacgcagtcctgggtatcgaatggctgaaacagtttggcccaattaccacggattactcaacctccctcatgaagttcactcattcaggccacgatatcgagcttcacgccgatgttgaaactggaccagaaccagcctcagcctctcaaatcaaaagactcgtacgtataggctccacctcagcactctttcacttatccatactcaccgcgagcccaactgaacctccaccatcatctctttcccacccaattccggcaattaacactctactccaccaataccagaaactattccaacctccctccaccctccctccaccacgccaagttacacaccacatcaacctccttcccggaacctctccaatcaatgtgagaccttacagatacccgcattaccaaaaatctgagatcgagaggcaagtctctgagctcctttcctcaggattgatccgccccagtacgagcccgtattcatcacccgttctcctcgtgaaaaagaaagatggaacatggcgtttatgtgtagactatcgggcccttaacacaaccacggttcgtgatcgatttcctatcccaactatcgacgaactgttagatgaattgggaagcgcttcttggttctcaaaattggatctccggcaaggattccatcaaatctccatgcacgggcccgacatcgagaaaaccgcgttcaaaacccaccatggtcactatgaatacctggttatgccctttgggcttagtaatgccccttcgacatttcaagctgccatgaatggcctccttcagccgttcctacggcgttttgcagccgtcttcttcgacgacattttagtatacagtgacccactacaggcccatatcgagcatttacaagacatcttcaaggctttgctacgtgaccagttctatctgaagcaaaacaagtgcttgttcgcccaaaggaagcttgaatacttgggacacctagtttccggcaacggagttgaacccgaaccatccaaggtgcaagctatgacccaatggcccacacctttatctgccaaggatcttcgtgcattcctcggtttaacggggttttacaggaagttcattcagcattacgcctctatcgcggctccacttaccacgttactctgcaaggacgcgttcgaatggtccttaaccgcacaaaccgcctttgatcagctcaaaagggctatgacaagtgccccagtactggcccttcccaacttcgcagaacctttcgtggtggagtccgacgcgtcggctactgccatgggcgcggtgcttctgcaacaaggccgtccaatagcttttttcagtaagctatttaaccctcgtctgctccttgcttctacttacataagggaactacacgccatagttgccgcggtccgaaagtggcggcaataccttctggggaggcccttcacaatcatgacagatcataagagcttgaaggagctcatgacccaggtcatacaaacccccgagcaacactactacctatccaagttgcttgggtttgactacacaatccagtacaaggcaggcaatactaatatcgtcgcggacgctttatcgcgtataccaccagattccggccaaatgcttcttctgtccgtaccccaccttgacttcatggatgacattagaagaaccttgcatgataatccggagttccaacaactcctctctcgggttcgttccaacccttctgatcaccctggatttcgcattcaccgggacttgatattattcaacggacgcatttggttgaacagggacaaccctagcatcccttcccttctactggaacaccactcaaccccgctaggaggccatctaggtgttaccaagaccacacatcgtttggaaacaagcttcttttggaccgggttgtgccacgatgtcaagcaatttatacgcgaatgcaagggctcttgcaaccattaccgataccggcaggggtctgggaggacctgtcaatggatttcatcacccatctgccatcatcgcatggattcacggttatcttggtcattgtggatagatactcgaaggcagcacatttcggagccctacccaccaacttctcagccttcaaggtggcgtccctcttccttgatctcgtctgcaagcaccacggcttttccgacgagcatcgtctccgaccgcgacccaatcttccttagctccttttggcgagagttattccgcctcagtggcacccgcctccgcatgagcacggcgtaccacccggaatccgacggccagactgaagtcatgaatagggtcttggaacaatacctgtgtgccttcacccattcacaaccttcaagctggtttcgatttttgtctttagcagaatggtcatacaatacatctctgcattccagttcgaaactaacacctttcgaggtcgtgtacggcaaagcacctccatcagttccccattacatccctggaatgaccaacaacgaggctgtcgagtctctcatctcttctcgtcagcagcttcacacaaagctacagcaccgtctacgaaaagcataa

SEQ ID NO: 68626 - DNA, 416 bp, Glycine max
  Peptide Sequence Number=SeqID_185404
atggcggatcataccacccgaaagacaactacggacaggttagaggaagcaatcgcacgactcaccagtagccaaacctctctctcaaacaaatactcagacctcgccggaaaggttgattccattctggatcaccttcgtcttcgcgaaacctctcataaccaaccaaactccaacccctcgttcaatcatcgtcactcgataaagcacgatataccaagatttgatggacgagatcctttaggatggatattcaaaatccagcagatgttcgattatcaaaacacgcctgaagaagaacgaatcacggtggcttcgttctacctcgacggcgccgccctgagctggtaccagtggatgttcagcaatggttttatcacgtcgtggacagggttcctgcaagcattggagtctag

SEQ ID NO: 68627 - DNA, 577 bp, Glycine max
  Peptide Sequence Number=SeqID_185405
atgcaaagtgtcctcgccggggcgaagattgaatgcggtaatataagaatccgccgccaaatgattctgcccctgcatttcatacactttccccagcagcacataattcagccacgacatttgcaattcaatccccagatcgatcgcccggtgcgcctcgtcaatgcgcccctgcgtcaatgcatctaccgccagaacttgctgcatgattggcgtgtttttcagttcggggatggtcgccaaatgactgatatcggcgcgcagttgcgccaaggcctggctgtcgaacggttgataagaattgcgcagcaggtccaccagcgctttttccgccagcaggtagtggaagtccggcgcgcttttaatcaactcgctcagctgggcgctggcgcgggtcaacgaatcggcgtcgccgtggatcagcaactgatgcgcctggtagaagcgctgcagcagcggcccgttgtcgggcagcagctgcgccagacgctgctccagctgtggcggccagggctgcttcagcgctgcggacaggctggagaggaagtcggtctggatcttcagctggttatcggcg

SEQ ID NO: 68628 - DNA, 1710 bp, Glycine max
  Peptide Sequence Number=SeqID_185406
atggcaataatctttctttcaagctccgcaattcttcttccaagtcttgctttctttctcacattatttaaccttgcaagttctgaatcattcatcggcgtgaactacggacaagtcgctgacaacctgccgccgccgtcggcgacggcgaagctgctccagtcgacggccatcggaaaggtgcgtttgtacggaaccgacccggcgataataaaagctctggcgaacacggggatcggaatcgtgatcggagcggcgaacggggacattccggggctagcctcggaccctaacttcgcgaaaacgtgggtgaacaccaacgtcgtaccgtactaccctgccagcaacatcatcctcataaccgtcggcaacgaagtgataacctcgaacgaccaaaacctcgtgaaccagatgctgccggcgatccagaacgtgcagggcgcgctcgacgccgcctctctcggcggcggcaagatcaaggtctccaccgtgcacgccatgtcggttctcagggactctgagccaccctccgccggaaggtttcatcccgaatacgacaccgttttgcaggggctgttgtcgtttaacaatgccacgggctcgccctttaccattaacccttacccttactttgcctacagaagcgaccctggcagagctgataaccttgctttttgccttttccagcctaacgctggcagagttgactccaacaccaacctcaagtacatgaacatgtttgatgctcaggtggacgcggttcgatctgcgttggatgctatggggtttaagaatgttgagattgtggttgcggagacagggtggccctacaaaggagacagcaatgaggctggtccaagtcttgagaatgctaaggcttataacggcaatctgattgcccacctgcgatctatggttggaaccccattgatgccagggaaatcagtggacacatacctctttgctttgtacgatgaggacttgaagcctggacctgcttctgagagagcctttggactctacaaccctgatcaatccatgatctatgatgctggcctctccaaacagcaagaaactagtagccccgtgccgacggttgccccgactccggatgtgtcaaaatctccagtgattccagcgccaacagacccgggtcaacaaacacaaaaatctccagtgattccagcgccaataggcccgggtccaacaccaaataaagcagaactcttaattggacatgaagccaccattttgaagtctttaataatgttcacaactactccggatgtgtcaaaatctccctctactccaaagccaacagtttcaagtccaaccaaaacaaataatagtgcaacatggtgtgtgccaaaaggaggagtggcagatgcacagttacaagcaaatttggattatgcttgtgggcaagggattgattgtaccgcaattcaacaaggaggggcttgttttgaacctaacactttggtaaaccatgctgcatatgccatgaatctattgtatcaaacagctggacggaatccattgacttgtgatttctcgcaaacagccatgttgtcaacgaataatccaaaagtcccaaaaatcttgacgatgtcgccgaaatcgtggtcatattttaaaaccttggattttagtgtagttacaagagttgtctttatgctggaggaaatgcctaacccagaaaacaagtag

SEQ ID NO: 68629 - DNA, 268 bp, Glycine max
  Peptide Sequence Number=SeqID_185407
atggaatcacctgaagatagaaaagtggagcctgagtcagtggaatctcccacgaagacacggttgaagagggaagcattgctgtgtgatccacaactaagaagaaagttatctgtggtagagaatgaaactgagaaaggctctgaggaaaactcatgccatgagtacaagttagaggatacaaaaggggagtgtgaacagaactgcaacaagaggacaatagagactgagagacagattgcacctactttcgcatttgcttttgatg

SEQ ID NO: 68630 - DNA, 807 bp, Glycine max
  Peptide Sequence Number=SeqID_185408
atgaagaaaaacggcacccacttggtacgttttcatttctcccccttcaaggctcaaagttttgatcttaaatcagcaaaatttaacgtctctgttaacggggtttcggtgttgagcaatttccaaccacctaatgatgtgttgctcaaagagtttattttgaagattgtgtcaaacgtgcttgagattttgtttaggcctgttggtgactcaggttttgcctttgtcaatgccttggaggtgtttactgcccctgtggattttgttatagattttggagccaggttggttggtccttctggggtggaggagtacagaagcctttcatctcaggttttggaaactgttcataggatcaatgttgggggtttgaaaataactcccttcaatgacaccctttggaggacttggattcctgatgaggattatctggtgtttaagggtgctgcaaagcctgcagtgagcactcacacaccaaattaccagaagggaggtgcaactagagagattgcacctgaaaatgtttacatgacagctcagcagatgaatagggaaaactcaagtttggcttcaaggttcaacataacctggaacttccctgtgtctcctggtggtgttccacacttggttaggttgcatttttgtgatattgttagtcctgctctcaacttgctctactttgatgtgtacatcaatgggtacattgcatacaaggatcttgatttgtcagcccttgcaatccacacacttgcatcacctgtctatgtggattttgttacaaattcagatgacacaggttttgttcaa

SEQ ID NO: 68631 - DNA, 1032 bp, Glycine max
  Peptide Sequence Number=SeqID_185409
atgtttggagggagctcccttagtagaagctctgagcctggttctcatggacttcttggcatgaagatcccttttgctgaaatacaatcagcaacaaacaactttgatagaaatctgattatagggtctggtggatttggtatggtctacaagggagaactgagagacaatgtgaaggttgctgtcaagagaggcatgccagggtccagacaaggccttcctgagttccagactgagataacagttctgtccaaaattcgccatcgccacctcgtttcactagttggtttctgtgaagagaattcagaaatgatacttgtctatgagtatgttgaaaagggtccactgaagaagcatttatatggttcatcactacaaacacctctctcttggaagcagcgtcttgaaatatgcattggtgcggctagaggccttcactatcttcacaccggttttgctcaaggaatcatccaccgtgacattaagtcaaccaacatattgcttgatgaaaactatgtggccaaggttgctgactttggtctttcaaggtcagggccatgcatcaatgaaacacatgtgagtactaatgtgaaaggtagctttggttatcttgatcccgagtattaccggaggcagcagcttacagataagtcagatgtttactcatttggggttgtgctttttgaggttctttgtggaagacctgctgttgatccacaacttgcaagagaacaggtgaatttggcagaatgggcacttgaatggctgcaaaaggagaaatgtttggccgaatacggtgttgacaggccagccatgggtgatgtgttgtggaatttggaatatgcacttcagctccaagaaagtgagccacatgccaatagcagtgctagggaatctgtgagtgtgacaaatgctgttattcctggaaatccttctaccaacagaaggacagagagggattattataactgttcttcagatgtaagtactagccaagtgttttcccagttaatgaacaatgaaggcagatag

SEQ ID NO: 68632 - DNA, 942 bp, Glycine max
  Peptide Sequence Number=SeqID_185410
atggaaggaccttatgatttatcatgcaatggagaagctggtaacaaaagccttcagatcattaaatactctccttataaaccctgcaccatgatatcatcatcaccttggtttgatctaagagtgttttatgtgagagtgtgtggcattcaggttgatgaatccaccccagagtttctctctctcaatcatattcctcttagtcctgatacccttttagaggtgaacggtgttaggagaagcatttactctgatggagaagagtcttcagttctgagaagggatagagtggataagaaatccgaggaagctacctttgtgaacactgatagtatacgttttaccgggagcatgaaatttgaggtttatgataaagagcattgcattctctctggggttctggagatgtctaatagcaatggttttgttggtggatcaagaagttgtgtgaagagatggagtatgatttgtcaaacagaaatgtcacctggttgtggctttttcaagaggaaacatgttgctgtgcccgaattaccttgtcctgaaattgaggtttatgttgctggttgcttctcaggaacacctattatcttaactaagacactgcaactcaattgccggaagaagcataacaggaaatgcgccttggattccattccagaatatgaaacaactgagtgccagaaagatgtttctgatcatggacttgatttgcaggtagttgactgtagaagcttcaaactggaacaagaagaggattacaacagcatgtattggccaagaacagtatatgtagatggggaagatggtgaactatcatggtttaatgctggggttagagttggtgttggaattgggcttggcatctttgtaggagttggtataggggatggcataagtgtcaaattttgtcatcatcatgggttgacatccattgtgtga

SEQ ID NO: 68633 - DNA, 222 bp, Glycine max
  Peptide Sequence Number=SeqID_185411
atgattcttgaatttagtggagatgtacaacttcccaaccaagaagagaaagaggttaatgaccttgcattacatgagtctcatcccacaattattatgtgtagctgttcactttctttgcgggagttaagggtccaggctagaggaggggataacaagctctatgtaacaggttaccggctcattcaattcaacatcaaaatccagatcagagagtgctaa

SEQ ID NO: 68634 - DNA, 471 bp, Glycine max
  Peptide Sequence Number=SeqID_185412
atgatgctcacacaaaagctgcagaagagtaaggacgcgaaacccgggaagcaacacaagtggtcagactggaacactgcgttagtgagagtattgatgatgggcaagaagaagccacaaaaaactaaggaactttctgtggcaatagctgaagcatcatcaacaatagatgagaaagagcaacatgaagttcaagttcaacctcaacctcaagctcctcgaaagagaggtagacctcgtaagattgttttaaagttggaagaaagtgaagaggaaaaggcacaagtgatagagcaaggaggagcacaaggcacagagagttcaatggaaaaaggtacaaccaacgaggaagaaggaacatcatcggcatgcatgagggttacaacaaaacaagaagagatacaacttccaaaagtggagccatcgagaagcagagctaggaggaaaagcaaacccagaaagagcagttaa

SEQ ID NO: 68635 - DNA, 168 bp, Glycine max
  Peptide Sequence Number=SeqID_185413
atgcacagtttaaccgtgcaagtctccgacggagtgaggagcaggaaaacacgagcggcacaactagcgatcgatgtgtcgtatttgacggcggagggtggtggtggagggggataccgtcaagttaagtggaagtggtcgcacctcgttgacattgttcaccagtaa

SEQ ID NO: 68636 - DNA, 1137 bp, Glycine max
  Peptide Sequence Number=SeqID_185414
gggtataaaattattgggtcgcatagtggtgtcaagctttgtagatggaccaaggcacagcttagaggtcgaggtggttgctataagcactcgttttatggaattgagagtcacagatgcatggaggcaacccctagcttggcatgtgctaataaatgtgttttctgctggaggcatcacacaaatccagtagggaaaagttggcagtggcagatggatgatccaatagagattgtaaattctgcaatagacctgcatacaaatatgattaaacaaatgaaaggagttcctggagtcaccttggagcgattatctgaaggcctctcaccacgtcattgtgcattatctcttgttggtgaacctattatgtatccagggataaatgcacttgtggatgagctgcacaaaaggaggatttccacttttctagttacaaatgcacaatttccagagaaaattaagtcactgaaacctgtcacccagttatatgtaagtgtagatgctgcaacaaaggactctttgaaggcaattgatagaccactcttcggagatttctgggagcgattcattaatctgaccatgccttacgaagtgtatgaagatggaagagtaactgattccttgactgctctaaaggaaaaacatcagcgaactgtataccgtctgaccctggtgaaaggctggaataccgcagacattgatgcttattctaagctctttagtttaggagaacctgactttgttgaaatcaagggagttacatattgtggctcgtccactacatcaaaattgacaatggataatgtcccttggcatgctgatgtgaaagctttttctgaggccctagctttgaaaagccaaggagagtatgaagtcgcgtgtgagcatgctcactcatgctgtgtcctcttagcaaaaactaataagttcaaaattgatggtcagtggtatacatggatagactatgaaaaatttcatgatctggtggcatctggaagatcttttgacagcagagattacatggctgccacaccatcgtggtctgtttatggatcagaggaaggtggatttgatccaggacaattgagatataggaaagagagacatcacaagtcaacccgcaatcaagcaggttag

SEQ ID NO: 68637 - DNA, 157 bp, Glycine max
  Peptide Sequence Number=SeqID_185415
atggagattatgaaagagagagtgatgaatagtgatacggcgaacaccatcggaggaatcagccagcgagagcgagcaagaaccctctatgaggggtttaaacttgcagccccggttcctgtgttattgttattgacttcgagtcgatgcgaaagtg

SEQ ID NO: 68638 - DNA, 456 bp, Glycine max
  Peptide Sequence Number=SeqID_185416
atgggtaaaatccctcctgctatggtggaaaagggaaagttggatcatttagaggaaaggctcagggccattgaaggaggcagagattatgcctttgctaacctagaagagttattcctagtacccaatgttgtcacccctcccaagttcaaggtgtcggactttgacaagtacaaagggactactagccccaagaaccatctaaagatgtattgtcagaagatgggggcatacgcaaaagatgagaaactactgatgcatttcatccaagaaagtcttactggggcagctgccacctggtatactaacttggaaccttcccgagtccattcttggaaggacctaatggttgccttcattaggcagtatcagtacaattctgatatggctttggataggatgcaactacaaagcatgtgcaagagggggcacgaatctttcaaggaatacgcctaa

SEQ ID NO: 68639 - DNA, 177 bp, Glycine max
  Peptide Sequence Number=SeqID_185417
atggtgccattagcagaagtccaagcacaaacagatcaaacacgagcaaagggggtgcagggggtgcaaacatcaacaaacaagagaagaattgatcgtgcaggagcgttgagtgcaagatggaagattcaatgctggcctttaggggacaagaataaccaaattgctgaattctaa

SEQ ID NO: 68640 - DNA, 411 bp, Glycine max
  Peptide Sequence Number=SeqID_185418
atggaaagaagggcagagggggaagtagcgtcagcggttggggtatcatggttaggcagaggatatgttcctcggagcttcgatctgtataaggctggatacagagacatagagtatattatacgtagtcagcatttaatcaacggaacttcaacacgtgaggaattaaagaatccagatgaagataccaagcagaagttaaattcgaaacttgataaattgaagtttcacgagccatggggccagctgatgaagactagttatcagaactctcgctttgcacatcaggttgagcgatttgcgtgcctttatactagccaagtatctaacttggcattgttctcttcagacaaatactacagacccagtgaagattttatgcagcatgaatttagcatttttgaaagctga

SEQ ID NO: 68641 - DNA, 2586 bp, Glycine max
  Peptide Sequence Number=SeqID_185419
atgggaatgggaggaattgcagtgagcgtggttacagtgttgttgttgatgattggattaacaatgggaatgagtttgagttcgagaacagaatggtttgcgttaagggagcttcgacaatcgttggagattagggcaaagtattggccaataaaagccgaaccgtgcgggaactggaccggggttcagtgtcggaacggtcgagttgtgggtataaacgtgtcaggtttgaggagaacaaggtggggtaggcttaacccaagttttgaagtggattctctagtgaatttcacactcttagaaacgtttaatgcttctgggtttaagcttaatgggtctattcctgagtggttgggtgagagacttggtgtgttggaggagcttgaccttagcctttgttctataaagggttcaattcctgattcaattgggaggttgagtaagttgaaagttttgttgctttcagggaattttctcactggtagaatgccttcgacccttgggaacctcacaaggctttctgttcttgatctctctggcaactctctttcatggcctgtgcctgattctgtgtctaaacttgggaacctctcaaggcttgatctttcttataatttcttgtctgggtctgttccacctgaactgggtgccctttcgagtcttcaatttttgaacctttctgggaattcttttactgggtcggttccctctcaactgggtaacctttccaagttggttgaggttgatcttagtatgaattttctgtcgaggtcattgtcgggtggtttgttttcttctgtggttttggccctcgaggttctcattctcagagggaatttgttagatggtgttcttcctgctaatttgaggtcaatgcctaggttgcactttcttgatgtgtccagtaacaacctcactgggacactgccgaattttgccgattggaatgttagctctgctggtgttgtgttcaatctgtcaaacaatatgttctatggacttctgaatacttcacttgacaggtttaaaatgattgatttatcaagtaattttttggaaggtgaggtgctaggtggtggtggtggtgttagtaatgttgatctagatagaaattgcctacagaggattccaaaccagaggaatttggaagattgtagaatgttttatgataaaagaaatttatcctctgcattcccagaatctgagtccagaagccgcagacgggtgatattcatgctggtaggaatatttggtgggcttggctttattgtgctgctggcattggtcctcatgcttgttctaaaacaatgtcacaatcggaaaagcttggaagttccaagggagaccaaagatgggggggctgttgaagaaggggaaagtcctatacctccgaaagatattgactttgtgactggtgtgggagaagcatatagttttgagcaaatgctccgtttgactggcaatttcgctgaatcaaatgtcataaagcatggtcattctggggacctcttcttgggagtcttggaaggtggagcaactgtggttgtcaaaaaggtagatttgaatttatttaagagagaatcgtatgttgtggaattgggactattaagtaaggttccacatgcaagattggttccaatcctgggccactgcttggacaatgaaaatgagaaatgcatagtttacaagtacatgccaaatcgagatttagctacttccttgcacagagtcactggttcagatggtaaaatacagtccctggattggatcacgagattgaaaattgcgataggagctgctgaaggcatagcttacctacatgagtgcagccctccccttgtccacagagatatccaagctagcagtatactacttgatgataaatttgaagtgcgactaggaagtttgagtgaggttactgcccaaggagatcttcaacaaggagtcatctcaagggttttcagcaagccaccatcttctaatcaagccgattctggtaaatcaccagtgacatgcacctatgatgtctactgttttgggaagattttacttgagctcattaccggtaacattgaagtcagcaagtcagatgatgccactacaaaggagtggttagagcaaaccttgccttacatcactatatacgataaagaacgggtgactaagattattgacccatcattgatcgtggatgaggacctattggaagaggtatgggctatggcaattgtggccaatgcatgcttgaaacccaagccttccaaacgtcctcctatgagacatgtcctgaaagcattggaaaatccattgaagattgtgagagaagaaaatactagctcagcaaggttgagaacaaactcttctaggaaatcttggagcactgcattctttggtagctggaggcacagctcatcagacagtgttgttgccacaaacaaagagggttcaaatgacactaaaaaatcaggaaaagtaggttctcaaagtagtggaaatgatcactcttcttccaataaaagatcgtccaatgaaattttccctgaaccattggaaatacaagatgtggagacaggagtgacaagataa

SEQ ID NO: 68642 - DNA, 1116 bp, Glycine max
  Peptide Sequence Number=SeqID_185420
atgacgtccaaaaacaataccggaattctaaggtttattccgacgaactgcaccaggtgtgtcaaatgggtagtgagtcaagaagagcttcaggaaatcccgcaatatggaagtacgaaacatcctcgttgttccgacagaggtggcgaaacttgtgttggggaagaagacccgaagtggtggcgttctcgccctgcaagtccacgaagcgcccgtgatgaaagaacatcatgcgtaatggtgttggagcggtctggcatggtcgggtgtgagggttgggtctggggtcgggtcaactggatctatattagagcaattaggatcttcgtcttcagcaacgagaaggaaagctttagaggcgtagcaatgtcctctaggaaagtgggttcctccgacgtcaagcatttcaccatgggtggcggaggtggcggtggtgtcaacgacgaagtccgtggcagaggcggtaatgattcgggacttggttgtatgggtgagaagggcatccagtcgggagttgaggcggcgtgtagcgacatcaagtttggccaggacggcctcaaggcgatcctcgctagcgggagaaaagtcatggtgggttggcggttgttgtggatggcaatggtttgggctgtaatggcatccatggaaggcagccatggaagctccgtacgacgagtggcagccgtgggagggttaacacctctagaaacaaagaaggaagaaggagaaggtaagctggtttcgaggttaccggtgcctccagaggaagaagaaaaacacagaggagaaatgttcaaaattcagcaatttggttattcttgtcccctaaaggccaacatcgaatcttccatcttgcacacaacgctcctgcacgatcctgtcactaagggtggtgcggtggagaagagggggcacggtggagtgaggagatggtggcggtggcgtggcgaagaagaggggcataatggtgggaggaaaggggtgagggtggcgtggttgcgacacggtggagcagagaggaagaaggagaagggtgcaattctgggaggtgagggtggcgcagtcgcgatgtggcagaggagaaaggaaggaggaaaatggtgcaacactgggagg

SEQ ID NO: 68643 - DNA, 1982 bp, Glycine max
  Peptide Sequence Number=SeqID_185421
atggccatagctcggttagttcggcaagcaaagcgccctcatgggttgtgggtgaagatgacagccgtgaccatattgggtctctgcttcatctttgtgtggggggtgttttcgtcttcttcaacctctgtcaccacccaaagggagagctttgaggacattgcagaacccgtgtcctcttcctcttctcacaaacctcagaagttgaagaaagatgaatccaaaaagggtggtggtggtggaaagagtgagaaaaaaagtaacgggaatgggtcttcccaccctgaacaacacaagggaaaagacaaccaaaagaaagagaagaaacgcgtgcataaggaggataataaggagaaagggaatcatcgaggggatgaagatcctcaaccacaacatgaccaggaagagaaagagaagcgtgaagaggaggtggaggtggagggtgaggaggagagagtggatcgagagagtgagggggatgtggatgctgatggtggcggtgatttggctgaatctgtggatcagggtgattctgaggcggtggaagatgtggaggaggtgagaaaagcaagcaagggaaaagtgaaaggacccttgttcaatccaaatgctacctatagctggaaactgtgtagcactagaagcaagcataattacattccctgcattgatattgaagttggtggtgggaaggtaccaagctaccggcacacggagaggagttgcccgaggacgcccttcatgtgtatggttcctcttcctcatgaagggtatggatttccactaccctggcctgaaagcaaattgaaggtgattatggagaagttagataaggtagcttatggaaaagttaagatattgtataagaatgttgcacacccgaaactagctgcatacataaaaaggcataattggttgatggagtctggagagtatcttacttttccccaaaaccaatctgagttgaagggagggattcatcactatcttgagtccattgaagagatggtaccagacattgaatggggtaaaaatattcgtgttgttctggacattggatgtacagattcgagctttgcagctgctctccttgacaaggaggttttaacattatcactaggcttgaagaatgacctagtggacttagctcaggtggcgcttgagcggggcatcccagcagtgattagcccttttagtagaaggaggcttccttttccaagtcaaagttttgatgctatacattgtgggggctgcggcataccttggcattccaatggtggtaagcttctattagagatgaatcggattctacgacctggtggatactttattatgtcaactaaacatgacagcattgaagaagaagaagccatgaccacattgaccgcatctatttgttggaatgttctggcgcataaaagtgatgatgttggtgaagttggagttaaaatatatcaaaagcctgaaggaaatgacatttacgaattgagaaggaagaaggttccaccactttgcaaagaaaatgaaaatcctgatgcagcctggtatgtttccatgaagacttgtttgcacaccattccaattggaattgaacaacacggagcagagtggcctgaggaatggcccaagaggctcgaatcttatcctgactgggtgaacaacaaagagaaagtggttgcagacaccaaccactggaatgctgttgctaataagtcatatctcaatggattgggcatcaactggacaagtatccggaatgtaatggacatgaaatctgtctacggaggattggctgttgctctctctcaacaaaaggtctgggtgatgaatgtagtacctgttcatgcaccggatacacttcccatcatttttgaacgtgggcttattggtatataccatgattggtgtgaatcatttggcacttatccaagaacatatgaccttttgcatgctgatcatttgttctcacggctcaaaaacag

SEQ ID NO: 68644 - DNA, 417 bp, Glycine max
  Peptide Sequence Number=SeqID_185422
atgaaagcaaaaaaggatttggagcgtgggaaaattatgggggttaactttgatggtatggaagatgcaatggtggtccagttggaaggtatggtaaggagggatcaaaaggagatagaaaatattgagaaggtaaaaatagaggagcacaagaagatgcaatggttgtatgttccatcggaagggacatcgggagaagataggttgagggtgtgggaggtgcttaagggtattgggagtaggtgtgatattaaaaaatggtgtttgttgggagatttcaattgtgtcaagagtcctaatgagagagaaggtgttggtgttattgggtttggtaggagagagagagaggagtacaatgctttcattgagtccttggagttaatggatacgccacttgaggggaggaagttctcttag

SEQ ID NO: 68645 - DNA, 219 bp, Glycine max
  Peptide Sequence Number=SeqID_185423
atgatgcatatcattttgaagatcatcagggtgcgagttgcagaagaatcaaaaggtcaagataacatgttggaggtggaaaggccaaaggaaatcgcatgcatagggtgggacaaacaattagcggagccagttggggagcaagaggaaggtcgggaactggacattgaagatagcacaaggaaaattgtcaaggagatgaacaagacagaatcttga

SEQ ID NO: 68646 - DNA, 168 bp, Glycine max
  Peptide Sequence Number=SeqID_185424
atgttggatgaagtgtgtcaccgtgtgaagtgtagcgtgagagccgccgagaagtcgataatcatgaatgttacaaataatatcataatagacctttcgttcagtacgatgtggttcaaggatgaaccaggtggacacatgctagacgtaggtttcccgcgtttgtag

SEQ ID NO: 68647 - DNA, 774 bp, Glycine max
  Peptide Sequence Number=SeqID_185425
atgatgaggtggcaaaaggggattggtggttgcaaagtacgaagtgaaaagcagaatgtattggtatcagttctaactaacagccgcatctctctctttctaaacataacaccaaccttaaagcttgaaactttcactaagcagagaagcatggtgtcaaaaaatccgaacccctctgaggctttttacttggacccctccggcatgtcgctccccggaatccttcccttcgccgccgcagccaccgccaccgcagattcctttgaggaccctgctaagaagactcgcaagccttacactattaccaagtctagggagagttggaccgaacctgagcacgacaagttcctcgaagctcttcagttgttgcagcttatgaaggattgttataatagttatatgtcaagatttgaccgtgactggaaaaagattgaagcatttgttggatcaaagacagtcatccagatacgtagccatgctcagaaatactttctaaaagttcagaagagtgggacaaatgaacatcttcctccacccagaccaaaaagaaaagctgctcatccatatcctcagaaagcttcaaaaactgctccagtactctcacaagtatcaggatcctttcaatcttcatcagctttgcttgaacctggatacatattaaagcatgactcttcagcaatgcctaaaactcccattattaacactgcagtgtcttcctggtcaaacaactctctgcagaaaaccaccagcgtattgcatggtactaaaggctga

SEQ ID NO: 68648 - DNA, 459 bp, Glycine max
  Peptide Sequence Number=SeqID_185426
aaggttataaggctgaattatttgggtgatgacatggttcttattagaggtttgactatggagaaaacacagagtatgattacctctaatgatgatgatgtcatgtcactattatatgttgttcaacccatggaaccatgtgtactgtgtgatggcatccctctccaagcttggggggagcagtgcttttcaagggttgtgggactttttggaacatttgtgtccttagatattgaaattgctaacttagagagactaggtagagctcaaattatgctaaaggtctccttcttcttaccaatctcgagctgctatgatgtcaaggatagtgacaatgatgaagactttgaacatagtgtacttgagatggatatttcatccttctcgtcagagtgctattctaaggagtatgacaaagacacttatgcctaccaaggatttggatggaaagaatattag

SEQ ID NO: 68649 - DNA, 507 bp, Glycine max
  Peptide Sequence Number=SeqID_185427
atggacttgagcccatttacccacccctatatggaagtaggtgagggcaagggtgcacgtgactacaaagtcctaggtgatgagcaaccaatagaaggaatccaagagcccctaaagtacaaggcgggaaatgagaaagagaatttgaaatggggtcatgaagaggtttatggatcactaacagaagtcataagggagatcattcttaccaataacaaagtggatcaatgggaacagagtaagctaaaacaatcttccctagggagagtgcttaataagagtaagaagaagagagaagaaagaccttgtcaacaatccctcaaaaataccatttccaatagcaatgttagaaattgtaataaaaatttatggatgaggaatgagactaaggggacaaaaagatcttgggaacttggaaaaattatgggggtcacatatggaggaaatgaggatgatatggtgagggagatggaggatttggaaggtcgagaccaacaggagatataa

SEQ ID NO: 68650 - DNA, 601 bp, Glycine max
  Peptide Sequence Number=SeqID_185428
atggaaaggggcagtaaagtccttttcccaccccctcagccaggaccaagtgagaaagttagtgttatccaccaacttagatatgtgcaaaggctgattatgaaaaatcacatcattccggagcttccatatggaacttgtagctgctatccaccaaattttccttcttgtattggtaacctgcgaacctactatggaggagtgctggaggaaatgatccatgggcctacagtgaagagctctatcctccttaacccagctgaagctatccccaaaatcctttttccatgtagcaaagacctcaaatcaaatcttgaagaatgcttgcttgaagttgaggccaaagctgagcatgagtgtagagaatataacaaagcaagttttagaggtcttgagttggccagaaaacactgggaaacactgaaaattctggagaacagtgagagttcatccagagatatttacaaggagagactagggaggactaagcagagcaagtctaaggttggtttgaaaatgctggaaagtgttgaagatgctagagaagagtggggtgggggtgggattgaaattgcaagattgcctcccaaaacaaagcaat

SEQ ID NO: 68651 - DNA, 681 bp, Glycine max
  Peptide Sequence Number=SeqID_185429
atggatgaaacacaagaccactattattcttccagcctacccgagtcttctttatctcatgatggtggtgggaggtcttatttcaatgggcaaataaatcgtgggactgctatatcaggcctgaagaaaagaggtcatggaagtcgctcttggattaaaattggtcaggatgggaattttcagactgtgacacttgacaaggcaactataatgagatattgttctttgccttctagagatctccggctgttggatccgatgttcatttatccttctacaatattaggacgggagaaggctattgtagtcaaccttgagcaaatccggtgtataatcactgctgacgaggtcatcctaatgaattcattggatggtagtgttggtcagtataggttagaattatgcaaccggcttcagaatgaaaaagcggatgatctaccttttgaatttagggcactggagttggctctagaattgacatgcacatctttagatgctcagcttgatcgttattacactttattgactgtcacacaatattttccaccattcactgcaatcaagattcaggctggtaaaagctgtaggaataatgtagcactcaaaagaaatatggggagacaaaagaatgtgcaaggagatctgaagcacaaacaaaggggggcaggaggaatattctag

SEQ ID NO: 68652 - DNA, 651 bp, Glycine max
  Peptide Sequence Number=SeqID_185430
atgtcagatcctgatgcagcagcaatcaaagtgataacatcaaatggtggcatcatggaattcagtgctccagtgactgtgagtttcatcaccaacgagttcccggggcacgccatgttcagaagccacgacctcttttggaaaccactcagccaattcgatgagttggagccaggccaatcctactatctgctaccactcagcaacaacaacaacaacaacaacaacagcaagaacacagacagtactctaccatgtggtggtgaaaatattaacgttgttgtgagacaagggcatgttagatctcacagtgttcctacaatctcaaaccctgccttgtatagaatgtccttggactatcaccaccaccaccagggaatggggttgctcaagaggtcctccaataatattgatgccttctctagcaggagcagtggtgttgttaatagcagcaacaatattggtggtggtggtagcagtaggttttggaaagtgaagcttgtgatcagcccagaacagttgctggacattttggcacaagaggctcgcaccaaggagttgatagaaagtgtaaggatggtagcaaaatgtggaattgctggtgcctttccagcaccagttggagcatttcctcttagattgatgccttag

SEQ ID NO: 68653 - DNA, 1077 bp, Glycine max
  Peptide Sequence Number=SeqID_185431
atgccggaacacaacacccgccagtcagccaccgaacgcctcgaggaggcagtccaaacactatcccaggcccattctgccatgaacgacaagctcgaatccatcctggatcgtctttccttgcttgcgattcctgctgaccctaccactccgacatcgcaacccaaccagcatcaccatcacctgaaattggagattccacggttcgacggccaagaccccttagggtggatatttaaaatatcccaattcttcgactaccaaggggtgccggaacaggaacgcctcaccgtggtatccttctacatggacgggccggcactttcctggtatcaatggatgatgcgtaatggcttcctcaactcttggccagcaatgttacaggctcttgagtcccgatttgcaccgtctttctatgacgacccgcacggcgcgttattcaaattgttccagcacggctccgtcaacgattacttgacggagtttgaacgtttggcaaaccggaccgtcggactcgcgcctccttacatcctcagttgttttatctccggcctccaccccgagctccgccgcgaagtacaggctctgcaacctgtctctctcccacaagtggtggcccttgcgaaactgcaggaggataagatcctcgacagacgcaaaggttcgcgataccccacacccacccagccttctccgttaccctcccataaccaccttaaccccatcccaagcagtcaccccaccccatcattcccctatacacagacccaccctagtcccacccccttaaccacatccacacccacccccaaaattccagttaaacgattatcccccgaagagcttgccgttcatcgcgaccgtggtctctgctaccactgcgacgaacaatggacccgcggccatagatgtaagcctcgtcttcatctattcatagcggacgaggacgacgaggttacacctccctccctggaacctccgacagaccacctttctccccaactcaacctgaacgccttggccggttttccaacctctgaaacccttcgtctgttcggcactatcaacaaccattag

SEQ ID NO: 68654 - DNA, 1857 bp, Glycine max
  Peptide Sequence Number=SeqID_185432
atgggagaatccaagtttgtgtccttggcatttctactggtttgtttagtggtccaaagggtgtggtcacatggatatcatcctctttcaaaagttgctgttcataaggcaacagtatcacttcttgaccttgcttacatcaaagcatctccagcagttcttggactacaattttctacttgccatcttgttgcacattgcctgcttgttgctgattacagttctccaattccatcaattgatgattggattggagtattctctcctgcaaactttagtgcttccacatgtccaaaagaaaaccgtagagtctacccaccactattgtgttctgcacccattaagtatcaatatgcaaattactcaagtcccctctacaaagaaactggaaaagggtttctgaagcttctgctgattaaccagagatcagatttctcatttgcactattttctggtggcttgtcaaacccaaagctagtagcagtatcagataaaatagcttttgccaatccaaatgcaccgctttaccctcgcctggcactaggaaagtcatggaatgagatgactgtaacatggacaagtggatatgggatcaatgatgctgaaccttttgttcaatggggtccaaaagaaggggatcgtatgcattcacctgctgagacactgactttcactcgtgatagcatgtgtggtgcaccagcaagaacagtgggatggcgtgaccctggatacatacacaccagtcatctgaaagaactgtggcccaacaaaatatatgagtacaggataggacacaaattaaacaatgttacatatatctggagtggaaactatcagttcaccgcacctccttttcctggacaaaagtccttacaacgtgtagtcatatttggagatatgggaaagggggaagttgatggttccaatgaatacaacaatttccagcatggctcaattaacactactcagcagcttatccaggacttggaaaacattgacattgttttccatattggagatatatgttatgcaaatggataccttcctcagtgggaccaattcacagcacaggtggagccaattgcatcagctgtgccttacatgatcgcaagtgggaaccatgagcgagattggcctggaacaggatccttttatgagaacatggattctgggggagaatgtggtgtgttggcacagactatgttctacacccctgcttctaacagggctaagctttggtattcaattgactatggcatgttccgcttctgtattgctgacactgaacatgattggagagaaggcacagaacaatacaagttcattgagcattgtttggcatcagttgacagacaaaaacagccatggataattttccttgcacatcgcgtacttggatattcttcttgtatctgttatgcagaagagggatcatttgctgaaccaatggggagagagagttttcaaaagctctggcagaaatacaaggtggacattgccatctatggccatgtgcacaattatgagaggacatgccccatatatcagaatatctgcactaatgaagagaaacaccactataagggaagaaccttaaatgggaccatacatgttgtagctggtggtggtggagcaagcctttcagcatttacttccctcaaaaccaaatggagcatctttaaagactatgactatgggtttgtaaaactaactgcttttgatcattcaaatttgttgtttgagtacaagaagagcagagatggaaaggtttatgactccttcaaaatatcacgggattatagagacatcttggcctgcaccatggatagttgcccaagtataacaatggcatcttga

SEQ ID NO: 68655 - DNA, 1023 bp, Glycine max
  Peptide Sequence Number=SeqID_185433
atggctactaccaccgccaacaaagacgaaaccattagcaccattgcatcttcttcttctccagtcttcatatccacagagaccttatgcaccatcctcacccatcacactctgatgaaccacttccaatctactctccccaaagcctcaaccattctccaaaccccaattcgccaacaccactctctctctccttcctcctccctcctcctcatgccctcttggtcctcttcctcttctctcccttacatcggcgtcaaactcgtcacccatttccctcaaaactcttctctcaacttacccggcgtgcagggaagctatgtcctcttcagttcaaccaccggtcaaaccctagcttccatggactccaccgaactcaccctttacagaacctcgtgcgtctcaggcttggcttctaaatacttagcgagacatgacagcgaggttcttgttatggttggtgctggttccttggcaccgcacctgatcaaagcccatctttcagccatacccagtttgagaaaggtcatcatctggaacagaacagtggaaaaggcgacaactttggccaacaaacttagccaaagtggggaatttggtggagtgaggtttgagggttgtgggtgtttggacgaggttgtcggatttggggacattgtgagttgcgccacgaattccgagacaccccttgtgaagggggagaggttgaagggtggggctcatttggatttggtgggttccttcaagaattcaatgatggagtgtgatgatgaggccataaggaggggaaaggtttttgtggacaatgagactgcgcttgttgaagcaggggagctggtgggggcttttgagagaggggtcatcaagaaagatgagattggagggagtttggtggagcttgtgagaggtgaaaaagttgggagaatcagttctgagcagataactgtgttcaagtctgttggttctgctgttgtagatatgcttgcagcacaattggtttatgaaacttacacaaggagctag

SEQ ID NO: 68656 - DNA, 3132 bp, Glycine max
  Peptide Sequence Number=SeqID_185434
atgcaggttctcgtcggtaatggtaccaccatgcagtgcgaccattcttgccctcaggttccggtacttatccaagggcaccatttcacgatggatctcttctccatccctctcagcggcgcagacctagttttaggtattcagtggcttcgggaacttgggcccatcaccacagattatacccgacttaccatgtcgtttactcacctgggccagcctatcacccttactgctgatgtacccccccaccctagctccatttcggcccaacaggtccgacgttgtctccacaccaacagtgtctcggccctgttccaactaacgaccagcccatccgacgtctcaccgtccaacacccctgaccctcccccggacatctcctccctcattactaaattcgcccacttattctctgaaccgacctcccttccccctttccgccaaatttcccaccacatccaccttcatcctcacacctcccctgtaaacgtcaagccatatcgatacccatactaccaaaaagccgagctcgagaaacaggttgcttcaatgctcaaaaatggcctcatacgcatcagtcaaagtccgttctcctcaccggtgttgctcgtcaagaagagggacggcacatggcggtgctgcgtcgattatagagcccttaacgccatcacggtcaaggaccgtttttccatgcccaccatcgacgaactcctggacgagttgggccacgcacgatggttttctaagcttgatctctaccaaggttttcatcaaatccgagtagcagaggaagatatccataaaactgcgttccgcacccaccacggccactatgaattccgagtgctgccgtttggtctatgtaacgcgccggccaccttccaagctacaatgaatgaacttctcaagccttttctcaggcgattcgctgcggttttctttgatgacatcctcatttacagtcccacacttccgacacatgtccagcacctggcggcggccttcaatacactctctcagggtgaattttatctccgccgcactaaatgcttatttgctcgccgcacccttcagtatctgggccatattgtttctgacaaaggcattgccccggacccggacaaaattcaagcaatgctttcctggcctactccatccacggtgtccgaattgcgtggcttcttgggccttacggggttctaccgccgttttattcgcgggtatgcctccatcgcctcccccctcacctcactcctccgcactgatgcgtttcaatggaactccgatgcccaggcggcattcgttcaactccaacaggccatgactcaggcacccgtcctcgctccaccagacttcactgcacctttcatccttgaaacggatgcatctaggaccgccatgggcgctgtcttgatccaacgagcccacccaattgcattccacagtaaggtgttctgtgaccgcctccggcgagcatccacatatgtttgtgaactccatgcaatcaccgtggccgttcgcaagtggcgccactacctgctggggagtcacttcatcatcagaacagaccacaaaagtctcagagatctcatgaatcaaacgattcagacccctgaacaacaaacttacctcacaaagctcctcgggtatgattatgatattgaatacaaatccggcgcgacaaacatcgttgctgacgccctctctcgaatcccaactcaggggaccttcctctccctttctttaccaaattttgacttcttggatcagctgcgccaatcactgcactcttcacagtcctataccactctcctacaagacatcctccaacgtccagaccttcaccctggttacacgaccaaccgcgaaatgattttcctccataagaagctctggctcccctcagattgctccttcattcctgctcttatggacgaattccactccactccggttggcggccatttgggttttgccaagacactccaccgaatccaagagaacttctactggccatccatgcgacaggacatccacaagtttatcgcccattgcactacatgcctgcagactaagtatgaaaccaagaaacctgccggcttgctgcacccattaccaattcgggcaaccccttgggaagagctatccctcgacttcatctgcggccttccaccttcacacggccattccaccatcctggtcattgtagataggttttcaaaaggcattcatttgggcgccctccccgctcactatacagctcattcggttgctactctcttcttcaatcttgtctgcaaactccatgggctccctcggagtctggtttccgacagagaccccatctttgttagcaaattctggagggaattattccggctaatgggcaccaaactctgcatgagtacagcctatcacccggaaacggacggccaaaccgaggttctcaatcgggtggtcgaacagtatcttcgggccttcgcgcatgaccacccccactcctggacgcgcttcctagcccttgccgagtggtcctataacacctcattccactcaggcaccggtttctcccccttcgaggtcacatttggaaagccccctccctccatccctcaatatttgcagggttcctctcaggtggaagccgtggacaccctcctcgcgaatcaccagcatattcgctccgtgctccagactcgcctccgcaaggcccaggacaacatgaagaaggcagcagatacccaccgccgtgaggtctcgtactcccctggagattgggtctatgtgcgcctacggccctatcgtcaatcctctctcgctccgggctactgcaaattatccaagcgctattttggcccattcaagatccaagaacgcataggtccagttgcgtaccgccttgaattaccaccacactctcgtatccacccggtttttcacgtttcactgttgaagctccaccccggcgagactcccaccactcctggctttttacccgagaccactaagggaaacgaccccatcgttgccccgctcactatattggactggaaattggatgcgtccacctccccaccatcacgccaggtgctcgttcagtggaacggtctgtcgccggaagattcgacttag

SEQ ID NO: 68657 - DNA, 1200 bp, Glycine max
  Peptide Sequence Number=SeqID_185435
atggaacggttcatcccccacaaaactctccaagaccttcaccatcacaagaaattaaacaccattgatacatcaaaaccatttcaaatatgggactcattgcagggcctttcaacgtatataaggactatgctttctacccagtacatgagtagtcaacgaaatgcctttcaggccctcctgattgctattggggttgaggagaaatcagctacagttattggtgctacttttcagagggcgagccctggtgcagcggtaaagttgtgccttggtgacctgttggtcatgggttcgaatccggaaacagcctctttgcatatgcaaggggatctaactggtatgcttggaggaatcttattcacattttaccagggatcaaatcttgatagctatgcaaaaatgtggcgattggttgcagatcttatgaatgaccctggaatgttaatggacctcatttctccgttgtttccatcagcttttgtatttgttgtttgcttaggaagcatatcaagatctttcactggtgttgcaagtggagccactagagcagctttgactcagcattttgctcttcaggataatgctgcagatatatctgcaaaggaaggaagtcaagaaactgtggccacaatgattggcatggcactgggaatgcttgttgctcgccttaccattggacacccactagccatttggttttcttttttatctttgaccgtgtttcatatgtatgttctctcccctgaacaggtctcttcacaggagcatattttacccatacagttcatttcatggagctcaaagaaagctaattgtctgcataagaaagtaaatttaggcatgaggatttcttcattcgataacatggaaatcaaggagcatttgctttctgcagcaccttactacacaaaagccaagtatttacttgtggaaaggaagggaatcattgatgttattgtgcataaagattcgaatgctgctgatgtcctaaagttattctttcatgctcttgtcttggcaaagaatgttcataaaagcaaatctgtgcattcagagggccaaaaatggatagattatcaatatgaagtttttattcagaagcttaagtcattaggctggaaaatagaacggcttctatcacctataatatggagggcatactggagctatgaaccattggaagaaaaaattgattag

SEQ ID NO: 68658 - DNA, 465 bp, Glycine max
  Peptide Sequence Number=SeqID_185436
atgacttcacaggctcaaggttcagctcaatcaatcaataacaagctcaacatgggtgcaagggattcatcattcatgaacagggccagggatcccaggtactttgtgccgcctgtaaatctgttgcatagtctgtgtcctcggcgccttcttcatcctcagagacctccaaaactggcatggtcgcaggtgagacctatggagtcatctttggagtggcctccggctaatgctgtggctgaggctcctaggctacagaggcctcacctcccccctgaagagaaggctagactcttggccaagccacctgtgctgaataagccatggtggaggctctacagcatcaacactaaaacatctgagctctgcatggaggtgccggagggtgttgggattgatgttgatggtggtggagctggagcagaaggagttagaggtgtagaagaagcaggagtaaaagtataa

SEQ ID NO: 68659 - DNA, 357 bp, Glycine max
  Peptide Sequence Number=SeqID_185437
atggaagggcacaaagagcctgttcctgaacatgcacctgacaagtgcaaaggctggtgcagcagtgttggcatccctcatggagagcaagatttgatggagggtatgatggtcaatgagcatggggttcttctccatgaggaagagggtggaggcaaaggccctcttgaggttgagggtgtcaccaagggaggagaggtggatgaggagggaattgtgttgcttcttgtgagggagttttggagggtggtttggagagtggaaagttgggaagaagagagtaaagttggggactttggagaaggctctgaattgggttggtgttgttttttggtgagagcaaagactgagggctga

SEQ ID NO: 68660 - DNA, 234 bp, Glycine max
  Peptide Sequence Number=SeqID_185438
atgactctcactaccttcctagctatcgtgacaagctttttcgttgcattatttgaagaccaagaccaacttatatcgtctacactgcattgcaacccacgtggcacggaaaacgtcactcgtagtggcgagttgcccagcctgcaagttgccaccatgactggcgagttagggcaggcttttggtgcagggtgcaggcctaaaggggggtggcaattgcaacttgcgatttga

SEQ ID NO: 68661 - DNA, 204 bp, Glycine max
  Peptide Sequence Number=SeqID_185439
atggtatttttacagaattcaactgcaagatggcctccaggaagaggaaatctactgcctcccagccctatgacaccaccaggtttacatctgagggagcctgggaatgatattcactcccggaacattcttctggagaggaatgtgattctttacatcactgagttcgatgagttccaccaggagctcgagaggtggaactag

SEQ ID NO: 68662 - DNA, 2094 bp, Glycine max
  Peptide Sequence Number=SeqID_185440
atgtctctgagcctcatccaccataaaccactttcttcttcttgcatcttctaccttcactcttccacttcacaccacattcacactctttcaaaacccttcttcctcttacactccaaaaccctcccatcatcactctctctctctgcatcaccatctaattcttcccctcactcttcaacaacccccattcccctcccatatctccaagaagaagaagaagaagaaggccatgacccagatgaaccaaactacaatttcttcgaaactagcaaatggatttcctcccaagaccctcaaagcgaagaaaaattgtaccttgaggaggaccctcacatctcgtggcaccttgccacggacctggatgaagaatctgaaatgagtttggagaaggaagaaatggggtgttttcaaaagagggaattgcctgaggctgagggaattgtgggagaaattgttgagcttgcaaggaacttgcctcaaaatttgactcttgaggaggcattggctgagtatgaaggaaggttcagtgaaaaagagtgctgggaggttctggaaattcttggggaggagcaccttctgctgtgttgtgtgtgtttctttcagtggatgagtctgcaggaaccatcacttgttactcctagggcttgtactgtgctgtttcccttgttgggaaaaggaggcatgggcgatgaggtgatggatttgttcagaaacttgccatcaagcaatgagttcagagatgttcatgtttacaatgccacaatttcaggtcttctgtctagtggcaggtccgaagatgcttggaaggtgtatgagtcaatggaaacagagaatattcatccagatcatatgacatgttctattatggttaccgttatgagagaacttggccatagtgcaaaagatgcatggcaattttttgagaaaatgaacagaaaaggggtcagatggagtgaagaagtcttaggtgcattaataaattcattttgtgttgagggtctgaggaggcaagctctcatcatccaatctgaaatggagaaaaaaggggtttcttcaagtgcaattgtgtacaacactctgatggatgcattttgtaaatccaaccacatagaagcagccgaaggcctttttgttgagatgaaagctaaaggtattaaacctattgcagctacctacaacatcctaatgcatgcatacagcagaagaatgcaacccaagattgtagaaaagctattggaagaaatgcaggatgttggcttgaagccaaatgccacatcatatacttgtctaatcattgcatatggcaagcaaaagaatatgagtgacatggctgcagccgatgcattcttgaagatgaagaaagttggtgtaaaacccacttcacagtcttatacagcactgatccatgcatattcggttagtggcttgcacgagaaagcttatgcagcatttgaaaacatgcaaaacgaaggtattaaaccttccatagaaacctacactactttactaaatgcatttaggcatgcaggtgatgctcaaacattaatggaaatatggaagttgatgatcagtgagaaagttgaaggaacaggggcgacattcaacattcttgttgatggttttgcgaaacaaggtctcttcatggaagcaagagaggtaatatctgaatttgggaaagttggattgaaaccaacagtggtgacttacaatatgctgataaatgcatacgcacgtggagggcaacactcaaagctgccacaactattgaaagagatggcagttcttaaattaaaacccgattctgtaacttattcaactatgatatttgcctttgtccgagttcgagattttcggcgggcatttttttatcacaagcagatgatcaagagtgggcagatgatggatggtggttcataccagacgcttcaggcccttctggagaccagacctgcacggaaaaacaaggattggagttccttgcttggtataattaaaagtaaaatgggtgtgaaagtgaggaggcagaaagatgagttttggaagttcaagaaaaggcatgtaagaaaaaatagttctgatgttagtgtatag

SEQ ID NO: 68663 - DNA, 2403 bp, Glycine max
  Peptide Sequence Number=SeqID_185441
atgatgcttggttctggtcaatgccccaatgagtttaccttgtccagtgccttaagatcgtgttctgccttgggagagtttgagtttagggctaaaatccatgcctctgtgtacaccaagtgtgattgcactgtggaagcaccaaagctgcttgtgtttgtgaaggatggtgatgttatgtcttggacaataatgatctcttcattggtggagactagtaaattgagtgaagctctgcaactctatgccaaaatgattgaagctggtgtttacccgaatgagttcacatctgttaaactcttaggcgtgtgttcttttcttggtttggggatgggttatgggaaagtactgcacgcacagttgatcagatttgttgtggaaatgaatttggtgttgaagacagccattgttgatatgtatgcaaaatgtgaatgggtggaagatgctattaaggtctcaaatcagacacctgaatacgatgtgtgcttatggactaccgtaatctctggatttattcaaaatttgcagctcctcagttttatcattggagcttggggaacagtttcattcaagggttatcatgggatagccttgccgaatgtcatctcttggacttctttgattgctggttttgcagaacatggtttagtagaagaatctttttggctgtttgctgagatgcaagcagctgaagtgcaaccaaattcctttacactatctactatccttggaaatctattattaacaaagaaactccatggacatatcataaaatcaaaagcagacatagacatggctgttgggaatgctcttgtagatgcttatgctggaggggggatgacagatgaagcatgggctgttattggcatgatgaaccatagagatatcatcacaaacacaactttagcagcaagattaaaccaacagggagatcaccaaatggcattaaaagtcatcactcacatgtgcaatgatgaggttaagatggatgaatttagcttggcaagttttatatcagctgcagctggcttaggcactatggaaactggaaagctactccattgttattctttcaaatcaggttttgggagatgtaactcggcttcaaatagcctagttcacttgtacagcaagtgtggtagcatgtgcaatgcatgcagagctttcaaagatataactgagccagatacagtgtcatggaatgttttgatctctggattggcatcaaatggacatatatccgatgccctttctgcctttgatgacatgaggttagcgggagttaaacttgattctttcacattcttatcactgatttttgcttgcagccaaggtagtttattgaatctgggtcttgattatttctattccatggaaaaaacatatcatataacaccaaagttggatcaccatgtgtgtttagttgatctcctcggtagaggtggtcgcctagaggaagctatgggagttattgaaacaatgcctttcaagccggattctgtaatttataaaaccttattaaatgcttgcaacgcacatggaaacgtgccaccggaagaagatatggcaaggagatgtattgttgagcttcatccatgtgatcctgcaatatacttgctgcttgcaagcttgtatgacaatgctggactctctgagttcagtggcaagactcgcaagctgatgagagaaagaggcttaagaagaagtccaaggcagtgttggatggaggtcaaaagtaagatttatctcttctctggaagagagaagataggtgctatatgggattgttatgctggagagaatctaagtccggtgaaggtaggtaatccttattcaagtcaaattgcagccgttagtgaaacggagaactattctatgtgcaagattcaagtgtacggcttcgatttggaggacgaggatccaacagcgtttcctgatccacggacactcataatccaacggtcattaatgaaggaaattcaaaggtgtgcaaacgacgtgaccggaaagcggcccgggagatctgaaccggttcaaaagaagtcaaatccgaactgggttattgtatttgaatgtcaccgtcatcgtccccatcggtttccatatccgggtcgggttctaaatcgccggtttccggtggctcctccgacggcgacgtcggagagtgcggtggcgaagaagaagaagaagaaaagggcgtggcttggaaggaggagagtgacccaggtgacggtagcggattggtcgccggaatcttattccggtgttactccgttcaacttgttttcgagccatacaacctttggagctgctgcacctatagttgtgcgtttggtgaaactgtgggggaattgttctggggcagttgaaattcgtgtttctgaagtgcctgtagttgattga

SEQ ID NO: 68664 - DNA, 378 bp, Glycine max
  Peptide Sequence Number=SeqID_185442
atggcttccgatcttgagcttaaggccaaagaggctttcgaagatgataaccatgatctcccctacgacctcttaactcaggccattggtctcagccccaacaacgcagacctatatgctgaccgtgcccaagtcaacaacctcaccgttatatgcagttttactttgaaagaattgaagcttgtaaatttggcaaagttgcgaaattttgataagtttttaaccaagatggaaattttgttgtgtgggtgtttgtgtggatcaatggtttggagactaattgttcttgcttttttctccccagaggctgttgctgatgcaaacaaggcgattaagttgaatccttctcactcaaaaagcatatttgcggaaaggtga

SEQ ID NO: 68665 - DNA, 258 bp, Glycine max
  Peptide Sequence Number=SeqID_185443
atgccaccaatagaaaaacaattcacctcaccaacaactcaccccattgatccatcttctctcttaatcgacaacaacaacaacaaaatcatcaagattatcaacaacacaagcagacttaatcgcatcgtggaaagtgatgtgaaactgcgaggatgctgcccagtcaccgcacgtgcgcaccatcaccacccaaagtgtgatgacgatggtggtgatatccgttggagaagggaaagaaagggagaaatggaataa

SEQ ID NO: 68666 - DNA, 1015 bp, Glycine max
  Peptide Sequence Number=SeqID_185444
cacagttatggatggtctttgcaaggatggaatggtatccgaggctttggatttgttctcacaaatgtgcggcaaaggtattgaacctgatcttgtgacttatacttgcttaattcatggcctttgtaactttgatagatggaaagaggctgcacctctattggctaacatgatgagaaagggaatcatgccaactctgaaaacttttaatgttacagttgaccaattttgcaaaacagggatgatttcaagggctaaaaccatattaagttttacggtgcatatggggccggaacctgatgttgtcacctatacatcaataactagtgctcactgtatgctgaatcaaatgaaggatgccatggaagtatttgatttgatgattcgcaagggcttctcaccaagtgttgtaccttataattccttaatccatggatggtgtcaaactaaaaacatgaataaggctatctatctcttgggtgaaatggttaataatggactaaatccagatgttgtcacatggagcactcttattggggggttttgcaaagcagggaagccagtagctgcaaaagaattgttttttataatgcacaagcatggccaacttcccaatctccaaacttgtgctgttatattggatggcatagtcaagtgtcattttcattccgaggcaatgtcattgtttggggagtttgagatgagtttggatcttagtattataatatacaccattattctggatggaatgtgtagttctggaaaattgaatgatgcactggaactcttttctcatctgtcaagtaaaggcatcaaaccgaatgttgttacttattgcacaatgattaaaggattgctgcgaagatatgaaatttcaaattcaacaaagtaccttatgcttatgaaaggcaaaggttttcgggcagatgctaccaccaccgaattgcttatcaagtacttctttgctaaccaagaaaacagtgcattacaagtgtttctgcagaagtttgtttga

SEQ ID NO: 68667 - DNA, 258 bp, Glycine max
  Peptide Sequence Number=SeqID_185445
atgaggatcaaaaggtcttttaaggttgtaatggggccaaggacaaggcttatagtgagcttcaaaacaaggaaagggaaacaaggctcaaaagggctatcaaaggaattaattcaaggtaagtccatttggctagaagcttataagaacaaaattgcctcaatcatatccaaatatgcatgtgaattaggaagcatcaacaagaatcaagccaaggctactgtgcacgcaatcaatggggaaaaacacaccaaatga

SEQ ID NO: 68668 - DNA, 189 bp, Glycine max
  Peptide Sequence Number=SeqID_185446
tttgatgcaccacattcgtttggagaacaaggacaaagttcttcaactgcagcaacccacattgaatctattgacataggacaacaacatcatcatgacatgggagaaccagtcatacaggaaaaaagaaatccgcgacgtaatcgacgttcactgccttgtgagactgatcatcgccttggtcattaa

SEQ ID NO: 68669 - DNA, 357 bp, Glycine max
  Peptide Sequence Number=SeqID_185447
atgtatgtggtggagagcaaggtgggcgccatagggtgcatgctggtgtccctcttcttcctcgggacatggcctgctgtcatgactctgctagaaaggcgcggtcgtcttcctcaacacacctaccttgattacaccctcaccaacctcatggctgctgttatcattgctttcacctttggtcagattggcaacgctcaacccaacttcttgtctcagctttctcagagcatttatgtgttgagttgttttaccaaggcatgtggggagctgatgacactcccctcaaggtttgaattgtatttgcctttagagtttaattcaaattcactacctatgataataatctcatcataa

SEQ ID NO: 68670 - DNA, 549 bp, Glycine max
  Peptide Sequence Number=SeqID_185448
atgggatcaaatcaaacacctctgcttaagaaaaggttctatcatgtcaaaatcaaaagcttagagattgccagtttgagagaattggggcaattgatgggtcagctccaatgtcatgtcttccgcaagacttatgggaagatttgtgacctagctacagtagaagtctccgtgaaagcaattgcctcccttactcagtattatgaccagcccctaaggtgcttcacgtttggggacttccaactagtaccgactgtggaagaatttgaagaaatcctgggatatccactcagaggaagaaagccatatctcttttcggggttatatccctccatggcaagagtagcaagggtagttaaaatctcggtacaagagttggaccatgtgaagcaaaataggaacggggtagtcagaataccaaggaaacatttggagggaaaggcaaaggcattggcagatcaagaagaatgggcctcgtttattgacgtctttgccctgttgatatttggtgtcatcctcttcccaaatgtggaggctagcagcaattga

SEQ ID NO: 68671 - DNA, 405 bp, Glycine max
  Peptide Sequence Number=SeqID_185449
atggcaaactcgttcgctctcttcttgagctctcttgcaccgaactacattgctgggacttcgctcctaacggtgcttctcgcagcgttttttctcttctctgggtattttatctccaaggaaagcttgcccaagtactggctcttcatgcatttcttctctatgtataaatacgctcttgatgcccttctcatcaacgagtactcgtgtttggtgtcacggtgtttgatatggtaccaagagaatgaacagtgcatggtgactggtggtgacgtgttgcagaagagagggctcaaggagagtgaaaggtggaccaacgtgtacttcttgctcgggttctttctgctgtatcgtgtgctttgcttcttggttttggctagaagggtttcaagatcgaaaacttaa

SEQ ID NO: 68672 - DNA, 867 bp, Glycine max
  Peptide Sequence Number=SeqID_185450
atggcgattgatgcaaataaaaacaatgcacttgaaaaaggcataaaacaaccactgctgactagtttaaaagataaggtagatgaagatgatgatcaagattatgatgatagtgaagaagctccagaggattctcgtcagccagccaattcaattggagcagcatatagactccttacaccttctgtaaaggttggatctccattaaccattagtttattagaagtatgtgctttaagtcattgtttgaatggaacactaatttttcatgtgagacaccgtacgctcctaaatgatggaaaggttcagttattgatatacttcatgcttaaatatgcaatggagattttactgtcagaatccagtgtcatcacaacatactacttcaattggacaacaagcactgtttccatttttcttgcttgccttggcttgacagttcttccagttaacattattgttggaagttatataagcaatatgtttgaggacaggcaaattttgttggcatcagaagttatggttttcgtaggcatacttttcagcttccatgtaatttttccatacactgaaccacagtacatctgttcggggctccttatgtttgtttctgctgaagtacttgaaggtgtcaacttgtcacttctatcacgagtaatgtcatcaaggctttctcgtggaacctacaatggagggctcttgtctacagaggcagggacacttgcacgagtgattgcagatgcaaccattactcttgctggctacgggggtgtgagtaggctccttaacgtcaccctctttccttcgttcttcatttgcgtagcttccataattgcaacttgctatacctacaattctttatattga

SEQ ID NO: 68673 - DNA, 420 bp, Glycine max
  Peptide Sequence Number=SeqID_185451
atgggtgacgtagacgaggtgcaagaacaaatgaaggttgatatgtcgaccctgaaagatcaaatggcttccatgatggaagccatgctaagcatgagaagattaatagaaagtaacacagtcgcgactgctgctcccagcaccgccgccgagacagatccagctcttccaacttcaacaaatcaagcacaccaactcaccccagacatgagaaatgcctacccctatggcttaccccccaattacacaccgcccaccatgcatgagaacgtcgatcatgttgttcccgtaacctttgaaggtcagctttcccagcctatagggggtgcccgcgaggggccccaggagcgtgcccaagttgacattgactcataccccccgttcaccaccgaggggccgacattccacactatgccttag

SEQ ID NO: 68674 - DNA, 928 bp, Glycine max
  Peptide Sequence Number=SeqID_185452
atggatgctttgaacttcctcaagttctggagaaacgccaccacgaccacaacctccgaaccccacctcgtggtagaaaccgacaccgaatccgacgaagaagactcattcttcgacttggagctcacgctacacgatttccacaacaaagaaaacaccaccacaaccaaaatcgacgacgacccaaaacaaacgacaacaacaacaacaaccgaactcaaaagtatttgctccaaagatgacgaactcagcaaaatagacaatgacgttccgcgaaaaacaccgcttcccatgtcttctcctcccgaacctatctccaaacgtaaggtcctcccaatcgaacctatctccaaacctcagtcccccattgcacttctcaggtccgctcctagcttcagaattttcatgttcagaaaacgaaatagagctcctccgcagaaaacggagcactctgttaacgaaacgaaagtcttcgcggtgaagctaagcgtcgacgattttcgttcctctcctgcgctcagcagagacaacagcacgagaagcttaaggagcaaggttcggggtttgagctacgaggaacccaagccggagcggttttcaaaggaggtgttgcggaagtacctgaagctgattaagccgctatatgttaaagtttcgaagagatatagtgacaaggtgagattctccggcgagggtttcgcgacgtctccgtcatcgtcgccgtcggtggcctctgtttcttcgagaacggagaaacaggggaaggggatgacggtggtttcgaagcatttggggaagagtaggtcggcgtcgtcgacggtggtcggagttggttctccggcgaagaggagcgatgatacgctgcagcagcagcttgatgggatccaaagcgccattcttcactgcaaaaggtccttcaactccagag

SEQ ID NO: 68675 - DNA, 237 bp, Glycine max
  Peptide Sequence Number=SeqID_185453
atgaacgaagcgtttcagtcttcatcagagttccacaggaccccattctatgtgactacacctatgtttgaagaggtccaagtctttgtgccattgaatgagcacaagggtccaagtcttttacctcaaaagtcacacggccttcacaacaaacaagctaaaaccataaccaagctcaaatttacatctgaaaggtacctttcaagtttcaaaaagggctctgagccagaatattga

SEQ ID NO: 68676 - DNA, 834 bp, Glycine max
  Peptide Sequence Number=SeqID_185454
atggcgtcaggggacacagattccttcagcgacaaggtagaagagaatttccaccaccaccacaactccgattccgattcctattccgattccgacgacgaccacaacaagaggccgccgccaaaaaccaccggatccaccaacgtttaccgcctcttcggtcgcgatcagcccgtccacaaggtcctcggcggtggaaaacgtaactccatcgctaacgtttctgcattcgttatgtttctttgcgtttctcgttattatcttctcgcgtttcttacgcctgctgatattttgctatggaggagcaggagaagcactggaatcgtacttggtgctggcactgccttctggattttctttgagttgatgcaataccacctcataacttttatttgtcatttattgattgtgtctctggctgcacttttcttgtggtccaatgcatctgtctttatccacaagtctccactgcacatcccgcatgtagcacttcccgaggaatgcgttcatcaggttgcttctgctttaacaattgaaattaaccgagccttcgttgttgtgcgggaaatcggaactgggaaggatttaaagaagtttcttagcgttattgctgtattatgggttatctcggttattgggagttggttcaacttcatgaccttgttttacctattctttgtgtcactgttcacattgccactgctgtatgagaaatatgaagaccaggttgatgcattaggtgagaaggcaatgattgagatcaaaaagcagtatgcagtgtttgatgctaaggttttgagccagataccaatagcgggctttaaaaaggattag

SEQ ID NO: 68677 - DNA, 2123 bp, Glycine max
  Peptide Sequence Number=SeqID_185455
cttggctctggtgttgcctcacgaagaaagtgatggagaaacattggacaaaggtcagaaggaaaaaagcaaggacacaaatcaagattcaacaacatcccagatgcagaaaattcaagaggtgtttattccggcgaaaagggataaacatggatatcgttttggcttcgcaaaactcattgatgtacatgacgttcacatcctgtgccttactcgtaacaagttgttcttcggggagaaaaggttgatggtacatctccctaggtttgctaaaggtcaaaagcatgagacaaggaggaatgagccacaacagaagaagaagctaatctcagtgggttcacaaaaaaacgcactgatggtgaagatcaacaaggtacaacatggatcaaacaatttttatggcttgtcttttgaggtagcagtggaagatgtgaggaggcttagtcaggcatatgtagcacgggagtggttcaatgaaattaaaccttgggaaccaaaagatgtagatcgggaaaggctcatatggatcaaatgctatgatgttctatgccatgcctggtcggaagatttttttgagaagttgggattagcttatggtgcttttatgtacacaaatgaacacataaaggataaagagcatttggacataggcaaatttgtaatgaaaacaacacacaatattgttatcaatgaggttgtgaaagtaaaaatcaatgacaacatcttccatattaaattggtcaaggaaggatgcaaggaatgcttgaactattttggatgtagaaatagaagacacaaggattctgccacctttgaagaattagaggattataaggaagaagacaagttgaacaacaatgaggatggacaagtgggagacctcattccaaattttaattttgaaattcaaaatgaaaaagcaagtaagcctctgacagttctgctagatcagagagactatcagggtttggaaacaagcaggggtctcctaaccctcgtcataactgctttaggagaagttcctttggagtttagttgcgaccatccccatggaagggttcaagctaagtgcaaccggaggaattgtgcttcattggaggtatcagaagatgcaggaacaaaattgtggggtttggcaaaatccattggaaaatccaaggatgatatgtatgtcacatatatcaatagggtggatgaaactaaaagaggatctaaatcaaaaggcagtaccataaagaggttcgaggctattttgttccacgaaacgaagattagtggggtgtctagaagtacgattcgagaaatttggggtccatcagaatacgagtggatcgctaaagatgctaaagaaggagttgcattatacgaacgatgggaaagtctttccattatgttcatcaagacatgtatctctgttagtatccatggttcaattccagaatgccaaaaggtcaaggatttcatgaaagccatagatgaacagtttgaaagttttgagaaggtcttggatagcaccctaatgtctaagttgtcatctatgaggcttattggagtcgtagggagacttgctcaagaaattggtgaaggtgctcttactgtgactcaagataaggggaaaaaggaaaggaaggaaaagaaccatatacctcctattgccaaaattaaaaaagagtccaggtcctcgagtcagtcatctccccttggcaatctgcttttctcctgggcagctttttctgtacttgtaaatggttgtccaacctgggaaatagtagctgaaaagggtttaaaacaaggggaccctctgtccccttttcttttcctgatagccactgaaggtttatcggatgactccttggccataggaaaagcatcatatgataacttgtgggctctaaaggcaattctacgcaactttgaaatggtctctggtttaaagataaatttcaataaaagcaacataattgggataaatgtggaggagcgattcttggatgcagcagagcaattcctcaattgcaagaaatcatcttttccattcaagttccttggaattccagtcggggcaaatcctcatagatgtgaaagatggaaagtgtttgagtcgagattagcttcctggaaag

SEQ ID NO: 68678 - DNA, 159 bp, Glycine max
  Peptide Sequence Number=SeqID_185456
atgcatttaggaaatacaacaactaacagatgcaatcccattatcaacgacgagtggaagagagggacttacggcgacgacaaatgtgagggcagtggtggcactgcatatctaaataaaagtggtgctgaatatggcccagatttggatcaagcttag

SEQ ID NO: 68679 - DNA, 315 bp, Glycine max
  Peptide Sequence Number=SeqID_185457
atggagcagaaacacgtgttgttttcagcattgagtgttggggttgggctgggtgtgggacttggattgagcacaggacaagctgttcaaaaatgggttgtcgggagttgtgagtctgatgagatttctggggagcaaattgtgttggagctcaacaacagagtcattgatgggaagaacagcaaagtcacatttgatgactttccatattacttaagattgtttgttgttgactttacctcacctctgctactttgtcaacctcagtctttctttgatattctgttgacagttctgctttggttttcaatgtaa

SEQ ID NO: 68680 - DNA, 462 bp, Glycine max
  Peptide Sequence Number=SeqID_185458
atgtctggacctggtgccagcggagtcctaaaagcaacatccgctgatccctggtcggcatcgtttatggttgagactaggacgttgttcgtctttcataaatccaagaatttcacctctgactatgaaatacgaatgcccccgactgtccctgttaatcattactccgatcccgaaggccaacacaataggatcagaatcctcaccgggaggcacgacccggccagtttaaggacaggagcgcatcgccggcagaaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggctccctctccggaatcgaaccctaattctccgtcacccgtcaccaccatg

SEQ ID NO: 68681 - DNA, 246 bp, Glycine max
  Peptide Sequence Number=SeqID_185459
atgggtggtgccgatgtcgactatggcagtggtggtggcaatattgatgacaattgtgtttttggtgaggatggtagtcgttgcataggtggtgatcatagtagtagtgtcggtgcatatggttatggtggtggcggtagcggtgccgatggtggtggtggcaatagcgatagcggtgctgatgataatgttggtggtggtagaggtgccggtgctggtggtgattgcaacaaaaatgaaaaatga

SEQ ID NO: 68682 - DNA, 213 bp, Glycine max
  Peptide Sequence Number=SeqID_185460
atggaaatgtcttcagggctccgagtgcagccgcggttgttgttgttgttgttgttgctactgttgtcatcttggcttagttcgctggacacacatgagcttgatggtgatgttggtggtgctatgggtaatcgagttggtgaatcaggcttgaaggatcaagctttggctaaagggaagccaagctgtgaacgagaaaagaaagtggggtga

SEQ ID NO: 68683 - DNA, 258 bp, Glycine max
  Peptide Sequence Number=SeqID_185461
atgacacgttgcataggtggtgatcgtggtagtagtgtcggtgcatatggttatggtggtggcggtagcggtgccgatggtggtggtggcaatagcgatagcggtgccgatgataatgttggtggtggtagaggtgccggtggtggtggtgattgcaaaaaaaatgaaaaatgtcaaatgtgtgattacaacacggtagtggcggggtttcgcatgttcgctgctacctccattatcgccgaagaagggaaaccttaa

SEQ ID NO: 68684 - DNA, 1188 bp, Glycine max
  Peptide Sequence Number=SeqID_185462
atggatatccaagccgcatacagttgccttttgggtaggccatggatccatgaagctggggccgtgacatccaccttgcatcaaaagctgaagtttgtcagaaatgggaaattgatcactgtgagtggagaggaagccttgttggttagtcatttgtcagctttttcctttattggtgctgatgaaacagaaggaacctctttccaaggcctgactttagagggtaaaaagccagagagaaatgaagtatcttttgctacttggaagagcgcacagaaagtggtgcaggaaggaacaggtgtaggatggggaaaagttgtgcagttgctggagagtaaaaaccgtgaaggactaggatttgcttcttctgcaggatccgcaacgaacagtgttggatcaagctccattactagcaccttttgtagcgccgggttcatcaacaactcgccagaagccaatgctgtcttggaagatgctcctgaagagatagtgcttgcatttgtcacacctggaaaacttgttcgcaactgggacgcggttgacatcccttcagtggttcatgcatcaaaactaggcatttatgagcccgttgaacataataaccctgcactctctcccaacttcgaatctcctgtctacgaggctgaagaggaggaggatgatgaaatcccggaggaacttgctcggttattggaatatgaaaagaaaaccattcggcctcatgaggaggtagtagaggtgattaacttgggaaccgaggaagataagaaggaagtcaagattggggcatcgcttgaggcagctgtcaaacgaagggtgattgaattactcaaagaatacgtcgatgtgttcgcatggtcgtaccaagatatgcccggcttggatccccgtattgtggagcaccgtttgcctttgaagcccgaatgcccaccagtcaaacagaaactgagaagaactcgccctgacatggctctcaagatcaaagaggaagtacagaagcaaatcgatgcaggttttcttgtcacatcagagtatccccaatggttagccaacatagtgcctgttccaaagagggacggcaaggtcaggatgtgcgttgactaccgggatttgaacaaggctagtccgaaagatgactttcctctacctcacatcgatgtattggttgacagcgctgcaaagtccaag

SEQ ID NO: 68685 - DNA, 270 bp, Glycine max
  Peptide Sequence Number=SeqID_185463
atgacggacgaaggttgcgccaacggaggaggccgcaggatggtggggatgacgcagaggaggaggatgaagaggaggcagaggacattgatgccttgtgctgcaaaacgtttcagaggttgtgcaaggttttgttctcggggagagcggcaaggatgccataggaatggttgtggaggttgttgttcggagtggcagaggaagacgataatgaggaagaggaagagtggaggcgctgtgtttggagtggcggaaaaagataatcactag

SEQ ID NO: 68686 - DNA, 534 bp, Glycine max
  Peptide Sequence Number=SeqID_185464
atgagacgtcgaagacggttgaatctttgcgaaattcctcacggaaaacgttacggaaacgtttcggaagcgcctcggcttagattttcttcacggaaacaatttttccaagcaaattcgaaagagagagaagtgcctaaggggctgaccccttccttcttgccttcctcccctatttatagcaaaataggggaggtggttgccgcccagctcgcccaggcgagctcagctcgcccaggcgagcagggttgcttcctccagaagcaaccgccttctggaggaatattccggagggcccaagattgccatcatcaaaaagggggagattgtggaagcaataccttccaaggttattttgatgatgccaaagaatcaagagttaagcaaattccaaaggttcaagaatcaagtttcaagaatcaagattcaagattcaacaatcaagtttcaagaataatcaagatcaagattcaagaatcaagagaagactcaatcaagataagtactaaaaatgtttttcaaaacattgagtag

SEQ ID NO: 68687 - DNA, 221 bp, Glycine max
  Peptide Sequence Number=SeqID_185465
tatcttttgaagatgatgacttccattgtgaaagttgtaatggaaaacttgaggtagaaaatgacaaatttgttgctcaagaagggggtgatggagatgaaaatgcaagaagacggcgccatgaaaagttaaaagacatgcttcagaagatggagtcatggttatcactgccatttgctagaactgagaaatttgtgtcattactcatttgggcttatagg

SEQ ID NO: 68688 - DNA, 464 bp, Glycine max
  Peptide Sequence Number=SeqID_185466
atgccgatctccccctgcggaagtatcagttggtctgtgccgtcccgacataggggtcgcgcccacaagacacccagtggactcgaagaagtccaacagggccctggggtttccagttctagttatgggcctctatcaatcctacagggtgcccgtaccccccccccctgcatggtcatgccatcgcgacatagggatcgcgcccgcaggacacccagtggaaccaaagaagtccaacagggtcctggggtttccagctctgattacgggcctctatcagttctacgtagtgcctgtcaccccagcaaggtcatcaggcctcctactaaccgagctttcatcaagaagtattgcgcccccatgcaggcagagggcgagacaccacaacagcctggggatggccagcaacaggcaacaaatgcaccgccaccacctccagagcccctcagctcatccataaaaag

SEQ ID NO: 68689 - DNA, 1422 bp, Glycine max
  Peptide Sequence Number=SeqID_185467
cgcagttataacagcctgacgcagcgcgccggcctgtttggccgtggctggtcgacggtgttcgacagctatctgacgctggaaggcaatcaggccacctggtttgatgacaacggccgcgaactgcgttttgccttgcccggtgaaaaagaggtgctttacagcatcagcgaaggactgatggtgcgacgcaatgcgcacggtgacgtggtaatcgctgacgatgacggcgcagtctggcgcttgtacaaacccaccgccagaaacccgcagctcttgcgtctcgcctcgctgagcgacgagtacggcaacgcgctggagatgggctgggatgagcagagccggctggtgcgcatccatgatgaaccgctggcgattgacgtgacgctgcactacaacgatgaacgccatccgcaacgcgttaccgctgccagtcactttgacggtgaacagcactggccgctgatgcgctggagctttgatgatcacggccagctggccagcgtcaccgatgcggcaggcattgagacgcgccgtttccgttataacgtggatggcctgatggtatggcaccgcctgccgggcgggctggagagcgagtatcgctggcagctgtttgatcactggcgggtgatagaaaatcgcaccagcagcggcgatggctgccgtatgcagtacgatctcgcggcgggcattacccgcgtttctacctacgatggtcagcagcgcgagcatcactggaatgcacagggattgattacctgctacatcgacgagcgcggcgagcaatggcgctacgagtgggatgacaatgaactgctgacgcgccgtattgacccgctcggccatgcggtgaactttacctacgacgagctcggtaaccgcattgaagagcaggatgctgatggcaatgcgcagaccacagagtggttaacgcatcgtgccctgcccagcgtcatcacccagcctggcggcgctgccatccgttattactacgatatccatcacggactggaacgggtggtcgatgcgctcgggcacagcacgcgttatctgcgcgatgagtttgggctgatcactgaagagattgatgcggcgggcaatcgctatcgccgtgaatataacgatgccgggcaggtcattcgcgagacggactgctccggccagactacgcgttaccgttatcatccgctgggctggctgagttgtgttacagcagccgatggcgaagaaacgcgatactactatgatgccgccgggcgaccccggcagatggaacgtgctgaaggctgggaagaacgtctggagtggagcgaacgtggtctgccagtggcgtatgcctcggcagacggtaaacgcagcgaattcgcttacgaccaggccggcagactgactctctcgcgaaacgcgcagggcgaagag

SEQ ID NO: 68690 - DNA, 480 bp, Glycine max
  Peptide Sequence Number=SeqID_185468
atggtgatacactcttgcatgtatgtcactcgccgtgggtggcatacactggagctcaataggtgctcgtgcacagatgccatggatggcatggtgctcgtgcacgcatgccactcgccgtgggtggcatgtactggaggcttagtaggtgctcatgtgcacatgtcatgtatggcatgtactagaggcttagtaggtgctcgtgcgcacatgccattcatggtggtctgctattgcatacgtccctcttaccaagtggcacatactggagacataatgctagaagaagggctcaccaaggacggacctttggttttaagagcctcagagctacgactatggatgcttgtgtcttttctgatcctcattgtttcttggacttcttcgatggtgtcataccctaatttcgtccggggacctttgcttgatgacatgcaacttttgtttggtccttgtgaggtgcttggcacccatcattag

SEQ ID NO: 68691 - DNA, 255 bp, Glycine max
  Peptide Sequence Number=SeqID_185469
atgtatggatacatgaattttgatgatgccaaagaagaatcaaacaaggccgcttcaaaggataagcatttgcttcaagataaattcaagattgcttcaacaaacaaagccttgtttcaagattcactaaagatcaagccttgcctcaaaacaaagggttacaaagtcatgcaaggctttgagttttcagaaaaactgccaacagtcacatcttttcattggattggtggatggccatcaaaggcctacaaatag

SEQ ID NO: 68692 - DNA, 255 bp, Glycine max
  Peptide Sequence Number=SeqID_185470
atgttgcggtggaggaagaatcgtgttttggggaggcttcttgtgcaaatgctacttctatcatcgacactccccatcgtagcttatttggtggacgagaagttcgaagtgctgaggaaaaaagggagagaaacttatacgctgctattggaaactgctaccatgagcggcgaacggtggcaagaggaatggtgggaggagtatggcagaatattgagatgttttgatgtgttggcctggattatggagtactaa

SEQ ID NO: 68693 - DNA, 1875 bp, Glycine max
  Peptide Sequence Number=SeqID_185471
atgaaagaatatgcaaaggcaattctcaacggaagaatgatgcctaagcattcaagctctagtgactgttggcttgtagatagtggttgtactaatcacatgaccagtaatgaagaattctttagagatttggacaagtcacaagtatccaaagtcagaattgacaatggcgattacattactgtcaaagggaagggaattgttattatagagagtagcacagtcttctttgagaacaagcagtgcacgatcaatgatccgtatgacaatgaggtcataagaattaaaatgagaggcaagagtttctcacttgacccaatggagaaggagcaagcagcttatacggctgttatgaccaacacagagacttggcataagaggctaggtgtgttcttcaaattcaagaactggattgagaatcaaagtggctttagaattcaagttttgaggtcatataacgacaaggaatacaccttaaatgaatttgataaattctgtgaggaggttggaattgagcatcaacttacaacaccatacactccaaagcaaaatggggtcaacttcccacaaaagcagttgatgggaagactccttttgaggcttgttgcaagactagatacaatcagaatgttactagctattgcagcacaaaagcaatggaagatagatcagcttgatgtcaagtcagccttcttaaatgacttcctaaatgaagaaatttattttgagaaacctgaaggctttgctgcaaaaggagatgaagacaaggtgtatctattaaagaaggcactgtacggcttgaagcaagatccaagagcctggtataacaaaattgacgaatacttgttgaaactaggctttgttaaaagctttagtgagattactttgtatgttaaaggttacaatgatcatttttttgtggtatccttatatgtggatgatctcttagtcattggtagcaacattgagcttattcaacaattcaaagaagacatgattcgagtctttgagatgactgatcttggagaaatgtcttatttccttggaataaaaatcaagcagagacaaaatgaaatattcatttgtcaacaaaagtatgcagaggagattctaaagaagttttgcatgggtaactgtaagagtatgaccactcatatgtgtcaaaaagagaagttgtgcaaggatgatggaacaactaaagcggatgagttcgaatatagaagtttggttggctgcttgatgtatctaacaacaacaaggccagatattatgtatgcggtaagtgttctttcaagatttatgaattgtgctaatgagtctcatcttagagctgcaaaaagagttctcaaatatgtcaagggaactgtaagcttcggtgttaagtttttcttgataccaagctttgagttgcaaggttattttgatagtgattgggttgggtctttagatgacatgaaaaacacttttggtttttgtttcaacttcggatcaagagtatttacttggaattcaaagaagcaagaaattgtggctcaattaacaaccgaagctgagttctttgctgctacaacatctgttaatcatgctttatggctgataaaatttttaaatgatctgcacttagagcaaaaaatgagtattgaagtcatggttgataatcaagcggctatagctatctcaaacaatccagtttttcatggcaagaccaagcatttcagcatcaaactactcttcattagagatgttcagaaagatggtgcagttagactgaagtatttcaaaactgaagatcaactgacagacatattcacaaagcctcttgcaaaaagcatatttgaagatttaagagaaagacttggaatttgcacctactga

SEQ ID NO: 68694 - DNA, 345 bp, Glycine max
  Peptide Sequence Number=SeqID_185472
atgacatttgaagatacaaatgatgttgatgatagaccctcaaaacttcttaaatattgtgtttctttgtgtgaagatgatgaaaatgtgataacctttcaagagtcaaaaaggaaacctgaacctcaatcagaaaacattgatacatgggttccttacgaagggcaaatatttaagagtgatgaaaatggttataacttctactctttatttgcaaagaaaaatggtttttcaatcaaacgttaccgtgtctgcaaatgtagtaaaagtaagggtgagaagaattcttcagaagtctataggagggagtttgttcatcatcctactagtaatgttaaaccttag

SEQ ID NO: 68695 - DNA, 213 bp, Glycine max
  Peptide Sequence Number=SeqID_185473
atggtattttcgctgaaagtgaaaattaatctttatcggaaatttaagtacacaaaagctaggctgcaaattgtaacagaccaacctttgccacttaccagcaaggcagcaacaactgcaggccctacacaagaaatgaagaaagtactcttgaaaaggaaggagttgcatggaaattattccaccaaaggtccaaagccatatgaagtgtaa

SEQ ID NO: 68696 - DNA, 573 bp, Glycine max
  Peptide Sequence Number=SeqID_185474
atgggagttggtaccatgtggagtatgaaggcctccatatgtcgtgtgctagttgcggttgctatggtcatgttgctagaaactagggcagacaaaatggacttggcccgattggcctggtggtctggcaatttgacattgggctgggctgagcctaagaaatttcatcccaaaagaatatggatcaagcctaggcctacctgttttcaatgtatggcccgatgggtcagaccaggccagtctggccaatccattttgacagccctactaggaactgcatgtaaggctactatgatcacacacccctccaatactaagacacatatgacaactgtcacctcagttggtttagggtgtgagggttctaaaaaccatgaatttgtgaaccaagttcaaaatagtggtggccaaatgagggtcattgaggttaatattagtggtcctcttgatgcacagatgcaagcctctgatgataagaagagtgatatctccccgatgatggaagacatgcttgagatcgtagaaactgaaggcactccccaagccttgtcttcgattgatctgtcccaatag

SEQ ID NO: 68697 - DNA, 531 bp, Glycine max
  Peptide Sequence Number=SeqID_185475
atgaatatggacgaggaatcagagaaagtggcagtggagttggctgcacaaggagttattggaaagagagttgatgagatggaatccgatttcatgatggcccttgactacatgatccaacttgctgagaatgaccaggatgataagcgtaagtcactgttggaagttatcaaagagacagtattatcacatctaaccaaaaaatgtccaccccatgttcaagtaattggtcttctatgtagaactccgaaaaaggaaagccgacatgaattgttgcgccgagttgcagctggtggcggtgtatttaaaggcgaaaatgagttgaagatgcatatcccagctgcaaatctaaatgacatagctaaccaagctgatgatttgttggagttattttctgatatcatatcattgtgtcatgtaccttacaacctgatctttgacaaagaatgcagattcctttacttacatagagagtacttgacacttgacattgttcaagttctagaagatgttcaattttgggggctataa

SEQ ID NO: 68698 - DNA, 252 bp, Glycine max
  Peptide Sequence Number=SeqID_185476
atgggtgccatagatgcttgggccaagggtgctccatccatcctaaattgcttgatggaagtccaagaggaatgcaattcctttaataaaaaggtatttggcaatatcttggttcgcaaaagaaaggtggaggcaaggcttaatggggttcaattagctttggaagatggtggttctaaaagccttagacgtattgagcaggagctctatgctaagtacaatgatatccttccccaagaagaatttctctag

SEQ ID NO: 68699 - DNA, 489 bp, Glycine max
  Peptide Sequence Number=SeqID_185477
atggaaactcgtcctgttatcccagatcgaaaactacttgcaaggcttgttttgattagagaagaagctcgtaatatgatgggagggggaattacggacgaaagaaaccaccgtggattctatactcttcctcagcctgaggtggacttcttggccaaattggtggctctaaaacctggaaaaaatgtgcttgatatgataagaaatgtaatgcaaggaaaagatgaaggtgcagacaaatctggcaacaacgatgaggatgacactacaaatggggatccagctgaatttcttggaaggccacttgtaacgggagagaagacacttccagtgcgccctggcatgtttcttgagactgtctccaaggtcttgtctggtttatatgctggaactgattctggcatcactgcacaacacttggaatgggtatattctctttctctctatagattcacaattttttctatttccaagatcaatgtcctgtga

SEQ ID NO: 68700 - DNA, 196 bp, Glycine max
  Peptide Sequence Number=SeqID_185478
atgttcgtaaggaagaggttgtatgccattttcgttttaagagtagcatttcttggtgattcaaagaggtccaggaagcttgcctcaaagaggtccaggaaggataaagcggccgaagggaccagtttcgctcccgagtatgacagccaccgctttaggagtgctgaacaccagcagcgcttcgaggccatcaggg

SEQ ID NO: 68701 - DNA, 653 bp, Glycine max
  Peptide Sequence Number=SeqID_185479
ctattgaattgtgttcagagtacattgaaaactcaaaacctgttggccttcccgagtctcagcatgacaagagagtgggtgatctgaagaagctagcttatcagaatgagtctttcatcatgacagaacaaggtaaacaagtattttatgttcaagatccttgtgatgaaaggtggttaggggttttacatggaaaaaccatggatcttaatcttgaagatgatgattcaaccctagatacttgtcccactcctttctccacacaaatgcctaatgtcaacggagaagaaaaagttgacaacatccatgcaaatcacaatgatcatgatgaaggagaattaattaacattgcacatgactactccgagctcccttcttcctcctggagaccagtggttcatgtggatccttccactaggaaagctaatggtccccacaaaaagaaattaaggacatatttagggatcgtcgctcgagataaggggtcgacaatcgtccacaacgtccctttgggcaatgatcacatgaaggttgatgttgaagaagttcgagatgttgatgctagcctccctgtacccactcaagagggattcaacgatattcaaggaagtaaacccaaggctattgctaaatggatattccagttaaagtaa

SEQ ID NO: 68702 - DNA, 573 bp, Glycine max
  Peptide Sequence Number=SeqID_185480
atgtggaagagcaaaagaggatccaaatggaataactcctccaagaaagtgttcaaggagaggaaagacaaagaaaatagctcaataatatgctatgagtgcaagaagcctggacacttcaagtcagaatgtccaaatttagagaagtctaaggacaagaagaagtactacaagtccaaggaaaagaaaggcctcatgagcacctgggaagatttggatgacaccttgtctgatgaagaaggagaagaggaagctaacctatgtctgatggcaaatacaacctttcgagaatctaaatcagaccaaaaggatgaggttcagcccctgacgacgccgtttctcctcgggcagctccggtgggcccgaacgcggccgaagtcaccgccggtggcgctgaagagggcggaggagcggtcggagtggtgggcggtggacggcgaagtgcacgagatcggcgatctcgtgccgctacgtgagcgcttcgtgattccccgagagaacatccccaacaagcgccgcaagcagctcagagaacagttcatgcgccgaacgcgcctcgttcttaaggaatcc

SEQ ID NO: 68703 - DNA, 555 bp, Glycine max
  Peptide Sequence Number=SeqID_185481
atgagtttgaagaaatgtataaatgccccaggtgtgggggtatcaaggtacaaagtgaaggatgatgacgagtgtaacagtgacaaaaacacaaagaaaggccccctcagcgaagatgggagaaattgcaatggaatgctccaccaaccgactgattcctctcagtggaagaagattaatcgtttgtatctggatttcgacaaagagataagaaatcttaggcttggacttaccactgatggaatgaatccctatggcagtttaagcactcaacacagaaatgagatcgatgcttatctcagtcccttaattgaagacttgacaaagttatgggacgagggggttgctgtgtttgatgggtatcgaaataggacattcaagttgcgtgcaatgctattttgtaccattaatgactttccagtatgcggaaatttgagaagatacaatgttaagggccatcgtgcatgtcctatctgtgaagaagacacaatgagagtgagaaagggttcaagtggccatgagaaaggtttcaaagtgaggcaacttgatggttaa

SEQ ID NO: 68704 - DNA, 789 bp, Glycine max
  Peptide Sequence Number=SeqID_185482
atggagtatctcacccccaaagtggaagaaaacaacaacatacaactaccaactctacctcaaggggtgacatttgacttcaaatatgggttcctccaaatgattgagagcaaccagttcaatgaagcttcccatgaggatcctatggtgcacttaaggaggttcttgaggttgtgtgacacgatcagacaacccaacatctgcaagaagtatgtaaggctgcatgtttttcccttctctgcaaatggtaaagcatgggatcggcttagtgtattttcagagaacatcatcaccaattggacccgatgttccagtgccttccttaaaaggtacttatctgtgatgaagactgataagcttcaaaggcacattggcaacttcactcaaaatgagcaggagaactttttagaagcttgggaaagattccatgagactagccttgttgttgcatgtcaaggtaatttgatgatgaagccaccagcttatgttattaaaatcattgaagacttccctacatcagttatgggatatgagaatcatgaagaggccttgatgttgcatgtcaagaggtcggtcaaccaggtagaaactaaagcagctacttatgaccttggacaaaagattcaggcattgtccaagcaaattgagagtttgacgaaggctcagtctcaattgcctaactctacacctctctatcacacgtgtgagagatgtggatgtgttcatggtccaggagaatgcacattggcgggcaagttagctcaagttataatgccccttattaaataa

SEQ ID NO: 68705 - DNA, 267 bp, Glycine max
  Peptide Sequence Number=SeqID_185483
atgaagcacagtggacttgtggcctgcaattttcaaaaggcaaagtatggaggcctagatgccattgaaagttacatattttgggaccgtcatgaacccgttcgacgtgaatatgattgctcaggaaatttggattttatcgattttttaaagctaatccaagaggctgagttgtatttcattctaaggattggtccttatgtttgcgaggatggaactttggaggcttttcattatggctacacaatatgccagagattgaattga

SEQ ID NO: 68706 - DNA, 396 bp, Glycine max
  Peptide Sequence Number=SeqID_185484
atgactagcattgatatccctgacatttccctttggaacaattcaactcttcgtgtgagcactatggggcataccctccgtgcttatgttagtggaagggctgatgactttgaagctcctttcggaatagaccccatggttatggacttgcaagactcgggtaaaagacaagcttgggtgaatggaaaaagcattggttgttattggtcttcttggattactaataccaatggatgcagtgacccttatccattggagcttgtaagcctaagatcttcttcatcaatggattcctttgcttcttggaagatgaatggcagtggaatggagaaggaagagagagaggaaacaccacttcaaggagaagatgagtctagaagaagcccaccaccataa

SEQ ID NO: 68707 - DNA, 798 bp, Glycine max
  Peptide Sequence Number=SeqID_185485
atgggaagaagagtccctaatgagaataacaacatcacattgatagaaccatttctttattttccattttgcatggtaggatttgtcacaagcattactataatcgcagctttgtgcagtgtgaggtttcgaaaaaaatcatcatcagcacctgccccagttgatcatgattcacatgaagtgacaaatcttttgaatattgaatctactaccccaccaacaacaacatcgttagaacatgaacaacatcctagtacctcggagggaccaatgttggagaacacagcacaaacaacacaaacacaaaataatgacacgttggtaaaggagttacctcttccgccagcattgcagcaacaccctaatgtggaccccaagattgtgaagagagcaacttctgaacgtaggttgtctttcaatttgagcatgaagatgccaaggagtttttcagtggcaagaaacgatcaaaagggtaatttcaatgatggagggaataaaggaaagttgttaaaaacaaatgagtctatgtggatgaagacaaaagggaagttgaaaaatgaagattctgtgtggatgaagacaattatacttgggggaaagtgtgttcctgatgaagaagaagatgttgtcatttatgagggcaaagggaagaaaatctcagcataccatcctagaaagtctacctctatgtcactttctaggcaatgttcttacattaaccctggtgccttctctgtaccccaatcccatgaagaaagaatcaaatcaatcaataacacatgttacactcaaccttga

SEQ ID NO: 68708 - DNA, 315 bp, Glycine max
  Peptide Sequence Number=SeqID_185486
atggaaggttgtgcaagggggagggagaaggttgcagaccagcgatgcctaaaggaagaagaaggtcgcgcgaggggggagggagagatggaaggtcacgtgagggggaggggaagagtcgcgggccaccagtaccggaagggagagggaaggtcttgcgagggggaaaaggaaggtccctttaggggaaggggaaaactgagagaaaaaaatgaagagagggagatgaagagtgtgctgagagggaggaagggaaaaaaggtgaagaggagtggggagatgaagagacacgagagagggaggaggaaaaagtga

SEQ ID NO: 68709 - DNA, 1254 bp, Glycine max
  Peptide Sequence Number=SeqID_185487
atgggtgcatctggaaaatgggtaaaagcattaatcggactcaacaacaagaacgacctcggtgggaagaagaagaagtggaggctgtggaagatttcttctgcaggggaaaacagatctcaagactacgactacgctagcgtggcttcggattctttcaatgctgcggtggccactgtggtcagagctccgcccaaggatttcaaactactcaagcaagaatgggccgccacccgaatccaaaccgctttccgcgccttcttggcaagaagggcactgagggcattgaagggagtggtgagacttcaagctcttgtacgaggtagactcgtgaggaagcaggctgcggtcacattgaggtgcatgcaggccttggttcgtgtccaggctcgtgtaagagctcggcgcgtgcgaatgtctattgagggccaagcagtgcagaacatgctcaatgaacgccgcaccaaggctgaactcatcaaacaagctgaggaaggctggtgtgatagcaaaggatcattggaagatgtcaagacaaaattacagatgaggcaagaaggagctttcaagagggagagagcaattgcatactctcttgcccacaagcaatggagatcaacccccatctctaattcaagagcaaatgccactctcaacaatcaggatacggacaaggcaaactggggatggagttggttggaacgttggatggcagctaagccatgggagagtagattaatggaacaaacccatcatgctaatgccacagagaagacccctcctcctccgccaaagaaatgtgttgactcctcaaattcaaaaacatcagaaccatgcaatgtcaaaatcagaaagaacaatgtcagcacaaggatctctgctagacctccccttatttggcaagctaatcatttgtcctcaagtccaagttccgagtttcactatgatgagagctctaattcatcctcaatatgcacttctacaacgccaatatctgggagtgctgcattgccctgtgacaggacagaggatactaacaacacaaggcctagttacatgaacctcaccgagtcaaccaaggcgaagcagaaaaccaacaaccatcaatacaatagatctcataggcagcagtccatggatgagttccagtttctcaaaagaacagcggttttctctaatggtgcttctgacccttcaaccaacttctgtaggcctctttacctaccaacctacatggataagaggtcacagtga

SEQ ID NO: 68710 - DNA, 301 bp, Glycine max
  Peptide Sequence Number=SeqID_185488
gaaaatgctacaatgcgaaaggtatttctctcagctcaataacgatatcaaaatttccaacggtgagaattctcgtaattgggctgcgaatgtagtgatcgaatttgacgacgatccaacggtgaacgattccaagatcatcgtttttctgagacaggcagaggcgcaattcaacggggagctaacaagtggcattgatttgttgtgtcaaaagctttgcgtaatgggttgctacacatgcagtggcacaaccacttttggacaggctatggcagtgttgactgctttggacagcgcatga

SEQ ID NO: 68711 - DNA, 1377 bp, Glycine max
  Peptide Sequence Number=SeqID_185489
atgggaagacaaccactaatcttggtagcagatccagagctttgtaaaaaagtgggtatcaaacaattcaaagacattccaaacagaagcattccctctcctatttctgcttctcctcttcaccaaaaaggtctcttctttaccagggactcacgttggtcagccatgcgaaacacgatcttgtcagtgtaccagccatcacacttggctagcttagtgccaatgatgcaatcattcatagaatccgcaacacaaaatcttgataccccaaatgaggacataatcttttccaatctttccctaaggctagcaactgatgtgattggagaggcagcatttggtgtcaactttggcctctctaagcccatttcagtttgtgaatcaatcaagagtgttagtgttaacaatgtgagaaatgatgataatgataatggtgatgatgaagtatcagatttcatcaatcaacacatttactccacagcacaacttaagatggacttgtctggttcattctccatcatacttggtctacttgcaccaatacttcaggagccatttaggcagattctgaagagaataccaggcacaatggacaggaaaatagagagtactaatgagaaacttagtggtcgtcttgatgagattgtcaagaggagaatggaaaacaagaatagaacttcaaagaatttcttgtcactcattttgaatgcaagagaatcaaagaaagtatctgaaaatgtcttttcacctgactacgttagtgctgttacttatgagcacttacttgctgggtcagctactacagcctttaccttgtcatccattgtctacttggttgctggacacatagaagttgagaaaaagttgcttcaagagattgatggatttggtacacctgataggattcccatagctcaagatcttcatgacagttttccttatcttgatcaggtgattaaagaggccatgaggttttacactgtctccccattggttgcaagagaagcatcaaatgaggtggagataggaggttatcttcttccaaaggggacgtgggtatggttagctcttggagttctagcaaaagatccaagaaattttccagagcctgagaagtttaaaccagagaggtttgaccccaaatgtgaagaaatgaaaagaaggcatccttatgcattcataccatttggaattggtccccgggcatgtattggtcagaaattttccctacaagagatcaaactttctctgattcatttgtaccgaaaatatgtttttcgtcattcacttgacatggaaaaccctgtagaaatggaatatggtatggttctcaacttcaagcatggtctcaagcttagagtcataagaagaacgtaa

SEQ ID NO: 68712 - DNA, 576 bp, Glycine max
  Peptide Sequence Number=SeqID_185490
atggcagaaattgtgagattgaggcaccaacaactgaactcaagggaacaattgaattccatggagaccagattgcaagccactgagaagaaacagcagcaaatgatgagtttccttgcaaaagcactgagtaacccatctttcacgaaacaattagtccaaaagaccccccaaagcagagaagtgttgggtgttgaaatcaataggaaaaggagactgactgctagtccaagtgttgagaacttgcaacaagatgatcaagatttggcaactttggattatccaagccatgatcgagatttggcaactatggagactgatatggacacttttttctcaccggcttatgataatgaacttagcagtgaaaccaatgagcctgcatcaatttcggttgaggatacaatcttggaggactttctcaacaaagacttggttacttggaatccggaggatgaagttataattggggatagttcccaagtcgatgtgccggtggaggatttggttgcaaaccctgatgattggacagggaaggtggtagatgcagaagaaccaaacaaatactgctcttaa

SEQ ID NO: 68713 - DNA, 450 bp, Glycine max
  Peptide Sequence Number=SeqID_185491
atgccaaagaaaggagcttcaatggaagaaggggtagggcttcaatgtcaaagagctgaggtcaatgtcaaagaatggagcaagcagaaaggtgtagggttcacagcaaggagaaagcaagcagaaagctctagggttcacagcaaggagaaagctagcagaaagcggaataggggtgatgacgatgacggtggtgacagttgtgaaatggtgatgttttggaatgatggtgatgacaacgttgatgatggtggtggcgagaacagcaataaaatggtgatggcggcagcgaaaacagtggtgcaatgtaataatgatagtgataacgacaacatcaatgaaggcaacgacaatggtgatagtagtgacgtgatggtagcaacatgtcaaagtagtggcatggacaatgtggtggcagcaatagcagtggcaggagcggcagcggtggca

SEQ ID NO: 68714 - DNA, 1977 bp, Glycine max
  Peptide Sequence Number=SeqID_185492
atgtctggtcattgggggattcttgtttccgatccatggcttcagaatcagttcacacaagtggagcttcgtagcttaaagtcccatttcatgagcatgagaagggaaagtgggaggcttgtgattgcggatttggcttccaagatgtcaagggtgaaggtggtgggagagaacctgagtgaggaagagagagcttcttgtgtgaaggatttgtatcagaacactgaagaggaggtctatttgaaactccaaacatttgtgaattctagaaccggaagtagtccaaagaactcgttggcattcctcaaggcagctacaaccacattgcttcacacaataagtgaatctgagaaagcgtcatatgtagcacatataaatcactatctagcacaagatgagttcctcaagaaatatcttcctattgacccttcaaccaatgagctctttgaaattgcaaaagatggtgttcttctttgcaagcttatcaatgtggcagttccggggaccattgacgaacgggcgatcaatacaaaaaaaatactcaatccatgggaaaggaatgaaaatcacacactttgcctcaactctgctaaagcaattggatgtacagtagtcaacattggcacccaggacttcattgaaggaaggcgtcatctggtgcttggggtgatttctcagattattaagatacaattattggcggacctcgatttgaagaaaactcctcagctgcttgagttgcttgatgatagtaaggatatggaagagttgatgaatctacccccagaaaaaatcttgttaaggtggatgaatttccatttgaagaaagcagggtacaagaagattgtcactaacttctcctctgatgtgaaggatgctgaggcttatgcacaccttctaaatgttctggcacctgaatacaccaatccctccacattggcagttaaaaatccctttgaaagagcaaagttagttcttgaacatgctgataagatgggttgcaagcgatacttaactgcaagagacatagtggaaggatcaccaaatcttaatcttgcctttgttgcacatattttccagcacaggaatggactttcagcccagacaaaacaacaaatgtctctccttgagacatttccagatgacacccaagactctagagaagaaagagcatttcgcctatggatgaatagccttggaaattcaacatatatcaacaatgtctttgaggatctccgaaatgggtgggttcttcttgagactcttgacaaggtgtcaccagggattgtcaattggaagattgctaacaaacctccaattaagatgccattcagaaaagtagagaactgcaaccaagttgtgaaaatagggaaacagattaaattttcgctggtaaatgttgctggaaatgacattgtgcagggaaataaaaaattaatactagcttatctgtggcaattgatgcgatacaatatcctacaacttctcaagaacttgagatttcattctcgagggaaggaaataaatgatgctgatattttagagtgggccaacagcaaggttagcagctctggaagccaaagccgcatggacagttttaaggataaaagtttatccgatggaatatttttccttgagcttcttagttcagtgcagcctagagctgtgaattggggtcttgtaaccaaaggagtaaccgaccaagagaaaaaaatgaatgccacctacattatcagtattgcaagaaagcttggatgttctatattcctgcttcctgaagacatcactgaggtgaatcaaaaaatgatccttacactaacggctagtataatgtcttggtgcctaaaacaccctcgtgaagaaaggacagtgggaacttcagataatgagagtgggagtcaattggagactacatcaaattcaacactagatgactctgcctctgattcatcaatagatgagaatgggaacatgtaa

SEQ ID NO: 68715 - DNA, 651 bp, Glycine max
  Peptide Sequence Number=SeqID_185493
atggaagggttagtggacctagcagcgattgacgctttcctcacctttcatcatggcaaggaaagcctggtcgtcgccattttggccatatatgacacgttcgaccggggatgtgaaaagaacggcgcaagaattgaaggaagaatcgggattctatcttcatgcgaaggatgtcccatgagaggagtgccatcagacgaaagcatcacgcctttcatcgcacgaggtttcagtgaccacaacgcgagggacagagagcttaggggaagcagtaatgggatcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaagggaatatgtgggccatcatcgataagtgcaaagagaatctaaatctagcggtgactcacgagcaaaggctagaggatgagtacgccaagatatcagcagaaagggaagcaagggaaagg

SEQ ID NO: 68716 - DNA, 613 bp, Glycine max
  Peptide Sequence Number=SeqID_185494
aggactacacgtcctcgccttcagacgacaacacgtcctcgccttcgccttcatagggatacacaccctcacctttaaaggactacacgccctcgcctttagaggactacacgtcctcaccttcagaggacaacacgccctcaccttccgaggactacatgtcctcaccttcaaaggactacacatcctcgccttcagaggacaacacgtcctcgccttcgccttcataaggctacacacccttacctttagaggactacacgtgctcaccttcagagggctacacgccctcgccttcagaggactgcacgtcctcaccttcagaggaccaaacatcctcatcttcagaggactacacgtcctcaccttcagaggactacacgtcctcaccttcagagggctgcacgccctcgccatcaaaggactacacgtcctcaccttcagagggctgcacgccctcaccttcagagggctacacgccctcgccatcaaaaggctacacgccctcgccttcagagggttgtacgtcctcgcctttagagggctacacatcctcactttcagagggctccacatctgcgccttaagagaatttatggtcctttgcccttaa

SEQ ID NO: 68717 - DNA, 636 bp, Glycine max
  Peptide Sequence Number=SeqID_185495
atggatgatctgacagttaacttcagaggggcaaggaaggcaagggctcgactagctgatgttccttcttcttctactccaccagctcctcccacatatgctactcctacaccagctcctccaggcccatctgcccaggactctcagtgctttgagtccatgcttctgagtctttatcagggacaaatattgttaatgcaaagcctgcaggtagtctggccaggaactcagccttctcttgtgagggaaggtggaggttctggtgctcaggtacctcagcaggtacaagatgcatctttagaggccaccatccttgtgccatttgtttttaaggtaggagggacacaggtaaggcaggaggctgctactccagagaggtcaccacagatttcaccagatccaccctcaccaatgatggatcaatcttctcctcaacagttagcagattctcctacaacagtgcatgagatgccagcagacctttctactccattactagagattccagaggaccctgccacaccagtcctgggactgactaccactcctccagccactcctgtgctacattttacagatgaggaggccactcaggatcaagatacccaacaggatgaccagtcacaagagttttaa

SEQ ID NO: 68718 - DNA, 165 bp, Glycine max
  Peptide Sequence Number=SeqID_185496
atggtggacgtggatgtagttaaagaacaagtttcacaaaatcttgaacctaccaagtgtgatggttgggattgtttaacatattgtgatgaaaacaattatggtttgaatggcattcaggatgcacgtaaatttgtaaaacgtctaattcagaagcaacattga

SEQ ID NO: 68719 - DNA, 264 bp, Glycine max
  Peptide Sequence Number=SeqID_185497
atgggggttaagtacctcaaggcggtcaagcgaaggttgcatgccaccaaacaatggtccccagacgaaattaggatgatgcacgatgcacgaacaacgctaagcaatcaattcgtggggctccggactcttgatggtggacgatgcacgaacagctctaggcaatcaattcatggggcttcggacttcatgatggacgatgcacgaacagcgctaggcaatcaattcgtggggctccaagacttgatcgtggacgatgcatga

SEQ ID NO: 68720 - DNA, 595 bp, Glycine max
  Peptide Sequence Number=SeqID_185498
atggttggttcggttgttaatggagatacgtcggagatggacaaagatcaatggatgtatgacagtatattgtctgaagaagttgatataaatgatgaaaatgaaggtgaagctggtgtgaatgaagaacatattgatcattctgatgtgtttaatacttctcatgtgtttgctacccaagatgatattttgcagtgggctccatcggttgcttatgaaattggatttgtcacgatgattttgaggtcagacataaacattggtatgagaggaaggacttcatttatgttaattggttgtaaaaggagtggtcagtatgggtctaggaagaaagattttgtgagaagaattactggtagtaggaaatgtgggtgtccctttaagcttcatgggaaaccagtggttggaggtcaaggatggatgatgaagttaatgtgtgggagtcacaatcatgaattggccaagtcattagttggacatccatacgctggtcgattgactaaggatgagaagacaattattgcttatatgacaaagtcaatggtgaaactaagaactattcttctaacgttgaaggagcacaatgccaatagtt

SEQ ID NO: 68721 - DNA, 306 bp, Glycine max
  Peptide Sequence Number=SeqID_185499
agagacgtgcgcgcttgcttgaacgagtggtgggaccagaggaaggggatgaaggggcagctgaggaagcctccgcccgcttccggctccgagtttccatacaaaatccagccaacccgcaatctatcaactcgctcgccaccgagcgccaatcacaacgctaccatggatcgatcgagtctttgtggtgttgagttgaatgaatcggttccgcaattcgaaaccctagaaattgcagaagagaagatttcacgtttttcgaacgaggcgttgagtgagcattgtgaggagtgtaatcagcaatag

SEQ ID NO: 68722 - DNA, 132 bp, Glycine max
  Peptide Sequence Number=SeqID_185500
atggccttggtcatggatgcagtggtttgttcctccttgtctgtacccagcggctccatgggtcaggcccaattatcagcaacctccgccccaacagcccggtatttttgggtccagacctcagatttttag

SEQ ID NO: 68723 - DNA, 198 bp, Glycine max
  Peptide Sequence Number=SeqID_185501
atgaatattgctaggggattgaagaagcatctcaagaggctcaatgctcgtaagcattggatgcttgacaaactgggtggtgcatttgcgcccaaaccctcatctggatcacacaaatcgagggagtgccttcccctcatcctcatcctacgaaaccggctaaagtatgctctgacttacctcaagacgagtaggtga

SEQ ID NO: 68724 - DNA, 645 bp, Glycine max
  Peptide Sequence Number=SeqID_185502
atgcttgtattggaggagggccaggagtgcgaatatagtcagaggaggaaccgggccgatggatttgatgaggaggccatcgctcagctgctatgcataccaggtatgccacctaccaggcaccctctagacccagataagtctaacagggccctgggttttccggcattgatcacgattctctgccagtcgttcggagttcctgtcacacctagtaaggtgattcgaccgccgatcacccgggctttcatagagaagtattgcacagctagacaggcacagggtggtgacccgcaggccccagacgcaccgccgccacctcctcaggctgatccagctgggtcatttgacacggagcggtatttacggcatttggttcgccagcaggcggccaaccacagggcgcacgtgcagacccatgactacctctaccagctcagccttagcctgcagagccagggtttccctccatttccatgccctactctggatcagttcagggcagaggtcgcatggcccgaagattggcctgaggcccaggcaggggaggcacccgcagaggctcccggcgatgcagatgaggcccgcatggacgaagagatgacaaatttgctcgatttcttgggagggagcggagtcacataa

SEQ ID NO: 68725 - DNA, 498 bp, Glycine max
  Peptide Sequence Number=SeqID_185503
atggatccactacctagcatagctaaggttttctcatatgcaatacaacaagaaaggcaaattgacaacaatgatgcgttaggaagcactagtttgattaaggcaacaaacactagctcaccaaactcacctttttcatgtacatattgtggtaagaattggcatattgttgatagatgttacagaaaaatggctttcctcataagtcattttctagaaaagcatggataccctcatggtcgtaaatatcataagccccaaggtccatcaatcaataatgaaaatgctataaatgaggaaaatgcaaattcaaatgtagaacagaatcaagaggcacaaggttcagatgttaaagtgactactcaacaatacaaagccttaatgacattgctgcaacaacaaggatcttcaactcacaatagtttacatgtgaatcagattggcacgatgactggttctggtcatgcacttacaagtaatgtcatcaataagttatag

SEQ ID NO: 68726 - DNA, 255 bp, Glycine max
  Peptide Sequence Number=SeqID_185504
atgaggaagtgtcgacgggtgaaacttcctgcttctattgttgaccacagagtggtacctggagatatgtcgcgggggtcacgagaccttgcggacatcaggcgagctcctggcagtcaaccgataaccggaacgaagaccacaaagcaaggaggcttgtgtaggtggctggccagctgtgaatcttgtgtgatatatgggttatggcctctggtaatcgataaccaagggtgggtaatcgattccaaggcttaa

SEQ ID NO: 68727 - DNA, 312 bp, Glycine max
  Peptide Sequence Number=SeqID_185505
atgggtgattcttggttatggcatcgtagggctgcacatataaatatgcatcctctcaatcatctagttaaaaaggaattagtaattggtattccgaaactcaagtttgagaaaaataaattgtgtgaagcttgtcataaaaggaaacaagttaaaaattcttttcaaaaaaatgaaattcaccacaacatttgctccccaagaacacctcaacaaaatgatgttgtggggaggaaaaatagatcccttgaagaaggacctagaactcttctaaatgaatcaaagttagcaaagtgcttttgggctgatgtt

SEQ ID NO: 68728 - DNA, 888 bp, Glycine max
  Peptide Sequence Number=SeqID_185506
atgccgcccaccagcagctggaaagtgaaaaacaccgcgatgatccccaagagcatcgtcgcgatccgcgtattcctgaacattggcattctccgtaaaaaagcggcggcgcgatccgcggccaccggccttgcatgccgcgcgcgggggtcgtgcgcacggcatcgattttgcaatgctgatttgctgattgaagcgggacggacgtgctaccgccagacgacacaacggccccgaagggccgtcgtggacgtcacaaagcggtggcgatcagggctggttgacgaccaggcgcaccacgatgcgacgccctggctcctgccgttccagcaccagcatctgcgggccgagcgtgtcgtagcgcgacagccgcgcgcgccagccgccctgctcgaaggccacggggcggccgaggtcgtcgttggacacgtcggtggcttcgggctggcccggcagcttgccgcgcagccagtcgcgcatgccggataccggcatgctgctgcccagggcgtcctcggccagggcatcgggattgtcggccaccaggcgggtgccgtcggccttggtcaggctggccgcgccgggccggccttcgacccgcgcttcggtcgagccgagcgggttggtcaggtcgagcacgtagcggcggccatcgtccgaccaggaaaagccgccctgcacggcgctctgcttgccgttttcctcgttgaccgtgatggcgaagcgtccgacgcgcgagaacgcgtcgggcgacacgccttcaatgggcttgggcgtggtggtgcaggccgccagcacgaacgccagcatggccagcagcgcccagcgcatccattccagcccgaggccgcgcggcgtagccgtcacaggctgacccccagcgcttga

SEQ ID NO: 68729 - DNA, 466 bp, Glycine max
  Peptide Sequence Number=SeqID_185507
atggtgaaggtggtgactccaaacggaggcatcatggagctgtacacccccataaccgcggagtgcataaccaacgagttctccggccaaggaatattccgaagccgccgcgacttgttctcagagcagctgcaccacgacgaggagcttcatgcgggggagctctactacctcctccctctcgacccttcttgtaggttgtcatcgaccaagaacatcaccagacaattatccaacaacgctgccaccctaacgccgtaccgaatgtttacatgcgacatcaataacaataggatgtggtcggaagcagctgaagtgtttccaaggaagggagtatggaaggtgaagttggtgataaacccggagcagctgtcggagattttgtcgcaggagtcgcggacggaggccttcgtagagaccttgaggacggtggcaaagtgcggcaatgggatgccgtcgggggcga

SEQ ID NO: 68730 - DNA, 225 bp, Glycine max
  Peptide Sequence Number=SeqID_185508
atggcttgcacccacattccgctttcaaaattgccccatgtgtggcatctcttgtcaatgtcaggatttacacgtgattctcctcaaatttcagccagcttgcatcaattagaccttgcaccttacgcttcaggcccctacaatgctcaatggaatgccccggggcttctccatgacaagcaccacgttgcgttcgagtcgtattctcggagaaatggaggttga

SEQ ID NO: 68731 - DNA, 363 bp, Glycine max
  Peptide Sequence Number=SeqID_185509
atggaagtggatgcttgtgatcatcttattcctattcataatctgagcattcagttcagggctctgtctaaagaatggaacagaaaaggaagcagaaagaagaagaagaagcgaaggaaaaagaaaaagaaatggaataaaatcctccagaagaaaaggaagaaaaatctgatccccagcttgcagagggacagaagtaccactgattctgcatcaaaaaaatatgtagatgaagaccattctggtaagcatgatattctcaagtcaaagcctgaattacgtgaagagagcaagggttcagtagcaactccaaatccttctcttcaggatcccaaaggaaatcaaactggaagggcttcataa

SEQ ID NO: 68732 - DNA, 546 bp, Glycine max
  Peptide Sequence Number=SeqID_185510
atgtttggtggagctgttcctgctccaactccaactccaaatggtggtgtagttaattctgatgaaatgcagatgcacattactgtcattgtcaccatttccaagggagaaggttgcgtgttggaaatcatgtgctctgcttggcctgacagtatagagataaaaaggttgttcattcgtgcaaatgagaaaataatagctgagccctatgctggtcctgaattcatggaattggatgatgagctgcaatacagactttatgatttcttggaagtgaggggtataaatgatgaactcgcttgtttcttgcatcagtacatgaaaaacaaggataaagcggagctcataggatggatgaaaaggactcagatactgaaaaggttggaaccacaggcttctttctggccgagtaacttctgggacagatatgtaatcgtgttgaaatacgaaagctttgtcaatcagtataatcttatagtctattcccagctgagtgaggtttatgctaacttggtgattcaaattgaaccacagaacagaatatag

SEQ ID NO: 68733 - DNA, 786 bp, Glycine max
  Peptide Sequence Number=SeqID_185511
atggatcttcaaaggcaagagtcatgcccttctgaaaatttgaacatcatcacattttcagatactgtgccatgccaaaatcctgaaccttccatcaacactcaaacaaagacgaatcagacacaaacggaagatcaaaaacacccacatgactcggttcctcgtgttttactagatctaagtctctccaacaaggattcaagtgatgatgactcaaagtcagaactcaacctcctcaattgtttccatacaaatttctctgaaaacacatcagaatccagtcagggaaatgaactggatcctcgagtcttctcatgcaactactgccaaagaaagttttatagttcccaggcactagggggacaccagaatgcacacaaacgtgaaagaactttggcaagaagaggatacaaagctggcgtagcagattttggacacacatactccaacatgcattttctgccttcacatgacttgtacaacaaagcacttggaattcaggttcattctatgattaacaaaccttcttatcaaacacccatttttgggccgtgccgttcaattggatggcagaggcaacctttggatgcacaaccagcgattgggaactttcgcgtgggggcagaaactgagtcatctttggctgatagtgttccaaagttaggcaagttttccacaaggttggtgacagaagggtttggagggtactgctttggtagcattactaatttgaagtctaaacaacaagagaagttgcagaagcttgacttgtcccttaagctctaa

SEQ ID NO: 68734 - DNA, 678 bp, Glycine max
  Peptide Sequence Number=SeqID_185512
atgattgatagcagaaatctccccctgcccaatcttttgcaggcgagaaaacttgaagctcagttggatgagcagatgaattcttatcgtaaattggtttctgctaatgtttctacaaaagctgacattgcagagagtgatctagggtcttggattgagcgtttactaaagcaactccaacaagtaaacacacagatgcaagcttgggtatcatctggtggttcagaaatggtttctcatacattgactagacaccaagaaattcttcaagatctcacccaggagttttatcgtcttcactcaagtgttaaagctaagcaagaacatgcttcactgctagaagattttaaagaatttgatcgaacaagattagatttggaacaaggtgtagactctgaacagcatgcactcctaaaagagcgctcatctatcagccgaagtgcaggacatatggacaatgtaatttcacaagcacaagcatcactaggagcacttgtcttccaacgttcgacatttggcggtatcaattcaaagcttggcaatgtgagcagtcgcctcccaacggtaaataacatactttcagcaataaagagaaaaaagtcaatggagaccattatactttcccttgtttctgccgtatgcacatttctcattttcatgtactggctatccaagtga

SEQ ID NO: 68735 - DNA, 225 bp, Glycine max
  Peptide Sequence Number=SeqID_185513
atgggagaagaaactagagcaccaccattgcctgagcttctgtgtccattgccaacattgggaaacatgatatacttgaagagaagcatgtcaatcaccataaccctacacaatagtttgatcatagcaggagaggggtcagttgggttcaggcttggaggtttctgtgaggaattgggtgagataccaaagaaaaaaagcagcaggcagcaggcagttgtatag

SEQ ID NO: 68736 - DNA, 642 bp, Glycine max
  Peptide Sequence Number=SeqID_185514
atgactatctgctatgactatacaactgcctgctgcctgctgctttttttctttggtatctcacccaattcctcacagaaacctccaagcctgaacccaactgacccctcacttccagtccagcagtttattctcttcactctcttccttcaccctacctctcctgctatgatcaaactattgtgtagggttatggtgattgacatgcttctcttcaagtatatcatgtttcccaatgttggcaatggacactcacctagatgccatgaatcccttcacagtttcagatttcagtatgtaggcttgcaatttagtatactggcatgtttgagtgtttgcaagtctggtggtggtcttggcagagggggagacttagagtcatgtggtgactgcccagaaggaatcgaaacactttgtgctgatatggaggtggatcatacagatgtgagggttttgatgcttgcatgtttgtgtttggagttgatgaggactaaatttaacaggaaaatgaaagctgaggagcaaggatattttaccttggatgagtggaggagaggcttaaaagcattaagggccgatacagtaagtaaattgaagaaggcacttccagacctagaaaaagaggtacaattattgaagtga

SEQ ID NO: 68737 - DNA, 597 bp, Glycine max
  Peptide Sequence Number=SeqID_185515
atggtgagaaatatgatggaaagtgaagaaaatgataaagatcgaggagtacagagtgacaaccccaacaacgctatcgtggagtccgccaaaggcactggggctcttgggaagactagaatatggctaggaacttttgaaacggcagaagatgcagcaagagcatatgatgaagcagctaggctcatgtgtgggccaaaagcacgcaccaatttcccatacaaccccaatgagccacattcatcctcatctaagcttctctctgccactttaacagctaagttacataagtgtcacatggcttccctttctcttcaaatggccaagcagaaaccaccacagaacaaagagcctcaaccatcacacgggtccaatccatttgcctctgccaatgccattgctggatcaagcgctgacacgagttttcgatggccagataatagacatgaggaattcaggtggcttgaagggaattgggttggtgttgaaggccaggttgaagtttccaatcaacagtttcagccagttcttgaagatgatcacatagagcagatgatacaggagttgcttgattatggatcaattgagctttgccct

SEQ ID NO: 68738 - DNA, 225 bp, Glycine max
  Peptide Sequence Number=SeqID_185516
atgctgaatagttgcaatcggctgatagtagaccctgcaagcagagacgactacaagaggctgagaacttgtgaagcaatggagaaggagaaggacaaccgaaagggaagcatgcataacatcccatgtgtgcctctgttgtatgtctctctcgctaagatatatagagaaagtgtcctattccttgttagaatagtagctggctactgtgcggtgtggacataa

SEQ ID NO: 68739 - DNA, 306 bp, Glycine max
  Peptide Sequence Number=SeqID_185517
atggaggaagagcgcgtggaggtgggagtggtggaggcgcgtgaggtcgagggaggtgagaaaggggaacctgaggaagaggttcgggagaagagggagcgtagggtcggaaatggtgagggaggttcggaggcggttggtgatggagaggaattgggtggagagaagagagagaggctcaaagtgacgatgggatttcaggaatttcaataccaattcccagcactcgtcggaggaaacactatggttttgaaactcatctcttcgaacggggatgttgtgtctggtatgcttcttaaaaattga

SEQ ID NO: 68740 - DNA, 1020 bp, Glycine max
  Peptide Sequence Number=SeqID_185518
atggtgaatggcgacggcggctcttcagggtcaggaaccaaattctctggtggctcctccggcagttctggtggcgccaagaaaacatccggtgggtcctccggcagctctggtggcgttaagaaaacatccggtgggtcctccggaagctccggtggcgccaggaaaacatccggtgtagtgggcatgttaaaagtcggcggttcctccggcatctccggtgtttccggcacagtaaaagccggtggtacgtcagcaaccaacggtggtggaaagaaggcatttggtgtttgcggcatagtgaaaaccggtggcgttgaaagaaacggcgtcggttcaagtggagggggaaaggaaatgtctggcagtgttggagttgaaaggagaggtggcgaagataagaatgggacaagtggtggtgcattattcatgaaggggttcggagggggaagaacaagaggtggtaaaagggtaggagcaggtggcggcggcgatgggactaatggcggcgccggcggcagaggtggtggggagggcggtggtaatgggcagcagggtgcaaccggcgggggtgaacacaccggtggcggtggcggtggcggaggaggcgatggacatgctggtttgggtggtgatggacacggtagtggccacggtggacataatggtggcggcggcggcggcggcgatggaggtagtggtggtggcgatggcggcgattgtggtgggggaggtggtgcggaatattgcactggtggagggattcttggaaaaggagacgaaggcattggtgtttggtcaaaagggttgtcagggcaagtaaaggtaggaaaaggccaaaggccacactttccaaacagatatagaggggttgttctagtttcagcagcaagagagtgtgtgagcaaaagtagtgcaaataaagttgtagtcacagtatttgctttcttcatttctggtgcttttggattgtttttggcactgtttagtgaacaatgtgaaactactcctactacgtga

SEQ ID NO: 68741 - DNA, 1500 bp, Glycine max
  Peptide Sequence Number=SeqID_185519
atgtcagtgaaagatcttcctgaagaatgctgggaattggtcttcagattcattggccatggccgtcatttggagtctctatctttggtttgcaagcagttcctttccatcacaaaccggcttcaattttctctcacaatatatgatccaaccattccactccttcctcggttactcctgaggtttccaaggctcagaatcttagacttcagtcacttgaatggccaccatgaagccttgcttcatcaaatttcacaatccaggttggaccttgatttgcttaatctatccaaccagaaaacactttctgttgatggcttgcgagaacttggctcaaacatgaaaaatttgagggtgctgatctgctctaacattggctctcttcgcgatagccatctggtagtcatagcttattgtttcccatttcttgaagagcttgacataagcttcccattggattctcaagcatctgattttggggtgctaaggctgtcttccatgcttgagaatcttcgcaagattaatatttctggtaattacttgatcactgataaatcattgttctctctatgccaaaactgtttgtcattggaagagatttcattcttcacctgttataagatcactcaattaggcattgcctctgcgattcgcctcagacccggtttgaattccatttcctttaacattgaaaagaaaagaatacatggacctggtttaacactcacccccattgacttggatttgattgattcattcaggagtttgaaaagtttaactgctattgatttgtcaaattctgttatctcggatgagtttctctttgcggttgcagaaggtggtggtcttctgctaaagaagcttatcctccaagactgttgcaattgcacattttcaggaatctcttatgtgctatccaaatgccaatctgttcaacgattggatcttcggaaagctgattttttaaccgatcaatgtatcagcaagttatctatatttcttcttaacgtaacttctataaaccttagtggttgttgccagcttaccaattcaacatttttcatactcacaaggaactgtcctttgctcagtgagatcaaaatggagagaacatatcttggggtggaaggggaagaagattcaatacaagattcttttgtcaaccttgaagtgaaaaaagtttatttgggtgataatgttttgctgagtgatgcaagtttgataaaatttgcttccgtttgccccagtttgcagcttcttgacttaaacggctgcgagggtgtttctggtgaaggtattgttgaggttttaaagagatgctgtgagataaggcatttgaacctggcctatacaggaatgaaagtgtttgagatgatggactttgaagtttctcaacttgaggtgttgaagttgtcagggtcaagaattgaggatgaagcactctcaataatctcgaagaggtgtagtggactactacttctggacatccagagttgctga

SEQ ID NO: 68742 - DNA, 1350 bp, Glycine max
  Peptide Sequence Number=SeqID_185520
atgggttctctcagaaactcggatctcatcctcatcgcccagtgtttccctttcctcgaacatctcgaccttagtttccccgaagacaccgacaattccaccttccccgtctccgatgtcggcgtaaaggccctctctttggccctccctatgctcctcagcgttgacctctccggcaatttcttcatcaacgacgcttccattctcagcctctgcaaaaactgcaactttctcgagcaagttacgatcttcgagtgccacttcatcacccagcgtggcatcgcttccgccatcagggagagaccctgtttgcgttctttccgcgtcagcaacttcggttgtggaaccaaaaaaggggactttttgagaccctctgtgacttctgatttcattacggcgctggtgagtttgaagggcttgacttgtctcgatttgtcgtgttcctctatctccgatgagttgctatgttgtgttgcggaggaagggattcctctgaagaagcttgttttgcaaggttgctgtaactatagctatgttggagtgctttgcttgttgtccacgtgtcagtctttggagcatttggatcttcaaaacgctgagtttctgtgtgatcagcgtgtggaagagttgtgtgggtatcttgggaatttggtgtctgtaaatgttagtggttgtaggatgttaactgatttagctttgtttgcactagttagggggtgtcctttgttgaatgagatcagaatggggggaactgatgttgggaagaggagggttgatcaggatttgatgaatggtgttgtgaattgtcaagtgaagtctctctatttgggaaacaattccttgttgagggatgagagtgtagaaatgtttgcttctgtttgccccagtttggaggttcttgatttgagctcttgctgtggcatatctgaaggtgttgttgaggttctaaggaggtgttgtgaggttaggcatttgagtttggccttttgttcaggagtggagctagctgggttgaactttgaagttccaaaacttgaggagttgaacttgtcacgctcaggggttgatgatgaaatgctttctgtgatctcaaagtgttgtcgggggctgctgcatttggacttggaaaattgctctggtgtcacggccaatggagtgaggcaagtggtggggaagtgcacccgattgagagagattaatttggggtcttgtgatgaagtgggggctaatgttgttgcttggatggtgttttcaaggccatccttgagaaggataatggctcccccgagttttgatctcagtgatggccagaaggaactcctcttgcgtcatggatgccttgtttgctag

SEQ ID NO: 68743 - DNA, 2805 bp, Glycine max
  Peptide Sequence Number=SeqID_185521
atggataatctcgaaaaactgaagaatgaaaatctcgatctcgagaaaatacctttggagcaagtcttccaacagttgaactgttcggaggagggtctcacaactgaggaaggccgaaagagtaagctgctgaaattcttggggtttatgtggaatcctctgtcatgggtcatggaagcggctgctatcatggcgattgcattggccaatggagggggcaggccaccagattggcaggacttcgtgggaatactagcattgcttgttatcaactccaccattagttttattgaagaaaataatgccggcaatgctgctgctgcacttatggcaggtcttgctccgaaaactaaggttctaagggacggaaagtggaccgaggaggatgctgctatattggtaccaggagacattatcagcatcaagttaggagacatcgtcccagctgatgctcgtctcttggatggtgatccactcaagattgatcaatctgcacttactggcgaatcattgcctgtttcaaagaatccaggtgatgaagtcttctccgggtctacagttaagcaaggagagcttgaggctgttgtaatcgctactggggtacacaccttttttggtaaggctgctcacttggtggacagcactaaccaagaagggcattttcagaaggtattaacagccattggtaacttctgcatttgctcaatagctgtgggtatggtcatagagatcattgtcatgtacccaattcagcaccgaccttataggagtggaattgacaatctcttggtgctgctcattggagggattcctattgccatgccaacggttttgtcagtgactatggctattggttctcatcggctgtcccaacaaggtgctatcactaagaggatgacagccattgaggagatggctgggatggatgttttatgcagtgacaagactggcactctaactctgaacaagctcactgtagacaagactttgattgaggtttttgcaaaagatgccgacaaagacactgtaattttacttgcagctagagcgtctagggtagagaatcaagatgctattgatgcttgcattgttggaatgttgggtgacccaaaggaggccagagatggcatcaaagaggtccatttcttaccctttaatccagtggacaagcgtacggccatcacatatatagacaacaatggcaattggaaccgagcaagcaaaggggcaccagagcagattatacatctctgcaatctccgggaagatgtgaagaagaaagctcatgctattattggaaaatttgctgatcggggtcttcgttcccttgctgttgccaagcaagaagttccagagaagaccaaggagagtccaggaggaccatggcagtttgtgggtctcttgcctctctttgaccctcctaggcatgacagtgcagagaccattcgccgtgctctccatcttggagtgaacgttaagatgattacaggcgatcagctagctattggaaaggagactgctcgcaggcttggcatgggaagtaacatgtacccttcttcctccctccttggcgatcacaaggatgagtctattgctgcacttccagttgatgagcttattgaaaaggctgatggctttgctggtgtctttcctgagcacaaatatgagattgtgaagatactccaggatagaaagcatatatgtgggatgactggagatggtgtcaatgatgctcctgccctaaaaaaggcagacattgggattgcagtggctgatgcaaccgatgcagctcgaggtgcatcagacatagttcttacagagcctggtctgagtgtgattgtgagtgcagttttgacaagcagagccattttccagagaatgaagaactacaccatctatgctgtttctatcacaatccgaatcgtgctgggctttatgctgctagctcttatctggaaatttgatttctcaccttttatggttttgatcattgcaatactaaatgacggaacaattatgaccatttccaaggacagagtgaagccatcacctctgccagattcatggaagttgaatgagatttttgccacaggcatagtgcttggtgcctaccttgctataatgactgttgtcttcttctgggctgctcatgcttctgatttcttcacggaaaaatttggtgtcagacctatcaggaatgtccaggatgagctcacagcggctgtttaccttcaagtgagtattgtaagtcaggctctcatctttgttactcggtcaaggaacttctcttttcttgagcgccctggtctcttgcttgttacagcctttataatagcacagctgattgccacactcatagctgtttatgcaaactggggctttgcaaggatgagaggtattgggtggggctgggctggtgtcatttggctttacagcatcattttctacattccgttggattttcttaaattcggcattcgatattttttgagtggcaaggcatggaataatattaccgagaacaagactgctttcacaacaaagaaggattatggaaaggaagagcgagaagcacaatgggccacagctcaacgcaccctacatgggttgaatcctccagaaacagaacagatatttagtgaaaagaacaactaccgcgaattatctgaaatcgcagatcaggctaggaaacgagcagaagttgcaagattgcgggagcttcacacattgaagggacatgtcgaatccgtcgtgaaactcaagggactggacattgatacaattcagcagcattacactgtttga

SEQ ID NO: 68744 - DNA, 339 bp, Glycine max
  Peptide Sequence Number=SeqID_185522
atggaagaagatttttgtgagaattttgaacatacggaagaagtaggattcatatggaagaacttcttccataatgcaaaatgtatacttacggaagaacttattccgaatcctatggaggaacttcttccgtggagcccatacggaagaagttcttatgtattaggtgatgaacaactatggaagaagttctttcgtagctgttcatcaacaactacggaagaagttccttcgtggatcctatacggaagaatcaacaactacggaagaacttcttccgtaaggaaaccacagaagaagttcctccgtaggattcctccggaagaagttcttccgtaa

SEQ ID NO: 68745 - DNA, 1212 bp, Glycine max
  Peptide Sequence Number=SeqID_185523
atggccattgttctccgtcttggaagcagaagcagaagcaaagggaaccacccttcttctcatatcgtgttcttctccacctccaattccaattccaactccaactccaactccaattctcctttctctgacctcttcagtgaaatcaaaaacaatttcaaagaatcctctccctctccttcaaacaccccgcgctcctcgaatttccgcgacgagatcaacaaaaacctccatgaattccgcgcccggaccaccgcgcctccgccgcagcagcagcaaatctcgttccagaaaatctaccaggaaaacatgaaccggaacccgcccaactcctcttccttcaacttcaattccattcgcgacagcctaaaaaacatcaagcccgccgcccagaccacccaaacctggtcgcgcccaatgccttccaccaccagcggctcctttttggggaaggaagtgagcagcgacggctctccagcgtcgtcgtcgtcgtcgttgtcgttcttgaggacttacagcgtggatgatttgggggagaaattgaggatgttgaggccggagggaatgagaaatgattggttttctgtgagggagttgagtgagaggcttagaaggttgaggaagatggaggaggaggaggtggagaagcaagcccattccaatacccaatacggtttcaataaagctgtgctagatcatgtcagaggatccctcgctcagttggatcaaaatcaaactgaggccgctaagaaagcttcacgccagggacttagtatattgagccacttgaatgggactccaaccttctccctcgaccctcccaaaccccaccttgttgaaaaggcaatcattatatcttcgtttcattcattgtctcgttactttcatccggataatatgtcctcctccgagaagttgaaaatcgagcttgccaaggttagagatgagtttaaaatgtccgactccgattgcggttctgcgcgtgttcaaattgcacaactcacaacaaagattaagcatctatcagcagttctacacaagaaggatgttcattctcgtaaaggtttgctagcaatggttcagaggagaaaaagattactgaaatacctcagaagaactgattgggattcctattgttttgttatctccaagctgggtctacgtgataatcccgatcatatttatagagctcgatctggtacggcgacatag

SEQ ID NO: 68746 - DNA, 582 bp, Glycine max
  Peptide Sequence Number=SeqID_185524
atggttcctgatcccggccgacgtgctgatcatcggcgcgctcctgggctaccggcgttggcgcgaggccaccttcgtggcggtcagcttcgtcggctcggcgctgctgaacatgggcagcaagcacttcttccagcgccagcgccccagcctgtgggaatcgatcgcgccggaatcgacgttcagcttccccagcggccacgcgatgggctcgatgaccctggcggtgaccctggtactgctggcctggaacacccgctggcgctggccggtgctgctgctggcgccggcattcagcctgctggtcagcgtgtcccgggtctatctgggggtgcattacccctccgatatcctggccggatggtgtgccgcgctggtttgggtggtagggtgctatctggtcatgttcagtcgccggcacccttggcgacgtcacggcccgccgccagcgaaggccagcgaagcatcatcacagggggattgacgtggatggcccttgagggacgtctacgtgatagatcagttgtttcgttgcagcaggttctgcaagacagggggcaagcacaacgcgcggtactgtga

SEQ ID NO: 68747 - DNA, 624 bp, Glycine max
  Peptide Sequence Number=SeqID_185525
atgagtacaaagaaagcagactttatctggttcaatggagagatggttaagtgggaagacgctaaggttagcgttatgtctcacgcactgcattacggcacctctgtgttcgaaggcgttcgctgctacgactcacacaaaggtccggtggtgttccgtcaccgtgaacacatgcagcgtctgcacgactccgccaaaatttaccgtttcccgatcaaagccagcgtggatgagttgatggaagcgtgccgcgaagttatccgcgtcaataaactgaagagtgcctatattcgtccgctggcctttgtcggcgacgtgggtctcggcgttaacccgccagacggcttcaccaccgatgtgatcatcgctgcgttcccgtggggagcttacctgggtgccgaagcgctggagcaaggcatcaacgccatggtttcttcctggaatcgcgtggcgccaaataccctgccaaccgcggcgaaagcgggcggtgctggcaaaaacctgtttgaagtgaattacggcatcctgttctccccgtcgttcacctcttcagcgctgccgggcatcacccgcgacgccatcatcaagctggcgaaggatctcggtatcgaagtgcgcgagcat

SEQ ID NO: 68748 - DNA, 583 bp, Glycine max
  Peptide Sequence Number=SeqID_185526
atgaaggttgcatgcatctgcatcccaaaaatcatgttcatattaggctataagtgcatagatttccctaatctacttccctatctttttgagtttaggatgagaggccctctcaaagagtcaacctcttgctttctcataaggttgagccctttggtactagtacctattggcttgtttcataggactcaacgtcctttgctttatgatttcatgggactcaaagtcctcacttttatctttcataggactcaaagtcctcacttttatctttcacgggactcagagtcctcgcttttatctctcataggactcaaagtcctcgcttttatctttcacaagactcaaagtcctcgcctttatctttcacaggactcaaagtcctcgcttttatctttcataggactcacgtcctcacctctatctttcataggactcaaagtcctctgtctttatgctttcataggactcaaagttctctgtgaagaagaaaatgaagaagaagattcagatgatgaagaagacttctcactctttgtgaagaagtttcaaaaatttgtcaagaaaagaagaatcgagaggc

SEQ ID NO: 68749 - DNA, 201 bp, Glycine max
  Peptide Sequence Number=SeqID_185527
atgggtgccaagtacctcgaagtggtcaaacgagagttgcatcccaacaacggatggtccccggacgaaattaggtaccgacacatcatcctgatactgtcgaatttgttcctctcggttgatacaagatgcagaatgaccataatttgtctctgcgttccgttggaaacgatcgagcctgggcgacgagataccgaatga

SEQ ID NO: 68750 - DNA, 1186 bp, Glycine max
  Peptide Sequence Number=SeqID_185528
tggtttcctggagcacaagctttcgcgataggtgtcaccagtattgtgtttgtgttaatcattggttttggttatgtcgcatttttcgttctccgtagaagaaagacacaagaagaagttgaagattgggaactggagtattggcctcacaggataggtttccatgagatcgatgcagcaacaacggtgttttttgaagagaatgtggttgctgtaggagggaccaggaaggtatataaaggggttttgcatggggtagaagttgcaatcaagagaattcctcaagaaagggaagaagggatgagagagtttttggccgaggtttcaagccttggcagaatgaagcacagaaatttagtaggattaagaggctggtgcaaaaaagaaaagggaaatttgattctagtttatgacttcatgagcaatggaagtttagacaaatggatatttgagtgtgaagagggaatgatgctaacatgggaagagaggattcaagttttgaaaaatgtagccacagggattctatacctgcatcagggttgggaagttaaggtcttgcatagggacattcaagcaaacaatgtccttcttcataaggacatgaatgcaaggctgggagatttcggattggctcgtatgcatgatcatcagggacaagtggtcagcacaacaagagtaatagggacactaggatacattgctcctgaagtgattcaaagaggaacagctgcagttgatgaaaggttgaaggctaaagggggatacaccatagaggaagaccctagtattagaccaacaatgaggcaggttgtgaaaattttggaggtggaaattgacagcattgagtctgatgaagataacatggaaatgagtttgcttggaaaaataagatcagctactacgtggtctagagctgaatgtgctttaccatacagtggttacccttcttttgatgaagttaagatgttcagttttaattctaggacttctagaagtggctcaaacacaactaaacatgaagacagtaaatctgaagctcaaattaaacatcatgggtttcatcaagttcagtgtactaacttagaccaaacgctcaacgaaactgataatgtggcacaggatgacacaccactgatgaaggatggtagcaggctgttcccgaaagtcattcactcactgcccgcaa

SEQ ID NO: 68751 - DNA, 168 bp, Glycine max
  Peptide Sequence Number=SeqID_185529
ttgattgtgctttacgtggttttcaagcttgacaagagttacatgccgagcaaagtttccatccttgccggtgatagttttcacaacttgaaggagattaagaccgtggaactcatgaagccaactgggtgggtatatctatccttgtctggagctgatcctaggtaa

SEQ ID NO: 68752 - DNA, 163 bp, Glycine max
  misc_feature (150)..(150): n is a, c, g, or t
  Peptide Sequence Number=SeqID_185530
atgccttctcaatttgtccagaatcccataaatgcgagtgccattacattgaggtggggaaagcagtatcaaggacctcaaccagtagcatcttcttcatccgcaaatgaacctgcccaacctcactctactccagaaaaagatgatgancaaaatttaaaga

SEQ ID NO: 68753 - DNA, 258 bp, Glycine max
  Peptide Sequence Number=SeqID_185531
atgtcggctgaaaaatatcagtcacggctgtttaacggcccgatgttggctattgtttggtctattcaatcccggaataatatttggatgatgtcgattaggaaatgttcgatcggcgtcaccaggaaatgtgcgatcggcgccatccggcgaggcttcttttccaaacctcgatcggtcatctttcctggccgaagtcggctagcattgttttcgatcagtgccggtgaatcatgtttttctgccgaggttggctaa

SEQ ID NO: 68754 - DNA, 993 bp, Glycine max
  Peptide Sequence Number=SeqID_185532
atgacggcgatcatcgccgcgccgccgggtggtgcagaggtgctgactgaggtacagcgcccggtgccgcagccgggaccgggcgaagtgctgctgcgcgtggtcagcgcaggggttaaccggcccgatattctgcagcgcaacggcatgccaccgccgccaggctgcagcgatattctcgggctggaagcggcgggcgtcatcattgcgctcggcgcaggcgtcagcgaactgcagccgggcatggcggtgatggcgctgctgagcggcggcggttatgcacaatactgcgtggcgcgcgccgacctgtgcctgccggtgccggacacgctgccgctcagccacgcggcggggtttcccgaagccgcgtttaccgtctggcacaacctgtttgagctggggcgtctgatgccgggcgacagcgtgctgattcacggcgcggccagcggcgtgggcacgctggcgatccagtgcgcccaggcttgtggcgcacgggtgattgctaccgccggcggtgcggagaaaattgccgcgctgcagcagctgggcgtgtggcgcgccatcgatcgccatagcgaagattttgtggcggtgattcagacgctgacccgggaacgcggcgtggatgtggtgctggataacgtcggcggcgactacattgcgcgcaacctcagcgtgctggcagcgggcgggcggcacgtcagcctcgcctttatgcagcgggccacggtggagatcgatttacagttgatcatgcgcaaaggcctaagcctgacctcttccacgttgcgaccgaaaagcgcggcggaaaaagcgcgtctggcgcagtgcgtgcgcgcccatctgctgcctttactggccgccgggcgcatcacgccgcaggtgcatcagcgattgccgctgacggccgccgcgcaggcgcaccgcatcctcgaagccaatgccaatatcggcaaagtgctgctgctgccagatgcggaggctatgccatga

SEQ ID NO: 68755 - DNA, 273 bp, Glycine max
  Peptide Sequence Number=SeqID_185533
atgcctaaggcacagaattccacagacaccacagtgcctacctcgggaaaagagctctggaggcagcaaaaggagcagcttttgcagagatacctaggttttaacttgattgaagcaggatcgcaacttagtcttacaagagggatctacggattaagttttggttttaattatgttgttacaataatgttgtttagtatgttgttacaagagggatctgcggatgaagcttatgctaaattaggcgaaactttcgtaagctgcttgagctga

SEQ ID NO: 68756 - DNA, 426 bp, Glycine max
  Peptide Sequence Number=SeqID_185534
atgtctccttatcaggttgtctttggaaaggcatgtcatcttccagtggagattgagcacaaagcatactgggcagtgaagacctgcaacttctctatagatcaagctggtaagaaaaaaaagttgcaactgagtgagttagatgagatccgcctagaagcctacgagaatgccaagttctacaaagaaaagaccaataaattccatgattgcatgataattaagaaggacttcatggttggacaaaaagtgttattgtataattctaagcttggactcatgagtgttgagatcaaaagcgactccacaaacaagagcttcaaggtcaatggacaccaacttaagccattcctcacaaacccttctttagtagacgtagtggtggaaaaagacttccttccttacacttcctccaccatgacttag

SEQ ID NO: 68757 - DNA, 157 bp, Glycine max
  Peptide Sequence Number=SeqID_185535
gagggcctggcgtggggagcaagcgagcatgaacctggttggtcttgcggatgaaatggacatggagatggcgcaggagagagagggcgatggtgggaattgctactggcaaaccgcgctttggccttttgtggcgaagtcggtctgcgcgaagtga

SEQ ID NO: 68758 - DNA, 1404 bp, Glycine max
  Peptide Sequence Number=SeqID_185536
agcagcatcttccaatatctcgggaatttgacagtaggtcctgagcccacagctttagacaccttctcctcaagcagtggcgggggctccctcctcattgatggcagttacgtgctaggctttgcgttcgggagttgtgtctttaccctcgtttttggttgttttgcgattttgctgcgcacgctttggttgcggtggtggtcaatgactgcatctcgtttgaccaatcagttgaacagcctgtttctggtcctcctcattgcgtttagcttcgcgtcagtcccctactatggagtagattatctcttgaccaacggattagggttccttccgcaggacaagtcattggaccgaacggttgtctacccatcaaccacgggagatatcagccagatcctgggccggctgtcggattacaaatcttttgacacggacgtgtcaacatttgatcgaggagtttatttgcaagaggacaaggccctgccacaatcctttgaagatttaaattaccaaggtgagtacgcctggaccaagcgaatgagcaaactggttaagcacctgacacggaccaatacaccttcggcttggtacaagttgctggggagtgggggtcaagcccctgccgaagatggaccgtcagctcttagcagagctcccggaaccggccaggcctcgccagaattgaatgccccgtcatccgggcggggccaaccacgcctcagggacaaggtggccgatctggcaggcaaacaaggcaatgtgctgaatgggcgcgaactggggggtgccgagagcagcaaagtttctgatctcgttgccctagaggatgacatcgtggcgaagctcggctctgcccccttgggccccaacggggttgatggcgacatttcttacatggcagaatcactcgcagaggatggggagacggagaagcaattcctctctctctttgacacggggctatccccgctctttattgcggatatgccagatccttcagtcattgaacggagcctcaagaagaaatacgtggagaatccactttattccctcctacttcgcattgacatagattcctttttagcccgccaaccggcttcgcatctcttgtccccaaatgaggagagaacactcttccaaaagcgtcagatactcggtcactattacgacaccctgcgacaatacaatcagctccaaaactgggatgagttccaagcgatctacaatgggtcgaaaagctttgcgaaccgtgtctacaatcagcagtttaaaggcactcttaaggtggtacgccgtctcttctctattacattggacgaagatccagatggtggtggtggccgcagggtgctgaagtatgaccaacccctcttccaagcgcccgcggggcaaccaggaacctaa

SEQ ID NO: 68759 - DNA, 396 bp, Glycine max
  Peptide Sequence Number=SeqID_185537
atgtgcatgctgaagggcggtcttgtgggcattggttggcgcgaggaaggaaaggaagatcaggcggaaggagtagtatgcggtcattgccacacaaacagagccaagccagtaggcgatgttgccacttatcgtgtaagttgcgtaggcggcctccaagatcacatccttggaatagaacccagtaagaaatgggaatccaacaagggagactgcacgacaccgcccatcttccgcatgtcctgctcattggatagggcatggatcacagatcctgcgcctaggaagagcaatgccttgaagaaggcatggttcaccagatggaaaacgcctacggaatactgggacagcccagaagcaaacaccatgtaccccaattggctgcatgtagagtag

SEQ ID NO: 68760 - DNA, 345 bp, Glycine max
  Peptide Sequence Number=SeqID_185538
atggcaaggggagactgcaatagtctcagtcaaaagacatggaagtcttcaaaaaaggggcagatgaccataatttgtctccgtgtgccaacagacttgcttgtctctggaaggcaaagggagactataaagacaaggactttgagtcttatgaaagataaaggtgaggactttgagtcctacgaaggcataaaagtaaggactttgagtcctataaaagataaggtaaggactttgagtcctataaaggcgaggactttgagtcctatgaaagataaagtgaggactttgaatcctataaaggcgaggactttgagccctatgaaacaaaccaatgggcactag

SEQ ID NO: 68761 - DNA, 240 bp, Glycine max
  Peptide Sequence Number=SeqID_185539
atgtggagtcgccaccaatgtttattcgaggaaaacgtcggaaaaaccaaaacggaaaaggtcgaagctttgcgtattttgaaaataagggttcaagagttgtttatgcacggggaaggattacagtatgaacgatcatcgatgatcgaagaaggagatgaagatgcacaaacaataaagggcactcctaagggtccagaaatcaaattcaaatccttaaagcaagcactaatcggatga

SEQ ID NO: 68762 - DNA, 450 bp, Glycine max
  Peptide Sequence Number=SeqID_185540
atggtcatctgcaccctttttgatatccgaagacaatcaagtccgatggcacgcagagacaaacatggtcatccgcaccctttttgctatccagagacaatcaagtctgatggcacacggagacaaacatggtcatccgtaccctttttacaatccagagacaatcaagtccgatggcacgcggagacaaaacatggtcatccgcaccctttttgctatctagaaacaatcgagtccgatggcacgcagagacaaacatggtcatccgcacctttttttctatttagagacaatcagagacaatcaagtccgatggcatgcggagaccatcatggtcatccgtgccctctttgctatccagagacaatcaagtccgatggcatgcggagaccatcatggtcattcgctttcattgttttcgagactattttagtctcctttgccatctag

SEQ ID NO: 68763 - DNA, 285 bp, Glycine max
  Peptide Sequence Number=SeqID_185541
atgaggcttcactgtcatcaagcgagtcagagacccaacatgaccacagatagacctcccctccttgtggctcacatagacccgggtatagggcctaacatctcaatgtgtgtgcgagtccccagtggagtcgccaactatcgcaacctacccttcggcaggagggcaacgcgaggctcacaggtgcgtcttccaaggaatgaaaatgcgtggagtcgccaccaacatttattcgaggaaaacgtcggaaaaaccaaaatggaaaaggtcgaaggcagcctctaa

SEQ ID NO: 68764 - DNA, 231 bp, Glycine max
  Peptide Sequence Number=SeqID_185542
atgcatcaaaccctaacacgtcctcttccaccacccacgaccatcgatggtcgtgacgagccaccagtacttgccgtcggaccaccgcacggagataaacactttaattggagcaaaatcttcagaatccacctcaaggattcgataaatggaagcggaatggagaaggaagagagagaggagatgccacttcaaggagaagacgagtctagaagaagctcaccaccatag

SEQ ID NO: 68765 - DNA, 934 bp, Glycine max
  Peptide Sequence Number=SeqID_185543
gcagctcgttctccctgggggcatgtcttgcaagacatgcctttcctcacctggctttcttctcggggctacccgcccggtaggatcatagcttctcaagacggatcaacgcgaatttgccacactggtgcacttgctacttcaatcccattgaaggcattgcttcactccttgcagcatggcaaggatacactattgcccaaggctttcactgcgataggcaataacgtccctcctctcttgcccacccgacagggcgacgaaccgttcaacgaagctcccttcgctagctcggcctgtggagccagactgctttcccacacattgggcaaaggcagccattctcttcttgtaaccacccagaagagatcaaaagatttcttagtgacaacgattaccgaaagcttctaccttgcaatgtatttcacctttctggccttccttgtcgggctttccgcttcattgcgatggcggtacaaagatcagcttgtttcaggctttgttcggaacaatttgccagctgtgggcaatccctcaaataagataacgtgggagacatttgagcacgttgggagcaaggagctgtcgctgcaccacctggctccctcgtcggtcggaggcgggcttcgaaccggtctgacggaacgcccttgggcgtgggcccctgccccctcgttggccgggggtggccttcgaacccctgtgaggcctgtgacgcctgcaaaggcctgggaaattacgccagcgggggggcctctcgcacttttggttgagagcccccttgttgaacggatcgacgtgtacaacgactcatttgtcatcaaaccaaaaacgccgtggcagaagctacagagccaaaagtacgttgggttctatatctccagctcagatcagtacaaagacgcaactcttggcacctcgttaaccaccactg

SEQ ID NO: 68766 - DNA, 279 bp, Glycine max
  Peptide Sequence Number=SeqID_185544
atggtccgtggtggcgatggccaacagcagcggtggtggacgatgatccctttctcttcttcgacgattctgccatttgatgaagttttagagaatttcaatcgggggaatcaaaagaggagtgaaaatgatgaagattgggctttacgggacgtgttttgggatgaaggaggcacgagggagagagtgaggctgcgcagcgtgactggtttcgaaggtatttatagaggaggacgaggtgtaatcgattacaaggtatggctgcctgttcttgtgtaa

SEQ ID NO: 68767 - DNA, 741 bp, Glycine max
  Peptide Sequence Number=SeqID_185545
atggatacgtttttgctggagccaaagcgatccgaggttgccagcgcgcagcaagaaatcgtgaaaatccagaatgataccgcgacattgaccgagcaaatgaccaccattgctagccaggcagcaccgcaaccagcgaacaatgcttttcagcgtgagattgatgagacgcagcagaaaattgccagccagtcagccgacctggtgaaagtctcttcttacatggtgccgccacaagagatggtggcattgctgaaaaaactgctacaaaaacatacggatgtccaggtggttgaaatgcaatcacttcccgtagtcgattttattgacaagcagagaaagcaattacaagcgcaagcaggtgatagcgccaatgttgctgctcaagcaggctctgaggatgtgtggaaaaacgtgccgcatgtttaccagcatgcagtgaaagtccgtctcaagggcaagtattttgcattgatggcgtatgcacagtctttaaaggcgataggtagcactttagcctgggaaaacgcagagctaaaagcggattatccagagagtgagttgaccgttcaggaagcatttgcagccagcgaaggcatgatagatccaaccaaaccacctgcggaagtcatggcatttttaccaaatgcagaggcgcagatggagacgccttgggagctttcggcaatccaggaaaatggaaaaagtggctttgcggtcgtcaatggccaaatggtccag

SEQ ID NO: 68768 - DNA, 564 bp, Glycine max
  Peptide Sequence Number=SeqID_185546
atgtggatgcttaacaagcttagctccccctacagcgacaccgaccagaaactagcctcgtacttcctccaagccttcttcaaccgcatcacccaagtcggggaccgaacctacaaaaccttagcttcagcttcggagaaaacatgctcctttaaatcaacccgcaaaacatactcctttgtcaccgtcggcgccaatatgcagaaggtcatgaaggaaatcagagccagaatggagaaggaggttgatttggacattggattggaagggtttgagttcgtcaaagggtttgaagaatgtttgaggtggtttagggtttactttgaggccttggatgggagttttccgcggacaagcaacgagcatttgatgcttgagagggaggcggggagggcggtggtggacctggtggcgtggttttttacggttccactggaggataggagaatgggggtggaggaacggacaagaaggtggcgtcggggagaaggtggagatagggaaaggggaagaagagagaagaagaaggggaacaaacacaaagaagaagaggaatggacgtga

SEQ ID NO: 68769 - DNA, 1184 bp, Glycine max
  Peptide Sequence Number=SeqID_185547
atgcggtttcaaggaggatgtcctgggcccactagccagaggagaactcgaaagggaaggcagcgtcgacgccgcgagtatttcagaagattaacaggcttggatataaaaggcgagctttcagaagatatcgggttactgtctgaattggagatgctagacctctctaacaataagggcttaactggttcacttccacattcaattggaaatttgaccaagctgtcaaacttatttcttgttgattgtggtttcactggtcctattccagatgaaataagatcccttaaggagctggtcttcttatctttaaattctaacagcttcagtggaggaatttcggcttttattggtaatctaccaaaactgaattggttagatatagctgacaatcagcttgaaggaaccattcccatatcaagtgtttccttgatcactcgtgataactacccatctcttgaattcaccttacaaatattctcttcaagccgagcttatttcagccaagcagagattgtgagaataagctctgcactaagcaaccttactatggatgccttttatttttatcctgatgaatatgaacattatgaagaacctattgagtcaagtaaatcatcaaatgctggcttcataattagagcagcaattggcgatggttcttccctgcttgtgttactactcctcacagggggttgtgctttatggctaaagaaaaagctattgttgcaagaagaagcgtttgaatgtgtattgaggtatggcattgagcaagagtataccttattgcagaaagatgtaaattggccacttgggtggccacttggtgggtttcctagaccacagagacagactatgctcacgttgttcaataatggctttagtgtagaggctttgatggaagtattaaagtctgggatgtatctggaaaaaattggactggataacctagaagaatctttactacttcaggctgatatgatggatcttaaagcacgaattcatgggcctgctcaagcatatgtgatggaagcaagacttgacaaaggacggggttcattagttcttgaggtgctagtggaagtggtccaaggtgatgctaggaacgtgttgtgtgatgctgtagagaggcaccgtgcatctgtattggttttgggaagccacggctacggagctatcaaaag

SEQ ID NO: 68770 - DNA, 423 bp, Glycine max
  Peptide Sequence Number=SeqID_185548
atgataaggaaaacatattggctaatgctttgtgcagaagttagagaaagtcatggtggtggaatgatgagacattttggtgtgaaaaagactttagaaattttgcatgagcatttttattggcccaacatgaagcatgatatgcaatctgtttgtgagaagtgcatgccatgtaatggatcagattcgagcttgaatccttttgaagagggagggaatgatagaggtgaaaacagttcgtctaatgatcctttacatggaattagaagtcctatgacaatgtccaagactaagaggatgaagcaagcattgcaaggcctgattctaaagatcaaagagaaagaagaccaatgtgaattaagggctacacctaattgggtcactttcatacgaattgatgaagatgtttggagcctaacttga

SEQ ID NO: 68771 - DNA, 438 bp, Glycine max
  Peptide Sequence Number=SeqID_185549
atgagtggagaagaagaaggagtggactcaagttgtttgttaatgatatttagaggtcgtagacaaccaacttcagaagaagaagaggaggaagagtatttagatggaagaaggcgaagaggtgaaccaagaagagataatcatttggggagtattaagatgagaatccctacatttcaaggtaaaaatgatcccgagttgtatttggagtgggagagaaaggttaaactagttgttattgaattcaccgattatgctggtatttggtgggatcaacatgtgactagtaggcacaagaatggtgaaagacctattagtagatgggaggagatgaagattgtcatgagaaggagatttgtacctagccactcccatagggatttacacagaaaattacaaactctaacacaagtttccatgagtctggagcactactga

SEQ ID NO: 68772 - DNA, 831 bp, Glycine max
  Peptide Sequence Number=SeqID_185550
atggctgcgccgcaaccacgtccggttccgctgcgggaccgcggcgggcctgcgggcgcgccagcgggcccttcaccagtgccacagggagcagatgtcactgttgatcctgctgctgctgtcacagcagacccatcagcaccttgggctcatgtgtggcaagtggtgcacgcttcccatctggaccggcggcagcgcgtgacagcgtggaggctgctgcatggccagctcttcgtcggcggcttcgcgcgtcacgtccaccgcgccgatcccgccggtcacgtttgcccgcatccgagctgtgcaggtcagctggccacactcacccatgtcttcatcatctgccctctcgccgccggggtgtgggactggttcgcagcgacatgggccgcggtgaccggagacgacgcgccaccgcgcagcgccgaccttcttctcgccgatgacaccaggatctggggaccgccgcggcagctcaggcagctctgggatcgcctgcggctcgctacaatctgtcagctgtgggcagcatatcagcgcggccgccaccagccagatgcggcggcgatcacccccggagcggttgcggctcgcatcctgtcttcctgcaagaaggccctgcttgccgattggcggctcgcgaccgtcaacgtccggcagacagcaggtgtgctcagcgactggcttcgcggacgcgacccgatgatcaccagggagcagtttgcggcgcgatggtgccaccgcgcggtcctctgcgcgctggaggagctgccgggcgcgcaaccagtcatccactggagtgcccagcatcccgtgccgcttccagcgtga

SEQ ID NO: 68773 - DNA, 480 bp, Glycine max
  Peptide Sequence Number=SeqID_185551
atgcgggatagagcagcctgggcaccaaactgcgcctcccttacagctgggcacatcgtaagagagatacgaacacttaagtttcacgcccccccgctatatggttgcggaagagttccccacagcagcgccggtctagggacgttgattagttttttaacctcttggcttcacggccaggtcttacgggcctggctatcgagagcctcacgaggcctcacagtgcttgggcgtttcgctgaacgggctgtgcataccaaggcactacaactcagcttcgttgaagggtttggaagactgtgtttaagcacaaaaagggtgagatgccggccccagtgtctgcagcacggtccaggccagatcaggcaaggcttacagtttatgcaccaccttttaagctcacttgcaacgtcgtacttagcaagcctagagcggggtagttatcctgcttcgacgattactaaaaagatgctaaaatag

SEQ ID NO: 68774 - DNA, 639 bp, Glycine max
  Peptide Sequence Number=SeqID_185552
atgaccaatcaggacaccatgctgtcgtttcagattgcagcccttcggtaccaaaatgcggaccaagtctccctagagcgtgagcaaaagattctgaagttgttagagaagaaggtagctctcaagaaagcttttcgggacctaatgacccaaatccttgcaatcctccacggaggtctacaataccagagcgccgcacgctgggccatttacttatgggcaagagacaagatcatggtgtgtgccattgcaatacaagcaatacaattactcaacgcaccctcaaccctgaaaaacatcgattacagccttctggacaggcgatggccaggaatagcaaaggactacctcaagaccgtagactcgggctcgtccaacgtgtccgagacatggatcgtgcccctcgaggagctaaagccaaacagggccgtttcatttagggcgaaagagagagaactcgggccagacggaaaaggggcactaccaacaggtgtaccacttgcccggtacttaacctttcgggagaaagatcccaatttatggatttgccgctatttcttatgtgaggattgccttatttcattgcagactggtacaggtaagccccagtcgctggaggcccagcaatggggggcctag

SEQ ID NO: 68775 - DNA, 393 bp, Glycine max
  Peptide Sequence Number=SeqID_185553
atggcaattatagagccaacgagatcgctctcattagggtgccgtgtccgcatagtcctcaagtcgacccagaaatcaccaacccacctaaggatgctgataaggcatgtgggtgtgggcggccttgtcaagaacaggaccacctgggattggttgatacgggagaggggcgctaccaggtggctcctctaccagattgtggggcagacattggtgaagcgggcacagtgcaggatagccctgcgcatactctcgatggaggtgaaagacaggcatgacctggctagggtctgcaggtgggcggacgctttgtcacagttgaacccgcgctccaagctgcgcaggcgcaacacatggtcaaaggtctcggagggggttccccgtaacgactga

SEQ ID NO: 68776 - DNA, 606 bp, Glycine max
  Peptide Sequence Number=SeqID_185554
atggttgaccttaacagtgttggccaagccaagcggctattgcaggaagctgtcgatggcttgctagacaatggcaaagggggcgctatgcccatatctggtccaaatgataggcccttgaagtctctttcggacggattgaaggggaaaagggggcggtttcggcagaatctcttgggtaaacgggttgattactcaggccgatcagttattgtagtagggccccttctcaaactgcatgagtgtgggttgccaaaggaaatggcacttgaactcttccaacctttcctcagtcgccaattgaaagagagagggatagtagaaaacataaatgcggcaaaacggtttatgagacaggatcatccaatcctttgggagatccttcagcaacttatgcagcaacatccagtgttgctaaaccgggcccccacattgcatcgccttggcattcaagcctttcaaccgaaactgccttcaatgcagactttgatggggatcagatggcagttcatctcccactctccttccaggcacaaggggaggcttggaagttgctttggtcccgaaacaatctgttgtcccccgcaactggtcagcctattctag

SEQ ID NO: 68777 - DNA, 195 bp, Glycine max
  Peptide Sequence Number=SeqID_185555
atggcaaggcaatgcatagccttcattcaacgccctcacaggggctcagcgaaacagcgagcccgtccgacggaacgcccttgggcgtggggccgttcaacgaagcgccgaacccgtccgacggaacgccgaacccctgtgaggcctgtgaggcctgcccctgtgaggcctgtgaggcctgcccctgtgaggcct

SEQ ID NO: 68778 - DNA, 903 bp, Glycine max
  Peptide Sequence Number=SeqID_185556
atggtggttttaattggcctctcagccaatcagcctgcacaaagctatccggtctttgcacaacagaattacgccaacccacgggaagcaaatggtcggattgtgtgtgccaattgtcacttggctcagaaatcagttgagatcgaggtgccacaatcagtgctaccagatactgtttttgaagcagtggtaaagatcccctacgatcaacaggtgacacaagttcttggtaatggcaagaagggtggcctcaatgtgggtgcggtccttatccttccagagggcttctctgcagcaccggccgacagaatacctgaggagatgaaggctaaagcagggaaactgtattttcagccgtatgcgtctgacaagaaaaatattctggtggttggcccggtaccgggtaagaaatacagtgagatggttttcccattgctttcaccagacccttccaaagataagaatgtctctttcttgaaatatcctatctatctaggggcaaacagggggagaggtcaggtttacccagacggctcgaaaagcaacaacactgtttttaatgcgtctaccggtggaaccatctctcaaatccagcctgtcgagaagaagggaggatttgagataaccatcgagaccgggaatggtgaaccaatcgtcgacaaagtgcccgcaggtccagatctgattgttaaggttggccaaacaattcaggcagatcagccattaaccaacaaccctaacgtgggtggatttggccaaaaagacactgagattgttctccaaaaccctgtgcgtgtgcaaggcttgcttgccttcttctcttttgttgtgttgacacaagtcttcttagtgctgaaaaagaaacaattcgagaaagtccagctcgcggaaatgaacttctaa

SEQ ID NO: 68779 - DNA, 243 bp, Glycine max
  Peptide Sequence Number=SeqID_185557
atgaaatttgtacaatttcagttgagcttagctcatcagtgggctaagcgtgcatccaccactaagcgtagcctcagtgtgcttagcgcaataaaagaatctggtagagcattaatatcaaggtcgcacgctaagcacgagatcagtgtgctcagcgtagtagttgtcttcagccaggctcagctcacgactggcgctaagctcacatccacttactcgcgctacgcgcaagggtggcgctaa

SEQ ID NO: 68780 - DNA, 303 bp, Glycine max
  Peptide Sequence Number=SeqID_185558
atgtctggcctagcgatcacaactccgacctcccttggcctaagtgccagttggtgtatggcgcctactaggcaccctctggacccagataagtccaacagggccctggggtttcaggcactgatcataggcctctgccagtcctatagagttcccatcacccccaataatgcgcagggtgacgcacatcaggccgcaggcacaccgccatcgccttggcaggccgatcctgctgggccactgggcatggagtgttatctacagcatttggttctccagcaagcggccaaccaccgtgggtag

SEQ ID NO: 68781 - DNA, 664 bp, Glycine max
  Peptide Sequence Number=SeqID_185559
ggctacacaccctcgcgttgggagaactgcacgtcctcaccttcagagggccacccatccttgccttcagagggctatacgtcgtcgccttcaaaggagtgcacgtcctcaccttaagagggttgcacgcctacgccttcagaggaccgcacgtcttcgccttcagagggcaacacatactcgccttcacaaggccacacgtcctcgccttaagaggactacacatcctcaccttcagaggactacacgtcctcaccatcagagggctacatgccctctccttaagcgggctacacgccctcgcctttagagggctgtacgtcctcgccttcagaggactacacgttgtcaccttcagaggacaacacgtcctcaccttcagaggactacacgtcctcaccttcagagggctatatgccctcgccaaggcgagggctacacgccctcgccttcaaaggactacatgtcctcgccttcagaggactacacgtcctcaccttcagagggctatatgccctcgccttcaaaggactacatgtcctcgccttcagaggattacacgactacacgtactcgccttcagagggatgcacgccttcgccttcagaggaatgcaggtcctcgcctttagaggactgcacatcctccccttcagaggatcgac

SEQ ID NO: 68782 - DNA, 297 bp, Glycine max
  Peptide Sequence Number=SeqID_185560
atggcttctaggaaaagaaaggcaccatctacacccacccaagatagatttgacagatcaagattcacttcccaagaggcttgggaaagatacactgatgttattgtgcctaggaagctttttcctaagaggaacgtggtggtctattatacagagttcgatgagttcaaggaggaactcgaaagacaccactgggacaaggagttgactgactttggggacgacaacattgatgttgccattgtgaaggaattctacgccaacctctatgacctcgaggacaaatcacctaagcag

SEQ ID NO: 68783 - DNA, 180 bp, Glycine max
  Peptide Sequence Number=SeqID_185561
atgaaatctgttcattttcaggtgaaaaagaggctaagttttgaattgcaaaaagcagcaattgggctaagctcagcagttgggctaagtgcatatccatcgctaagcgtagcttcagcacgcttaactcaaaggagaatctgcttctacagatggccagggcagagaattccagagtag

SEQ ID NO: 68784 - DNA, 219 bp, Glycine max
  Peptide Sequence Number=SeqID_185562
atgaggaccttgagtcctatgaaagataaaagcgatgactttgagtcctatgaaagcataaaagcaaggactttgagtcctatgaaagataaaggcgaggactttgagtcctacgaaacaagccaacagattgacactcatgagacctcatcctatctttttgcaaatctcttcagggactccctcagagtgtatgttttgtttgatttagtcacttga

SEQ ID NO: 68785 - DNA, 174 bp, Glycine max
  Peptide Sequence Number=SeqID_185563
atgactctttcttcggtggacatggcggaggctcatgcacttacacttaggaaagattcatctcaggtcttgaaagcttttcatagtcaaaagtcgtctacagatcgcagtctgaggcctattgttagtgatgtgcagcaactccggatgtcccaccacagctggtcggtataa

SEQ ID NO: 68786 - DNA, 405 bp, Glycine max
  Peptide Sequence Number=SeqID_185564
atgacgcactccagctggctggtggggttatcggttatgttaaccggcagcgcaatgtttatcggcctgatggtcggcggcgtgctggcggaccgttacgagcgtaaaaaactgatcctgctggcgcgcggcacctgtggcgtgggctttatcgggctgtgtattaacgctttgctgccggagccgtcgctgatggcaatttacgccctggggctgtgggacggcgggggcgatcaccatgctcaccgtgcgcctcggctcggtgatttcgccgatggtgggtggcctgctgctggccaccggcaacgtggcgtggaactacgggctggcggcggcgggaaccttcattaccacgttgacgctgctgcgcctgccgttgctgccacctccgccgcagccgcgtga

SEQ ID NO: 68787 - DNA, 714 bp, Glycine max
  Peptide Sequence Number=SeqID_185565
atgccgcagcgtgcggatcacaaacaacacgcccgccgccagcgcaatccagccggtggtggcaatggtgtcatcatcaaaccagccccagcgcggcccctcttccagcgtatattccagacagccgaacgccagcgccagcagcacgatgctgagataatccgcgccgcgcagcagttcgcggttgggcgcgtcgatgttcaccagcagcggaaccgcaatggtgatgtaaataccgggaatgatgttgataaaaaacagccagtgccagctgaagttatcggtgatccagccgccaacggtcgggccgagcgtcggcgccagcgacgccagcgcgccgacggtcgcggcagcaatcacccgctgccggccctggaaaaaggcgaaggcggtggtgaacaccagcgggatcatcgagccacccgccagcccctgcagcgcacggaacgcgatcatgctctgaatgttccacgcccagccgcacagcaggctcatcagcgtaaagccgcaggccgaggcggcgaacagccagcgcgtagacagcacgctggccagccagccggagagcggaataatgatgatttcggcgatcagcgcgataaacatgccgatgcacagggtggcaaaggcgaagactttccggctgaccggcatctgcgcgggcgcgatcggcgcggcgaccacgcggctcattgcgcgctgcgctcatcgacg

SEQ ID NO: 68788 - DNA, 267 bp, Glycine max
  Peptide Sequence Number=SeqID_185566
atgaattttagaggattgacgagaggcctcggggtatgttttactgctgccccacggtgggcgccaaatgttcttaccaaaatccagaaccgtgacatgtcagggttgacttggttgagtggggtcccgaacttcacacatcggcttggagaggtacctttgacaggaggggggacctgcaaaacaaaggactccgacgctcaagtaagagtatgtgttaggaaaataaaccttgtagataattctcggcttatagataatagctga

SEQ ID NO: 68789 - DNA, 381 bp, Glycine max
  Peptide Sequence Number=SeqID_185567
atggagcgatgccacaagaaagagttgacaaagctaaaggctgaccatgaccagctagaggctcgtgtcagacgtccccacggccataagtttttattggtcacattgacttgcttagagccaattgtcgcgcgatccgtaagattttgtgatgtttcgcaaggaaataagccaaaagctcaaaatagggctgaactaatcaatttagggggtgttcttcagccctgggcccatctaagcccatcaggaagcttctacatgaagcaaccagctcgcctaggcaagcatgttacttcaagcctaagccaccagctcgcctgggcgagctgggcggcaagctcctcccctatttttgctataaataggcgtgggagactatag

SEQ ID NO: 68790 - DNA, 722 bp, Glycine max
  Peptide Sequence Number=SeqID_185568
atggcgacggggcgcccgtgcttcccgggccagatcggaaagtgcggcggcccctgctccatgacggtcacgatcgccgagcaccgcgcgatggtcgacgacttcatcgcattcatggagggcggcgacgagcggttcacccgtgacctcacgcggcggatgcacgaggcgtcggccgcgatggactacgagagcgccgcgaagtaccgcgaccggctcgcatcgatcgatgcggtgttgggccgcagtgcgctggtgctgccgcaggacgaggacgccgatctcttcggggtcgccgaagacgagctgtcggcggcgatccagcacttcgtgatccgcggcggtcgcgtgcgcggtgtgcgggcgtccacgctcgacaaggagatcgacatcgcgggcgcggatctcgtcgatcagatcctccagcgggcgtacggtgaggcgaccggggagcaggtgccgcgtcgcgtgctcgtcccgtcgctgcccgatgatgccgccgagctcgaggagtggctgcgcgcgcgccgcggcaagaaggtagagatcgccgtcgcgcagcgcggccagcgcgccgagctcatgcgcaccgccaccctcaacgcgcagcaggccctgatccggcacaagacgcgccggtcgagcgactacacgacccgcacgcaggcgctcaccgacctgcaggaggcgctcggactcgacgaggcgccgctgcggatcga

SEQ ID NO: 68791 - DNA, 825 bp, Glycine max
  Peptide Sequence Number=SeqID_185569
atggagtcatcagaggaccccatcatccaagtcaaagatgaacaactcatggtttcaccattatccggtgaaaacccagttcacagaactgcttatttcatcaaaccttgcgtggaagactcggcaactcttcctcattccatgttctcttctggaagaacagccactgtcaattcggaccacgcgaagttgcttgaagtaagatacaaagggtggcattacccaagtgcagaatggaatacatgggtccaacaaatgcaacacaagtatgaatgtgtgtggatgaaagctgggatagaccaggcaatcaaagcttcaacttttcaaatccgtaggaatgatgagttgatcattgagcttgcacaaagatggtgttctaagaccaacacgtttgtgtttccttggggagaagcaacgataacattggaggatatgaaagtttgttggggttactctgttatgggagctcctatttctagccctcttgtgagtggtgaggaaagggaaatagaacaaaaacttataggagtttttaggatgtttttcaaatctaaggccagaagggcggatcatactccatggatgaagcatttcatgagtaacgagagccgagtggagcatgaggcgttcttgtctttgtggttgtcgagagggcttaaactagcacttgctcctgctgtcttggccagcatctacagggatttcagtactccactttatccttctccttttctccagacacttccttttgcattttcatgcacagattcctcattcaaccctctatccttccctaccccctaccccctcaaaaataagaactaa

SEQ ID NO: 68792 - DNA, 283 bp, Glycine max
  Peptide Sequence Number=SeqID_185570
ggggtctgttcttgggtgtaacccgccattgccaatggcggcaaaggtggagagaggctgggcaatctcgccgttagcattggcgagatgctccctgttgactggtgccgctagcccttctggcgggattggcgctatgctcttcttgttcatgatgagactaaacataaggtctgaaatagggttcaaagctagctgtaggttgcgcatgctctccttgttcatgatgagactaaacataaggtctgaaatagggcttataactagctgtaaatgttcacag

SEQ ID NO: 68793 - DNA, 934 bp, Glycine max
  Peptide Sequence Number=SeqID_185571
atgagcgacgatatggatgcggcgattgccgcaggcagtacgatggtgcgcatcggcaccgcgtggtcacgctgtgacttttacaatccgctggcgcagtttgtcgtgaagatcacccagccgattgttaaaccactgcgccgcattttgccggcgctgggaccgattgacaccgcgtcactactgctggctttcgtgctgaccacgctgaaatatccgattctgctgctgattcaggtcggcgtgttctccgtcgatccgaccaacctgctgccagggacgcggtgcgatggactatgtgctgatccagctgaccgaaccgctgatggcaccgattcgccgtatcctgccggcgatgggcggcatcgatttctcggcgatgatcgtgattctgttgtgctcgccaccggtaatccgggcaaagtacgtgaactggccgatctgttagcggccttcggcctggatatcgtggcgcaaaccgagctgggcgtagagtctgccgaagagaccgggctgacctttatcgaaaacgccatcctgaaagcgcgtcacgcggcgcagatcaccggcctgccggcgattgccgatgactccgggctggcggtcgatgcgctgggcggcgcaccgggcatttactcggcgcgctatgccggcgttgatgccagcgaccagcagaatctcgacaaactgctgcaggcactggagcaggtgccggacggcgagcgccaggcacagttccactgcgtgctggtgtacgtgcgtcacgccgccgacccgacgccgctggtgttccacggcagctgggccggggagattacccgcgcggccgccggtgaaggcggtttcggttatgatccgatcttctacgtgccggcgctgggtaaaaccgccgccgagctaagcaaggatgaaaagcgtgccgtgtcgcaccggg

SEQ ID NO: 68794 - DNA, 435 bp, Glycine max
  Peptide Sequence Number=SeqID_185572
atgacgaaccgccgcggcgtttcgatgcatgcggaaaccctgcgccagaagctgcgccgggtgaaaggccaatccatgtctctggacctgttcgaactcgccaccgagtggatgatggagaagcagggaggggaggcctacgcgcgggattggctgctggcgttgaacgtgcgccacggcgtttccgccaacatcctgccgccggcgccgcagcaccccgacgaggtggacgcggcgcgccagaaagtgatggaaatgtcccagctcaacggcgaactgtcggccgtggcgatcgaggcgctgtcggatggcgatatctgcgaggcggacgcctcggccatcgtgatcgagtgccgcaagatcgtggagaaggcccagcgccttgagcgcaacgttgtgcgcgccgcaggcgacaaggcgagggcgggatgctga

SEQ ID NO: 68795 - DNA, 1241 bp, Glycine max
  Peptide Sequence Number=SeqID_185573
gcgtgggtggcgccggtggccagcagcaggctgtcgtagtccagcgtgctgccatcggccatgcggatctgccgggcctgcttgtcgatggccaccacttcgccgaggcggacttccacattgcgctggtggccgaggatgtggcgcagcggtgcggcgatatccggggcggacaggccggcggtggccacctggtacagcagcggctggaagaggtgatggttgcggcggtcgaccagggtgatgcgtatgcgctcgcgggccagggcgcgggtggcccagagaccggcaaaaccgccgccgacaacaaccaggtggggaacgcgctcgcgactcatcgactcactccagtgggggcattgggggaagcgcctggcatcttcgcacggcggccgcctgtcacgtcagcgcccgggtggatcggcgatactcgggttcaggcaacggcccgtgaggagcccatgagcgaaccggaaaagcgcatcgccctgttgatcgacgccgacaacgcgccggcctcgaagatcgacgaggtcctggccgaagtcgcccgctacggtgtggccaacgtgcgccgcgcctatggcaactggaagagtccgcggttgaagggctgggaggcggtgctgcacgagtacgcgatccgcccgatccagcagttcgcctacagcaagggcaagaatgcctcggacatggcgatggtgatcgacgccatggatctgctgtacgcgcgcaacctcgatggtttcgccatcgtctccagcgatgccgatttcaccccgatggtgatgcgcctgctgaccgatggcgtgaaggtgtatggttttggcgagaagaaaacgccggaaccgttcgtcaacgcgtgctcgaagttcacctatctggaagcgctgggccagacccacgccagcgtgccggataccgaacaggcctccagcgaacaggcctcgaacgagccggtagccaacgacgatgcgcggccgcgcaagagcggtgcggaaatgcgcagcgacacccggctggtgaagatgctgcgccgcgcggtgtcctcggccgagggcgaggatggctggtcgcatctggggccggttggcagccagatcggcaaccaggcttcgttcgatccgtgcaactacggttacggcaagctcagtgatctgctggcagcgatccggctgttcgagctgaagaaggacggcatgtcatcctacgtgcgcgcgctgccgaagaagaaccggtag

SEQ ID NO: 68796 - DNA, 978 bp, Glycine max
  Peptide Sequence Number=SeqID_185574
atggcttctcatattgttggatacccccgcatgggccccaagagagagctgaagtttgcattggagtcattctgggatggaaagagcagtgccgatgatttgaagaaggtggcttttgatctcagggcatccatttggaagcagatgattgatgctgggatcaagtacatccccaacaacactttctcatactacgatcaggtgcttgatactaccgccatgcttggcgccgttccacccagatatggatggaacagcgaagaaatagggtttgatacctttttctccatggccagaggtaatgcatctgtgcctaccatggagatgaccaagtggtttgacaccaactaccactttattgtccccgagttgggacctgatgtgaatttcagttatgcttcccacaaggcagtgaatgagtacaaggaagccaaggcgcttggagtagatacagttccagtcctcattggccctgtatcatacttggtgctctccaaacctgccaagggtgttgataaatccttttgtcttctttctctcctcccaaaagtccttgctatctatagggaagttgtggctgatcttaagcaagctggtgcttcgtggattcaatttgacgaacctatccttgtcttggaccttggctctcaaacgttgcaagcacttactgcagcatacgcagaacttgaatctactctatcgggtttaaatgttcttattgagacctactttgctgacattcctgtagaggcataccagaccctcacagctcttaatggagttgcagcatttggatttgatttagtccgtggaactaagactcttgatctaatcaagggtggatttcccagtggaaaatacttgtttgctggcgtggtggatggaaggaacatctgggctaataatctcactgcttctcttgatacattaaatagtcttgagggaattgtgggaaaaggtacttgttgcaattcatga

SEQ ID NO: 68797 - DNA, 942 bp, Glycine max
  Peptide Sequence Number=SeqID_185575
atgctggtgtcttttttttcctttgtgttcttctcttatctggtgtgtgtgttttgggtcgaccagccacttttctacaagactttcatgtcacgtggtctgactcccacatcaggcaatttgatcaaggcagggcaatccaactcagacttgaccaaagctctgtgcgtgtttggattctcggtttccaactttcatttacatccaacctctatttttaacaagcatcctcttctttgcttttgcagtgaaagatgtgggtttgcttccaaggtgaagtacatgtttgggcgtgttagcatgaagatcaaactcgtccctggagactctgctggcacagtcactgcattttatttgaactctgacacgaattatgttcgtgacgagcttgatttcgagttcttggggaaccgtactgggcaaccttacacagttcaaacaaacatctacgctcatggaaagggtgacagagaacagagggtcaacctctggtttgaccctgctgcggacttccacacctattcaattctctggaaccatcaccatattgtattctacgtggatgattttccaatcagagtatacaagaacaacgaggccagggggattccatacccaaagatgcaagcaatgggagtgtattcaacattatgggaagcagataactgggccacaaggggtggattggagaaaatagattggagcaaagcaccattctatgcttactacaaggacttcgacattgaaggatgtgcaatgccaggacctgcaaactgtgcctccaacccaagtaactggtgggaaggggctgcataccaagcccttaactccattgaagcaagaaggtacaggtgggttcgtgtgaaccatgtcatctatgactattgtaaggataagtcaaggttcccagtgaccccaccagagtgccttgctggcatttaa

SEQ ID NO: 68798 - DNA, 198 bp, Glycine max
  Peptide Sequence Number=SeqID_185576
atgatgatgactgtctgggaggaatatgctcttcagcttgatgatgctatagagaagaatcatattgataggaagccattggtggttatgttaacacttgctaacatcaaagatcctaaagacaagtatcctctcagtgtccaaaatatcaagcatgggtcgaagttgtatgtcaacactgatatagcagaaatctga

SEQ ID NO: 68799 - DNA, 480 bp, Glycine max
  Peptide Sequence Number=SeqID_185577
atgaagatccattttcaccaataccaagtggttgggagagctcttcccacgcaaccagatcagcaccccaagatctatcaaatgaagctttggtccaccaatgaggttttcgccaagtccaagttctggtattttttgaggaaattgaaaaaggtgaagaagagaaacaaccaagtgcttgctatcaacgaggttggaaatgtcttgaggcagagtgttgctcgtagcacaaaagcacctgttttatccatgtataattacattcgttgcatgtcttcaagcaagcttttcattggagcaaaagttataattgacatagactctagaagatcaaggagatttgggtttgctaacttttccaatgatgagtttctgatggccattaaatttctcatatttgtctctccttcctttcttggtaacaagtggttttctcttcaagcaatgtttgttgttgaaaaagtattaaggctagagtag

SEQ ID NO: 68800 - DNA, 357 bp, Glycine max
  Peptide Sequence Number=SeqID_185578
atggcgccaccaccattggcgctttcgcgtaggagctgccacgtggcctcggagacgccagtagcaccaacgcgttgcccttctgcttacgtggcaatggaggcgcaaggaccactggcgcgttttgcatggaaacccaaggcgccagtcaaactggcgtgttacctttgcagcaaggacatcagttttggcaggagaccaggagcagctttggcaggcaggagcagcgaggcagtagcatggaagcgtaaatggggttggcgttttagggtgtttaaatacacctcctccttcaccatttttttcagctgttttcacttgcaacaattgccttcgtttttgctttcgtgggtttga

SEQ ID NO: 68801 - DNA, 228 bp, Glycine max
  Peptide Sequence Number=SeqID_185579
atgtctcgtgcaaagattggtgccactctttggcaagaattgtttgctgaatttgagtcaaagttgcattgtggttctgcatatgtgattcagaacattaaggttgttaagaatcattctgaatacaaagtgagtaagattccatttttgatttacttggtgaaaactacttctgttggggaggctgaatgtcctgagattcttcctgatgtccatgttcttacttga

SEQ ID NO: 68802 - DNA, 537 bp, Glycine max
  Peptide Sequence Number=SeqID_185580
atggaatcggaagggcaaaagggtacggtgaacccgtccgcgatgttagcgtctctgcttagtaggagagccaaacttcacgaagagcttcgcagcattgaaaagcaggtagatttttcaacattggcgtctgggtgcccttcgaaaggggcggaaactttctctcactatgtgtatgatatggagacaagttacttacaagatcctggacaatgtgggaatgtattaaaaggatttgaaggcttcctatcttcgtcgaagaacactgcactcttgaaaaggtctagaaagtttcaacctgaagataggctcttctcactatcttcagtgacctcgccagcggcggaagagcttgcagctggacgagatgatggtagaccagattatggtcctggtcgttcaaaaggtggaggaatttatgctaatggacagggtaaaccaaagaaaggtagaggtggggcaagagaagcaaagagagcaagggcttcaagtgaacaagattttgattatgaagatgatcctgacctgaccttgtga

SEQ ID NO: 68803 - DNA, 303 bp, Glycine max
  Peptide Sequence Number=SeqID_185581
atgggtgatgccaaaccaattagcacacctttggctagtcattttcgcctatccaaggatcagtcacctcagacagagaaagaaagggagttcatggctaagattccgtatgcttcagtcattggaagtttaattgaatcgaatcgaaacatcgcagcgaggggagtgtatatggccagacatgcggttctcgactttgatgcacacgctaagcctttcaaccagttgttcctcctcaaactcacagcgaatgagacatatgtagttgtagaaaccaataaggacattggagaaaatagttaa

SEQ ID NO: 68804 - DNA, 3696 bp, Glycine max
  Peptide Sequence Number=SeqID_185582
atggtactgttcgttgttcgactatggtcccttagctcaagtggcagacatgatcagcgtgctttgaaggctacactctatggccttgaaaaacctgtggatttgttctcagttgccggtttagctaagagaagtacgacgatgagcgacggacagagctcagcaaaaatccctcactttgatggtcttcattatgatcattggagtgagttgatggagaactttcttcgtgccaagggtctatggaacctggtcgacagtggtgtccgggaggagaacgacacaacaacggattataaggtcaagcattatctttttagggccattgatagatcaatcttcaaacaaatcttggataggagcacgtccaagattgtttgggattccctaaaaagaaaatttgggggcaatgaaggtgtgaagaagtcattgctcaatgcattacgaagggagtttgaggtacttgaaatgaaagaagcagaaaccattactgaatactttgcaagagtaatggcagtggcaaacaaaatgaggagcaatggggagaatatgcctgactcgaaggtggtggagaaaatacttcgaacattgacagagcggttcacctatgtagtagtttcgatcgaggagtcaaaggacacagcagcaatgtccattgacgagcttcaaagctctctggtggttcatgaacaaaagtttaaaagggtcagccgagatgacgagcaagttctcaaggtggaaagcagtagaggaagaggaagaggaacataccgaggtagaggacgtggaagaggaaggcaatctttcacaaaggccgcagtggagtgctttaagtgccacaatttggggcattttcaatatgaatgtccccaatggaacaaagaggcaaattacgcagaattggatgaagaagaagagctccttttgatgactgttgtacaagaaaatgaagcaacaaggcaggatgcgtggttcttggactcagggtgttctaatcatatgtgtggagacaaaggtatgttcacagacatggtagaaggacataagcactccgttaactctgaagtaactgcacctattgaagaatgtctacacacttcttctgatctcacttacctttggcatcaaaggtatggtcacttaagctacaaaggtttgaagacactacagacaaagaaaatgatgcgtagactacctcaactggaagtctcaagtgtcacttgtacagactgcttcaccggcaaacaacaccgtaatccaattcctaagaagagtgaatggcgtgctagcaaggtcttggaactcatacacgcagatatctgtggaccaatagaaccaatctcaaatagtggaaagaggtatcccttatgtttcatcgatgattatagtcgtaagggctgggtctatttgctctctaaaaaattagaagctttggagtgcttcaagtcttacaagaaattggtggaaaaggaggcagaggcatccatcaaatgcttgcggaaggacagaggaggagagtttaactctctcaatttcaaatcattttgtgaagaagaaggcataaagaggcaactcaccacatcatatacaccactccaaaacggagtagcagaacgcaaaaatagaacagttatgaatatggtgcactgcatgctctcttcaaaaaaggttcccaaacctttttggactgaagctgtaaactggacgttctactttttgaatcgatgtccaacacttgctgtgaagaacgtcactcctcaagaagcttggagtggagttaagccttcagtagaacaccttcaagtttggggctgtgtagcacacgtgcacataccagaggcaaaacgaggtaaacttgatgataagagctttccttgtattttgttgggtatgagtgatgagtcaaagggttatcgtctctttgaccctaagacaaagaggattgtagttagtaaggatgtcatgtttgaggaagagaaaagttggaattggggtccaaattataaagaacaaatagaagcagagttggtttggggtgatgatgatttcagtagtgatgaaagtgaaggggagcatagagatgagggtaatagtgataggtttgtggaagacatggagtttgatagtgaaggtgagaatgatggaaataatgcaaggggtagtgaagctaggaatgaagcggggagttcacaagaaaatgtgattcaagggagagaaaggaggcagccggcttggatgagagaatttgtgagtggtgaggggttgagtgaagaagaagaagcagaggcctacgcagtgcaagatgttgtaggcgatgatccaactcagtttgaggaagctgtgaagcatgagaaatggagaaaggctatggatagtgaaatcaactcaattgaaaagaatcagacttgggagctcatggatctgccaagtggagcaaaaacaattggagttagatggattttcaagacaaatttgaatgagctgggtgaaattgataagtataaagcacgattggtggctaaggggtactctcaacaacatggaatcgattttactgaagttttcgcccctgttgcacgcatggatacagtaaggatgattgtggcactggtagcatgcaagggatggaacatatttcagttagatgtcaaatctgcatttcttcatggagaattgagcgaggatgtgtacattgagcaaccaaagggatatgtgaagaaagggaaagagcacaaagtttacaagttacagaaagccttgtatggccttagacaagcaccaagagcctggttcagccgtatagagtctcattttgtgaagaaaggatttcaaaaatgtccaaatgaacaaacgttgttcatcaaaagaggcatgggagataacatattaattggtatgatgattgagttcaagcagtctatgatgcaagcttttgacatgactgacctagggaagatgagattctttcctggcattgaagttttgcagaaaccagaagggattttcttgtgtcaaagaaaatatgccactgatatcttgaagaagtttgcaatgtctgagagcaaacatgtgaaaagtccaattgttccaggttttaaaattaatagagatgttgatggtgcagctgtggatgacacttatttcaagcaaattgttggaagcttaatgtatcttacaactacaaggccagatataatgtatagtgtgagcttaattagcagatataggtcaaaaccaatagagttgcatttacaagctgctaaaagaatattaaggtatttaaacggaaccactagctacgggatattctacaagaagggaggggcagaagacttgtttgctttcacggattctgactatgcaggagatgaggaagattctaaaagtacatctggttatgttttcttcttaagttcaggagcagtgtcatggatgtccaagaagcaaccaattgttactctctcaactactgaagcagagtttgttgctgctgctgcctgtgcttgtcaagctgtgtggatgagaagagttttgagaaacttaaatcacgctcaagaagatcttgtaaaagatggagaaatcgagttggtgcactgtggaactcagaagcaggttgcagatttgatgactaaagccttgaaacttgaggccttccagaagcttagaaagaagatgggaatgcttgatttcactgaa

SEQ ID NO: 68805 - DNA, 1149 bp, Glycine max
  Peptide Sequence Number=SeqID_185583
atgatttccttagcagatgtctatcatgtagtcactgccactgttccattatatgtcaccatgtttctagcctacatctctgtgaaatggtggaagctcttcaacccggaacaatgttcaggcataaacaaatttgtggccaatttctcagtcccaattttgtcattccaggtcatttcctccaacaacatttacaagatgagcctcaaactcgtgtatgccgatgttgttcagaaattgcttgcatttctagtcttcacagcaatcataaggatcaagggcagggggggtttgaagtggatcataactggtctctcactatcaacacttcccaacactttgatccttggaatcccactcatgaaggctatgtatagggatgaagcttctcttctcctaccccagattatcttccttcagagcatggtgtggtacaatttgttgttgtttcttcatgagctagatgctgcaattcctgcaaggaccatgcctgttgttgcaccaccatcacaagacacgggagaatctgagacttctctggagatacaatcaaaagaagaagaagaagaagaagcagaacacagaactcagagtaaaacgagaatgttgctcattcttatgaaagtggggaataaattaatcattaatcctaatacctatgcaactttcataggtcttatttgggcaagcatacacttcaggtggggagtggatatgccagatgttgtaaatcagtcaatagaaatattggccagtggaggtctaggcatggcaactttcagcttaggtctatttatggcatcaaacaacagagtcatagtatgtgggccaaggatgacactggtagcaatgggcctgaaatttcttgttgggcctgccataatggctgtagcctccattgtgattggattaagagatagaatgctcaaagtggcaattattcaggcagccctaccacaaggaattgttccttttgtttttgctagagagtataatgtcaatccaggcattttaagcactgggtcaggtcttgctaggaatgctcatggccttgcccgtggcattgacctactatctcctcttatcactctattgatacattatgttaaatatataccagaaacaatgacaagggttgcattggtgtaa

SEQ ID NO: 68806 - DNA, 552 bp, Glycine max
  Peptide Sequence Number=SeqID_185584
atggctacaaaagaaggaaaggtgaaaattgagaagtttgatggtgtggactttggcttttggaagatgcagatcaaagattatctatatcataaaaagttgtatcaacctttctcaggaaatcaattgaagggcatgaaggatgaagatttggctcttcttgatagaaaagccctcgaaatgacaaaaggcgtgttagcagcgcaacatctcaatgaactcaatatagtcacaacgcaattaagttcagttggatttgagttcgatgaagaagtacggacattgatacttttgtcttctctactagaaatttggaatgctactatcacatctgtgagtaggttgtcaggaagtaataagttgaagttcaacgatgttcatgatctgagtcaagagaaagaaattcaaccaaaggatatggacgtggaaaaccaaaagaccgcaggaggtcaaaatctaggagtcattgaagttcccacaactcgaagactatcgagtgttagaattatggaaaaatcgtgcattacaaaaattagtgcaagattgcaataa

SEQ ID NO: 68807 - DNA, 2094 bp, Glycine max
  Peptide Sequence Number=SeqID_185585
atgttcaggttatctcccagaaggagtcaaagatccaaaggcttcaaggtgaagcatgctctacagttatgtgttctgcttggagtttgtatctggctggtttaccaactcaaacactctaaggagaagaaatcatcctatgtagaaagcacaaaaactaccagtgaggttgtcaagttcgggaggaaggacctccatcctcgcgtggaggaaacttccgtggtagatgcaaggcacaaggaagaggatgaggaagaagaacaagaagaaaataagcaagaagagcaacacaaactcgacgatgttagcggtgtgcaagatgaggtactaaagcatgagcaaaatgacaatgaagagaattctgagcataaacaggattcggtagaccaagaaactgaagaaaattctgaaaatgcattgacacaagtggaaggagaacagcataatgagaaattgggtgaagagaatgacaatatagacaacaaagagagtgagagtacattgaaggagaatgaggagaacaaaagtgaagggaaggacaaagaaactggagagaatacagaagaaaagactgagcaggagaatgacagtatggataacaaggagagtgacaatacagtgaaggagaatgaagagaataaagataaggagaatgaaactgaagggaagaacaatggggaggaaaatcatgagcaagatagtaaagaaatgacagatgagagcaatcaaagagaagctgagaaagaagaacatggcaagattcaggaagagacttcatctgagaatcaggctcaggatggggggaaaattgaggaagagcatcgagaggaaaattatgcaggagataatgcctctagtgctgtagacaataaatcacaagacgacacctcggatgaaagttccaagacagaagaagaatctgacaaaaaggaaaagaatgagtttgagtctcagaaaaatggtactgaaactacagaagtggctgattctactgtcacaacaacaaacagccaaggaaatgaaaatcagacacagtcagagaatgattcacagaaaagtgttacatcggagtcaaaatggcagcagcaagagcagaataaccccacaaaggtagaggaatccggtgtagaaactcatacaactgaagcattggaaaatgaagataactccaaggtagaggactccaatgcgcggagtacgacacaaaaaactgaagattcttcttctaactcagatgcctcggaagagaaggctgagacacatgacagcaatgcaacgaacggtgaagacaagaacaaggacacctcgactaattctgctcaggacgaaaacaccagcaacaattatgtccaagaaggaaatgttgcgtcatccaacaatgacaataaagattctagccaagatgttcaactcacttcctctgatacttcctcagaacaaaagaaagatgaatccttgaatctagaaagtaacactgactctgctcagaatgacaatgaaaactctgatcaaagcaacaaaaacagtgatggaagtgctaatgacaataaagatgctagccagtcctatacttcatccgagcaaaacaaagaaggatcctcaaactcagataacaatgctagccaatcagatacttcatctgatcaaaacaacaaagagggatcctcaaactcagataacaatgctagccagtcagatacttcatctgatcaaaacaacaaagagggatcctcaaactcggataacagcagtgatgctaaccagaatggctctaacagcaatgaaaatgcaaatgacaatgggaatgctagtcatgaagcacaaaacaatgctgatgcgggacagggcaacaatgaggccactgttgagagtaagacaagtgaaaatgaaggtggtgctcaaaacgaaacagtggagtcacaaaaagaggaggaatctgcacactccggcggagatagcaattctaacttgaatgatcaaggaagttctgatcattcaatcactcaggaggataaagaatctcgcgtggatttgggaactctaccacaatccaatgcagaaaacaataacattgaggttactgctgctgagtga

SEQ ID NO: 68808 - DNA, 773 bp, Glycine max
  Peptide Sequence Number=SeqID_185586
atgagagagtgcatttcaatccacatcggtcaggccggtattcaggtcggaaacgcctgctgggagctctactgcctcgaacacggcattcagcctgatgggcagatgccaagtgataagactgttggtggaggtgatgatgctttcaacaccttcttcagtgaaactggggctggaaagcacgtgcctcgtgcgatttttgtagatctcgagcctactgtgattgatgaagttaggactgggacataccgccaactatttcatcctgagcagctcattagcggaaaggaggatgctgcaaacaactttgcccgtggccactataccagtaatgttcctttcatttcattgcttcaaggtgtttttggttcagttggaaaggagattgttgaactttgcttggatcgcatcagaaagcttgctgacaactgcactggtctccaaggttttctggttttcaatgctgtgggtgggggcactggctctggtcttggttcccttttgctggaacgtctttcagtggactatggcaagaagtccaagcttggtttcactgtctatccttcaccccaagtttcaacctctgttgttgagccttacaacagtgtcctctccactcattcccttcttgagcacactgatgtggctgtcctgctcgacaacgaagccatttatgacatctgcagacgttcacttgacattgagaggccaacctacaccaaccttaatcgtttagtttctcaggtgatttcctcactgaccgcttccctgag

SEQ ID NO: 68809 - DNA, 599 bp, Glycine max
  Peptide Sequence Number=SeqID_185587
accactccaaacaaggcacaaagcccaagaataacaacaagaggaagggtgatgagactataagtgaagaagatgatggagcatgcagacaagcttttgctaggatgattattgtagatgagttgccattcaagtttgtggagggggagggttttcgttggggaatctctagagttttcaccgttacagttgataatgcaagtttcagtgatgttgctctttcttacttgaaagattgtaggatacaagacaactgcactgtacaattagatgtccccactagatggaactccacttaccttatgcttgaaactgctttaaaatttcatagggcatttaaaaggctgggagagcgagacacaaaatttgcaatgatgcagggtggtatcccattgagtaaggattgggataatgcaaggcacaagcttcaagttgtggaaatctgctttcgaaagctttatatcaaggaagacgttgagtgtttaagatttaaagagaataaaactttccacaaaatgtttaatagttataaggattttcatggagctgttgaatctgaatctacacaagcttctcatgacattgaacttctgatgtag

SEQ ID NO: 68810 - DNA, 432 bp, Glycine max
  Peptide Sequence Number=SeqID_185588
atgccaggagagcgcaagggccggcatgattttgccatcgtcaccgagccgcgtcaggccttcatacatcgggtccagcaccgtgccggtaaaggtcgcggtctgattgcccgggtccatgctgcgcggcggttcgttttgcataatgaccagctgagcagccaaaaccgatgcgctggaaaacgacgccagaatacccgcggcaagtgtcagtaccctgaaatgcttgagtgtgctttgcatgaaggcctcagtgaatcagtgacaaagagtgaagagtcattgcccggcaggcagctgaccgtcaatgcgcgccatcgcctgccatacgctttggttgtgttaacggcagcagatgaacgggctcgacgctatataaggcacactctgcaaacaaaagccaagatgtcagttcatatattttacttataa

SEQ ID NO: 68811 - DNA, 474 bp, Glycine max
  Peptide Sequence Number=SeqID_185589
atgaagctgagtaaagccgcaatcagcactttaatcaaagagatgcttagcgcaggactgcttgaagagagcattccggaaagtaacggtcagggtcggccttcggtgttattaaaaatgcgtgccgacagtgcctattttctcggtgcgtcgttgctcggtgacgatgtgtatctggtgctgacggatatgcacggccgcatcctggccagtacccacatgccgctgaatcccgatcctgcgctgctggctggtgcgctggccgccgccatccccggtctgcttgcacaaaaaggcatctccgccgaccagcttatcgggctgggcgtcacgctttccggctttgtggatgaaaaccaggcggtgtgcgttcagtctgccctgctgggctggaaaaacgtcccgctggcggcactgcttaacgcgcaaaccggtcaggaggtgtcactggaaaacgatgccaaagctctggcg

SEQ ID NO: 68812 - DNA, 470 bp, Glycine max
  Peptide Sequence Number=SeqID_185590
ggagtccggagacgtcggcgggggccccggaaagagttatcttttctgtttacagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 68813 - DNA, 195 bp, Glycine max
  Peptide Sequence Number=SeqID_185591
atgaaaacaacgatagaaagacgtagaggaaggttggagtttttttgggagaaagaaaagcaagaaacacaacaagctcacccaggagaaagggacgcttcagagaagaaccctcactgtatcgtcgtggtgttgccagagaagaaccccactgaggccgcgcagcacagagtgaaaaagaccgtgaaacaataa

SEQ ID NO: 68814 - DNA, 363 bp, Glycine max
  Peptide Sequence Number=SeqID_185592
atgtcgcagaagagcaatgcatcatcatctcgaacaagagtttcatcacaagttgttcttttttgtggttgtggtagaagggctgttaggcgtgttgctggaacaaatattaacagaggaatggcgtttttcacttgttcaattaataaggatgaagttggatattgtgggtactttatttgggttgatcaattgattgaagcacttggagttgatgattcacttgggacattttccatggaacaaagaagacaatttgaaagagaggaagataagacaatgtggaaggctcaagttaactcaaagcttgattgtatggggattgaaatgaagatgtttagaacaattgtctatggaatctga

SEQ ID NO: 68815 - DNA, 447 bp, Glycine max
  Peptide Sequence Number=SeqID_185593
atgggggtgggtggaaaggtgggatcttttggagggaaaggatggtgggtgattgtattgttaaaattcgttggacccaaggagaagaagctatgtgcaagggagttgcggagggaagtgaagatcatgtatttagttgtgaagagagaaactgagaaaaggaagagaacaagcgaactaaaaagcttcgagaaatgggatgctcctgaggagaatggcagagaaggacgcagaggaagattggagttcttttcggagaaagaaaaccaagaaacacaacaaccacaccctggagaagggaacactccagagaagaaccctcactgtgttaccgtggtgttgccagagaaggatgcagggggcgtcaatttcttttgccgttgtggtgttgtcagaaaagaagcccgtcgaggccgcgcgacacagagtggagaagaccatgaagtg

SEQ ID NO: 68816 - DNA, 453 bp, Glycine max
  Peptide Sequence Number=SeqID_185594
tggatgtgtccggttgagcgatacatgaagatcttaaaagggtatacaaagaatctacaccatcttgaaacatctattgttgaaaggtacaatacagaaggagctattgagttttgtttagagtacattgaaaaggaaaaacctattgggcttctagagtctcgacatgacgaaagagtgggaggatatgatatcaacaagtatttcttctacacgaaatcacaagacaacaggagtagaatgcaaaacaatggggttagtcaaagggttgaatctcaacagtttgttactctacatgattacaatcctcgtctatcttccatgtcttactttggagtcactaaagaattctcgaagcttaattatgccaaattcattgtctgtgttttcaagtttgatttgaagaagctcgcatatcagaatgatccttttcatcatagcagaacaagctaa

SEQ ID NO: 68817 - DNA, 498 bp, Glycine max
  Peptide Sequence Number=SeqID_185595
atgatattgcgcttggatattgctaatgatagctatccaaatgtttataccatgacccaaccaagcagactgaatttgacaattttatggtacaacaacttgatggaactgttaatgaatgagggtggtcttggagctaatgctattttggcaatgtcactagttgtctgtaaggctggtgctgcagtgaagaaaattcctctgtacaaggattattacaaagtgttgaaggttgaatatgatgcaatcgaatgctattttggcagtatcactatgtactatatgaaagatgtcgtccttaaagggggtattccatttaacaaagcatatggaatgacaacctttgaataccatggaatagatccaaggtttaacaaggttttcaacaaggggatggctgatcactttacaattacaatgaagaaaattcttgagacctacactggctttgagggcttaaatctctggttgatgttggtggagaaactggagttgtag

SEQ ID NO: 68818 - DNA, 300 bp, Glycine max
  Peptide Sequence Number=SeqID_185596
atggcggagcctagcatgtcgagccttagggccttgaggttgatgtgggcctggaaggcctcatcggcgtccttgttgttaagtagattcaacgccagctttagcctttgtggcactagtgatgagaagaggaagaagctaaacaacaccacttcgaagacgaggagcttcttgactacgtcaacattggcgatgcatgaggagtggttctcgaggctgcactggccccgaggtggtgagagagaggcccacgaagatggtggtcgtgaaaagggagttcacgttcaccgagccgtctag

SEQ ID NO: 68819 - DNA, 174 bp, Glycine max
  Peptide Sequence Number=SeqID_185597
atgatgggatgtgatggcattcaatggagtggaacagctgggccaagtgatggaaaaaggaatggggtttggtccaacgaggaaatgcttgtgtggaactctagaatcaaaatcaatggggtatggaacctctacagaatcagaatccatatatccatgaggggtggctgctag

SEQ ID NO: 68820 - DNA, 279 bp, Glycine max
  Peptide Sequence Number=SeqID_185598
atgtatattgcctactttcgaaaacggaccccgacgggtgcagagaaacgcgaggaactggaaccagagaggcagcacgcaaaccaagacaagattttggcatccaaaaagaaaatttcagcagctctctttcctccctccacgttgctttttctcctcttcttctccaccattgttgcctcccttgaagctccaaattcctcttcatttctaccccaaattgcaaggaaaagctattttcagagtcttggagcctacctctacttcatggggctttaa

SEQ ID NO: 68821 - DNA, 240 bp, Glycine max
  Peptide Sequence Number=SeqID_185599
atggagggtgcttgtggtggtgtcaccactgtaggcttggaagggagtcgttgtggtgacaattttgtcgttgtcattgtcattgtcggcgtggtggttgcatgtgttgtgttggtttctgttgatgttgtcactgtgatgattgcggtggtgtcatcgatgttggctctttgtgctagtgcatgggagagatggggacagaggacaaagttgaaaaatgaggaaagggagataaaataa

SEQ ID NO: 68822 - DNA, 1377 bp, Glycine max
  Peptide Sequence Number=SeqID_185600
gatgaggaaaaatgtggtggtggcagtgagcacaacaactcttgcgctggtagtagtaggggtattgatcagaaggttgctgatgatttcgtctctaacatgaaagtctctcttggttcttccgatgaaaactccactctcaacatggtgatctccaatgttacatcactcccacttggagatgaggaaggatttttttatggggttaatttgcaaggaaagcatttgttgatgttgtgtgcacggctaggaggaaagagtatgcctatctctgcgttacaaagagaagagatttccatccctgatgctgtcttggctggtgcttctgaggaaataactgattacgtagctacagagatagctaagtttgtttcgttgcatcctgagattcaagatggtgcacccgccaaaaagaagaaattgggcttcaccttgtcatatccagtggacgaagttttgccttttgcggccacaacatttcaacggaaaagcgcaaacaacccagttcgcaaaggaatggtgaaagaccttaataaagcattgactaatcatggaatgaaaatgcatgtttcttcactggttgatgaaactatcggaggtttggccggtggaagatactataacagagagagcgtggctgcaattacccttggcatgaacacaaacgccgcttatgtagaatcggcagaagaagttgctaatgaccttacacaatctcccaattcaagcgagctggtaattagcatggagtggggaaagttcaattctcctcatcttcctttaacatcatttgatgcgagtgtagatgctgaaagctcaaatcctggtcgcgagattttcgaaaagcttatttcaggaatgtatttgggagaagttgtgagacaggtcttgttaaagttggcccgagaaacagccttatttggaagcaacgtgcctccaaagttaatgactccatacttactaaggtctccagatatggcagctatgcatcaagacatgtccgaggatcgtgaaatagtgagtgagaaactcagcgagatttttgatatcgatagttgtagcctaatggcaagagaaatggtggcagaggtgtgtgacatagtgacggagcgtggtgcacgcctagccggagccggaatcgtggggataatcaagaagcttgggagagttgagaacagaaagagtgtggtgactgtggaaggagggctttatgagcactatcgcatctttagaaactaccttcatagcagcatctgggaaatgctcggcaaggatctctcagacaatgtcatcgttgaacattcgcatggtggctctggaactggtgctttgttccttgctgctgctcaaacttatgcacaccgtgcggattcttga

SEQ ID NO: 68823 - DNA, 474 bp, Glycine max
  Peptide Sequence Number=SeqID_185601
atgccaaagaggtcttgcgtcaccagcgactgcgactcttgcaaggtggaatgtagcagaaatggagtgttttcattggccacattggtgaagatctatccagacaacatggacgaacatgttctataccatatcagcttggagcatggattcaatgtgttggtgatggtggttccatttgacgttcctggcaaaaagtgcatcagcacggagtgcccaaaggatccaaataggatttgtccaccaaagttgagttttataatactggttatgttcaaaagaaagtggaaccatactcaaaatccaactgcaagtgaggtaggaatttctttattaagtcctaatggcaacatgtcaatcccacttcaagtttttaagacagctatcgacaattttagtgaagaaaacctcttaggaagggcaattttggcattgtttacaaaggacagttgcctaatggaacaaatattgtag

SEQ ID NO: 68824 - DNA, 168 bp, Glycine max
  Peptide Sequence Number=SeqID_185602
atgaaggttcaaaggggttgcagcaagatcacgactgagagatctaaggtggttggggtttgggttgatggtgtggcaacaagttcttcatttggcatcacactcacaaagaataaagttgttttcaaggatttcacaagactaccacatgttcattatttctattaa

SEQ ID NO: 68825 - DNA, 1050 bp, Glycine max
  Peptide Sequence Number=SeqID_185603
atgatgcaaatttcgtcaaacatgtacatgcctgaatttggaatggaggaccccactttgtttcatcaataccctatggattcttcatcagcattattccagctcgaagatcttgactttgagtccttctccgcatccccaaagaactcttcctctcacaataagcgattattcaactcagaaagcacacaaaactctttccacaaaagtcctcatgaacaatattctgttgccccaccaagaccaaccaagcaaaataagactgtgatgagcactacttggagtgcttacaacgctcatcaccatcatcatgacatggtggctccgaaagcttcttcttcttcgtcctccaaaatcatctcttttgatcagcactccaatgcatcttctgttacttcccaacaactctacaacaacgtggatgcggctgccaaagtgaagaagcctaagattgaaactgggtatggtgaaaacttggatttttcagcagctgctgcggctgcttctcaaagtatctgtgacaacaacagttttctagatcactatgataatcaagataaaaaggctgcggcttcaacgactagaaaccctacccaagctcaagatcatgtgatagccgaaagaaaacgaagggaaaagctaagtcagaggttcattgctctttctgccatagttcctggactcaagaagatggacaaggctaccgtattggaagatgctataaagtacgtgaaacaactgcaagaaagggtaaagactctggaggaacaagctgtggataaaacagttgaatcagcagtttttgtgaagagatctgttgtgtttgccggcgttgatagctcctcctccgacgaaaactccgaccaatcgctccccgaaatggaagcaagaatttctggtaaagaggtactaatcagaattcactgcgacaaaaacagtggaggagctgctgctatactaagggaattagagaagcattatctcacagttcagagtagcagcttcttgccctttgggaataacactcttgacataactattgttgctaag

SEQ ID NO: 68826 - DNA, 171 bp, Glycine max
  Peptide Sequence Number=SeqID_185604
atggaacaaattggtgaaactatgagagtgtattataaagggggcatgtacacgctacgtacccgctttctctctattgaccatagccatagtgtgaatatgttaatcccattttcttgggtttgcgacgtcaataatgcgtccattgccaacgcaataaataacgcttaa

SEQ ID NO: 68827 - DNA, 459 bp, Glycine max
  Peptide Sequence Number=SeqID_185605
atgaagctttgcttctacactttaatggttaaggaagagtgtaaggaggtaagtgtctcctccaagaggttagctaggaaggaaagtcattttgaaataaagaaaaatattaaagaagcttcccctcttaaacaacctccacatcttctcctttgtaaaaagacacttgttagcactgccacacctcttgggcttgaggttattcctcaagtaaaggagaataatcaacatgaaaatacagaaaaaggtagattttattgcattactttccttaattttttaaatggtgatcaaagggttcccatagaccctaagaaaataaaggccattcctgattggcccactccaccaagtgtcaagggaagaagcccagagtataaagaacctcgggatttgaggtcaaatccttttcaaggtggaggggatgatgcaatcctaccccccaagggtattggatag

SEQ ID NO: 68828 - DNA, 237 bp, Glycine max
  Peptide Sequence Number=SeqID_185606
atggttttcggggagattcatctggaggctagagagagtggcaaggaaggtagggatggggccaaaaaacttattgtaggcgagagaaatagaaagaaaatgaagatttaccaatttgttggtgttggagaggaagtgagcttagtctcagtgcattggcatgttgttcccggtcaccagatacctcaaaccaagtataatgtgaagctaaggagtttcatgaaagagcaccggtag

SEQ ID NO: 68829 - DNA, 219 bp, Glycine max
  Peptide Sequence Number=SeqID_185607
atgatgctatggtggaaaggtagtgatgatgagtataaggagactactatggacaatcatgcattattgttgtctaattatgtcattgctactgaggtggagttgtttgtggaatgtgttggtggtaatgagggggttatggataacaatttttctgtggacaaggctggtggtggtaaaaaggctactagtggtggtaagaagtgttggatcgagtga

SEQ ID NO: 68830 - DNA, 549 bp, Glycine max
  Peptide Sequence Number=SeqID_185608
atgttgatctatgaatacatgtccaaccgaagcttggactactttatatttggttggacacatgaagccaaaaggaagttgttagattggcgcaagcttttcaatattatttgtggcagtgccaggggacttctttatcttcatcaagactcaaggctaaggattattcacagagatctaaaaactagtaacattttactagacactaatttggatcccaaaatatcagactttggccttgctcgatctttcttgggagatcaagttgaggcaaacacaaatacagtggccggaacttatggttatatgcctcctgggtatgctgtgagtgggcaattctctgtgaaatcagatgtctttagctatggagtgattttacttgagattgtaagtgcgaagaaaaacagggaattttcagaccctgaaagctataataatcttcttggacatgaatggagattatggactaaagatagggcactgaactactggatgatgtgttgggagaacaatgcacattccgtgaagtcatacgatgcatacagatag

SEQ ID NO: 68831 - DNA, 432 bp, Glycine max
  Peptide Sequence Number=SeqID_185609
atggccaacaactggattgtcacctggtttgtgaagccatttccatttacattcagtccacccattttcgcgttgacttatatgtcttacccatttccgggtgatcgcgatacctccattagttctctttccgcaatttgcaggcttggccaaacatatcgagatgtcctttactaccacatcacatttcttgctaaggatgcttcttcctcactagacctcccaatagcaatccgtgagttattaagcaagtttgctacattgttccagcccccaagcactctgccgccgactggcgacactgaaacagagacactagcagaagccattgaagtcacagagggagcaacaacatccacagcagaggtgcaaaaagtagagaaatccaagagagtagtgaagaagcccacttatctcaaggactttgtctga

SEQ ID NO: 68832 - DNA, 774 bp, Glycine max
  Peptide Sequence Number=SeqID_185610
atgagtcaatatatcccagatgacggtgagactttggtttcagccggtgaaattactgaaatgggtttcttcagtcctggaaattcgacaagacgatacttgggtatatggtacaaaaatgtatcccctttcacagtggtatgggtggctaaccaaaatacacctcttgagaataactttggagttctcaaactcaatgaaaaggggatacttgagcttctcaatcctacaaacaacactatttggtcatcttccaacaacatatcaagcaaagccaggactaatccaatcgtgcgtctcttgaattccgaaaacctcgtgaaaaatggacagggaacaaaagatgacagctttttatggcagagttttgatcatccctgtgacacatacatgccaggaatgaaagttgggtggaacttagacactgaccttgaatggtttttgtcgtcttggaaaagtgttgacgatcatgctaagggagaatatgctttgaaaattgatcttagaggatatcttcaaataattaaattcaagggaattgttataataacaagagcagggtcatggaatggcttgtctgcagttgggtatccgggaccaacacttggaatatcaccaatatttgtgttcaacaaaaaggagatgtcctatagatacaacagtcttgataaatcgatgttcaagggagcaacaacatacacagcagaggtgcaaaaagtagagaaatccaagagagtagtgaagaagcccacttatctcaaggactttgtctag

SEQ ID NO: 68833 - DNA, 777 bp, Glycine max
  Peptide Sequence Number=SeqID_185611
atgttgatctcatttcttccctgtttctgtctgattctgaccacttggttttattttttgcgtgtacgtgatggtgatgatgatgctcgagatgcaaaacgcagcgcacagttatttagtagttcgggcctttcgtacaaacaagaagcgccacgaccacactcaccccgaggaggaaccaccagcagcgatgacgacaaatctcacggcacctccgccaccaccaccggcgcagacgacgacgacgaaggaccagaatatcagtacatcacaaccatcctaacccgtagtactaccaccactgggccccacaacagcaacctaccccacctccagtttcagtggttctctccgacacaccccttggacccttccgtatttcaccgtctcgagcactacacaacatccaattcctttgtttccttccccagcgacaacaaagattgcatctttaagcggaaacaacatctgggtccgcgctgcaaccgtagattactgttcgatttggtcgatgagttgctgtcggagattcttgttcggccgaggcgttacaaaggggcgttgttggagacagtgtgggagagggttcggagtttcccacgtgcgaagtgcgaggttttggaggatattgatgcgttgattgagatggaagagatgaagaaagatgaggaaggggaagggttggtgaaggagattgagaggagcatgtttgagacgttggtgcatgaaacgtttaccgttatggttggtggcgtggatacgaagggaaagtgttaa

SEQ ID NO: 68834 - DNA, 909 bp, Glycine max
  Peptide Sequence Number=SeqID_185612
atggcccctctgccagcagaaaacatcttaccaatcattttcctcctcttgataatattttcagtatccaaagctgaacttcatgctcattactatgaccaaacatgtccacaagtggaaaaaataatttcagagactgttctcaaagcttctaagcatgacccaaaagtcccagcccgtatcttgagaatgttcttccatgactgtttcataagggggtgtgatgcctcaatattgctggactcaacagccactaaccaagctgagaaagatggccctcctaatatctcagttcgatcattctatgtgattgatgaagccaaagcaaagcttgaattggcttgcccacgcactgtttcttgtgctgatataattgccatttcagctagcaatgtggtagccatgtctggaggtccatattggaatgtactgaaaggaaggaaagatggaagagtatcaaaggcatctgataccatcaacttacccgctccaacctccaatgtgagccaactaattcagagctttgctaagagaggtttgacagttaaagatttagtaactttatctggaggtcacactctaggcttttcacattgttcttcctttgaggcacgtcttcgtaattttagttcattgcatgacactgatccaagtatgaacaccgagtttgctttagacctaagaaagaaatgtccaaaaccaaaccacaaccataatgcaggacagttcctggactcaacggcatcagtgtttgacaatgactattataaacaactgttggctggaaaagcatttgtgaaagaccagagcttgttcttcaaagagtttacagcttcaatgttgaaacttggaaatttaagaggctctagaaatggagaagtgagacttaattgcaggattgtgaattga

SEQ ID NO: 68835 - DNA, 225 bp, Glycine max
  Peptide Sequence Number=SeqID_185613
atgcaaagaaaggagcttgagggtgtaatcagcaactttttaaggagtgggattgtccttggactcggctcctggagtaaccatgctaggcttgaggagaataccttcgaacaagacattgttctctaccagctaagctcactaccatgccaaaatacaagaagggagaaagcttccttgagaagcctccctgggaagcaagtgttacacccctctaatagctaa

SEQ ID NO: 68836 - DNA, 204 bp, Glycine max
  Peptide Sequence Number=SeqID_185614
atgggtccaccattggcggcagtggcgtttccgaggtgtcatcgccaccgtcgtggtgaaattgaatcaatggctggatacactcctcgcgttaatttggccattgggatggtgccacgtagggagtctaggttctaccatgacttcactgttcctgttgcacttttgtgcctaattgatgacaatttgcgaatttgtcaatga

SEQ ID NO: 68837 - DNA, 144 bp, Glycine max
  Peptide Sequence Number=SeqID_185615
atggtgggtttaagcacgtgtacgtatgattttgtggggcccgctcatgggtggaagcagcctggccctctctacacgtgtcgattctggaggtacattgtagctcctcaacacagtgcgaccttctcaagatttttaatttga

SEQ ID NO: 68838 - DNA, 264 bp, Glycine max
  Peptide Sequence Number=SeqID_185616
atggagataatgtgcacctgcttacaaaactatggtggactgaggggtgacagagcccatggttctcctagccaactgggtagcgatggaggtctaggcaaaaagggaaggtgtttaaaaaatgatggggaggaagacaaaggtggtaacgggggtccaactaaacttggaattgtaggaaacaagaaagtccaccattcatgtactaccgacaaaaggggagcttcaagtcatggtaaaggcagagcaacaagaaatgagtag

SEQ ID NO: 68839 - DNA, 397 bp, Glycine max
  Peptide Sequence Number=SeqID_185617
tcttctatccaatgcccttgcggggtaggattgcatcatgcatgctgtcaaacaaaggaacacttgttatcattgtcatacctcttgagcttgaggttattcctcaagtaaaggagttgttggatgagggtatggttcgtaagagcttaaatccttgtgctttgttgctgcccaaaataggtattatgaggcaccaaatccccatgataggtggtatgatgaatgtgttgagaggggttcccatgaaccctaagagaataaagaccattcctgagtggcccactccaccaacaccactcattgagttggtgaggaactatgttctctcatgggaagatggccaggaaaggggtgttgaggaaagaattcatgagtttcaagaacctctggatttgag

SEQ ID NO: 68840 - DNA, 1788 bp, Glycine max
  Peptide Sequence Number=SeqID_185618
atgaataaggctgggcaatctctgaaatgggttctcttggatttgattcacaaatgcaacgacttgagatccttcaagcaaatccatgcgcatcttttgacttctgcccttgttactaatgatttggttgtcaccaaagctgcaaactttttgggaaaacatatcactgatgttcattacccttgcaatttcctgaagcaatttgattggagcttgagctctttcccttgcaatttgttgatttcaggttatgcctcgggccagttaccctggcttgcaatcctgatttatagatggactgttaggaatggttttgtgcctgatgtgtacacttttccagcagttttgaaatcttgtgctaagttttctgggattggagaggttagacagtttcattcagtgtctgttaagactggattgtggtgtgatatttatgtgcaaaacactcttgtccatgtttatagcatttgtggggacaatgttggtgctggcaaggtgtttgaggacatgcttgtgagagatgtggtctcttggactggtttgatatctgggtatgtgaagactgggttgtttaatgaggccatttcgttgtttttgagaatgaatgtggagcctaatgtgggaacctttgttagcatacttggagcctgtgggaaattgggtcgtttaaatctggggaagggaattcatgggttggttttcaaatgtctgtatggggaggagttggtggtatgcaatgctgtgttggatatgtatatgaagtgtgactctgtgactgatgcaagaaaaatgtttgatgagatgcctgaaaaggatattatttcatggactagtatgataggcggattagtgcagtgccagtctcccagggaatcactggacttgttcagtcaaatgcaggcctcaggttttgagcctgatggggttatactgactagtgtgctttctgcttgtgccagtcttgggcttcttgattgtggcagatgggtccatgaatacattgattgccaccgtatcaagtgggatgttcatataggaacgacattggttgacatgtatgcaaaatgtggttgcatagatatggcacagcgtatcttcaatggaatgccttctaagaatatccgcacttggaatgcctatataggtggtctagcaataaatggatacgggaaggaagcattgaaacaatttgaagatttggttgagtctggcacaaggcctaatgaggtgacatttctagctgtttttacagcttgctgccataatggtttggttgatgaaggccgcaagtatttcaatgagatgacaagtcctctctacaacctctctccctgtttagaacactatggatgcatggttgatttgctctgcagggctggactggtaggggaagctgtggagttaataaagacaatgcctatgccccctgatgtgcagatcctaggagctcttttgagttcccgcaatacgtatgggaatgttggattcacccaagaaatgttgaaatcacttccgaatgttgaattccaagatagtggaatatatgtgcttctttctaatctgtatgcaactaacaagaaatgggctgaagtgagaagtgttaggagactgatgaagcaaaaaggaataagcaaggctccaggttctagcatcataagggtggatggtatgagtcatgaatttttagttggagacaatagccatcctcaaagtgaggaaatttacgtactactaaacatccttgccaatcaaatctaccttgaggggcatattaataccctttcttga

SEQ ID NO: 68841 - DNA, 1887 bp, Glycine max
  Peptide Sequence Number=SeqID_185619
atggagattattcaagcttctaacgagggaagacagacgtcaatgggtttggtgtacgagcaatttatatgggcatttcttgttgggtgcacgttcattagtgtattatctcatcctgatgaagcattcattttctttgatatcttcatccaatgtgtccatgcagcagctccaaagtacacatttttaaaagaagcaacatctgctccagaaatcttaacttatgactacatagtgattggtggaggaacatgtgggtgtccactagcagcaactctctcacaaggtgcaggagttttagtccttgaaagggggggctctccttacacaaaccctgagcgaatcaacataaagaactttgcgaattccctcgttgacataagcccttcatcattttcccagccattcatatccagagatggtgtcctcaattcgcgggctcgtgtcctgggtggtggctctgtcgtgaatgcagggttctattcaagggctagctccacctacataagagattctggttggaatgaaactttggctgaggactcatatatatgggttgaaaaaaaagtggtctttgagccccttctgatgcagtggcaatcagcagtcagggatggattacttgaagtaggtgtgttgcccaacaatggttttacttttgatcacttatatgggactaaggttggagggacaatttttgataaggagggtaacaggtacacagcagctgatttgttagagtatgctgatcccaagagaatttctgtttatctccatgccacggtgcagaagatactatttaagtataacacagaaaaaagaaggcaacaagcttatggagtaattttcaaagatgcattgggagtgatgcatagagcatacttaagcacacaaggaaagagtgagataatcttatcagctggtgcaattggaagcccacagttgctgatgctaagtgggattggtcctgcaaaccatcttcaagctcatggaataaaagtggttttggatcagccctttgtgggtcaagggatggcagataatccattgaatgttctagtggttccttcccctgtgcctgttgaagtctctcttgtccaaacagtgggcatcactaagtttggtagcttcattgaagcagccagtggactgagcttgggccattcttggtcggaaaggcttcaagggatttttgaatttgtgtcaaaccagggttttgccgggggatttagaaactcacagatccataggggtgcagtgtttggtgatgcgtctggtgagccttccacgtttcccccagaagctaaggagagtgttgcagacactattagatttttaaccaatccaactcttaaaggaggagtcataggtgaaaaggtcacaggaccacgctctacgggtcatttggagcttataaccacaaatcccaatgataacccatcagttaccttcaactattttaaggatccagaagacttaaagaagtgtgttgaaggcatgagaatcgtcatagatgtgataaactcaaaagcattctcaaagtttcgctaccacaacatgccggtccaagctctaatagacttgatgttgcacttaccagttaacttgaggcctaaacatgctaatgctgccttctctttagaacagtattgcatagacactgtgctaacaatttatcattaccatggagggtgccaatctggtaaagttgtcgatcataattataaggttattggtgttgaagctttgagggtaattgatggatccacttttcatggctcaccgggtacaaatcctcaagctactgtaatgatgcttggaaggtatatgggagaaaagattataaaggaagattcttccataggcggaagtgaagggatcaattga

SEQ ID NO: 68842 - DNA, 1443 bp, Glycine max
  Peptide Sequence Number=SeqID_185620
atgcagattattcaagcttcttacaagcgaagacagacatcaatgggttgggtgtccgagcaatttatatgtgcatttcttgttgggtgcacgttccttagtgtattatctcatccagataaagtgattggtggaggaacatgtgggtgtccactagcagcaactctttcacaaggtgcaagagttttagtccttgaaaggagaggctctccttacacaaaccctgagcaaatcaacataaagaactttgtgaattccctcgctgacataagcccttcatcattttcccagccattcatatccagagatggggtcctcaattcgcgggcccgtgtccttggtggtggctctgtcctgaatgcagggttctattcaagggctagctccacctacataagagattctggttggaatgaaactttggctaaggactcatataaatgggttgaagaaaaggtggcctttgagccccctatgctgcagtggcaatcagcagtgaaggatggtttgcttgaagtaggtgtgttgccttacagtggtttcacttttgatcacttatatgggactaaggttggagggacaatttttgataaggagggtaacaggcacacagcagctgatttgttagagtatgctgatcccaagagaatttctgtttatctccatgccacagtgcagaagatactatttaagtataacacagaaaaaagaaggccacaagcttatggagtaattttcaaagatgcattgggagtgatgcatagagcatacttaagcacaaaaggaaagaatgagttaatcttatcagctggtgcaattggaagcccacagttgctgctgctgagtgggattggtcatgcaaaccatcttgaggctcatggaataaaagtggttttggatcagcccttggtgggtcaagggatggcagataatccattgaatgttctagtggttccttccccggtgcctgttgaagcctctcttgtccaaacattgggcatcactaagtttggtagcttcattgaagcagccagtggattgagcttgggccattcttggtctgaaaggcttcaagggatttttgaatttgtgtcaaaccagtctggccagccttcaacgtttcccccagaagccaaggagagtgttgcagaaaccgttagatctttagccaatccaattctcaaaggaggagtcctacttgaaaagatcataggaccacgctccacgggtcatttggagctcataaacacaaatcccaatgataacccatcagttaccttcaactattttaagggtccagaagacttgaggaagtgtgttgaaggcatgaaaaccatcatagatgtgataaactcaagcattctcaaaattccgctaccacaacatgccagtccaagctctaatagacttgatgttgcacttgccagtgaacctgaggcctaa

SEQ ID NO: 68843 - DNA, 507 bp, Glycine max
  Peptide Sequence Number=SeqID_185621
ggggtggtttctgataccctgatctttgagtcactcagccctgcgatcaacctagcctatgtgaagaagaattgctggaaccccgccgatccatcgatcacgttccctgggcctcgccgcacacgcaccagagcttcagcatcagcttccgaggcccccctacctacccagtctccgtctcagccatcccagcgaccgcgacatccacctgcttccacctcagcatccatggacacgcatgggcagatgctgaggtcccttcacgttggacagcagctcatcatggagaatatgcacaggctgtccctacacctgcagatggaccccccgctcaccactccagaggcctatcgtcagcgagtcgcctggccaggagaccagccctccactgacaggggggaagagccttctagagtcgctgaggatcctgcagtcgatgaggacctcattgctgacttagccactgctgactggggcccatgggcggacttgggcggaggcagttga

SEQ ID NO: 68844 - DNA, 243 bp, Glycine max
  Peptide Sequence Number=SeqID_185622
atggacgtgtcttgtttattgctgtattttgtgattctctttgatggccaccaaagaagaaagggaaaacaagtgctgttgagtcaaccaagcaaggaaagatggatgcttcttccacgaagcggtggagcatcagcatccaatagatcaaagggtgcatccacgaagtctggcctgaagtccaaagatggcaacaaatccaaagattccaagactattagcaaacctcgagcctgcagttag

SEQ ID NO: 68845 - DNA, 204 bp, Glycine max
  Peptide Sequence Number=SeqID_185623
atggacgcgtggggtgctaatacctttcccgtgcgtaaatgcaactcccaaacctttcacttaaagttcgtagaccatgtcttttttccggtttttctgacgttttcctcaaataaacgttggtggcgactccacgcattttcctttcttggaagacgcatccgtgagtctcacgtcgccctcccgtcgaaggataggttgtga

SEQ ID NO: 68846 - DNA, 549 bp, Glycine max
  Peptide Sequence Number=SeqID_185624
atgactaggttatctgggcacccaaatgttgtagatctcaaggcagtttatgaagaagaggattttgttcatctagtgatggagctttgtgctggaggagagttgtttcatctgttagaaaagcacggatggttttctgaatttgaagccaggggtctttttaggcatctcatgcagatggttttgtattgtcatgaaaacgaggttgttcatagagatttgaagcctgagaacattctcttggcaactagatcttcctcatctccaattaaattggcagactttgggcttgcaacctacataaagcccggacagagtttgcatgggttagttgggagtccattctatatagctccagaggtactggcaggtgcatataaccaggctgctgatgtttggagtgcaggggttattctttacattctactgagtgggatgcctccattttggggaaagacaaagtcaggaatatttgaagttgctaagactgctaacctgaggttcccacctgagccttggattgcatttccgaatcagctaaggatttga

SEQ ID NO: 68847 - DNA, 618 bp, Glycine max
  Peptide Sequence Number=SeqID_185625
atgttttccatcaatcatttctccgccccagatgcgaactcgccggggtcggggtcaggaacttcccgaccggtaccggcgctgtcggacgaggattattttctggcggcgagcaatcccaagaaacgcgccgggaggaagaagttccgggagacgcgccacccggtgtaccgcggcgtgaggaggagggactcaggcaagtgggtgtgcgaggtgcgcgagcccaacaagaagtccaggatttggctcgggacctttcccacggcggagatggcggcgcgtgcgcacgacgtggcggcgctcgcgctgaggggaaggtccgcttgcctcaacttcgccgactccgcgtcgcgtctcccggtgccggcgacggcggaggccagggacattcagaaggcggcggcggaggccgcggaggcatttcgcccggggaaggatgatggtgcggtggtggcgacggcgacggagcgtgaagaagaagaagaaaaggttgtaccagagtatctgaggaacatggtgctcatgtcgccgacgcattgcttcgggagtgatgaatatggaagcgctgacgtggaattcgacgatgctgaagttcggttgtggagttactccatttaa

SEQ ID NO: 68848 - DNA, 2883 bp, Glycine max
  Peptide Sequence Number=SeqID_185626
atggattcctctgccaacaacaaagagaaagagaaagtgcaagtgcaacccacacccgaagaagaccccgagaagaaaaggaaaaaggaagaaaaggctagagagaagcaattgaagaaagagaagtttcttcagaagcaagctcagcaacaagcacagcaatcatccaatgcttctacttctaaaaagagtgaaaagaaagttgtgaagcgtggtggggagggtgagaatcctgaagattatgttgatcccgagactccatcgggtgagaagaagcgtatggctcggcaaatggccaagcaatatagtccaactgccgtggagaaatcgtggtatgagtggtgggaggaatcacagtattttgtggcagatgctaacagctccaaaccaccttttgtcattgttttgccccctccgaatgtgactggtgctctccatataggtcatgctctaacagccgcaatagaggatacaatgattcgatggcggagaatgtctggatacaatgccttgtgggtgcctggaatggatcatgctgggattgctacacaggtagttgtggagaaaaagctatttcgcgaaaaaaacctaaccaggcatgatctgggccgtgagaaatttgtctctgaggtttgggagtggaaacacaagtatgggggcacaatattacaacaattacgccgattaggagcctctttggattggtctcgtgagtgcttcacaatggatgaaagaagatctaaggctgtgacggaggcttttgtaaggctttacaaacaaggccttatctatagggatcttcgtttagtgaattgggattgtgttttacgaactgcaatatctgatattgaggtggattatttggaaataaaagaaaggagtctactaaaggttccgggatatgacaaaccagtggaatttggagttttaacaaagtttgcatatcctttggaagggaacctaggtgaaattgttgttgccacaactagaattgaaactatgcttggtgacactgctattgccgtacatcctaatgatgacagatatagccattttcatggaaaatatgctattcatccatttaatggtagaaaacttcctataatttgtgatgctattcttgttgatccaaagttcgggacaggtgctgttaagattacacctgcccatgatccaaatgattttgaggtgggaaaacgtcacaaccttgaattcattaatgttttcacggatgacggaaaaataaattccaatggtggctctgattttttgggcatgctgcggtttaaagctcgagaggcagtagcagaagcattacaaaagaaggacctttatagaggatctgaaaacaatgagatgcgccttggggtttgttcaagaagcaatgatgttgtggagcccatgataaaaccccagtggtatgtcaattgcaatgatttggcaaaacaagctcttcatgctgctgtggatgaggaaaacaaaaggatagagattattccaaaacaatatttggctgattggaagagatggctggaaaacatacgtgattggtgcatttcacgacagctatggtggggtcaccaaatacctgcatggtatgtcactttggaggatgatgttcttcgggaatttggtgcttataatgatcattgggtagtggcaaaaaatgaagaggaagctcagaaagaggctagccagaggtataatggaaagcagtttcatttaagccaggatcctgacgttcttgatacatggttttcttctggtctgttcccattatctgtgctgggatggcctgatgacacagaggacctgaagacattctatccaacttctgttctggaaactggccatgatatcctctttttctgggttgcccgaatggtgatgcaaggattgaagttgggtggtgatgtgccttttacgaagatttatttgcatcctatggttcgtgatgcacatggacgcaagatgtccaagtccttagggaatgttattgatcccattgaagtgataaatgggatatcacttgaaggtctacataagaggttagaggctggtaacctggaccccagagaactagccactgctttagagggtcagaagaaggactttccaaatggtattgatgaatgtggtgccgatgctctccgttttgcactggtctcgtacacagctcagtctgacaaaattaacctagatattcaaagggtggttgggtatcgccaatggtgtaataaactgtggaatgcagtacgatttgctatgagcaagcttggggatgattatatccctcctgctaatttgattccagaggttctcccatttagctgccagtggatactctcagtgttaaataaaaccatatccaagacagtgaattcacttgaatcatttgatttctcacaagctaccactgctgtgtattcttggtggcagtatcaattgtgtgatgtatttatcgaagtgattaagccttactttactggtaatgatcctaagtttgcttccaaaagacgctttgcacaagatactttgtggttttgtctggacaatggccttcgattgcttcatccctttatgccttttgtcacggaagaattatggcagcgccttccttcacccagggaatgtgagagagcagaatctatcatgatatgtgattatccatcaactgtagaggccttttgtgtgtttaaagtgccaatcatgaccggtgttattgatggtggatcatggcggaaggctgaaattttgccgtataaacatgccattgtgcctcatggtgccaccatggtggttctcccttcacaaattgcctatggcagttggcaaaaatctgccacgccattcggccatggtgctgccatgaccgctatttaa

SEQ ID NO: 68849 - DNA, 687 bp, Glycine max
  Peptide Sequence Number=SeqID_185627
atggatggcaactcttttggaaacgtgccacccccaccaatacaagttcctgataacttggctatctcctcctcctcttcgccaactcccacgacatcatctccgtctccgacaccctctggaggctttcggtaccgcgggacgcggtgccggagcggaaagtgggtgtcggagataagggagccacgtaaaacgaatcgcatttggctggggacttacccgacagcggaaatggctgcggcggcatatgatgtcgccgcactcgcgttgaagggtcccgacacgcccgtcaacttccctaattcgatactgtcgtaccctattcctgcttcattgtcctccacggacattcgcgccgcggctgcggccgcggcgcaggctaggatcgtgagggcgccgcaggagagtgaggaaacggtaaaccctgatgatggcgggcaagggttatcggagaggcgtgaggagtacattgatgaggatgagttgttgaacatgccgaatttgctcgatgaaatggccagaggaatgcaggagggctttataacgggattgtgggaatacttgtggtctcgtacaaaagaaaaatgctttgagtgtgtttgtgtttggtttgccctctttctggttgaagctgatttcggttttggtgactgctgggaaggttgcgttgcggtgtttatggaatga

SEQ ID NO: 68850 - DNA, 795 bp, Glycine max
  Peptide Sequence Number=SeqID_185628
atgcacatcttaacttcaatcggtacagatttcatttccagagctgggatcatgtatgctactgccaatgatgagcttggcaaacaactgcgttctaatatgttttccttgagtggcactggcttttttggagctgttggtcgtagcataaacctaggtggtcaaactgctttagcattacgattacttttggctactttttcatcgaagatctcttcagatattaatcgcccttttggtgatgagtttcgtgctgctcggaaagcttctgaggaaattggtgcacaaatagttttaggagatcggccaattgaaataacgcttcaaagagcatggaaggctatgaaatggactcagaaactaagtttagtgttatcaattattcgggggatagcatcttcatctaacagttctataaataagctcaaggaagcaagttcagatgatggtacatttcaactttatgagcaattgagtttttcatatccttctttattgccacctctcatacatgaacgagatacttatcttgcatggtcattgaagcggagcaaagctgtgaataacagtaaaaatgttgtgggtgtcattggaaaaggccatatgaacggtgtaatatatgcattgttatccgacacgggaaatttgaggtttcgagaccttgtagggaaaaattcatatgatggaggaggttcaaatggttggattgatgatctaatcaagagtttagtaagggacacaatcattggcatccttttatgggccttatatgaattcataaatggaggaacatga

SEQ ID NO: 68851 - DNA, 111 bp, Glycine max
  Peptide Sequence Number=SeqID_185629
atgagagaaaaatccatattagctcctagggatgaggttcgtggtcctaggttagagaaaaatccatattggattaaaagtgagaaaagccagcatctatcatgtctctaa

SEQ ID NO: 68852 - DNA, 3999 bp, Glycine max
  Peptide Sequence Number=SeqID_185630
atggcagagcacgccactcgccacaccaccagcgaccgcctcgaagaggccattatcacgcttgcggcaaaacattccgagctcgcctctagagttgacgccatgtgtgagcgtttctcttccgtacctccacatcaacacccatcttcatcctctcgaatgcaccagcgtccccccgttaagcttgatgtaccccgttttgatggccatgatccgctgggatggatctttaagatctcccagttcttcgattaccaggcaactcccgaagaagaccggattaccgttgcgtcattctaccttgacggcgccgcactcactctacttcatgcaatcgaaactcgattcgctccctccatttacgatgatcctcgcgacgctctattcaaactcgtccaacgtggttcagtcacagaatatatgaccgaattcgagaggttggctaatcgtattgttggtctttccctctccgatttgctaagttgctttatttcaggacttaaccctgaaataagaagggaagtacaagccttccagccggtgtcgctgccccacgccacttcccttgctcgtcttcaagaagacaagatcaatgatcgccggaaaaattcacgttctcatcaatcagtacctcaaaccacgccctcacaacccttctctctgccccaacaccctcgacccaaaaaccccttcatccaacgtactccagaagagatgatgcataggcgtgagaaaggcctatgctacaattgtgatgagaaatggtcgtcctctcatcgatgtaaaggacgcgttctcttgttcatcgcagactccgacgagcccttacttcccaacactaaacttgatgatacccttccgcaacctttaacggaaaccgcaccggcctacgaccccactccattccaaacccacatcagtttacatgctatggctggtgttccggccaccgataccttccgcttatacggtgttatcaatcatgcacgtgtcactattttgatagatagcgaaagtacacacaatttcatacaaccacgtgtcgcgaaattcctcggcctagccatggaagagacgacgaccttaagagtgatgctcattcaaagtcatcccttcacggttacactgcgcgttttgcctttaagtggcgccgacgtcgttttgggggttgagtggttacggaccctgggcccaattattactgattacaccgcctttacgatggcattcacctacatgggccaacccattactcttcacgcagacgtttcttcggataccaaccccacctcagcctaccaacttaaacggagcctccacacccactccatctcgggtttatttcacctgtccctgttacctgtaactcaacccgacttagacagcgaaccacctcaccccatttccgccattaacaccctcctcctcaaatatcaagttattttccaacaacccactaccttaccaccacctcgacagcatgatcaccacattaacctcattccctcagcactcccagtcaacgtaagaccgtataggtaccctcactcgcagaaaaacgaaattgagaaacaggtcacctccttactcgaatccgggttaatccaaccaagccgaagtccattctcctcaccagtcttattagtgaagaagaaagacggcacgtggcgcatgtgcgtcgactaccgggcgttgaatgcaatcacgggatttcaccagatcttgatggcagaagatgacgttcctaaaaccgcttttcgaacccacaacggccattttgagtacagggtgatgcctttcgggttatgcaacacaccctccacttttcaagcggccatgaatgcgttactcaaccctttcttgaggaaattcgcaacagcgttatcgcaggctcaatactatctaaagcgctcgaagtgctttatcggacaacgacaacttgactacttagggcacgtcgtctccgggaagggagtacagcctgacccttccaaggtccaggccattattgactggcctacccctcgctcctcgaaggatcttcgcagcttccttggcctcacaggcttctaccggaagttcgttagaggatacgcaggtttgacaacacctttgaccagattgctatgtaaagatgctttccaatggagttcggagtcccagtccaccttcgactctctaaaaaccgccatgaccacagctcccatcctcgccttacccaacttcaacctcccattcatacttgaaacagacgcttcgggtagtgccataggagcagtcctccaacaacatggccatcctatagcatacttcagcaagcctctttgccctcgacttcaacacgcttcagcttatgttcgagaactgcacgcgatcacggccgcagtgcgacggtggcggcaatatttgctaggccataggttcacgatatacacggaccatagaagccttagagaactaatgtctcaggtggttcagacacctgaacaacagttctacctagttaagcttctgggattcgactatgaaatccaatacaaagcagggtcttcgaacatagtcgcggattctctctctcgtattgactgttcttcccaagctcaatgcttaatcctctcggttccccatcatgagtttatgattcagttgaaagactcattgaaggccagcactgagtttcaacagcaacgcgaagctatacttgctcaccccgaacaatatcccgacttctccattttcgatgacctcatccttctccggggagtgatttggctagattccaagaatcccttcatacaatccctgttacacgagtaccatgcaacaccaatcggaggccattttggcattaagaaaaccctacaccgcctgcaatcaagcttccactggccttccatggcgaaggatgttcgagcattcatccggaattgcatcgtgtgtcagcaggtcaagcacctcacacgaaaacccgcgggcttactccaacccattcccattcccaacggcgtgtgggaagacctctccatggacttcgtcacacatctaccaagctcgcatggcttcacggcgatcctcgtggtagtcgatcggtttacaaagggagtacatctcagagctttacccacccaattcacagccttcaaagttgccaacctcttcatggatatggtatgcaaacttcacgggtttcctcggagtataatctccgaccgtgaccccgtcttcatcagctccttttggagagagctctttcgtttgcaggaagttatgaaccgcacggtagagcagtatctccggtcattcgtccaccaccggccgaaagaatggtacaaattccttgccttagctgaatggtcatataatacgtcacaacattccggtaccgagctcacgccgtatgaagccacttacggcaagccaccaccatctgttcctagttacgtcttgggaagttctaataacgacgcagcagcagtagtcacccaaacaagagtagaagttcacgcaacacttcaacgcaaactaatcaaggcccaagctacgatgaagcaatttgcagacaagcaacgacgagacgttcagtatgaggtagggcagttagtctatgttaaactacggccttatcatcaactttcagtacgacaggggcgctccaataagctcaccaaacgttattttggaccattctgcatattggaatgtatcggtcaggcgatccataatcaacctatcttaaagccactcactatccttgactcacgattagacacttccgtgtctccacctacccgctccgtactcgttcaatgggaaggcttgccacccgaagactcaacctgggagagctgggaggactttcgcggccatccccaccttgaggacaaggtgagtttcccaggggacggaaatgttagcaactccagttctacaacaatggaccgagaggcacgaccaagaagacaagcctcacgccccaagtacctcgaagactatgtatag

SEQ ID NO: 68853 - DNA, 1593 bp, Glycine max
  Peptide Sequence Number=SeqID_185631
atgtgtcatataagttcccagctcccctgcaaatgcaactcaatgaaatcccaagaggcagaggaatccgacatgaagatcactaaccccttgatccaaaaggacataacagtaacaccaccccatcatcatgtcttgaaagaactcatttccatatccaagatagccctccccatgatcctcaccggtctcttgctctactgccgttccatgatctccatgctcttcctcggccgcctcggcgagctggccttagccggcggctcactcgccgtcggcttcgccaacatcaccggttactcgatcctctccggcctcgctgtcggaatggaacccttttgcggacaagcctacggtgccaaaaagttcaccctcctcggcctctgcttacaaagaaccattcttttgctcctcttcacttccattccaatctctctcctttggctctacatgaagcatatccttcttttatgtggccaggacgaggccatagccacacaagcccaatcatatcttctttattccatccctgacctcttagcacaatcttttttacaccctttaagaatttaccttcgaagccaatccattactctgcctctcactctctgcgccactttctcaattctccttcacatccccattaactaccttcttgtttcccacctcaattggggaatcaaaggcgtggctctcagcggggtttggactaacttcaacctcatagcttctttgattctttacatagtcttctctggtacgcataagaaaacatggggaggtttttcttttgagtgtttcacgcaatggaaatcgctcctcgacttggctatcccaagctgcatttccgtgtgcctagaatggtggtggtatgagatcatgattttgttatgcgggttgttggtgaatcctagagcaaccgtggcttccatggggattttgatccaaaccacttctctgctctacattctcccatcgtcaataagcttcagcgtgtccacaagagttggtaacaaattaggtgctcaaaagccctcaaaggctaaactttctgccatagttggcctctcttgcagcttcatgttaggttttttagcttttgttttcaccattctggttaggaacatttgggccagcatgttcacacaagacaaggaaataataaccttgacctcattggtgttaccgattataggactctgcgaactcggaaactgtcctcaaacaacggggtgcggagtgctaagaggcacagcaaggcctaaagttggtgctaacattaacttaggttgtttctaccttgttggaatgcctgtggcggtttggcttggtttcttcgcagggcttgattttcaagggttgtggcttgggttacttgcggctcaggggtcttgtgcagtgaccatgttggtggttatgagtcaaacggattgggatgttgaggctctaagggcaaagaaactaaccagtgttgttgttgctgttgatgacagcaaagaggttggtgcagagaagccacccaaagctgaaatcaaggaagattctttattatcattagctgattcagaagaagataaacaatcgtgggtttaa

SEQ ID NO: 68854 - DNA, 701 bp, Glycine max
  Peptide Sequence Number=SeqID_185632
ctcgtccgcttgcgcgggcgccatgccggccaggcacgccaggccgatcgacagcgcggcgcaggtgcggagcagagggcgcgcgattcgcacgatcagtagccacccttcttgccggtgccggcatagacgaattcatattccaggtcgaacggctggaaccagtcgcccacgccggtttccttgtcgatgtggcggccgaagtggctcatcttgtcggcggtcggcggcaggatggtgtacttcagcttgtacttgcccgggccttccagcttgacgttctcgccgtagtgcgggccgtcgttggcgaccatgggcatgaaggtgcccttctgcacgttctggctgccgaccttctggatttcgtatttgacgaccaggtagggcatccattcgccttcgggaaagcccgtgggattgccggccgtggcgtggatgtcggcctcgaggtggatgtcggaatccttggcggggcgcatcatgcccggggggtccatttcgatcggctgcaggtagaccgcgccgatttccatgccgcccttttccacgggcttgccgatggggtattcagccgcttgggcggcggacacgctcaaagcgacaatggccagggccaaggctttcttcatcatgtgggtcatcctcgaagctcgattgaaacgacggatcctaaaaacataaacaagaaccgtttgcattaa

SEQ ID NO: 68855 - DNA, 342 bp, Glycine max
  Peptide Sequence Number=SeqID_185633
atgtacccaactgaagctatgtgcatgattgttcctatatataagatcgtcaacaagccaagagatcgaattgaccaatgtccaatatcattttgtttcatgagcaatactgatcaaattactacatgcattaaatgggattttgaagaagggaaaagtacagattccgaagctggaataatcccagaagagacagagcttgatgatgttaatggaccagatgtccattcgagcaaaaaccagtggctgaaaaacaaactaaggattccatcatttctctttcctgaaaatatccatcttttgagaaagcatagcaaacaagtggttataataattaattaa

SEQ ID NO: 68856 - DNA, 309 bp, Glycine max
  Peptide Sequence Number=SeqID_185634
atgagtaatgtcacggcgaagggttcgttattgcgtagaagcgacaaaaggttcagaaagaagcaggcccaaaatttactctcctcacgcgaaacacgtcagaggttagagttgcgctccgcctccgaatctaatgccttcaacaaatctttgtcgccttgccttttactatttacaccctttctgccaattgccaaagcctatttatttacactgttgggtttttcttcttactggaatggttttgcaccaaaggctcaacagcacgctccaactgcaaaaactttcatacttcctaaaaatttataa

SEQ ID NO: 68857 - DNA, 1158 bp, Glycine max
  Peptide Sequence Number=SeqID_185635
atgggtgcggtctgtgacctattaggtccacgttatggctgtgccttcctcatcatgctctcggccccaaccgtgttctgcatgtcctttgtgaaagatgctgcggggtacataatggttcggttcttgatagggttctccttggcaacgttcgtgtcatgccagtactggatgagcacgatgttcaacagtaagattatagggcttgcgaatggaactgctgcggggtgggggaacatgggtggtggagccactcagctcataatgcctttggtgtatgagcttatcagaagagctggggctactcccttcactgcttggaggatagccttctttgtaccgggtttcatgcatgtcatcatggggatccttgtcctaactctaggccaggacttgcctgatggaaaccttgcggccttgcagaagaagggtgtatggtatgccataacaaattacaggacatggatttttgccctcctctatgggtactcaatgggagttgaattgacaactgacaatgtcattgctgagtatttctatgacaggtttaatctgaagctgcacactgctggaatcattgctgcttcatttggaatggcaaacttagttgctcgaccctttggtggatatgcttctgatgttgcagccagattgggtttctgtatttggcttggccgagccaattctcttcctattgctattttggctatgatcctgttctctttaggagctcaagctgcatgtggtgcaacttttggcatcattcccttcatctcaagaaggtcattggggatcatatcaggtctcactggtgcaggtgggaactttgggtctggcctcacccaattggtcttcttttcaacatccaaattctccactgccacaggtctctccttgatgggtgtgatgatagtggcttgcactcttcctgtgagtgttgttcattttccacagtggggtagcatgttcctaccaccatcaaaagatgtcaacaaatccactgaagaattctattacacctctgaatggaatgaggaagagaggcagaaaggcttgcatcagcaaagtctcaagtttgctgagaatagccgatccgagagaggaaagcgagtggcttcagcaccaacacctccgaatgcaactcccactcatgtctag

SEQ ID NO: 68858 - DNA, 126 bp, Glycine max
  Peptide Sequence Number=SeqID_185636
atgatatctcagcgggcagcagtggacagcagacatgaggagcattacgggataagtggcaacaacgtaggtagtggctttctctcatgcagacaaaagttggccacggtaacgaagccaggctcg

SEQ ID NO: 68859 - DNA, 246 bp, Glycine max
  Peptide Sequence Number=SeqID_185637
atgaggatgaacgcaaagatggaaagaactaccaaatatatatcagaaattagcttggaagtagataggcttgctgggcaggtgtctgctcttgaatcaatacttagtaaaggtgggaaggtttcagaaatgaatgtgcttaatttgatcgatttgttgattaatcaactgcttaaattggatagcataatggttgatgaagatgttaaagagttcaagcgtatgttgaaactcaggatatgttaa

SEQ ID NO: 68860 - DNA, 765 bp, Glycine max
  Peptide Sequence Number=SeqID_185638
atatgtggcatggaagagctccttgaaatacccatcataaatgaccttactatgattttgggctccatatctcagtccaaggcagcaggagttgtagtcgatttcactgacccttcctctgtatatgacaacgtgaaacaggcaacagcatttggcatgaaaagcatagtttacgtgccccgaatcaaattagacacggtagctgcattatctgcattctgcgagaaggccagcatgggcgtcttggttgcaccaaccctttccataggatcaatattattgcaacaagctgcgatttcagcttctttccattacagcaacgtcgaaattgtggaatctagggccaatgcaaatgatcttccatcagcagatgcaaaccaaattgccaacaatctctccaacttgggtcaaatctataacagagaagacccttcaacagatgtcttggcaaggggtcaagtcctaggagatggaattcgtgtacacagcatggtccttccaggacttccttctagtacaacagttcacttctctggtccaggagaggtgtactctatcaagcatgatatcacagatgtgaagtgtctcatgccaggcttgctattagccattagaaaagtagtgcgcctcaaggtagccactcactcatatcaagtattcaagtctcagctattagtttctttatatcattctgcttcaatttttttgactgccactttatcatccttgcagaatttggtatatggcttggagaagttcatatga

SEQ ID NO: 68861 - DNA, 324 bp, Glycine max
  Peptide Sequence Number=SeqID_185639
atgacctgcctgaggctcgaccccgagaattcccacatcggagtgtggcagaagcgcgccggccagcattccgactccaactgggtcatgatggttcctcccctcggaaagaagggtggtgccaacgaaggaggtactggagatggttcttgttctaataatccctcttcgttctctaagtgcgatcctgccccgcaagtggtgagacaggagcttctaaggacagagatggacgaggaagagagaattgcgctacaaatgatagaagaactcctcggcaggaactgccccatcactagcccttctttcaacaacttatattaa

SEQ ID NO: 68862 - DNA, 270 bp, Glycine max
  Peptide Sequence Number=SeqID_185640
atggcaagtaaatatgctcaagaggcaaactgcagaacagttttaaataaatttcaggcaatagaagagtgtatcagaaaaacaacggacctggacctggagctggctggtgtcattgtccctgcaagtgttggcaaggaagtccagagggtggcaacatcatggaagaagcctctggtacagtcgggaccatggaacacgcacggtgcagaagtaaattcagcacatcaaagcagaaaaagaatgaaagggaaaaggattgaaaactga

SEQ ID NO: 68863 - DNA, 324 bp, Glycine max
  Peptide Sequence Number=SeqID_185641
atggccgacgatgactatgaggatatcgacatggggtacgaggatgagccaccagagcccgagattgaggaaggtgcagaggaagatttggagaacaaaaacgatgagttaactggagagcctattgacactgaggataaggaagaggaacaaccagtggagcggcctcgaaagacatcaaaatatatgactaagtatgagcgtgctaggattttaggtacccgtgctcttcaaatcagtatgaatgcacctgtcatggttgagttggagggggaaactgacccacttgaggtaatagaaccttttgttctctttgcagtttga

SEQ ID NO: 68864 - DNA, 2607 bp, Glycine max
  Peptide Sequence Number=SeqID_185642
atggatggggatcaaaacgagttgggtactgtgggtgaagggaatgttgatattggacctcagacgttgaataacttggacttgaatgtggagcagaactgttgcagctcaaatgttgctcacgctagtgacactcaatcctgtcatccttcttcagcaaatgtacttagcggtgatactgtattgggaattggtacggaatttgagtccgatgatcatgcataccaattctataacaagtatgccagattgttgggtttcaatgttagaaaagattggataaataggagtaaggtgcatggtcaagtggtgtctaggaagtttacttgctccaaagagggatatcgcaggaaagacaaaagagatgctaatgtgaagaaacataggaaggaaacgagatctggctgcttggcacatatgattgtcactcggcaaccagatggtaaataccaggtcacccattttgaagcacaacataatcatgacaatataaactctaactctaacagtgctaacatgttaaacttgcaaaatgaatttagtgttgctcaagctgtggaagctgactcaaacaatagtttgggacctaaatcaaagtcagcactagatgtgttgaataaaaaaacaagtgcccgtgaatctcttgatctactttcaatgaattatgataattaccttcattatgcgagggaaagagatatgaaggaaggagaagcagggcgtttgcttggttacttccaaaggcaacactttgaaaatccaacatttttttatgccatacagcttgatgttgatgacaaggttagcaatattttttgggctgatgacaatatggtggtggattatgaacattttggtgatgtaatttgtttggatacaacttgcagaacaaacaaagatcttcggccatttgtacagtttttaggtattaaccatcacagacaagtgttaatctttgctgctgcttttctgtatgacgattccattgaatcatataattggctatttcgaactttcattagtgcaatgtctgggaaaaagccaaagaccattctcacagaacaagaagctgtaattattgaagccatcaatacggttttatctcacacaaaccattgtacatgtgtatggcagttgtatgagaacactttgaaacacctcagccatgttgttaaagatgctgaatcttttgcaaacgatctaaggagaagtatttatgaccccaaggatgaggaagaatttactcatgcttgggaggctatgctggagaagtataatctccagcaaaatgaatggctgagatggatttatagagaaagagagaaatgggctgttgtctttggtcagaatacattttttgtagacatcaaaggctttcatttaggtgagattttgtctaaaaaatttagaaattatctaaatcctgaccttgatgtgcttcaattttttaagcattttgaaagggtagtagatgagcagcgttacaaagaaatagaagctagtgaggaaatgagcaggtgtttgccaaggctaatgggtaatgtggttttgttgaagcatgcaagtgatatttatactccaagaacatttgaagtatttcagcgagcatacgagaagtctttaaatgttcttgttaaccaacacagtagaaatggatcattgtttgagtacaaagcaaatacatttgggcatactagacaatacaatgtcaccttcaattcttctgatgacacagttgtctgcagttgtatgaagtttgagcgtgttggtattctgtgtagccatgcactaaaagttcttgatcatagaaacataaaagtagttccatctcggtacatcttggatagatggacaggacatgcaaggttgggaaatcttagggagattaggcaatgtaaaatgcaagataatcctaacatggttgtcacaagctgttacaaagatttgtgcaacagactgctcaagttatcagcaagagcctctgaatctatggaggcttatcagtttgccgcaaggcaacttgatgaagtgatgataggagtggagaaaatcttgacattaaaagttgagcaacgtcaagttatcacctcaagtaatattgatgcaaatgcttcagaaaatgagcctgcagagatctttctgaatggacattcaattgaggatcaggatgaaagtaacagagcaaatggaggaaaagacaggagagctacatcagataggggctatctaacaaccatgacttgtaatggagctgattctgataggattttgaatgtagaagtatctccaccaaataccgttgtatgcatttcaagcccctcgtctgcatatgtttcatctcattctgcaacaccaaatcccattctgcagggtttgtacggttttgaagccaatcaagtggttcactgcatgtatgaacagagtaatcgtgtgctcgaccatcaatctaattctaacaccttacaaccaccaaacatcttttctaaccaacaggattctcctggtcaatctcagctgctgcaggggatggatcttgacatccgaaatccacattcctcttcattcttgctgtatgaccatagatacagaagttccaagtctgcatga

SEQ ID NO: 68865 - DNA, 531 bp, Glycine max
  Peptide Sequence Number=SeqID_185643
atgtcatcaagatttggttggcatgggtatatgagagcagttgcacccacaatcacaagatcgacaaatgtatttgcccccagcatgtcattgtctcaaaaatatgaaacaaggtcattaaccctcaacaaattggatgatttggagaatgaggcttccattatcctttgtcaattagagatgtatttttcaccatcatttttttatatcatgattcacttaattgttcatcttgtacgggagattcgattgtatgggcccatctttttacgttggatgtatctggttgagcactacatgaagatgttgaaaggatatacaagaatcaatatcggccaaaggcaagaattgttgaaagatacattgctgaagaagctattgggttttgatcagagtatatgcaagccgttacaccagtcgaggttcctcaaagtcgacatgactacacacgggaaggtaggggtacacgaggattcaatgttgcaaccatggattgtcagtagctgtcacaagctcatctatatgtattaa

SEQ ID NO: 68866 - DNA, 684 bp, Glycine max
  Peptide Sequence Number=SeqID_185644
atgaaagatgattcgaaaaatgcattgtatatagagaatctgaccaaggaatatgtcactagctatgatgatgtaacacaaattctgattaagggcctttcaaacagaaaagttggagcaactagcttaaattctaagagctctagatcacatataattttcacttttgtgattgtatcttggtgtaaggaagaacttattagagcaaagcctaaggttcatagctcagatgggagtaaaaatggatacctccaagtacgcaatgtacgggacaaccttgataatgacactaatgaagaggaaaatatggacaaggaagacataagacaattatgccaacagattgatgaattgtgtcatagatcaatgagtaagctatgtcctgaggaaagtgagggatcaactaccaccttgtatgcatcagcagatgactttgcatgcacagctaatgcctcatggacaattaaatctgcattcagggatagctttttagttagctcatgtactcagtctccaatacttggagaaccacagttgcctgattctctaaaaatcaagaatgtccagaggaaaagcaatcatttaaagagggtgagcagatgtgatcgtcactacggtcaagcaaggtttttcaaggtcttaccgaatccttggcagcaagccttcagaggggattacagataa

SEQ ID NO: 68867 - DNA, 309 bp, Glycine max
  Peptide Sequence Number=SeqID_185645
atgggtaaaagaattggagaagatgataattatcatgtaagggtttctgccatgaagatgaagaaaatgaaagcaattgtgatgatgacggaggcaaggttttgcttcaagactatgagtgatgtagatgtcttggatgatggctacaagtggaggaaaattgaaaggctggtcgtgggcaacacaaagaatagattcttagtcagcttcgggaattggccaagtctgagctgttggaccttgaaccatatgtgtaatcggctggtgctgatgcttgatgatgggttatttgtttttccaaccatgtaa

SEQ ID NO: 68868 - DNA, 231 bp, Glycine max
  Peptide Sequence Number=SeqID_185646
atgggaacttatactgaagaaattgcagttagacattctacttctgcggttggggaaactcacacctatggtgacaatggagggaaaccatccatttctctcaagtctgaaaccctatcaactactcccaaagctgcagcatgtgagttaacaagccaagaaagagattctgcattattacggtacaagcagaagaagaaaacaaggaggacaagctttaacttctcctag

SEQ ID NO: 68869 - DNA, 225 bp, Glycine max
  Peptide Sequence Number=SeqID_185647
atgtacgctgtaatgcaaaatactccattagggttaagggtcgatggaggtgctcgagaatggatggttagggggcataatggcactgccagtggtactcaacgatggtgtattatggaaagggattcgttggagatggaggtgtggtggggggaagtgaatgcactagaagcaggaggggcaaacccagatctcaacgataagttaatgataaaatggatttga

SEQ ID NO: 68870 - DNA, 858 bp, Glycine max
  Peptide Sequence Number=SeqID_185648
atgtcttgctatggttctgatggagatagttctccacatgttcctcgcaagtctatgcttgcgaaggaggaagtcaaaagttcgagtgatgccggtgaccaacccaaggaaaaggcaacaaagactattgaaaccactactgctggtggcactaccgattcttccttgaaaacattgatcccttcaaaaccaaatattgagaagaccaccactggtggtggtgatgctaccaacttgggtggttcctacgacgtggagaatgatacttctacgcctctagtggtgccttcaaagaacaaggggaaacaaatccccctaaatggtgttgaactcatgcctaccaacaaattgcccaataggtttgatgtcaggatgatggatttcattggggtaaatgagagcatggatgcttcagatatgagagaaaaaaagatgattgaggctctcaatgagaagaatgaggtcatccccactaaacttggcatcattgagagccttgaacaaaaaattactgatcatgaaaagatggtcttcgttaagtgcatcaagaatgagaagttgttctctgatgtggagaacctgaaccagaagttcaacgaggctttaaaggatttagcagagagcaagaaaacgactattactttaaacgaacaacttatcattaaagagaacaagaagacaaccgtcatgcttgaggaggagaaagagaaggtgagtgctcaaaagacaactcttgatcaagtcttcatgatggggcaccaggatggtttccaaaaaccctataaccacctttgtggccacctctctctccataatatccgcacgattggaattgtttccctagatgaaatcgtttag

SEQ ID NO: 68871 - DNA, 423 bp, Glycine max
  Peptide Sequence Number=SeqID_185649
atggcgccggaatttcaagcctccggcgtggcgactcagaagtctgatatatacgcttttggagtggtgatgttggagcttttgtccggggaggagccgttgaagttcaagttcgacgagaagacgcgcacattcgtgaggacgtcggtgattgatgcggcgagggccgccgtggtcgacggcgaaggtagcgtggaggggaagctgaggaggtgggtggatcggagattgaaagattcttttcctgttgatgtagctgaaaaatggacacgtgtcgcgctggagtgtgtacacgtggatccagataagagaccgaacatgggacgcgtcgctggcaagatctccaagttttatttgacgtcgaggatctggtcagatagtattaagatgcctgatatgactgtttcgttgggacctcgatga

SEQ ID NO: 68872 - DNA, 867 bp, Glycine max
  Peptide Sequence Number=SeqID_185650
atgatagagacaaagaagcaattaccccatgggaggggtttggccaaagccattttcgaccatatttctcctcgtaacttgctctgtcatgcggagattcctatgcttcttttgctcactaataaacaagaagatgaaggatttgcatgcaaaagcacaaggcaagcaccatctccatcgctaacctccagctccaacctgagaatgaatattgcattgccatataggaatacaaatatatatgtaaatatacacctagctggtggccatggagttccgaaagaagatcctagcgtacgactccgcgaacactatggtggcgctggaggcgctcagcgccacaggggcatgctcatgagaggagccgcgaccaaagttggaactgccaatgacaatggcatacttggtattggcctcaccgaggtcgacgaagcgcatggggtaggtggcagggatgccagtgagggtgtaggagccaaacttctcgtactcgtcgggcttcgaagggacaagggtgaggtactctgcgggaatgatctggttggtgtcgatgttgtcgttgacgacataacaaaggttgtagaaggaggtgcacacgccagattgaacgtgtgtggtttggagagagatcgcaatgcagttgcgagggaagaacggttgccgaagcagagaacaatgccattgttcaatgctcagtgcctcatctctcaattgttttccctttcccttatgttcgtggttatttatgtagggtatccaaacgatggaatttatgtgcaagaacctaatggagaagatgaaagtggaagatgcagaaaccctagcacggcagaaacacaagaggttggtcttgagtacatagactga

SEQ ID NO: 68873 - DNA, 261 bp, Glycine max
  Peptide Sequence Number=SeqID_185651
atggaaaggagtgccagaatggatgatgcagatttcgggtcatccccagcatggaagtctaataatgtaaagtcatggatatggatgcagcaagcgatgcatactgaattgaatgacaacagctgtttccgaaagaaatgggtttgttgtgatcaccatgcagatgccatggaagcagctcataccactgaaaagtgtctcaataaaataaagatgaagagaaaagcagatcagaggtgcatgcagcaatatcagttatag

SEQ ID NO: 68874 - DNA, 825 bp, Glycine max
  Peptide Sequence Number=SeqID_185652
atgcacacaagcatgtgttgcattgtgaccaatgtcagaggatcgggagtatatcacgaaggaatgaaatgccccttcaaaatatcattgaggtggaagtctttgattgctggggtagagactattgctactccgaagaatgatgcaaagactgttgttaggttcctgaagaagaacatattttctcgctttggggtgccaagagtcttgattagtgatggaggttcacatttctacaatgttcaactgcaaaaagtattggggcactacaatgttacacataaggtagcatcgccttatcatcctcaaacaaatggtcaagatgagaccgcttttaaaactcccataggactattcccctttcaaatggtctatgggaaaacatgtcacttactagtagagatggaacacaaggcatattgggctctaaaatttcttgattttgatgaagtcctatctggggagaagaggaatctacaacttttagagctagaagagatgaggctcaatgcttatgaatcctccaagttgtacaagcagaagttgaaagcctaccatgacaagaagctgttgaagaagaatttccaaccaggccaaagagtttttctctttaattcaagactcaagctatttccaggtaaattgaagtacaaatggtttgtacctttcactatcaaggaggtgaagccccatggagcaatggaattgatggatccaaattcagatactcctgagagaagttgggtggtgaatggtcaaagattaaaattgtatcatggcaacgttgagaggctaaccaccatcctgcacttacaagacccttag

SEQ ID NO: 68875 - DNA, 525 bp, Glycine max
  Peptide Sequence Number=SeqID_185653
atggggttttcaccatattcacaaaacaaaaacttctctattctaactttcactttccttctcaagattgcgttatgcaacaccctcaacgacgatggaagctgtcagaaatccggcaccctgacctgtgcaaccggagagtacgatcagtaccagtgctctccgccggtatcttcctcgacggacgccatcctgacgcggaacgatttcaccgaaggcggcgacggaggggaccggtcgcagtgcgacgagcaattccacgacaactcggagctcgtggtggcactctccacggggtggttcgacaacgggtcacggtgtttgaagttgataacaatcaccgccgggaacgggaggagcgtgacggcgaaggtggtagaccagtgcgactccgtccacgggtgcgacaaggaacacgcggatcaacctccgtgccgtaacaacatcgtggatggttcacaggccgtgtgggacgcgctggggcttgactctggcgaagagcgcgttacttggtccatggcttga

SEQ ID NO: 68876 - DNA, 450 bp, Glycine max
  Peptide Sequence Number=SeqID_185654
atgcagggccagtacctggaccgtgaaaccggactgcactacaatctgtttcgttactacgacccggacagtgcccggtttacgcagcaggacccgatagggctggcgggtgggctgaacctgtaccagtatgcgccgaattcgttcagctggatagatcctctggggctgagtaagtgtggtgtagatcaggcgcgtaagcggcaacatgccatgctaaaaaattctaatgaaggatataacatcagccctaaatcttgggatgtatatccaactattggtagggatggctcatttatcagcgataagcaaggaataatgcagtatttctctcatgcagacgctcgccgtcagggatcagacagccctgttcaacctgcatggttaacttcttaccgaccccgaaccccgccacatgaagccgctacccccggtaaatccaagtggtag

SEQ ID NO: 68877 - DNA, 237 bp, Glycine max
  Peptide Sequence Number=SeqID_185655
atgtatattgttgtggtaaaacaggggcaggatcaccttgggctaccttctggagtggagacaaaacatgaacggcagaaaccaatcaaggtacttaaggatgaacgcaagcggggatggggtcacgaccgaccgatcgttgcccttctctgtgcgaaacaagcagggaatgtcgctgcaaggcagccccgtatcctttctattttgcagctttcttttactatttgtttgttttaa

SEQ ID NO: 68878 - DNA, 474 bp, Glycine max
  Peptide Sequence Number=SeqID_185656
atgcctttgacccgtgatgattcctttcacctcttcggaagcttgagctcactattgctgccctataaagcccctcaaaacttgttttggtcgtgttcttcctttcgggccttcttggtttctcattccaaggcttcatcggtggccatattgacgtcccttagttcatcatactctcttcagactttgatggctatggacttgaacttctctttgactacccgggctctttcaagctttgcctttagggcttatttgggagccaatcccaatccttgtgtccggattctcagccactttatgatagcctccgatgatcccattactgcttcccctaagctctctgtcctttcttcacgccgcatcctatgcccttgcgaaactccttggagtaccctcgcgttgtggtcactgaaaccccgtgcgatgaaaggcgtgatgctttcgtctgatggcacttctctcatggggtag

SEQ ID NO: 68879 - DNA, 519 bp, Glycine max
  Peptide Sequence Number=SeqID_185657
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgagtcaggaacaacgaatccctttatgataaacagattcattttgcaagttcgttattacgggtagttcctacaaaggatcggactaatgacgtataccatacttga

SEQ ID NO: 68880 - DNA, 812 bp, Glycine max
  Peptide Sequence Number=SeqID_185658
ggctacacaccctcgtcgtcagaggactacagctacagacccttagaggactacacgtcctaaccttgagaaggccatacgccctcgccttaaaaggactacgcatcctcaccttcagaggactacacttcctcgcctttagaaagctacacctcctcaccttcagaggactacacgttctcgccttcaaaggactacacatcctcgctgtcagaggactacacgtccttgccttcaatggagtacatgtcctcgccttcagaggactacatgtcctcggcatcagagggctacacgtcctcaccttcagagggctacacgtcctcgcattcagaggactagacgcccttagctcagaggactacacagggctacacatcctcgccttgagagggctacacgccctcgccttcaaaggactacacgtcctcacgttcagaggactacacgtcctcgccttaaaaggactacacgtcctcaccatcagagggctacacgtccttgccttcaaattgctacacgtcctcaccttcagaggactacaagtcctcgccttcagaggactacacgtcctcaccttcagaggactacaaatcctcgccttcacaggagtacacgtcttcgccattaaagggctacacatcctcgcctttagagggctacacgtcctcacctttagaggactacatgatgcactcctccctaggaagggatcagtcactagaaccatgagcaagaggctccaagaagattgggctagagttgttgaagaaggccctagggttctcatgaacctcagggtagatttctga

SEQ ID NO: 68881 - DNA, 578 bp, Glycine max
  Peptide Sequence Number=SeqID_185659
agactcaacataaggatgcacaggccaaagttgagtatgtgaaaagattgtatgaccaagtgaaggtgcaaattgcaaagaagaatgaaagctatgccaagcaagccaacaagaaaaggaagaaagtgatacttgacctggcccaagtggaaaaggacaaagcccccgagtggagaaggatgaaggcccaagtggagaaggatgaaggcctagagcttctctctgggttccttgttgaaccaatctcaaacttatcaaggatcacatcacctaacatattccataggactactaagctggaggagaccttgacacagtttatgcaggtaaaaatatcaaatcataaaagcactgagtcagcactaaagaaccttgaggttcaagtgggacaactagccaagcagatagctgacaattcatccaacagttttgtggaaaatatagaacagaatcccaaggaggaatgcaaagttgtgatgaaaaggagtaaaaggtttgtggaggctgaggatgaggatagtgttgtgcataagaagaaaactgctgacaaaaaaagtattgatggcaagaaaaatgag

SEQ ID NO: 68882 - DNA, 276 bp, Glycine max
  Peptide Sequence Number=SeqID_185660
actcatcttctccttgaagtggcgtctcctctctctcttcctttctccattccgctgccattcatcttccaagaagcaaaggaatccattgatgaagaagatcctaggcctacaagctccaatggagcttgcatcaacaaagggtaccaagtatctcgaagcggccaatcaaaggtagccataacccctgctaggtttcctcaactccattcttccgaggatatgactcgaacggaatgtgtgcttatcatggaggagcctcggggcatccattga

SEQ ID NO: 68883 - DNA, 420 bp, Glycine max
  Peptide Sequence Number=SeqID_185661
atgggcctctgtcggccctacagggcgcccgttccccccagcaagttcatttcgtcgtggcatagggattgtgcctgcaagacacctagtggacccgaagaaggccaacagggtcttggagttgccagctctaaatacgggtctctgtcagttctagggagtgcctgttgcccccagcaaggtcatcaggtcccccctaccaatcgagctttcatcaagaagttctgcgtctctaggcaggcgcagggcgaaacaccacagcagcctggggatggccggcagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 68884 - DNA, 339 bp, Glycine max
  Peptide Sequence Number=SeqID_185662
atggggtccttttggaacaatttctggcatggtgctcttttctacgtgggctgcatgcattttggatgcaaaacgcaagttcgaatgtcgacttcgtgggcagaagacacgtggaagcccaacccgccagtgctgctggcgacttcacgtggaagcgtgtcccgccagctttgctggcgacttcatccctgtgctgaaatcgcagctttgactggcgatttccgaggctaccaggctagggtgcaggacgcacagaagccatttccgagggagctgcagactgcagctgcagggcgcagagaagcagggaatcaccagtttgactggcgattttgctga

SEQ ID NO: 68885 - DNA, 445 bp, Glycine max
  Peptide Sequence Number=SeqID_185663
ggggtacgttgggagccaacttggaaagcgagaccttcgtggaggccgtaaaggtgaaaagacgcgtggaggaatattctaccctaccatctgcgtcatgaaatcgtttgggtttcctcaatggtccccctttatccgatacccttatgaccaaaagaatgaagagagatctccatggtctacagagaccgctgagagtaccatccactctctttcgggtctagacacttcggtgagtctattgactcaggctcccctggtagactatcgcaatctaccgaggctggcgctgtctgccaccgataggtggcccctcagtctgaagactcaccttattagaactttatttggtaagtctgttggagattgtttagatgcaatcttcagcagatctatgaagtaccctttcttcgctcagttcgaggtgtcgtattctttagagtag

SEQ ID NO: 68886 - DNA, 213 bp, Glycine max
  Peptide Sequence Number=SeqID_185664
atgggctcagaagtctaccctgaggttcatgagaaccctagggccttcttcagcagctctagtccaatcctcttcgagcctcttgctcatgcctctagtgattggtcccttcctagggaggattgcatcattacccaaggttttcagaaattttacggaagcattacggaagtcccggaaaccatttttcaacaaaacgtggagtttgcttag

SEQ ID NO: 68887 - DNA, 372 bp, Glycine max
  Peptide Sequence Number=SeqID_185665
atgacgcgcaacggcttcctcacgacatggcccgtaatgcttcaggccttagagtcgcgtttcgctccatcattttatgacaattcgcatggcacactcttcaagcttcatcaacacagcacggtcaatgactatttgatcgagtttgaacggctggccaactgtatcgttggtctcgctctgttgtttctccttagttgcttcatctcgggtctcaatcctgagttgtgttgccaggtgcaagccctccaacccatatctcttctagaggctatgccctcgctaagctttaagaagacaagcttaacaactgctgcaagggatcccgttacctatttccctcgactaaatcttcgatctcagcatcgttag

SEQ ID NO: 68888 - DNA, 351 bp, Glycine max
  Peptide Sequence Number=SeqID_185666
atgggtttggacaaagttacgggttcttccatcatccacgagaataaggacgtgatggttgctgatgttcctgctcagttgatgggttctccgctgcaaggaacattggggttggtcaaagctaacgatgctgagatcgaagatttagtcgagggaaatagatatgggttggagggcttgcacctggcaacacaactcaggattgagacccgagatgaagcaactaaggagaaacaacagagcgagaccaacgatacagttggccagccgttcaaactcgatcaaatagtcattgaccgtgctgtgttgatgaagcttgaagagtgtgccatgcgaattgtcataaaatga

SEQ ID NO: 68889 - DNA, 228 bp, Glycine max
  Peptide Sequence Number=SeqID_185667
atggctaggcctaaaacaaaaaaaggggtggatggttgggttggaatcagggcaaggcgacccaacccaacccgtgattacgcagtagggttggaaaactgtagttgcctcacacagaaaacgaagcggccaatgcggaaaccaccacggagggtggcgtgctgcctgtggcaccactggtggaaagtccagtggcgtgaggccatcacaggaccggcagcgatatga

SEQ ID NO: 68890 - DNA, 288 bp, Glycine max
  Peptide Sequence Number=SeqID_185668
atgagagacaatgccatcaaattcatccatattattagcattgtgactgttgtttacaggtcatatagtgctcaatggaatgccccaaaactcccctatgataagcacatgtcacattcaagttgtatcctcagggaaatgaaggggtggtgtttggtcttggatgtgcagcgggtggattttgtggtggcctttgtggtagggtggggggtaatgggcaagactgatattggcttagtagtgatattgctggggaggatattggtacatgggattataaggggctag

SEQ ID NO: 68891 - DNA, 585 bp, Glycine max
  Peptide Sequence Number=SeqID_185669
atggagacatatggattgccttatgttcatatcatggctgcgttgatgcgtcttaacattgatgagttgcctagttgcttggtgttggagagatggactatagctgtgaaagaccgttttgttggcatgataatagatgatgctagtttttggaactctcatgtcattgctagatatgtatggatgctaaatgcatgcagggagttttgtactttggcctgtcaaagtgccaatgattttgtcgagggtagaaacaaaagtagaaaagaaatacaaaatttgaaatacaagaatggaatagaggttggcactggttgggtggaaagatgtgtaggtggtttgcaagatcctacatatgtaagaaccaaaggtagtggttgtaaaaaatcacgtgtttcaaagttgagaataaagaggatagtcaagtgcagtgcctgcaagctacctgggcacaataagttggcttgcacaacagtgaataagccagatgcaatagatgacaatgttttagcaagttgttcttttgatggagaggacaatgcttctccaatggcaggggatttcaatgttgatgttatagggtaa

SEQ ID NO: 68892 - DNA, 723 bp, Glycine max
  Peptide Sequence Number=SeqID_185670
atggtgtccacagaatgctatccacaggattatgtcaatggttactttcaagtagatggctgggactttgcacagccacgccggttgcctcagtgtgggtatagtaagaactccgccgtgtgggtgttgatcgaagtggctggatatgctggaaggcttcattccacatatagtaccattggtatggttgttaggatgaggattgcgctatcattgcttaaatactctcataattcaaaacggcatgtcattgagaaggagtcacacaaagtcaggaaggtaagttggtctgttgcttgtcctcttgggcctagtttgattactatcaacacccccttcctgaaaaatctccttgtccttaagggcatatgcagcacacaattcttcctagtcctcccaagtggattcttctgggataatctcatccattggaccaacaccaatttggtgggagggcaattgtccctattccatttccaatctagcattgtgagagtagcgatacaagaaacacggggtgaatcttggatgattccaatagttgcaagcggattggcgataaggacgaagcctaaggtacacccagccacctatggaatatgggatgtcacaacggtgagtgtctgtagagttcttcatagcgctgtcatatgggcgtccacaacctccacggtcggtgtaccctacaagtattggggaatggatggtggaggtttcccatag

SEQ ID NO: 68893 - DNA, 108 bp, Glycine max
  Peptide Sequence Number=SeqID_185671
atgttgaaagtgcaggttactacatcggtgctggcgagaaatgatgttgaaagcacaggcctaaggcaattgcctaactcacctagctatataaacgactctgagtag

SEQ ID NO: 68894 - DNA, 186 bp, Glycine max
  Peptide Sequence Number=SeqID_185672
atgtcacttgacttcacgggtcaggatgacaaaggtgcagaagatgatgttactgttgggtgtctccatatgccactagactcttgggtcacggtaacaaaaggtggggtggtcgagaaaagcaaggttgttgctcttacatatcctcaatttgtgatgaggaactcaaacctacgtagttcttga

SEQ ID NO: 68895 - DNA, 234 bp, Glycine max
  Peptide Sequence Number=SeqID_185673
caagcgctggatgcaggtgccaaaagtattttgctggataacttcacgttgaacgacttgcgccaggcggtggttatcaaccagaaacgtgctttgctggaagcatcaggcaatgtggatttaacgacagtccgtgcgattgccgaaactggcgtcgacaggatttcgattggcgcgctgactaagcacatacaggcggtggatttgagtatgcggattcagatgaggttgtag

SEQ ID NO: 68896 - DNA, 383 bp, Glycine max
  Peptide Sequence Number=SeqID_185674
cacagtatcaatcagcagccttctctggatacgcgtctcaaggatgtgaacaaagttttcaaccagtagggttctcatcatatatgcctcaatactcatttcaagtcccttttatctcaaatgtttttggtggcccctcacaaatgtttgccaccactttcaacactccaccatctgcatgtaatctaccaccatcgacttcttgttatcgtccatcattacctactcaaatgcgtgacatgggtcatgaagatgaggaggatgatgatgataacaacaataacgatgatgatgatgacaacggtgaacaagaggaggtagaagttgtagaccaagaagacaacaaacataggcaaatccagtctaacaagatgagagactaa

SEQ ID NO: 68897 - DNA, 453 bp, Glycine max
  Peptide Sequence Number=SeqID_185675
atggacatgaacataggagctcttatttctggccagatgacttctatagcccaatctaactcttctagacttgggtttcttgctctgatcaccaccctatgtcgagccagaggggttatctctgacaacctcacttttgagcgcctgagcctgatcattaacttggcctacatcaggaagaactattggaatcctgatgatctgacagttgctatacgaggggctaggagggcgagggcgaggccagctgatcttccttccacatctgtagctcctactccagcatccacttcagcatctccttcagtcccagctcagatggattctcagcgctttgaagccatgcttcagagcattcatcagggacaaatcattttacttcagagtttacaggtggtggcgcctccaagatccattccttcaattgagcagtttctggagagggtagcctag

SEQ ID NO: 68898 - DNA, 3087 bp, Glycine max
  Peptide Sequence Number=SeqID_185676
atggtgggcgacggtggcgtcatccattgtgactgccgctaccctcaggtctccatcaccattcaggggcaccaattcaccactgatcttttcgggttacccttaagtggggctgacctagtacttggggtccagtggttacgggccttgggccctgttactactgattacaccgccctttcaatgtcttttacacatttgggcctccccatcaaactctttgcagacgtcctgctaggtcctgcttcttcctccccaatcactaattcccccaccttacttctagccacagaaccaccaccccctgcccttacccctcttctgaccaaattccgccacctcttccaggagccatcccaattacccccagcccgacccatttcccaccatattcacctcactccagatgccaaaccagtcaccgttaagccttatcgttacccacatagccaaaaaaccgaactcgagaagcaagtccagactatgctagattccagtttgattcgactgagccatagccccttctcatcccccgtcctcctcattaaaaaaaaggatggcagctggcgctgttgtatcgattatcgcgcccttaactccataaccatcaagcacagttttcccatgcccaccattgacgagcttcttgacgagcttggtgcggcctcgtgtttctccaagttggacttgcgccagggatttcaccaaatccgtagggcagaggaggacatccacaaaaccgccttccgcactcattccggccactatgaatactgcgttatgcccttcgggctgtgtaacgccccggcaacgttccaagcaaccatgaatgaaatgctcaaaccctttttacgcaagttcgttgcggtgttttttgatgacatattggtctacagctcatcttgggacgatcatcttcttcatctcgaggctgtcttctccgccctggcccgtgattccttctacctccgcgagtccaaatgcgtctttgctaagccccgacttcagtatttgggccacattctctcttccaaaggagtttccccagatccttccaaaatttcggctatcctcgattggccaacccccactactaccactgctctccgtggtttccttggtctgaccagcttctatcgccgtttcatccgaggttatgccccattggccgccccactgaacgcattactccgtaaagacagcttcctttggactgaagattcccaacgcgccttcgacacactcaaacaggtaatgacctcggcccccgttcttatcccgccggatttcacgattccgttttgcttagaaacagatgcttctggagtcgccgtcggcgcggttctatcccaacatgctcatccaatcacgttttttagcaagactctctgccccaggctgcaacgttcctctacctatgtccgggaactccatgccatcacctccgtcgtccgtaaatggcgtcactacctcctcggccatcctttcactattattactgaccatcagagcctgaaggacctgatgaatcaagtaatccagactcccgaacaacagcagtatctggttaagaccatccaataccgggctggctccgacaatgcagcagcagatgctctttctcgggtcacccccgccggccaatgcctgattctctcgattccccttctcgattgtatggctgatatccaccattcaatgcagcaatccccagcttaccacgaattacttgccacactccaccaacaaccagaggcccaccctgactattccatcacttccggccaaattcactttcgcggcaagctttggctgccccccgacaacccattcatccccatgctccttgaagaattccactccaccccactgggtggacacatgggcgaaaagaaaacgctgatttgccagcaaattaaatacaaggcccgtaaacccgctggcctgctccaacctctgccaattccctctgtcctgtgggaagatttgtcgcctgatttcatcaccggcctcccgccgtcacacggcttcaccgccatcctagtggtcgtcgaccgctattccaagggtacccacctcggcgcacttcccccaaagtactctgctcacaagacccgatctttctcagttcattctggcgcgaattatttcgcattagtggcaccaaactccggtatagcaccgcgtaccaccctgaatctgacggccagacggaggtccttaatcgaactctggagcagtacctctgttcgttcgttaatgacaagcctgccctctggcacgccttccttctggcacgccttccttcctttggccgaatggagctataacacttccactcacttcggtaccggcctctccccgtacgagatcacgtacggcaagccacccccagcctttccaccatatacaacaggcacctcgccggtggaagctgcagactccatcttgtccacccgacaagctctacacactaagttacaaagtcgtctattgaaagcgcagatggcaatgaagaaccatgctgaccgccaccgtcgggatgtccatctccagccaggtgacttggtctatgtccgcctcaaaccatatcggcaactctccatgcgcccccactactccaagcttgccaagaggttctatggtccttatccgatcacagaatgtgtcgggcctatggcctatcgcctacaactcccagcggattccaaaatccaccctattttccatgtgtccctcttaaaaccccatcacggcccgcctccgcctgtggatgaccccgttccacctacacaggtcgatcatcacccactcgtcgagcccctctccttccttgattggaaattcgacaccaccaaggacccaccttcgcactcggtcctggttcaatggcgtggcctcgcgccgaaggacacttcgtggaaggactgggacgctcttcgatcagtttacaacctcggggacgaggttgtgtttccaagggaggttgttgttagcaacaagacacagattagcagagaagcacccaccaaggacaggcccaagagaaatatcaagaagccagcccactttcaggattacatttga

SEQ ID NO: 68899 - DNA, 405 bp, Glycine max
  Peptide Sequence Number=SeqID_185677
atgcctagatgcatctctcatgcacttatccggccaaatcaaggattctatgggcgtttgggtgatgttgatatcttaaaagccgagttcatgggtcttcttcaggggcccaaaatagcttgggacatgcactactccaatataatttgtgtgactaattcggcccttgctatgaagcttattcaacagccccttcaaccttgccatgcatatgccacgttaattgctaatatcaaggatttccaacggaaagaatggagcttggagttttgtccctccctaagagaagggaaccaatgtgcggatttcctatctaagagaggccttcatggcaatgtttttctagttattgttgacgttccccctcatgatatggttgagctttggctactacgcctttcttaa

SEQ ID NO: 68900 - DNA, 665 bp, Glycine max
  Peptide Sequence Number=SeqID_185678
agtctttagatgaagatgatagtgttgatggtatatctgatacagatgatgaagtcacccacatgattgaaccagttacaattgttcaaccaagagaaggaaaatatgttgcgttgcaaatttgtgatgacgaagatgttgaaattatgatcgaaagttttcaagaacaagaacaaatgtcagttatagaattgtacatagaaaaggatgctattagtggttctacatttcattttgcaaattctattagatcatgtagaaataatgagtcgaaactgccaagaaattctttagatgaacatgatagtgttgatggtatatctgatacagatgataaaatcacccacatgattgaaccggttacaattgttcaaccaaaagaaggtgtagaaggaattcaaaatccattttggaatgatgttttgcattataacaatatcaattggagtcatcctgatgaggaggacatttgcggtttggagatgtcatcgagttttaatgttgggcaagaattatatattacttactccacacaatggtggtctcttaggaatgaagcgacaattcctccttctgatgactcatggacacttattcttgatccaagtataattcgtgcgaaaggtcagtcaaaatcaacaaggataaggaatgagatggattga

SEQ ID NO: 68901 - DNA, 591 bp, Glycine max
  Peptide Sequence Number=SeqID_185679
atgttatttgatgacaggatgcttccaaaatattctgtcactgccacgttgcagtgtgcaggtaatcgaaggactgctatgagcaagatcaaaacagtaaagggagttggctgggatgtttctgctattggaaatggaagtctaagttctggtatgagaaggggggaggggatgccaacatctatttggggtggtgccaaattgtctgatgttctagaacttgttggaattccaaagttgactagtgtcactcgatttggtggaagacatgtggaatttataagcgttgataagtgcaaggaggaaaatgggggtccatacaaggcttcaataccactcagtcaggccacaaatcctgaagcagatgttctactagcttatgaaatgaatggtgaacctcttaacagggatcatgggtatccattacgtgtggttgttcctagtgtcattggggcccggtctgttaaatggctggaagatatcaatatcattgcagaagaatgccaggactacaaaatgtttccaccatcagtgaattgggataatattgattggtcaacccggagaccgcaaatggatttcccagttcag

SEQ ID NO: 68902 - DNA, 411 bp, Glycine max
  Peptide Sequence Number=SeqID_185680
gaacctttcaatgcggagccaccgcgtgctgcgttggttgcctcttatgtcaccccttccgatttcttctacaacaggaaccacggccctatccccattgttgaagacatcaacaggtccctttctttctttctctttaaccttctttgctgtgctttaaaaccttgtgggtttaagtttgactcgttttgcgatgcgtttgcttgcttggaacagatactccgtgaccgtgtctggtttggtggagcgtcccaaacagctcttcatgaaagatatctggttttaaattgccgtcatggtcgtggtcgtggtttcctactttccttatatggtgggaaattacatacaaatgtggctgatgcagccacaattgcagttgtattgtggttgcagaaacttcaaaaactttga

SEQ ID NO: 68903 - DNA, 1075 bp, Glycine max
  Peptide Sequence Number=SeqID_185681
atgacccttcgctcagcaaataggtacaactcatcattcttccagattcttcctcgcgctcagccgaggagtgttgtgctacctcgcctcggatatgccactgaggggcaagcagttggtggtgtacccctgccaaacactttggagggccctcagtttcacccacaaccacaacccttgcatcttgcggcgaggagaatccctcctgctatggcggaaaagggaaagttggatcatatggaggaaaggctcaaggccattgaaggaggcggagatcatgcttttgctgacatgtcagagttgtacctagtgcctgacattgtcatccctctgaagttcaaggggactgcttgtcccaagaaccatctaaggatgtactgtcggaagatgagggcatacgcgaaagatgaaaaattgttgatgcattttttccaagaaagccttactgaggcagccgtcacctggtatactaacttggaaccttcccgagtccattcttggaaggacctaatggttgccttcgttaggctatatcagtataattctgataaggctctagatagaatgcaactacagaacatgtgcaaaaaagagcatgaatctttcaaagaatacgcccaaaggtggagggatctattagctcaagtagcgcccccaatgacagagaaagagatgatcacaatgatagtagacacgttaccggtgttctactatgagaaaatggtgggttacacaccttcaaggtttgcggatttagttttcgtcggcgaaaggatcgaagtgggtctgaaaaaaggaaaatttgatcatcctgctttgataaatgagaaacctggggcaaatagagaggaagagaaggaggaaggaacccatgtcgtgactgtcattcctacatggccaaaattcccactagcacaacaattggtagtcataaccccaaccaaggttcctcaaccaccatttttccaaggatacaactcgaatacaacatgtgattatcatggaggagttctagggcattccattgagcattgtatgaccctgaagcacaaggtgcaaagtctaattgatgcgg

SEQ ID NO: 68904 - DNA, 324 bp, Glycine max
  Peptide Sequence Number=SeqID_185682
atggatcccaaggaggaaaaaggagccaacaacgttgcgccatttggatctgcagctagagatggaggaggggtctctcagttttgcaacccatggcgctccaccgcaccttcccacaactgtcatcgccaggctagccctcaccacggcagtctcccgctgccaagccctgcacccagtggcgttagggcctgtaccaccctccatggtggtgccacacgttgtgtcgtcaaggtgttgctgttgcacctatggttttccaacctttttgctgacttgtgggttgggttgagccgctctgacctaatttcaaccctagcctaa

SEQ ID NO: 68905 - DNA, 180 bp, Glycine max
  Peptide Sequence Number=SeqID_185683
atggaggccatgaagaggcaaatgacaacaatgatggaagcaatgatgagcatgaggaagatgatggacccgactcacacacctgatttcaatcaagagaaccatccagtcttagacatgggaggtcaaggaggagcgacaacggctaatgcatatgagcttcattgtgtccaagtctag

SEQ ID NO: 68906 - DNA, 321 bp, Glycine max
  Peptide Sequence Number=SeqID_185684
atggagtacttactcccttgttaccattttcaagatccaatgttgaccacaccgttgaatcccccgttcttcattgatgcgagacgtggtgggagcatgacgatacgcttaatgagattgcttctagggtttcttccttgtcatatcatacctgagccttgggtatcaccctgggtagacttggtgaatcttgtgtttgaggatgaaggtgaggatgtggaggaggatacatctatcaaggaggatctatttatggatgaggaggatcccgtcacgaagttggagctgatggaggaggactcttctgatgagtcttactag

SEQ ID NO: 68907 - DNA, 1632 bp, Glycine max
  Peptide Sequence Number=SeqID_185685
atgctaaggaaaattgagccattcctatgggatgaagcctatgaacaagccttcttgtccttcaagaagacaattgccacatctccagtcctatgtcaatccaagctagtagtacctctactcatatacctctcagtagatgacaaggccattagcttaaccctcatacaaaaggaagggaaacaccagcttcctatctatttcaccagctgcatccttcacgatgttgagaagcgataccagatgatcaagaaggtagtactgcctgaactgacaggaaggatggtagtatggtccgtagaagtgtcagagtttaatcttcagtatgaacctcaagaccccatgaagacacaattcatgacagattttctcgcaaaatttgttggcaatgaccaaaccaccccagactggtggaacctctacatggacagtgcgtcctacatgaagggaagtggggcaggtattatcctcaaaggccttaacaacgtcactttagggcaaggtctcaagcttaactttaaagcctcaaacaatcaagccgagtacgagacacttacagtaggcctaaaactagcaaaagaagttagggccaagaagctaaggtgctacaccgactcacagcttgtccaagggcaaggagagcaacacagagcaaacctgttctccaagttggctatcacaaaaaagactaggcatctcaataccaacatccaagagacactccaagcttccaccatagacaccaagaaggttatggcaggaaaagaagaggaaccagactacatgacctcctacaagaattttctaattcaggggagagggttgacaacacccttgctcaaatgcctgaacaaccaacaagcaaattatgtcatacgagaacttcatgaagtgatctacggtctctatactagaggacgctcccttgcaaccaaagtggtgcgtgccagctactattggccgacacttagggccaacaccctcgacttcacaaaaaggtgcaggcaatgccaagaattcgtagatgttacacgtacccctcatgacaatctctatagcttgagctccccttgtcattttgccatgcggggaatggacatattgggactactaccaaaagccctaggagcggtggaggaagcaactagagttatcctcaaggccttgtgcaccagactcaacaagtccaagggtgaagctagaaaagattcccgagcaggaaagcttggacccaactgggaaggcccattcagggtcatagcaagcctagataatggaccatacaagctacatgaacctgatggcccgcccttggtaagcctcgacaaaatccaggacagacgtgtccctggtcgcatttccaaaggcttgtcaaacccaaggtctacccttggtgagtctcacttctccaaaggctcgtcaaacccaaggtttgcccttgctgagtctcttatctccaaaggctcgtcaaacccaaggtccacacttggtgggtctcgcttctataaaggctcatcaaacccaaggtccgcccttgttgagtctcacttcttgaaaggctcgacaaacccaaggacaacccttggtgagcctcaccaaaaccctggacaaacacgtccttggtctaccctt

SEQ ID NO: 68908 - DNA, 1794 bp, Glycine max
  Peptide Sequence Number=SeqID_185686
atggagggtgtgagaattgcaggtctgttaagcttgtcaagccccctagcctgggcaggtgttgtccgggatgcatttgctaagttgtccaagaatgcattgaagataggcgtttcattttgtcttttgttgtgggcaagtgcagcgcacacgcgttactcttgcatacgtgtcactcatggagtacgtacaccctcttccacagtgtctttcatttccaactctgccaagggcataggcggtagtgaccctggggtttcgattcagcaacccctggtgaactgggggggtctggaggaggagacttgccatgggacttctaacagtgagtccacttcctcgaagaggatagtgggcgagcgtatgttggaggaggtacttatcgcctccgttgcagggactggtggtggggacgttaaggcttccccccgtgtacggcataaccatagtgttggatcgccctcatccccttctatcgtcattggctatgagtgggtatgggacaatgtgttgaaatatcggtcctccattacctccatggagaacgttgctactttgcaacctcaactaaggttagcaaaccccgaggactccagcaggataaccgtccaggcttacaggagtgacgatttcccttttttgagggtggtgtcaggtaatctgcctttctttttcatgtacaaatgtctctttgaggactgtttcttcaaggtcatagctactgacgttatggctaataggttgccactattgttcaaccaggatggggaaccccgcttcctgttttattggcaatcaaacgctactaggttcaagtcttttgacaaggatttgttgaccctagtggagaaggttgacaaggctatcttagagcaactaccacctcgtcggatgcataggacattttgtctcttcattcggcagacgatcctctcgctgccttggacgggttcaccttcaactccatcggtcgtccaagctactactcctgctcctactattgttgttgctcatgctcctccgaccctttcttcccttcctattctagggtttatgcttctcttgttgttgcgtgtgacgaccatgagtgctccagaaatgtcgccttcttcttttttagctccgttagttccctccccaactatgttggcatcagcatcgccttcctcctcttttcaccctaagcagaaaacccttattggctttgtgtcttcttttgataaaaatcttattcagtcagttggggttcagaatgcaactgattctacaaaagtcttcctccaaagaagtctggtgattctggaggaaaatggacaatggtaccaggaagctctaagcaaggtggcatccttagaggttgagattgccaagtggaggaccactactcagactatttggagagtggagcatcccaaggtggccaacaccactgtctccttttccgaagctgttagaatgaattggtggacaagatggagagcactacgtagaaaagatgagcttgccaaggtggttgctgacctccaggcctggttgagggagtcggagtccaagctggaggagtctgagcagagggtgtcaaagaagagagaggccaacaaagagtttgaagaggagttgttggtgtacaagaaggaagccattgagcagcatgaaaaaggctttcataagatcatcaggcaagctaagatcttcgccaaggatcttgacttgggtttttttgacccattcaaggatgtgaaggatagtgaactgcttgacaaagaggaaatagatgctattatgaaggaggat

SEQ ID NO: 68909 - DNA, 369 bp, Glycine max
  Peptide Sequence Number=SeqID_185687
atggtttttcacttaaggcttgtagtgagcttcaaaacaaggaaagggaaacaaggctcgaaaggactatcaaaggaattaattcaagagaaggcaaggatttcaattcacaaaatgccaagaaactcctatttcgaaaacaattacccatttcctgtacataacccaaaattcaaagagaaacatgcaatgctgtacacaaagaagaactccctaagtcatggcgggagagaagtcaggtggagtaaggaagtctctttcaccactgcgtccactaaagaagggtttgtgaggaatggcttaagtcggtgtccattgaccttgaagctcttgtttatggagtcgcttttgatctcaactgtaccgtaa

SEQ ID NO: 68910 - DNA, 210 bp, Glycine max
  Peptide Sequence Number=SeqID_185688
atgacattgaaatatttttatctgccacttcaaattttaaaagatttgtttcaaaataaggatattgatacgggtacagggtatgaagaagaagatgctgaggaagaagaagatcagagttcagctcaagagaagaaaaagggggtgcaaggagaagaaaagcccaaaagaagaattgttaagcccagctacttaaaggactacgtttaa

SEQ ID NO: 68911 - DNA, 369 bp, Glycine max
  Peptide Sequence Number=SeqID_185689
atggctacaccacccaactctcctcctcctcttcttgagtcagcagcacatttgctgtctacgccgaagaagacaagaaaagcaacacagcttagatcattggctactagactagttgaggcggagagaccaatggttcatgtggatcctgccactgggaatgtcgttgatctccacagaaagaaattaagaatgtatttggggatcgttactcgccataaggtggatgttacaattgataattggaaacaagtccatgcagctcaaaaggatttgatctgggaggatattcaggttgaatttgatattcctgaagcatccaatttgagaatgaagaaaaaaatatttcagactgtaggagagaggtag

SEQ ID NO: 68912 - DNA, 801 bp, Glycine max
  Peptide Sequence Number=SeqID_185690
tcgagtctggagccccgcgaattgatcgcctagcgctgttcgccaattctccattctccacttttattcggagccccacgaattcattgcctagcgctgttcatgcgtcctacaccttcgagtctggagccctgcgaattgattgcctagcgctattcgccaattctccattctccacttttattcagagccccatgaattcattgtctagcactgttcatgcatcctccaccaacgagtctggaggcccgcgaattgattgcctagcgttgttcgccagttctccattctccacttttattctgagccccatgaatttattgcctagcgctgttcatgtgtcctccaccttcgagtctggagccctgcgaattgattgcctagcgctgttcgccaattctccattctccacttttattcgcagccccatgaattcattgcctagcgctgttcatgcgtcctccaccaacgagtctggagccgcgcgaattgattgcctagcgctattcgccaattctccattctccacttttattcggagccccatgaattcattgcctagcgctgttcatgtgtcctccaccttcgagtctggagtcccgcaaattgattgcctagcgctgttcgccagttcttcattctccacttttattcggagccccatgaatttattgcctagcgctgttcatgtgtcctccaccttcgagtctggagccccgcgaattcattgcctggcgaagttcgccaattctccattctccacttttattcggagccccatgaattcattgcctagcgctg

SEQ ID NO: 68913 - DNA, 252 bp, Glycine max
  Peptide Sequence Number=SeqID_185691
atggttcaagaaggcattatgctgggacacaagatttctaaaaggggaattaaggtagataaatcaaaaattgatgttattgataaatttcctcctttagtgaatgttaaaggtgttgtgttagggcagagaaagggaagaatttttcataccatttactatgccagaaaagtgttgaacgatgctcagatcaattatgccattactgaaaaagagatgttggcaatcgtttatgaacttgagaaattctga

SEQ ID NO: 68914 - DNA, 935 bp, Glycine max
  Peptide Sequence Number=SeqID_185692
atgtcgcctacacgcttgtttttcacaggtaatccaggtgaaaaagtaacaaagacagtcacgcttcaaaacagctccgataaggattatgtttttaatctcaactataaagattgggttagagaagaagacggaaataaggtttatcttgaagcaggcagttcaaaaacttccaatgcatcctggatatctactttagaaaatactgtaacagttcctgcaaaaagtacaaaggaaattgtagtaaccatgcagattcctgcaaatgcatcaaagtcttccgtcacaaacagtatgttgtttttcacccaacttcctcagcaggctgataaggcacgtattcagaatggtattggtattatcaccttatttgaggtggggctccacatcttttatactccaccgggtaaccacgtaaaaagtttggatattaccaatatttcagaagcgagtaatgagaatgcagcgaacagaaaagtcgcagtaagtatccataatgatggaaacaccatcaatgatgccaccgttgagtttgaactcaccaatacagacagtggtaaggaaataaaattacccgcaatttccatctctatgcttcccgataccaatcaggtcgttcaattttccttgccagagaacatttcagggaacttccttggcgtggaaaagaaggatattcaaatccattttgaaaatgacagcgtagctgttgagaaaggttctacttttagcaatttcctggttattgagaataaaagttctgaagagattaccattcagaatattatacccaaggaaaaatatcctggattgcttttctatcctaaaaatgattttatcttaggtgcgggccagtctaaaaatcttcctgtgaaactgctcgccaacgtggattttatgaaacttcggtccaatgagatccaattccagatttc

SEQ ID NO: 68915 - DNA, 306 bp, Glycine max
  Peptide Sequence Number=SeqID_185693
atggtcattctgcacccttttgtcatccagaggcggcgggccccgatgacatgtggagacaaattatggtcattccgcacccctttgccattcagacacagtcgtgtccgatggtacgcagagacaaattatggtcattctgcacccttttgtcatccagaggcggcgggcccgatgacatgcggagacaaaatatggtcattccgcatccctttgccattcagacacagttgtgtccgatggcacgcagagacaaattatggtcattctgcacccttcgtcgatcgcggccgacaagcccgttga

SEQ ID NO: 68916 - DNA, 822 bp, Glycine max
  Peptide Sequence Number=SeqID_185694
atggcgcacctcgccaaagctgccgtactggccgctccagcgcaccgcgccgcgctcgtcggtcacttccagcggcgcgccgttcagatcggtgttaaaccagtaaatctcaccgctgttctggtcacgaagatgatccacccgcgccagcgggctccaggcttcattcgggtcgtagatataggtgttgcacagcccgctctcctgctgctcctgcagcaggcggtagccctgccacaggaagcgcgtttcggtggtgccgtgcgtcgtagtgacgattttacgcgtgcggcggcccagcgcgtcgtagtgatagcgcgcctcaaaccgcccttccgggccggttccgcgggcggataccaaccggttctcggcgtcatacgcataatggtgttcatacagcccgttgcggcggctgaccaggttgccccagtggtcgtatttcataaacagcgcctgccagtgctgcaggcggttatccgtgaccggtaccgcatcatcattggcggcgaggttatccgcggcgtcatagctgaactgcgcgcggctgtgcccctgtcgggcctcgtagtgcttcagcagacgaccttcggcgtcgtagccgtaatctacctcaccgcgcagggtgtcgctgacgccggaaagctcaccgcgcgcggtgtagcgatagaggcgttccaggagcgccttctccggcagggtcacgtccgtgctcagctcacttgcgctgcagggtgcgtctgccgaggctgtcatactgacggagctgctcgcgcgcgccctgggtgcggcgcacctcgcggtgcaggcggtcgcgggtga

SEQ ID NO: 68917 - DNA, 393 bp, Glycine max
  Peptide Sequence Number=SeqID_185695
gttcaacattcaatttcgagcgtctcgatatatgacgtgactcaatcagacaaccgagtaaaaagttattgtcgtttgaattggctcagagcttcaacattcaaattcgagcgtctcgatatgatacaggactcaatcaatcatccgagtaaaaagttattgtcgtttgaattggctcagagcttccacattcaatttcgagcgtctcaatatattacgggactcaatcagacatccgaaggttcaacattcaatttcgagcgtcccgatatgttaagtgactgtatcggacatccgagtaaaaagttattgtccgttgaattggctcagaggttcaacattcaatttcgagcgtctcaatatattacgggactcaatcagacatccgagtaa

SEQ ID NO: 68918 - DNA, 219 bp, Glycine max
  Peptide Sequence Number=SeqID_185696
atgacggatatccctggtgagggaaatagagtgggtgaccttgacactggccgcctagttttcctaagtgacagtgtcctgtggacatgcttaggatatttcctaatggatggcaccacattgtgtcgcaacctaccctatgacgggcgtgcgggcgaaaagcaaaagtgcgtcttccaaaaagaaaacgcatggaagtcgccaccaacgtttatttaa

SEQ ID NO: 68919 - DNA, 243 bp, Glycine max
  Peptide Sequence Number=SeqID_185697
atgacgtttttccaattggactacaaagctcaaaacgcacaagtgactaatgctctcagaaacggaagagtcgcgcagactccagccatcttttcaaagatcccgatgctccagacaaaatttcgagaagatccaacggttaacgaaggctggacagcgtttttaacgagacagatacatgtagcttccttgagaagcttcattaagaggcttcctcgagtctttggaaatgtgcaagactaa

SEQ ID NO: 68920 - DNA, 1593 bp, Glycine max
  Peptide Sequence Number=SeqID_185698
atgccgaagccggagcgggaaattttccgtcgccgcatgcaggaagccatcgcgctggtgtggaaagccgaaggctggcatccggccgacgccgcgtttgacgccaccagtcaggcacacagcctgcggccggtaccggatgtgcagatggagtgggatgaagccacctgcggtcagatggtgtggctgtttaacgaaacccaggtgaattttgccggtcgcgcggaagatttcttcagcagcatggcgcgcccggatcgcccgcgcgaagcggatgagctgccgggcaaaagcctgcgcatcgcctcgattgatatcggcggcggcaccaccgacctcgccatcacccagtatcgtctggatgatggtcagggcaacaacgtgaaaatcaccccgcgcctgctgttccgggaagggtttaaagtggccggcgatgacattctgctggacgtgattcagctgtggatcctgcccgcgctacagcagagtctgcaaaaagccggcctggcgctggcggaaccgctgatgaacaagctgtttggacacgacagccgcatggacggccaggccacgctgcgccagcaggtcaccctgcagctgtttattccgctggcgcaggcggtgctggagcgctatgaaaactggaatccgctcgacagccacagcgaaattaacgcgctgtttggcgagctggtgccgcaaaagccagccagcagcgtgctggcgtttgtcaacggagagattcagcgcacgctcggcggcgacagccgtttcgatctgcttgacgtgccgctggtggtgagcatggcgcagttgcatgctgagttcctgcagcaccggatggcgattatcccggcgctgcgcgccatgtgcgaagtggtttccctctatcagtgcgatgtgctgctgctgaccggtcgcccgtcgcgcttcccgggcattcaggcgctggtgcgtcatttgcagccgctgccgggcagccgcattttgtcgctggaggggtatcacaccagcgactggtatccgttcaacaaacagggacgcattgataacccgaaatccaccgcggcggtcggtgccatgctgtgtctgctggcactcgatctgcgtctcagcagcttctggttccgcgccggcgattttgaaccctactcgaccattcgctaccttggcgtgctggatgaaaacgccacgctgagcgatgacaatctgtgctacagcgagattgatctcgacagccacagcttcgcgctggaccgtaaaagcagcttccgcattcgcggtaacgtctgcctcggtttccgccagctggagaacgaccgctggccggcgacaccgctctacagcctgagcattaccgatccgcagctggcgcgccaggtagcgggcgaaagcgtgctgcgcatcaggctggcggtacaaccgggcccggataacctcggcccggagcggctggtgctgagcgaggcgcgcatggacgatggcacgcgcgtgccgctggagcaactgagtctgaaactgaatacgctgtcggccaccggcaacgccaatgcgcaatactggatcgacagcgggagcgtgtgtaaacgatga

SEQ ID NO: 68921 - DNA, 291 bp, Glycine max
  Peptide Sequence Number=SeqID_185699
atgcaggcagaagaaagcacgaaagcacaaaggcacaagcacaagacaagctttggtgtaaagcacaacaagcgcgctaagcgcacttccaagaattcaaaaatagtaagggattggcgcttagcgcatcctacaactaagcccaactatgaaagctcaattccagaattgatctggggcttagctcaggacagcgcgcttagcgctgctacaataaatttttccagagaagaagtggcgcttagcgcatcatctccgttaagcccactgcttgaagtttacttccaatga

SEQ ID NO: 68922 - DNA, 182 bp, Glycine max
  Peptide Sequence Number=SeqID_185700
gggttgagggtgtcacagtaagtctaccattccctcataaagttaagaatgaccagcgagatgtgcaatttagaaaattccttgaggttatgagaaaaatgcacatcaacctccctttcattgaggctatttcacagatgccatcttatgtgaagcatttgaaagaaatgttatcaaactaa

SEQ ID NO: 68923 - DNA, 285 bp, Glycine max
  Peptide Sequence Number=SeqID_185701
atgttgggtgcacctagcaatagccccctacttaatatgggcctaggaccaaggttagctgttcattttcccatatggcttctttttctccaattttcaacaattatattcaagggaaatgaaacaccggaaaacgcaccgagtcatcaacctaaaatactaaacctcgatccctcattcttctgtcgcactaagcgcgctaaagttgcacttagcgttggatgcacgctaagctcaaatggtgagctgagcgcaactgctccctttagcacttcaagattttag

SEQ ID NO: 68924 - DNA, 1015 bp, Glycine max
  Peptide Sequence Number=SeqID_185702
atggataagagcttgaaggtaggagaagatgagtggagggagaaggagggaaggagcacaaaatttgatgccacaaatgaggatactcaccgtggtacctctttggagagggtgggggtttcatgccgtactggtggggcacttctcgacctcgcaggtagtaacggtggagatgtcagggtgtctccttgcatgcaacgtagcattgggtcgccatcgtctccacctgccattgctggctatgagtgggtgagggacaacgttctaaagtacaagtcctctctcacttttgcggcttgtgggagtgatgacttccctttcttgagggcggcatcgggcagtctgcccttcttctttaagtataagtgtctgtttgagatcttggatcttattctcccattgaacgcttttcaatgtgctctgcttgagcacttgaatgtgcccgcttctcaactccacctaaatagttggacaatggtctccttgaatatcatatccaagaagttgtttgacttcgactcaaacatctttcaccactttaaggaccatttctttaaggtcctgggtattgatgtcacgactgatggtttgccactaatgttcaatagggacgaggagccttgcttcccgttctattggcagtctaaccttactaggttcaagtcatttgacgagaatttgtttacccttgtggatagggtcaacaaagctattttggagcagttaccggcctcgctggatgcacgggccattttgtctcttccctcaacgagcgatccccttgctgccttggacggtattatgggtgacttcacttggaggccactcgtgaagcaagtagaacctgctgttgaggttggccctgttgttgttgtcgttgacatcacctctagtgccacttcctctgttttggcaaagaggaaacgagatgatggtgttgggttgtctggccgtaaaaagtcgaaggcctccatgagccttcgtgtcttgaggcaagctacaaggttgatgcccg

SEQ ID NO: 68925 - DNA, 216 bp, Glycine max
  Peptide Sequence Number=SeqID_185703
atgttctccagtgtcgggtgtggtaaccttgacaggctaagtttgacgtgtcagacgtgtgcggcgcacgcgcaatactcttgcatacgtgtcactcgtggagtggacacgtattggagtcgtggtgcatgggtcagtgggggtgcatcgtggtgcaaaaatttagggcaccacttctacacccgccagttaccgaaaaattcatctcccttttaa

SEQ ID NO: 68926 - DNA, 906 bp, Glycine max
  Peptide Sequence Number=SeqID_185704
atggctgccatttcagctagtcctgtcgtggttccgtcgtccaccatcattgcacccttgttgagtgtcagtgtggcgactgttggtgctcctgtaatgtcgcctccttcttcttcggctccatcggttccaccttttgctgtgatggcatcatgttactctttttctcgcccccgtgtttcattagatcacctgtacacctccagtgatgctgattcattatggggtgcaagttataggcgggagcagaagaccctggatggctttgtgtcaacctttgacaaaaatttgattctattggctggggtgcagaacgctatggattctaccaaagtggtgtcctttgaggcagaggtcgccaaatggagggctactgctcacactatttggagagtggagcgccctaaggtagccaatgccaccattgccttcactaaagccatatggtcaaaccgccaactatcttccaaagttggcggtgcattagccaagttgctacgtactaggttggatggtgatgaattgttcaaacattgcaaggacttgcaggttgagaaaaaggacctggctggcaaggtggaaggcattgcggtggagagggacaaacttgcgaagatggttgttgatttagatgcccagcttaaggagtcggagtctaggttggaggagttcaagcttcgggctactagggagagaaaggccaacaaggaacttgaggatgaacgactcgtatacaagaaggaggttgtggagcagcatgaaaagaggttcaacaaggccgtcaagcatcttgggttcttcgccaaggaccttgacttgggtctctttgacctttgcaaggatgtgaaggacggtgttctctttgacaaggaggaaattactgcagaggagaaggttgttgattag

SEQ ID NO: 68927 - DNA, 393 bp, Glycine max
  Peptide Sequence Number=SeqID_185705
atgctaccaaatgatataaaaggtagcgctagcactcatcacctcagcccgatgactcagaccctacttccagagtcatcatgtggtaatcaaaatgaactaccccatcaagcagaattcgctagaaacgacacaaccaccccaaactggtggaaccttttcgttgatagtgcatccaatgtaaaaggaagcagggcaagaatcattctcgaaggcccttacaatatctccctagagcaagccctcaagctcaacttcagagcctcaaacaaccaggcagagtacgaggtgttcattgcaagtctgaagctagcaacaaaaattggggctaaaaagctacaatgttacatagattcacatcttgtccagggacaggttgccaacagatattag

SEQ ID NO: 68928 - DNA, 264 bp, Glycine max
  Peptide Sequence Number=SeqID_185706
atggatgatcatctagagaatatgattcgtgatattggatcaaagtcttttcagcaagcacatgtgtatgatactttgaaaagtgatgtggaaatccctttgtatctagggtgcactagtttcacaaggaatgaatttaaagcgatgcccaagtgccttatgtgtggggtatcaggttgcaaattgaaggatgaggattgtagtagtgatgaggtaataaagggtattcctgcaaaggtgttacaatatctttcaataatttga

SEQ ID NO: 68929 - DNA, 483 bp, Glycine max
  Peptide Sequence Number=SeqID_185707
atggaacttagtaacaaaaagggctcaccaagggtgaaccttggatttatcgagccttggaccagggacatgtttgccttgagttttgacaagcctatggagctacgtcgaggcttggatgatgacaaaaagcccgagagaatgatttcaagattgagtcaacaattcaagaatcaagagaagtttgatttcaagattcaagaaaagatgaattcaagttccaagagaagaaatcaagaagacttcacaagggaaggtacatcctttgtggtacaagtagagggtacatctacttgggttgttgtgactgagaacaagagagggtacatctcttgtggatcagttcaagtggagggtacatacacttggttgttcaaagagaacaagggagggtacatcccttgtggatctttgcttgtaaaggtttttacaagattgaaaagaaatctcaaggaccgcaggtcacttggggactgggtgtag

SEQ ID NO: 68930 - DNA, 1380 bp, Glycine max
  Peptide Sequence Number=SeqID_185708
atgacttcgttagctactgagagatataggagtaggggtactcctggccagggtcggatcaaaactggcggtgcgactatgtacgatagtacatttgtcggggttggcttcaatcccccggtgagtgatcatgaagccggggaacttgcctctgcctaccccgaaagtacattttttagggttgaggcacatatcagtatagttggtgcacattcaccattttccattggcatttttgaccatgacgacgttcgcaagccaagtggagtacctgacttctctgataaaatggcaagtttgtcgcagataatgctaggatggattcctagcatgtcagatggatgccaagcaaacaaattcgcacttttgtgtagcaccttgacgagctctttgatgggtcttgggcctttgtcagaggtgtcatctcgcggatctatatcgaaatcatcgtcctcgcttgcctggctccctagtgggaggataaggtgctaccttcaggttctctacatagcactgtcgtgtttgcttttggtctgccttgacatttacaatctcctcggtcagggtagggaatttcattttcaaaggcggcgtggagactatggccctaagctcgttaagcgtgtccacgtagcctctggtctctactctctcgcctataaagccaaggagtggactgtcgtaaggatggacagtgtcaggggagaccttaagtctttggaaagtttttcaatacaagatattagtggaattgtcctagtcgatgacgaccttggacaccatgaagtttgcaatgatgatggagacaaccactgggtcattctggttaacggggttgatacccttgaagtccctatccgtgaaagtgataagagggagacttcgttgcgatggtgtattgaaaaaattgatgttgatgtcccgaatggcgtgaagattgtgctttcgggactggctggactgttctccttaggaaaatctgcccataatggtgttgattacacctctgatttgctgggggggttccttcctgttcttatggaggttgtctctcacaccgctgttgctggtctcgttcttgcttggtggttgtccgaccttttgacaaactgggctagcactcgtacttggacccttttggaagaggctaacgcttgtctagcttatgtctcttgtccgacttgtgtaagtcggtcttggtgtttactccttgcttgttgtgcttttgtccgactcatatctggacattttctttcactggatgagcatggaatgcaatgctacctctgggttaagttttcagatctggacggtgatgcgcccaaatctatccatgaagtttttgagagactcgattgtcgtctgcttgtcacagactga

SEQ ID NO: 68931 - DNA, 246 bp, Glycine max
  Peptide Sequence Number=SeqID_185709
atggcgtatgggaggtcgtacctacagatgaagtgttttcaattggtggcgactagtaagtatttgactgctcttggggcctttggcagtggtcccagtatgtctatccccaacatggcaaagggccaagaggagctcagatttaggagattgtcaggaggggtgcatggaatgtttgaaaacttttggcatcgtttgcacttcctggtaaagtcgagggcgtctgcccttagtgttggccattag

SEQ ID NO: 68932 - DNA, 357 bp, Glycine max
  Peptide Sequence Number=SeqID_185710
atggcgatgacggaggtcagggagaacaagatgggaaagcatggctggtgggtcgggtccttactcaaggatttttcaacacaaagtcttcatgaccactatggaacacatatggagagtgaagagggaatcccatggagtttttacatgaatatggtcgttctaaacaatgaggccaaatgtggtggcaagggacacatgcctaatgcacaagaccctatgggagaaaggggtacattgacggacagggtgacagaagttgtgcagtgtttggagagctactatattaatattttatcaaaagggaaagatgtagtagcaggggaggcccccacaacacatagcaaaaaaggttga

SEQ ID NO: 68933 - DNA, 969 bp, Glycine max
  Peptide Sequence Number=SeqID_185711
atggaagggtatagttacacctggtcaaacaagcaaatataccccgatatggtggaggagaagttggatagggtttttgccaacaagccttggtgtcaaggagctaggagagagagcagaaggaaaagggagaaactttaccactttaaaaaggaccagaagcatgagttggaactggatgtcttgttgataaaagatgagaagatatgggagcaatgttcaagggctttgtggctgaaaagtggagataagaatacaaatttcttccacaaacacttggtagatgatattgaacaaattgaggaagtgatatatgatttctatgccaatctattcaagacctcagacccacaaaatatggatgagatagcatatttggttgggggaggagcacataccatatcacacatcttattcgcaaatgacaacattgtctttggaagaccaattgtggaggaggcaaaagaaatatcttttatccttaatagagttaatcagcttgtccaacttctgaatgttaaggcagtagagaatcatgatagggacttgggcctccctaccattgtgggtagatcaaagactcgaaagtttaattttttggagatggcagccagagcttgtcataatgccttacgggttaggaaaagtttgttgagaagaggcatgccattggaccctacttgtcctagggaggagtcccattttgtagtttggatgagcaacttcctattagttagtgataatgagagtgcaaccttggtgtttgagattttatacaatacatggagttgctgccatctgctggtctttgagaggaagagtatacccattccccagctcctctctagagccatctccatgcattctcaagaggagacaatcgttactaagaccactgctagacccaccatatggaagtctccacctgatggaaatttgatgcctcggtttagtttggggaaggaacta

SEQ ID NO: 68934 - DNA, 408 bp, Glycine max
  Peptide Sequence Number=SeqID_185712
atggcaaccaaaaaacatgaaagggaacttatgagactccatcaacatgaagagaatgatataaagagaaaaggaatagcactcagagcctcatcatcttctattcaagaagaaagtgacaaagaggacttgactgaaatagaagaagatgatgatgatttcagattctttgtgaaaaggttcaataaatttctgagaaacaaaacaaataaaagggaatcaaacatcaatacaaagaagaaagaagaagattcctccttagccccaaaatgctatgaaagtgatcaacctgggcacatgagattcaattgtcttgtctttaaaagaagaatgaaaaatccgacaagaggaatctcaaagaaaagaaagaaaagaaaggatacatcacttgggaagataatgtcataa

SEQ ID NO: 68935 - DNA, 279 bp, Glycine max
  Peptide Sequence Number=SeqID_185713
atgattgatgtaaacacaactttgaggaaggtgtcttcagttgcaaatttcatttggtcaaattctcctctggagatccttggtttagtcacttccataacctttaccgatccagctgattcactaatcaaggatcatgacctaactagtgaagaggtaaaatctctctatgatgatttaagggttttggggaagcaagacttcaagcaggcaaaaccttttattttgtttttgatttttgttcttcagttatgtataaatttttgcctgttttactaa

SEQ ID NO: 68936 - DNA, 453 bp, Glycine max
  Peptide Sequence Number=SeqID_185714
atgaccgtgagttgtgatttgtctttacttgtcactattccaaatcgaataacagttttggtcaagaagattgagtgggaagagaggagcagcaaggttgcgtcagaatttataataagactgggaaatgcaagggacaagaatttagtcagattgttggggttttgccacaacccgcatctagtctatcttttgtatgattacttgcctaatgggaacttggctgagaaaatggaaatgaaatgggattgggctgcaaaattcagaacagtagttggaattgctagaggactttgcttccttcaccatgaatgttacccagctatacctcatggtgacttgaaggccagcaacattgtatttgatgaaaatatggaaccccatttggcagaatttgggttcaagcaagtattgaggtggagcaaaggctcatcacccaccacaaataaatag

SEQ ID NO: 68937 - DNA, 1071 bp, Glycine max
  Peptide Sequence Number=SeqID_185715
atggaagggaatcatgagaaggaggaaaccctcccaccaggatttcggtttcatccgaccgatgaagaactcatctcttactatcttacaaacaagatttcagattctaattttacaggcaaagcaatagctgatgtagatctcaacaaatgtgagccatgggagcttccggagaaggcgaaaatgggacaaaaagaatggtacttcttcagtctaagagatcgtaagtacccaacgggtgttagaaccaaccgagccacgaacacagggtactggaaaaccacaggaaaagacaaagagatcctcaacagtgctacatcggagttggttggtatgaagaagactttggttttctacaaaggcagggctcccagaggagagaaaagcaactgggtcatgcatgaataccgcattcattcaaaatccagcagcttcagaaccaacaaggatgaatgggtggtttgcagggtattccgcaagagtgctggtgcaaaaaagttcccctcttccagccacatcagagcattgaatctgaatccttttagtctggaagttggccctagcattatgccaccaccaccaatgatgcaccttgcagaccctgctgctgctgctcatttcctttatggaagaaactacatgatgaacccttcagaggtagctgaagtgactagggttttgagaggtggtggacccacaaatgtgaatgtgatgaacatgaacttaccaatgcaatactctcatttgaacaacccagtagcaggaggaggaggagaagggtttactatttctggccttaatttgaatctgggaggaacagttgctactaccaccgcacaagcacaacaatcccttttgaggccaatgatgccaccaccacagccatctcctgctcacacaattgcccaagtgcatcatgacttcagttccaacatggtgacacccaatattgctcttgctgctgacaatgtagggtatggtggagaagtggccagtgcaaattctcatggcaataggtacatgggcatggaccattgcatggatcttgacaattactggccttcctactaa

SEQ ID NO: 68938 - DNA, 294 bp, Glycine max
  Peptide Sequence Number=SeqID_185716
atggtattctatgacgcagaggaagttgaagaggtagtcatctacggttctcctcgacggctgcaccggcttcacggaggtgttcctttacgatccgtcgcggtggttcctaccgggattcgaggcctcgacattgtcgtctccactagggtctccgaagcaagtattgaagaaccgaaaaaacttaaaacattggcgtctctgtttttcccacactctgctagggtttcagagtcgtcgcgctccctcacttggcttcgactcgctttctcaattgttgattccactcgttaa

SEQ ID NO: 68939 - DNA, 789 bp, Glycine max
  Peptide Sequence Number=SeqID_185717
atgttggagaacaacctattcaatggtgctgcgcatgaaaatcctatgcagcgcctaaggaagttcattgaccaacacggtgagataggactgtgtactagcaaaaatagtatcactacatggaaccagtgcacaagtgtcttcttaaggaggtatttctctcccaagaagatagatcaatacattagggacattggaaactttgtgcagagggaacaggagaatttacctaaagctttggaaaggttgcaaaaaatgatcaaaagctgtccatattatagcttctccccacagaggctagttcacactttctatggtggagtgtcctcacacaataggaaaagtttgaatgctacttgtggggattatgaagatatgtgctccaactcttacaacaacttaggggataaaaggattatgaagaaatgcatcaactatgtggagaaggatggaaaacatatgcaagctttgacactgaagattgagacactcatgagaggagaatacactattgatgtcaagctagttggagccatggataacatcaacttttcaagcaacctcccttcacaacctgaaccaaatcctaaaagggaggatgttaacgctatgaggactagaagcaagaggattcaagaggactccgagaagaaggaaggttctttccctaaagctacagataatgtccttattgagaaggagcaagcaactaggaaagttgaggttcctatggataggaatccagtggcaagcaaagaggatgaaaagaaagtattaacacctcctcag

SEQ ID NO: 68940 - DNA, 531 bp, Glycine max
  Peptide Sequence Number=SeqID_185718
atggaatcaagaaaaagagctagaacagaagatatcccttcgtcatccactccagctcctccgtcagtaactgtaggacaggatgtgcaaagctcactaactttagttcctatgctacaaagcttattccgaggacagtttattctcatgcacagcctacaagagttggctcacaataggccaatgatatttatggaacattttcttgagcaagtagcctgtcctgaagctcaacttccattggtgagacccaacgaggctgttccgcctgagcccacacatgtacaggtcaattcagagccagctaacccacaatctccagtggtgaatccaccttcttcgcctgagcttgaaacagttcccccatctcctcctctgattgtcatttctgacgcatcatcagatgaagcagctgctcctcttgattcaccagctgcaaaaacagttgacccccctgtttccccaattggaggaatttctgatctttctgattcatcatctggaaaagttgttgctctcactgattcccca

SEQ ID NO: 68941 - DNA, 351 bp, Glycine max
  Peptide Sequence Number=SeqID_185719
atgccaccatatccccctgttgtggtggaagcatcatattatggtggtagtgaatggagggaagagtacaatccatttgagaaaaaaatcatggatcatgttggccctgaagttggtcaattcatagatgaagagatgataacaaaagatgatgacaaaggtgatgacaaaaagcttaaaggtcaatcaaagaatgagttcaagatattcaagatagaatcaagaacaattcaagattcaagaggaaagttgatttcaagaatcaagaatcaagattcaagagatcaagattcaagaatcaagagaaggcttaatcaagataagtatgaaaaggtttttttcaaaaactga

SEQ ID NO: 68942 - DNA, 847 bp, Glycine max
  Peptide Sequence Number=SeqID_185720
atgggaagggaaatagagactcccaagtaccctactcctaacaaggcaaggagggcattgagagcgcttaaagcattggtgaagttgcaagcattggttaggggccacattgtgagaaagcaaagtgcagatatgctgaggcgcatgcaaacattggtgcgacttcaggcccaggcacgtgcaagccgtgcgcacttgtcagataatacgccttctttcaacttcaactcttccctactttctcactatcctgtccctgaagaatatgagcacccacctcgtggcttcagtacaaaatttgatggatcttctatccttaagagatgcagttccaatgccaattctaggaatgttgactcggaacgagtcgggttcgattccaactggttaaaccgttggatggaattagataacaagtgtagccaaactggagatgcttcattgaaaaataatggacgccctgatgatgataaaagtgacaagattctcgaagtggatacttggaggccacacttcaagtcccaccacaacagtagcagctcctctcaagcagcacattattatctgaatgctgattacaataatgagaactttgcggcggcacacgagtctccatcaaaacgttcagcaaaggctctaaaccaaagcttctcatcaagggaggtgttgcagctaagatcattgaagtttcacaaaggaaaagaagaagcaagttcaagaactgctgacaatagtccacaagcattttctgccaattctagaaacggaagtggtgcaaggagaggaggaggaccctttacacctactaggagtgagtgttcgttgggtttcttcagtggctacacgg

SEQ ID NO: 68943 - DNA, 348 bp, Glycine max
  Peptide Sequence Number=SeqID_185721
atgtcaggatttacacgcaattctcctcaaatttcagccagcccgcatcaattagaccttgcaccttacgcttcagagccctaccatgctcaatggaacgccccggggcttctccgtgacaagcacacgttgcgttcgagtcgtatcctcagaaaaatggaggttgaggaaccttggttggggttatggctaccattgaatccccgagtggatatgggatcaagtttagcatatgacaacggaaaaaggggtgaaccctacaggctttttgctgcaaaagtggtgttcgtcattggaagtgcggtagacagactttgtggtagatttagggatggcctttgtggataa

SEQ ID NO: 68944 - DNA, 234 bp, Glycine max
  Peptide Sequence Number=SeqID_185722
atgtgtgcacaagtttgttctaagtcgaaaagattagaaatggctccgaaaaagctttccatgaataggtctaggagagatgccgcggcggaagggtccaatgccgcccccgagtttgatagtcaccgtttccgaagcaccgagcaccagcatcgcttcgaggccatcaaaggatggtcgttccacagagagaggcacgtccagctcaaggaggatgagtatacatatttttag

SEQ ID NO: 68945 - DNA, 243 bp, Glycine max
  Peptide Sequence Number=SeqID_185723
atggttgccgcccagctcgcccaggcgagccaggttgcttcctccagaagcaacagccttctggaggaatcttctggagggcccaagtgggcttgggtgctatttgcacccccatttttactaattacggaaacttacaaatttcgtaacgatacttgttttctttccgtaatgttatggaaccttgcggattacataatcatcccctttttgacttacggaatgttacggaacctcacttaa

SEQ ID NO: 68946 - DNA, 381 bp, Glycine max
  Peptide Sequence Number=SeqID_185724
atgccgttaacaaacagtacaaccaccacagcttgtctaggtcatcttcttcgtcttcccttgtctccgacagcgacactactagccccaccactattttcaatccagatttcaaatattggtcacagtcgcgttgctgggtttgttgatattgcgattaatcgccgaaaagtggccgatacgatcttaattacggtcgcatacagggatgatttggctgcgaagaagactcgtttgaagcaatgggcacaggtggttgcttgttcggtgtgggaatcttcttcatcttcgtgttcaaacccttccgaccaaatattcacgcaagtcactaacctattaatcggttgcgttaaaaacaagagaaaggaaaatacaaaatag

SEQ ID NO: 68947 - DNA, 276 bp, Glycine max
  Peptide Sequence Number=SeqID_185725
atggtggcaatggttgtagtggtggtggtggaatggtggtggcaacggccacatcgatgtaacaatggttgtagcagtggtggggacaatgacagtggcatgaatggtggtggtggtggtggtatgatgatggtgagggaattaggtcaagaaatgaagttgggattgcatcacttaagcatgacttgttgtgcgcttaagcgaagggaggaagtaattgttgaaggagtcgacatgccttgctcaaacacatcacttgagcaaggggaaccttga

SEQ ID NO: 68948 - DNA, 831 bp, Glycine max
  Peptide Sequence Number=SeqID_185726
atgagcaatttaaggcctgaatctcatgtagcacagcaaattcggcgtgaaaaattgcgaatccagaacagttctcagccttcacacgaattccctaacaatcttgaacagttatctttacacccggcgggggggtttaataacttggaccttcttcaagttaggagtgttagaaatgctaacatccttgatgggctagctgtttattcatcagaaatgccaaacttttctacctcttcgtcgaatcctaatttgtctgatgcaaggaacgcgttggagtatcaccaagaacaaggtgcagcagctgaaccgagtaataggctgatgatgaatcaatatggttcatttccccattccatgtctgcaattcattcttcccataaagaacactgtgagcttcgtaatttgggaaattggaggaacagtgccccccatcaggggtctgattggtttgtgaattatgcaagcaatgccaattcttttttgtctgctgacctcaacaacaacgtgtctgcttacaacgaacttatggatgtacactgtagcaatgcatctggtgaaatcagtggtagagaaattcagaagcaattaggtgtactgcataataatcctcctccttctccgctttatcagaatgctttgcaagatattgtgaagtctgcttctttcagttctcacactaggcaagacatgtcttcactgatgcaacaaaatgaccacagtatttgggtggggaatgctggtgaagctgagcctcaacaaccaagttatgaaaccagccaaatcagttgcattttgggtggacaaatcgaacaattgctaataccctga

SEQ ID NO: 68949 - DNA, 1788 bp, Glycine max
  Peptide Sequence Number=SeqID_185727
atggtgtctgacgcgagcaagaagaaggctgcgcagaagaaggcggcggcagcggccaagagaggaggcaaagcagcagctgcttcgtcgaaaacgacgtcgtcggagaaggccgccgacaagcttgccaacggaattggggaaattcagatatccgatcgaacctgcaccggtgtcctctgctcgcatcctctttccagggatattaggatagaatctctgtcagttacttttcatggacatgatttgatagttgattccgaattggagctaaattatggaagacgttatggcttgcttggattaaatggttgtgggaagtctaccctgcttacggctataggttgtcgagagctacctattccagaccacatggatatttatcaccttaccagggaaattgaagcctctgacatgtctgcattggaggctgtcataagctgtgatgaggaaaggttgagattggagaaagaagctgaagctttggcagcgcaggatgatgggggtggggaagctcttgaacgtatttatgaacgattggaagccattgatgcatcaactgcagaaaagcgtgctgctgaaattttatttggtcttggtttcaacaagcagatgcaagcaaagaagacacgcgatttctctggtggttggagaatgaggattgctttagcacgtgctctatttatgaaccctaccatccttttacttgatgaaccaaccaatcaccttgatttggaagcttgtgtgtggctcgaagagaatctgaagaagtttgaacgtattctggttgtggtttcacactcacaggatttccttaatggtgtctgcacaaatatcatccacatgcaaaacaagaagctgaaactcttcactggtaattatgatcaatatgttcagacacgtgctgaactggaagagaaccagatgaagcagtacaaatgggagcaggagcaaattgcctcgatgaaggaatacattgcccgatttggtcatggatcagcaaaactagcccgccaagctcagagtaaagagaaaactcttgcaaaaatggagcggggtggacttgcagagaaggtggtaagagacaaagttttggtattccgctttgttgatgtgggaaaacttcccccgcctgtcctccagtttgttgaggtgacatttgggtacactcctgataatctgatctacaagaaccttgactttggggttgatttagactctaggattgctctggttggacccaatggagctgggaagagtacgttactgaagctaatgactggtgatttggaacctctagatggcatggttcgacgccacaatcaccttcggattgcacaatatcaccagcacttggctgagaagctagacttggaaatgtctgccctccagtatatgataaaagaataccctggaaacgaggaggagaggatgagagcagccattgggaaatttggactgtctggcaaagcgcaggtcatgcctatgaagaatttatccgatgggcagaggagccgtgtgatattcgcatggttagcttatagacagcctcacctgctacttttggatgagccaacgaaccatttggatatagaaacaattgactcattggctgaggcattgaatgaatgggatggtggcatggtgcttgttagccatgattttaggctcataaatcaggttgcccatgagatatgggtgtgtgctgatcaagctgtgaccagatgggaaggtgacattatggatttcaaggagcacctaaggtcaaaggcgggtttatctgactga

SEQ ID NO: 68950 - DNA, 2912 bp, Glycine max
  Peptide Sequence Number=SeqID_185728
atggcagacaatactcgtatgaaaggtatagaggcggctatccaagctatcaatacaacactgaagaagatggtggaggatgcagaattacgacactctaactatatgcaaatgcgctctactggccttgcacgaatggatcactttgaaacccagcttggctttctgcacctcaagtccattttacatggtagcgagaactccctgccttcccacaccgcacaacctttccaaattcgcaatatcaaacttgattttcctaggtttgatggttttgattattactccactcctgaccaacatcgcctcactatcgccgccgtgcatatggagaaggaccttgaatttggcccatccccgtatgagtctcctagaccagcgcttttcaaactcacccagaccagctctgttgcggagtattacaccaccttccccgcgctagccaatcgtaaaccttacccaaccccacaaaccaaaccaagctttccatcggccaaaaacccacccatcaaacgtctcaccctggctgaaatgcaactacgccgtgacaaaggattgtgctactattgcgatgacaaattttccttaacccataaatgccctaacaaacactcccttctcctccaggtcaatgaaactgacgattctcaccttgagcatcaaccactaggcactggtcatatccaaggtctgaaggttcaaatcttacttgacaatggcagctctgacaatttcttgcaaccctacatagctcgttgtttgaaattgcccattgaaccaagggcaaagtaccaagttcttgttggcaatggcagttccttgacggtcaatggctatattccggagctacctgtgacaatccaaggccacaccctacatttaccggtgtatctgttagctaatacaggggaaaatttggtgttaggggcaccatggttgaagactttaggacctcatattgctgactatgagtcattctccatcaaattctatatggggaacacttttatcaccttgcatggtgatacgggggccacactggctcaggcacagtttcaccatatcgatcgaatgcaacgtactcgctctattgatgcctctttcatactccagtttcagcaattacaacagcagattggggatcccgggtgcattcctgtacacttgcctccggatttaactgctttactttatgcttatttggatgtttttgctgaaccattaggcttacctccccctcgggtccatgatcacgccattccactccttgagggcagcaatccggtaaaggtaaaaccgtaccgttatccacatagccagaaaacacatatcgagaaaatggtgcatgagatgttaagccaaggcataattcaacctagcactagtccttttgcttcccctgtactgcttgttaagaaaaaagatggaacatggcatttttgcactgactatcgagctctaaacgccatcacactggatttaaggtctggctaccatcaaatcctggttaagtctgaagatcgccacaagactgtttttcacacctaccacagcttgtatgaatggctagtgatgccatttggcgtctctaatgcacctacttcttttcaaagtctaatgaaccatgtttttaaggagcaactcagaaaatcagtcctactgctccgacaacactccctttttgccaaatggtctaaatgttgttttggccttactcaagtggattacttaggccacaccatttccagccaaggatattatcgtcgatttatcaagaactatgccactatcgcaggcccattgattgctcttcttcaaaaagacgttgtttcttggaattcagaggctactgaggcattcaacaacctcaaaagagagattactcaagcccttgtgctagctttaccaaatttccagcatccagttgcttttttctcaaagaaattgagtctcagaatgcaaaaacaatctacctatgtcagagagctctatgccatcatcgaagcattggccaaatttcgccacgatctcattggccacaagttcatcatcaaaattgaccaaaaaagtttaaaatataaaccgggtattgataatgtggatgctgatgctttgtctaggtcattttgtatggcattttctacaccaaagactgatcttatgtctcaaattcatgctgccataaatgttgatgcggcacatgctgaaataaaaaatcaatgcctccaagggatttgtgttgcacctcattatcaatttcattcttctcctctgggtggttatgctggtttcactaggaccaagcaagctaaagcatccacgatagtacccgcaggattactacaaccattgccaatactattgcagatttgggaagatatcaccattgatttcatcacgggttttccctgttccaacttttttactgtggctgctgaagttttcatggcctcaattgtgaagttgcatagttttcttaagtctattgtcttcggcaaagacaaggtttttactagcagattttggcaactcctttttcaactttgtggcactaccttgggtatgagttcatcttatcacccacaattagatgggcaatctgaagttgttaataagtgttcggagttgtaccttcgttgctttactagccaaaaccctcgcacttggtcaaagatgcttccttgggtaaaattttggtacaacacctccttccacactagtattggtatgacgtcttttaaggctatgtatggcagagatccacccactctcatcaaatatgatcttcatccctctgacccgcccttactacaagctctgttaagtgacatagacacattttttaccttgttgaaagcaaatttattgcgtgcacaacaagttatgaagaaatttgccgatgccagaaggag

SEQ ID NO: 68951 - DNA, 879 bp, Glycine max
  Peptide Sequence Number=SeqID_185729
atgggtcagaagcagacgaagaagagtgattatgggcacaagaagaacaaggaaaaggacaaaggaaagaagaaagaggaaacaacatcctcaaatccaacaacgttagtgttaaaggtggacatgcattgcgaaggatgtgcttccagaatcgtgaaatgcgtttgcggtttcgaaggcgtggagagtttgaagccggagattgagaccgggaagttgaccgtcaccggaaacgttgaccccgccaaactgagggacaagctcgctcgtaagatgaagaagaatgtcgacattgtctcttcccttcccaacaaagacaagcccaaaaacaacgacaaaaaatctaaagacaaagaggctccggtgacgacggcagtactgaaggtgacggcgctttgcccatgccagggttgcagcgatagggttcgcagggcggtgttgaagacaaaaggggttaaagacgtgggtatagatagagagaaggggatggtgatggtgaagggaacgatggatgtaacagctttggcaaagaagttgaaggagaagtttaagaggaatgttgaggtggtacctcccaagaaggagaaagagaaggggaaggaaaaggaaagtgatgagaaaggggagaatggctctgccaagaagaagaaaaagggtgacaatggccatggcggcggcaaaggaaacactgataaggataatgagagtggtggtgataattgccaggggaaaatggaccagaacattgtcagctatatggtacctgcatatggttatggttatggttatggtgaatactctaataactacatggggcaatatcatcctgtgtcgcagatgttcagcgacgaaaatccctatgcttgtcacattatgtga

SEQ ID NO: 68952 - DNA, 411 bp, Glycine max
  Peptide Sequence Number=SeqID_185730
atggccaacttcagtagtgtcagaaacagcagcaaaaagaagagcgtagtaggtggcattgtgaagttcaaattcgtggttgagaagctccaaaagagactgatcttgctagggagaaacaaagaagggtgtgattcttcaaactcaagctatgtgccagaggacgtgaaggaaggacacttcgcagtgattgcagagggtggtggagaggaacaaaagaggttcgtgctgccactaagctgtttaacaaacccaacgtttttgaagctattggagcaagcagaagaagagtacggctttgatcatgagggtgcagtaaccattccttgcaggccttgtgaacttgagaggatactacttgctcaccaatggcatcaagagggaacttgtagaaaatccttggtattttaa

SEQ ID NO: 68953 - DNA, 204 bp, Glycine max
  Peptide Sequence Number=SeqID_185731
atggttggacacaagtatggtgttctgaggtggagtaaaacaggcaagaaaactgttgaaggtactgcagctggtataacttctgtattggctgcttgttctttactccttccactcttagcatcgactggatacattctcactcagcattggttctctcttcttctagctgtgactgaattgaattcctttatcccggtctga

SEQ ID NO: 68954 - DNA, 387 bp, Glycine max
  Peptide Sequence Number=SeqID_185732
atgtcacggggaagacgcaggttagggcttcttaacatgatattgttcccagatgacctaacctacgtatatctacatggactattgatgtcatcagagttagttactgcagaatatgaaataagtagaagtgagatcagcattataattcaggggcttgtgcttggtcttctgctatatccaatagctttgaaatacattctccaaatatgggagtggtttataagtacagcttctgctgaagcaagaagatactgtgagattgggagatctcttatgtttgttgcttcccttggaattgtcctgattttgattgtaccatcatggatgcagttcgtgcatgagtttcgaatgcatccttttttctggtatctcatcaatatctga

SEQ ID NO: 68955 - DNA, 2651 bp, Glycine max
  Peptide Sequence Number=SeqID_185733
tatggaagaaatacagtctcaatcagataattatagatcttcatcatcgtcggcaagcagcccggcaagtagggtgccatcaagtaactttttctacctgcgtaaacctggttcacttaggcatcccatctcttttgaggattcacctgagtgggaggatactgatattgatgctagagttgaggaaggaggtgactctattaatgttgcaacaacaccagcttctccctctctttcaaagctcaacagtgggtccctgccgtctccacatctaccggagggtgcagttattccgcggaaaattgctggggcttcagttgcctggaaagatttgaccattacgataaagggaaaaaggaagtactctgataaggttattaagagttcaactggttatgcgatacctgggaccatgactgtaattatggggcctgctaaatcagggaaatctaccttattacgagccattgcaggaagattgcatccttctgccaggatgtatggtgaagtgtttgtgaatggagcaaaatcacaaatgccctatggttcatattgctattgcattgtggaattccttggaaccgcgatcgcaactccgtccactattgcggctgctatgggtgttgtggttgcagtggctgcagatgcagcatgcatcctgcatcctcttggttatgtggagagagaaactactctgattggatccctcactgtgcgggagtttctgtattattcagctcttcttcagcttcctggtttcttttgtcagaaaaagagtgtggtagaggatgctatacatgcaatgtctttaggtgatcatgcaaataaacttataggtggacattgttatatgaaaggacttcctagtggagagagaaggcttgttagcattgccagggagcttgtgatgagaccgcgtattttatttatagacgaacctctttatcatttggacagtgtctcggcacttttaatgatggttacattgaagagacttgcaagcactggttacactctcatagtgaccatctatcagagcagcacagaagtctttggcctttttgaccacatatgtttactttcaaatggaaataccctcttctttggagaaacattagcttgcttgcagcacttctcaaatgctggatttccttgcccaatcatgcaaagtccttctgatcactttctacgtgcaattaatacagattttgacaggataattgcaatgtgtaaaaactggcaggatgacaatggagatttttcttctgtgaacatggacactgctgttgctatacgcactcttgaagcaacttataagtcatcagcggatgcagctgctgttgaaactatgattctgaaacttactgagaagatgattttgttgaagtatgggacttgcacttctcatgatagtgttaggaaagaggatcaagttagaactgttagacagttatttctgttagaggaagttgggctgagaagtataaagggatccttgctaggacaaggaggggaaggtccagttctcaaaagcaaaggtaaagctagcaatgccacgcggatagcagtttcgacatggagatcattattagttgtgtcaagggaatggaaatattactggctgcatcttattctttacatgcttctcacgctgtgtattggtactgtattttctggtctggggcattctctgtcttctgttgtgctcttgtccagcatcccatttctttttctcatctccatttcttcgagtctagtcttctacttccttgttgggctggaagatcaattcagcttgttaatgtactttgtgctgaattttttcatgactttgttggtgaatgaaggacttatgctagttgtggctactttgtggcaagatgtgttttggagtgtcttgacactgttgtgcatacatgtggccatgatgctttcggcaggctattttagagttcgaaatgctttgcctggacccgtgtggatgtatccaatgtcgtatatagcctttcatacttactctattcaggggctattggagaatgagtacctaggaacctcctttgcagtggggcaggaatccgtgtgttgcgttgttgttctgcttcactgcatgcgtgatctgatcctcttcccgcgtaaaacccgattctggtggcgtccttccatgacgacgtcgtttctgaacggcgagagagcggtggtggttttcttcatctgcagaatcctctactccctcactttctctctcctctcccatggcctcgctctctctctcctcgccctcgcctccttctccctcgatatctccttcgattcttccaattccccttctcttttccgcaccaggccaggtgcttcttctggaattctgctcggcgctgtcactctcccttctcttcttctctccaaattggtccaactgtcgcgggaattctcactcgctcaacttcatcttgaagagattcaatatctgacattgcaatactgggccacatctgccagcgcctgcagcgtcgttttgttcctcgccttcgctcgacgacgccgtgccccttcatccccttctcattggggtgtgaggtttagcttatgctccattttctttcaagctctagtttctgttgctgcccttgctaccacatctcaaattg

SEQ ID NO: 68956 - DNA, 140 bp, Glycine max
  Peptide Sequence Number=SeqID_185734
atggaacgtgagaagcagatgaataatcatctgcttccgcaagaaatcgaagaatttcttgggaatcctgcaagagctactcgttcttttttctctgacagatggtcagaacttcatctgagttcgaatcctactgagag

SEQ ID NO: 68957 - DNA, 378 bp, Glycine max
  Peptide Sequence Number=SeqID_185735
atgacggaaaaccttcacgactttgctcacgaaaatgtctcagaagctttacggaagcacctcagcttggattttcttcacggaaacaatttttttcacccaaaacagctgaaatgcatagccaagggggttagggatatttggaacagcatcccttcgcctattcataggaaaatgggggaggaagttgccgcccaaatcgcccgggggagctgggttgcttcctccataaaatgttgcgggactttacggattacgcaacaatgctctttttggcttccggaatattgtggatctttacggattgagcattccattgagcattgtatgaccctgaaacataagatgcaaggtctgattgatgtaggctggctatga

SEQ ID NO: 68958 - DNA, 101 bp, Glycine max
  Peptide Sequence Number=SeqID_185736
gcagttattctcatagctaggttccctgaccctaactatggtgttaaacgaggaagcgtaaaacatgcaatggcggtttccaaactcagaatgatgcaaag

SEQ ID NO: 68959 - DNA, 1188 bp, Glycine max
  Peptide Sequence Number=SeqID_185737
atggaggaatataaaagggcagccacagatattactgcaatgactatccattctgtaaatctaaaaaagttggtcagagacaagcctgaatctattgaaatttcattccctttcgaaggagataaaaagcttaccgtagagctttacaagcatcagatttttacagataattttaaagtaaccaccaatacaggggaaattgttccatataaccctggagcgtattacagaggtatcattaagggagataattcttcgatcgttgcttttagcttctttgaagatgatgtagttggagtagcttcatcctctgaattaggaaatgttattgtcggaaaaataaagaattcggaagattttgtaagctattctgagtcaaaacttacagacacgaatccttttgtttgtggagtagacgagttaaaagaaaatcaggttcaaaagacagcatttgatcctgctactgttaataaagctgttactgaaaactgtgtccggatttattatgaagtttgttttgctccttatcaaaataacggctctaatacaacaacggtaacgaattggcttacggctgttcataacaatatcgcaacactttataataatgatgatataaaagtagcccttaatgaaatttttatctggactactgcggatccttatacaggaactcctggtgctaatcttagtagcttcagaacaaacaggcctacttttaatggagatcttgctcatttagtaaatgctccggctacaacgagtattgcgtatctcaattcactttgcacgggaaataaatatgcatattcgggcatctctcagacctattccaatgttcctgtttattcatggactatccaagcaatgactcatgaaatgggacatagtttaggttctccccatacccatgcttgtgcatggaatggtaatggaacagcaatagacggatgtggtgcacaagctgggtatagtgaaggctgtacaggcccgattccggccaccacggtaaagggtacgatcatgagctattgtcacctggtttcaggagtgggaataagttttagtaatggatttggtcctcagcctgcagcactaatcaggagtaccgtcgactccaaaccttgtctgggaaccaactgtacaacaccttgtgcgcttagcattacaagctatgaatatttctaa

SEQ ID NO: 68960 - DNA, 990 bp, Glycine max
  Peptide Sequence Number=SeqID_185738
atgcctggcatatgcggcacaagaatatataatacggacaggttgtccgctcagacggacaatcagtccctcaggttggaggatcgggtgcctgacattaccgacgtcaatgcgtttctgctggtagctcgatccagaggttttcggcaggccgcgcgcgaaactggcatcagctcctcggcgttgagcgatgcggtgaaacgcctggaggaagaccttggggtgagactattcaatcgcaccacccgcagcgtactcccgacggaggctggacgtctcttgctggagcgcaccggacctgcctttgcagaggtcgcatccgcactcgacgaggtaagaagcagccgcggccgcacctcgggggagctcaggctaaatgtcccgatgagcgcggcaaggctggtactgcctccgatcgtgccggcgttcttagcggcctatcctgacataagactggaaatcgtgaccgacgagaatttcgtcgacatcataaaaagcggctgcgatgctggcatccgttatgacgaacggctcgagcaggatatggtggctttgccgatcggcccgcgtcagcagcgctacgcccttgccgcatcgtcgcgctatctcgcaagaagaggtcgaccgcaacatccacgagacctgctttcgcatgattgtatcttagggcggttttcagggcgtgccctcccctcttgggaattcgaacgcgatggcgaggaagtcatcataaatccgaaaggtaacctcgtggtccaattcggcggcggcaccgatcttggcatcgaggcagccattgccggttctggcatgatttatattttcgaggactggctaaggccacatttcgatcgaggagatctggtgccggtgatggaagaatggtggctgcggttttccggccccttcctctattaccctgggcggcgtcttgtgcccgcgccattgcgcgcatttatcgatttcgtgaagcaattgcacaaggtatag

SEQ ID NO: 68961 - DNA, 588 bp, Glycine max
  Peptide Sequence Number=SeqID_185739
atgtcgaactccagtgaaatcactactcctgccaccaccattatcatcactaacaccaccaccatccacgctaatggagaacctactgttcacgttaaacactactttgacattagcatgctagaagaggaggaaacacgtaccaggaagactcagagaagacctatgagagccatgtccaaaagctctctatgggaagaacttcaaagaggtggatgggaagaagaagttacacttcagtactatcaacctgaagccatgaaggttgaaattagaagaaagaagcacatgccttctgttgatcaagatggtattcaagagaggaggttcaaaggatccttcaagagtagtaaggcaaggtccagaccaggaagcaagcctaagaagaagaagaagaagaaaaagaagacgaaattgttcccaaggagcaacgaatcaagaaaacacatgaggagtccagaccctttcgtccaatgcagtcccaaaggactcgtccaaagactacttcagtcaggagaagttaaaggcaaatcactaagctctacttcattgaagacatgcccaacaaaaagcaaaagattcaactag

SEQ ID NO: 68962 - DNA, 285 bp, Glycine max
  Peptide Sequence Number=SeqID_185740
atgattgcactggctatggacaacttcgctaaaaagcagaaggctgagaatgaagagttcagacgtaccatgcaacaagcgattgctactcaattcagtagtcttgcttcatcaatgtcacttccacctacccaacctccaccaccagtaagtgttccacccacccttctaacccttaatccaaaccaaacacttagtcttgaccctccatcacaaacagccatttcccaaacacttctgccacctacttattttgatattccaccactaccaaaccacccataa

SEQ ID NO: 68963 - DNA, 567 bp, Glycine max
  Peptide Sequence Number=SeqID_185741
atgtttgtgtttggctatgatccgtcaagtgacaaatacaaggttgtagcaattgcattgactatgctctcacttgacgtatctgaaaagactgagatgaaagttcatggcgcgggtgacagtagttggagaaaccttaaaggttttcctgttcttgggactttacctaaagttggtggagtgtatctgagtggaacccttaattgggttgttattaaaggaaaagaaatcattcattttgaaatcgtaattatttctgttcacctggagaaggagacttgcatatcactgtttcttcccgacgatttttgctttgttgatacaaatattggagtttttagagactcgctgtgcgtttggcaagatagcaacacccatcttggtttgtggcagatgaggaagtttggagatgacaataaatccatgattttaccattgtgcatgtctgacaatggagacttcttcatgctgaaattcactagaaatgctgatgatgaataccaaacaattctgtataaccagggggatggtacgaggacagaacaagaatggtacattaaactgtag

SEQ ID NO: 68964 - DNA, 159 bp, Glycine max
  Peptide Sequence Number=SeqID_185742
atggaacaaatgcaagctgaaattgaagcacttaaagcccaagtttcacaagttgatgtctcaaaggagcaaattgcatttcttatgcagaatgttagaggaaatgagtctttcattatgcaaatgtacttgctaattgttaactttggtgacttgtga

SEQ ID NO: 68965 - DNA, 330 bp, Glycine max
  Peptide Sequence Number=SeqID_185743
atggtggatgaatcaaacaagggagaaagcgtggaggtgaggaggcggaggaggggatcggaaaagagaaagagcgaaggaagcgatgtagacgccaaggatgtcggcaagggcgtccctgaggaaagctccggaagagcggaagtagccgaggtgatcagcagcctcttcggcggcgccggcgaggagagaaagcacagatctgatggaaatagtgtagcgtcggtatgggtaaggggtgagagaagcaagggcgtagaagagaaatgtgagcgaatagtgagagaatggaggagccagagcacaaaagaatttcaaattctttcataa

SEQ ID NO: 68966 - DNA, 774 bp, Glycine max
  Peptide Sequence Number=SeqID_185744
atggatggtggtgtggcggtgttggccagcataggctctaccgccccgtttatcgggctgtttggtaccgtgtggggcattatgaatgcgttgcgcaccattaccgcgaccggctctgccgggctggatgtggtggctgggccgattggtgaggctttgattgcgacagccattggtattgcgactgcggtacccgctgtgctggcttacaactactttatgcgtaagcagaaagtgcacagggcggatatggagcagagggttaatgccatggccatgttcagcgacagcgataatgaagacttagtcagcgaaatcaacgtgacaccgctggtagatgtgatgctggtattgctgaccgtatttatcgtgacagcaccgttgctgatgaatgctgttaaggtcaagttgccgcaggccagtgccgaggtggcggtgacggtacccaaaacggcacatatcagtgtgacggatgccggggatgtctttttagaccagaaaaatatgccgctagatagcctgaccgcggagttagggacgctgaaacaaaagcatgaccctgccgtggaaatttatgccgatgaacatgcgcaatatggtgtcgttgccaaagtactcgccgcgatccagcgcgcagtggcggtgtcgctgggtttgcatctgctggtggcgatgatttatcccaaattgagccagattcaattacctgccattcccgagcgcatggaaatcgagtttttctcgatcaaagcgcctgcacctgcagtgcaacag

SEQ ID NO: 68967 - DNA, 789 bp, Glycine max
  Peptide Sequence Number=SeqID_185745
atgacgtcgttgacgcaggtttggttgcattccaacgcttttactgggcctcttcctgatttttccggtttggtaagcttgcgagatttgaacttgagggataacgccttcacgggtcctgttcctgggtctttggtggagttgaaatcgcttaaagctgtgaacttgactaataacttgtttcagggggcagtgcctgagtttggttctggggttgaggtggacttggatttgggtgatgattctaacagtttctgtttgtcacgtggagggaagtgcgatccaagggtggagattctgctttctgttgtgagggttttagggtatcctaggaggtttgctgagaattggaaggggaatagtccttgtgctgattggattggggttacttgtagtggtggtggggacattactgttgttaattttaagaagatgggtcttgagggtactatagctcctgagtttggtttgcttaaatcactgcaaaggcttgtgcttgctgataataatctcactgggtcaattccagaagagctagcttccttacctggacttgttgaattgaatgttgcaaacaatcggctttatgggaagatcccgagttttaagagcaatgtggttcttaccacaaatgggaataaggacatagggaaggataagcccaacccggggcctagatcatcacctttaggtccactaaattcaagagctccaaacagaagtgaagaaaatggtggcaaaagatcttcacatgtaggggtgattgtgcttgctgtgataggtggtgtg

SEQ ID NO: 68968 - DNA, 597 bp, Glycine max
  Peptide Sequence Number=SeqID_185746
atgaaggttgaacaagtctttgcttgcaatcatattagtgaaaagagaaaagttccattggctacccttagctttcaagggtatgccctctattggtggacttccgttgttagggaaagaaggattcatggggatcctccagtagagtatgggaatgatcttaagagttcccttaggaagaagcacattccctcctactatgaaagggagcttatggacaagctccaaaggcttagacaagggagtatgagtgttgaagaacatagaaaagaaatagaactactccttttaagagctagacttagggaggaggaaagaacaagaatagataggtttcttagtgggcttaatatgatggacctagatgagctagtccaactttgttcaagagtggagcaacaacttaaaagaaattcttcttcaaaatcttatggctttcactcttatccaaggaagtaccaagcccaaggaactttgggggttgcaccttcaaaacccaaggaagataagggtaagaccatagagaaatccatccctaagactagtggaagtgaagatgtcacattgcctcttaatgccccacaaagaaaaccatga

SEQ ID NO: 68969 - DNA, 375 bp, Glycine max
  Peptide Sequence Number=SeqID_185747
atggccatttgcgcccttcgttggagactcgatgactactttagcccccccccttttgccatccagagacaatcgagtccgatagcatgcaaagaccatgatggtcactcgccttcgttgctccgagactatcaaattccctctatcatccagagacaagaaggtctgatggtgtgcggggacgatgatgtcatctgtttccctcgtcgaaagactcaacatctattgatcaaggctactgaagtttcccctgctatcttgagacaagagagtccgatagcatgtggagaccatcatggttttgctaatagagctattggtcggtggaagctacctagctcgtctgggcgagctgagctcgcctcggcaagctag

SEQ ID NO: 68970 - DNA, 1251 bp, Glycine max
  Peptide Sequence Number=SeqID_185748
gttgcagaggagcctcaactgtttgttgtttttggggctgttgttgttgttgttgttggattggtggaggaacgtatggttgggatgattcctccacccgggattgtacctgttgctggagaggttgaggaggtctattgtagatgtttgcagcataagcttcaggctattcaattgcttcagattgttgcacagaagggaaaaggtctgttaaccaaggcatctagtttaccttcaagcttcttagtctcagctgatgaagatgaatttgtggctacttcatgcactcctctaatgacaatagcatcatttctggcactaaattgctgggagggtcatgtctccaagggctccaccactggcagcatctatcatacttctcatgaaatgaaatggccccaagaaagcttcccacaaagacatccaggaaggacgtcaccgaagaaggctccagcactgcccagcaagctgacacgaattttgacaggcaccgattctagagcatcgagcatcaacaacgcttcaagaccatcaagggatggtcattcctcaaagagagctcacaggcattgggcaccacttgtgacccccatggctaaatttgactcggagatagtcatggaattttattccaacgcctggcctactgaggaaggagctcgggatgtcctcagccatttcttgggtcacccgctgattttggaagagggatttctctcagaccactgtagggagacaggtgaggatcatgcacaccagcatgaccaccataacccagatatagatgacgtgagtattcacgtggctcagttgattgctgatgccatctaccagtttgtaggaatggtgcctacaaggcaccctgtggacccgaaaaagtccaacagggccttgggtttccctactctgatcacaggtctctaccaattttatggagtgtctgtcgtccccagcaaggtcatctggctccctattaccagagctttcattgagaaatgcaccaccgccgccatgagaggaggcaccatctctgaggtctttctcagatcacctggacaggatagagctccggatggacaggaccccagtcctttcccttggcccactcttgagcagtttgaggccacggtggcctggcctggggacgaggtcgagtttgagatgcaagcagggcccatagggacctctggaggtagggacgaagccaaggacgatcaggacatggcagacatgttggatttcctcctctga

SEQ ID NO: 68971 - DNA, 272 bp, Glycine max
  Peptide Sequence Number=SeqID_185749
gcggctatcacaaatggtttaaacctagaacacaagggataacttggctccaaaagctaaagggtctgaatagggaagagagtgaagaggtgcaagctttgaaagctgagctaaaaaagacaagagtagagaatgagaagctgaaggtggcagtcactagagttaggaaagaatgtgataagctgaaagatatcaacatgaccgtggctgaagcgctagagtgggaaacaaaaaaagacagaaaggaagaatggagcaagaacaagttctga

SEQ ID NO: 68972 - DNA, 137 bp, Glycine max
  Peptide Sequence Number=SeqID_185750
atgtcgcgagacttcatgggttacgcaacaatgccctttttgacttctggaatgttgcaaaactttacggattgcacaacaatgcttcctttcgacttccggcatgttgcggaacttcatggattgcctaacgatgg

SEQ ID NO: 68973 - DNA, 162 bp, Glycine max
  Peptide Sequence Number=SeqID_185751
atgtcgcggaactttacagattacctaacgatgggtgttaagtacctcgaggcggtcaagcgaaggttgcatgccaccaaacaatggttcccagacgaaattagggtacaggtagttatcctcatagctaggttccctgaccctaactatggtgttaaaatg

SEQ ID NO: 68974 - DNA, 354 bp, Glycine max
  Peptide Sequence Number=SeqID_185752
atgaaggggacgacgtgcagtcctctaaaggaaataatgtatagccctctgaaagcgaggacgtgctgtcctctaaacgcgaaggcgtgtagccctctgaaagcaaggacgtgcagttttctgaaggccagggcgtgcaaggaggtacagcccgataaaggcgaggacgtgcagctttctaaagtcgagaaggacgtgcagtcctctgaaggcgaggacatgctatcctctgaaggcgaggacgtgaagtcttctgaaggtgaggaattgcagtcctctaaatgtgaggacgtgctgtcctctgaaggcgaaggcgtgcaaccctctgaaggcgaggacttgcagtcctcttaa

SEQ ID NO: 68975 - DNA, 138 bp, Glycine max
  Peptide Sequence Number=SeqID_185753
atggagatatctgtggttgtgttgggcatatttaggggtgtcagtggtgcattagttaaggctgagttcaacaatggtggcaatatggttcttagccagcctcaacgggcatggattgggaaagccagggttatttaa

SEQ ID NO: 68976 - DNA, 327 bp, Glycine max
  Peptide Sequence Number=SeqID_185754
atgacgactatatgcagttgggcaattattgcttctaagttcaaggacaaaacaacaagacagtgcagaagaagatggtacacttatttgaattctgatttcaagaaaggaggatggtcactagaggaagacaagcttttatgtgagaaaacctgggtggtccaaagtttgagattggaacctactattgtaaaggagcaatatctccaacggttgatgggagcagttgaggcaaagtcgaactttctagtgcaagatcttcttagtgtaggacaatgtcaaagtggtacttttgagattctcgaaacacaaatccccagctgctga

SEQ ID NO: 68977 - DNA, 159 bp, Glycine max
  Peptide Sequence Number=SeqID_185755
atgaaaattccactaggagtgataggtgccattgttgatcttgcattgattgttgtttccaaaggtgctcctgtgctcattgctggaaagttaattgtgctgaagcctccaactcagaagtctttgatttataccagcaggctaatagagagcacataa

SEQ ID NO: 68978 - DNA, 748 bp, Glycine max
  Peptide Sequence Number=SeqID_185756
caacaaccccctattgaattattcggttcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacaggtagtctaa

SEQ ID NO: 68979 - DNA, 402 bp, Glycine max
  Peptide Sequence Number=SeqID_185757
atgggtaagtactttaaggtatcaaattgtaaaagagcaaaagatatgtgggataccttacaggaacatgaaatggaattgatgagattgaatcaacatgaggagaatgataagaaaaagaaaggaatttgttttaaagcttcatcatctactcaagaaggaagtgataaggaggacacaattgaaatagacgaagatgatgatcttagtctatttgtaaaaagattcaacaaattcttgagaaaaagaatagagaaatctgaaaagaaagtttttaatgaaaagaaggcaaagaaggcctacattacatgggatgccaatgatatggactcatctgaagattcagaaaatgaagtagtaaacctaagtataatggccaagagttatgaaagcgatgaagag

SEQ ID NO: 68980 - DNA, 1400 bp, Glycine max
  Peptide Sequence Number=SeqID_185758
gttgggctgatgggccagcatacataacccagtgtccaattcaaccgggccaggcttttatctacaactttacccttacaggccaaagaggcacactttggtggcatgcacatatcctctggcttagggccactgtccatggtgccttggtcatcttgcctaagcttggagttccttaccctttccccaaaccaaatatggaacaagttatgatattgagtgaatggtggaaatcagatactgaggctgtaataaatgaagctttgaaatctggtttggcaccaaatgtctccaatgctcacacaatcaatggccacccaggacctgtccaaggttgtgcttcacaagaaggatttaagttggatgtccaaccaggaaacacctacttgctaagaatcatcaatgctgcactcaatgaagagctattcttcaaaattgctggccatgaactcactgttgttgaggttgatgcagtctacacaaaaccattcaaaactgataccattgtcatagcacctggccagaccacaaatgtgcttctaacaaccaaacatgcagcaggcaaatacttggttgcagcctctccttttatggatgctcccattgcagttgacaacaagactgccactgccacattacactactcaggcacccttggttccaccatcaccaccctcacttccatgcctcccaaaaatgctacccctcttgccaccagtttcactgactcactcagaagcttgaactccaaaaagtatcctgctagagtgcctttgaagattgaccacaacttgctcttcactgttagtcttggaattaacccttgtgctacttgtgtgaataacagcagggtggtggcagatatcaacaatgttacctttgtgatgcctaaaatttctcttctccaagcacatttcttcaaaattaagggagttttcactgatgattttcctggaaatcctcctgtggtttataacttcacagggacacagccatcaaatttgaggaccatgaaaggaacaagggtgtatagacttgcttacaattctacagttcaattagtcttgcaagatactggaatgataacacctgagaaccaccccattcatctccatggctttaatttctttgtagttggtaggggacagagaaatttcaaccccacaaaagaccccaagaaatttaaccttgtagatcctgtggagagaaatacagttggagtcccagctggagggtggactgctatcagattcaggactgataatccaggtgtttggtttatgcattgtcatttggaaattcatccaacatggggactgaagatggcttttgttgtggataatggtaaaggaccaaatgaatctctattaccacctccaagtgacctccccaagtgttga

SEQ ID NO: 68981 - DNA, 270 bp, Glycine max
  Peptide Sequence Number=SeqID_185759
atgcctgcaagctatctcctcctgaaaatctgtatactcatcttccctgagctggacgcacctctctctatggaacgaccatcctttgatggtctcgaagcgctactggtgctcggtgctccggaaacggtggctatcaaactcgggggtggcactggacccttccactgcggcgtctctcctagacctcttcgtggaaagctttttcagagccatttcctgcgaagacaaacgtttggaaagtcaatttacaaggaaatgccattttaa

SEQ ID NO: 68982 - DNA, 486 bp, Glycine max
  Peptide Sequence Number=SeqID_185760
atgaactcgctaagcgagcatactgcggcatccacttcaacagccccttctgtcccaactcagacagattctcatggctttcatcagggacagatcattttactacaaagtttacagatgatggcacctccagactctattccttcagtagagcagtttaatgagatggtagcctggcccgagacccaaccttctcttcataaggaagatgaaggtcccagagcccaagaagaggagacacaggtgagacaggtagctgctgccactcctgagcgatcccttgaagctacttcagagccttctgcaccagtggtaaacctaccctcacctcagcctgcagcagacccctccactcctcttctacatatgccagaggacccaacgacaccagtcctagctgtggacacttctcctccaactactcaagtgcttcagctgatagatgaggaggatggtcagacacaggacacccaagaccagtcatag

SEQ ID NO: 68983 - DNA, 560 bp, Glycine max
  Peptide Sequence Number=SeqID_185761
gggttcccatgaaccctaagagaataaaggtcattcctgagtggccgactccaccaacatcactcattgagttggtgaggaaccatgttccttcatgggaagatgccaaggaaatggtgttgaggaaaatgcctagagtttcaagaaccttgggatttgagactcatcttctacttgaagtggcgtctccattcatctttctccttctccattccgctgcaattagacctcaagaagaaaaggaatccattgatgaagaagatccaaggcctacaagcttcacatggagctatatcaatgaggagcctccagcagcagcaacagcagaggatgaggatgagctcactcctcctgagcctcttgattttgatgcaggtacacatacggctcaggaggaggaggctattccagagcagattccagagccatctccagcccctgcgtatgcacctgatgatgccacaccagtggttgagccgaagcagactattcaagattctttagtagctctagcactggatcttaatgaagaccaaccacaagaggagcaggacgtttaa

SEQ ID NO: 68984 - DNA, 1174 bp, Glycine max
  Peptide Sequence Number=SeqID_185762
gggcaccagagttgatgaggtagcggtagaagaggatgatcacgccatcgttgggcatcagatagcgggcgcggacgctggccagatcctcgcgcttgtacttcgggtcccactggtaggtggcgcccagggtccagcggtcgttgatcatgtagttgccgtcggcgatccaggccgacttgcccttctccaccggtgcgccgcccggcgtggtgctgacccgcgattcgtcgaagtactggatctggccgatcgcggccgagaagcgttccttgccggtggtctggtcgatgaagcgggtgcccagtgccagggtcagctggttggcatcgttctggcggtcggcgccggtatagcgcgagtcgcggaacagctggccccagctgaaggtgaagtcacgggtgtcgaagatcggcagctcgtcctggttgcgatagggcgtgcgcaggccggcatcaaggctgccgatcggcaggctgcggctgggcgatttgttgccgcgcagctgctccggcgtggcggtgttcgggtcgatgccctgcgaggccagcacgttgcggcggacgctgtcagcgaggccctggtccaggtcgtagccggtgtagcggtaggccagggtcggggtgacgtaccaggccgcgccactgatcgggaacgacacgtacggcttcacgtccaggcgcgagccgccgtacatgcgctgggtctggccgttgcgcgtgtactgcaggtcgggccccgcatcggcgccgtacttgaagttgatgtcgtcgtgggtgaagcgcacggcttcggcatagatgccggtttccagccacggcaggaccggcttgtcccagttgaggtacaggcgcggctggcggttgtacggcagcgcgctttcattgagcgtgtagtcggtcagctgccagcggtcggccatgatgccggccgtccagttcctgccggtgccgtacaggcccacggtgctctgcaggttcgaggcagtcaccccgaccaggcggttggcgaagtcctcgacatagcgctcgtcactgacccaggccaggttggcgcgggcctgccagtggctgtccacgttgtggtaaccgctgaacatcacccggccgcggtcgcggtcgcgcagcttgtcattgggcatgaacgcggtcagcagttcgccgcggccgccgtt

SEQ ID NO: 68985 - DNA, 783 bp, Glycine max
  Peptide Sequence Number=SeqID_185763
atgtacatcggagacgaacactgcgcgccggtgcggcgacaggtagcgtttgcgcttgttcggccggatcgcacacaggtccacttcgatcaggccgtcgatcgaatcgctgaagtccgggtccacgccgaaggcgaggaagcgcgcgccaccgggttcacacagatcggtgtactggcggtacagcgtgggcacgccggtgccaagtgcggccaggttggccttgagcacatcgaacgcggcgcctgcatccagctcgccgaaactgggcggcgcggcgaagtactggaacgggcggttcgattcgaccaggccagcagtaccgctgtaatagcgctggtagtacgccaccagctgctcgcgcgcatcgcgtggcagcgccgcgctgatcgacacggcgccgaacaggtaacggatacccggccggcactgcaggtaggcgccgatgccctgccacaggtaatccaggctgcggctgccccagtaatcgggcaccacgaagctgcggcccagttccaggccctcggcgatgtgggtgatggcatcgtcggaatagcggaacagcgacgcactgtagagcccggacaggccgtgccgggccagcgcatgggcgccgcgcatgatccggtacgcgccggcgatgcgctgcgcggccgcgtcccagatcacgatgtgctcgtaccgcaggtcgtagtcgtccaggtcgcggctgcgcccggtgccctcgcccacctggcggaacgtcagttcgcgcaggcggcccagctccagcagcagcggtga

SEQ ID NO: 68986 - DNA, 669 bp, Glycine max
  Peptide Sequence Number=SeqID_185764
atggccgcttcatggtcagcatactccgtaagcactgtgggtccctgggtccaccaagaaatccctcaggctcatctgcagcatcctatgcaccgcatctaccatgggtgcactggtatcctctggtaccgcaggcgagttcgcatgtaccgtaggtatgagacttgcgtcctacattgcaagtatggtatcgaacaccgtgtgtctcagctgcaaacaagaggaggtggtggtaaccccaacattgcaggtttttgcccaagactagtaaaaaaggctagtgcacagccaacctgtttgagaaccagggctgcaaagctttgggctctccaactactacaactagcttttgtgatgtggctggaagggaagagaccattcatcttgtcatttgtgagagaattgaagccttttggcattagggaggcctattggtggatgatcaatgtagagcagtattttactaaggggctgtcgcaacgtgcccttcacgggcgagcgagggcgaggctcacgggtgcgctttccaaaggaggaaagatgcgcggagtcgccaccaacgaaggtattagcacctctcacgttgacaaaagcggggctcttgctcctacgtaccctccatcaaagaggaaatcagacctacgtagttctttcttatgcatggatcaa

SEQ ID NO: 68987 - DNA, 270 bp, Glycine max
  Peptide Sequence Number=SeqID_185765
atgaggactctctgcttcccacaagggatagtggaagacttactgatcaaggtcagaaaattcattttccctgtggactttatgattctagatatagaggagaatgaagtcacaccaattattttgggaaaactcttcctcaacacaataggaacattgattgatgtcaaggaagggaaattgacttggtgcctaggtgatgaggaagaagtatttaaggccactaacaagataaaagtcattttctcctcaaatacccataaaccctaa

SEQ ID NO: 68988 - DNA, 225 bp, Glycine max
  Peptide Sequence Number=SeqID_185766
atgggtacggattcggattcggatgcgaatggatggaaccgtgctcgagggttggcccttaagactctgctactctttggtggcgcacttctcgtcaagcgcctccgcaagtccaccacgcgctgggaccacgctcatttcgtctccaagtccctcgccggcgaaaagaatgcttacatgccccgcagcggagctagtggatggttccaaggttttgtattttga

SEQ ID NO: 68989 - DNA, 318 bp, Glycine max
  Peptide Sequence Number=SeqID_185767
gtttctagatctattggtgatgtatatttgaaaaaggccgagttcaatagagaaccactatatgctaagtttcgacttcgtgaaccatacaagatgccaatactaagctcagaaccatcaatatcagtgcatcatttgcagccacatgatcaatttattatatttgcatctgatggactctgggagcacctcagcaatcaagaagcagttgatatagttcaaaacagtccccgcagtgtaagatacatatttttctactgtgctagattgtgctatgtcattaacagaaagattaaagtggatacatgtatggattag

SEQ ID NO: 68990 - DNA, 264 bp, Glycine max
  Peptide Sequence Number=SeqID_185768
atggaaaatcttcacgaaatctcccacggaaacgtctcggaagcgttacagaagcgcctcggcttggaaacaatttttttcactaatttcaagagaatcgtaaatactagaagggctgaacgaaattactctgccctctttcccctatttatagggaaaaagagggaggtggttgccgcccagctcgcccaggcgagctgggttgcttccactagaaggcaccgccttctcttggaacatcctggaaggggtgggatcctctag

SEQ ID NO: 68991 - DNA, 489 bp, Glycine max
  Peptide Sequence Number=SeqID_185769
atggtcatcgaactatccacgctgggtttatttgccctttcggccgccgtcttaacgcttattcccggcgccgatatgctttgcgcactgtccaatgccgtcagccagggaacaaaagcggggctgattaccgtattgggggcggtcaccggggtgatatgccatgtctgttttgcgattgtcggcgtcacggcgctgatcgcctcttcgccgctgctgtatcagcttttcgtcatcggcggcgcgctgtacatcatgtgggtcgggttgggcatttttacccaggcaaatgcgattggcctggaaaaccacggcgagcgcaaaagccgcaaaaggctctattcgcaaggattcctgaccaatctgcttaaccccaaggacattattttcatgctggcgtttattccgcagtttattcgggtggaggcgggcaggccgggaattcagatgctgatattagcattgaactcatcgtcatcatgtttctga

SEQ ID NO: 68992 - DNA, 564 bp, Glycine max
  Peptide Sequence Number=SeqID_185770
atggtttatccaagtggtactagacacgaatcccttaagcatgtagtaaagggtttgaatcctgacgaatgcatatatggagaaaatcttgttgagagggagatcccacttatgagtgccaacagaatattctataaaaaggttgaatatgtgcttgaagattgtaatgaggttctcgtcaaaatcaacaaatttgtcgtcaacaaagaaggcttagtatgtgtggaaacgttgtgtatgcctgttactaaaccagaaagatttgagttggatgcttttgagttagatgaacctgaagatgctggcagtaaatgtaatcttattctatgcaaaagacatagttcgtttccctttccaacagaatgccaccatactttacttattgcacactgtgtacagaggcagagagaatctcccattacttactgtgcactatgttgccttgaaattgtggaaactccaaggatgttagatgtacctgaatctcaggattttgacattccaatttttattgagataaaatccttttggaatctcccgaaacaaatgaagtgcctcatttga

SEQ ID NO: 68993 - DNA, 357 bp, Glycine max
  Peptide Sequence Number=SeqID_185771
atggaggccatgaaagagcaaatgaccacaatgatggaagccatgatgagtatgagaaaaatgatggaggtcaacatggctacagtcgttgctgcaagtaccgccattgaggtcaggaaggtgaagcattgggaagtacgggcggcccccattttgtgtaggtctagaggaagcattccttcccaccatatggcttgccttctaactatacaccacccaatgttgcacacactcccgatgagaatgtcgacaactccgcacccatactcattgagagccaacaacccctatcttatcatgcacatgcctcttaacccatgggggagacacatgaagcaccccaagaccacaatctag

SEQ ID NO: 68994 - DNA, 312 bp, Glycine max
  Peptide Sequence Number=SeqID_185772
atgggggagacacatgaagcaccccaagaccacaatctagctgactttgagcctcacctcgaatatgctgctgaggggcagacgttttgtggcgtacccctgtcaaacacttttggaggccctcagtattgcccacaaccacaacccttgcattttgcagtgggaagagtccctcctgctatggtggaaataaagaaatttgatcatataaaggaaaggctaagggtcattgagggaggcgaaaattatgcctttgcagacatggcagagttgtgccttgtgcccgatgtggtcattcctccgaagttcaag

SEQ ID NO: 68995 - DNA, 351 bp, Glycine max
  Peptide Sequence Number=SeqID_185773
atgaatcattatcctttcgaaggtcatcaaagtgatacttctgcaagcaaacattcgttcggtggtgttgcgaaaacatatcctaatttttcatggcctactatgaccgcttcacaacaacatgatgctccaattgcaacacctaatgccccattaggtactactgtaccaagagcaataactgatatggatggcttattaggtgttgatttacgtcaccaattttctagtgaggctgaccaagttgaagcggggaggcataggggcagaagaaatcccgatagacaaacacgaagatgggaacgaccatgcggcacatcctcacgtcatcacggacatcataacgaatga

SEQ ID NO: 68996 - DNA, 924 bp, Glycine max
  Peptide Sequence Number=SeqID_185774
atgtttaagtttaaattaacctatgttgctttagcagcagcgttaagctcgacggtggtgtacgccgatccgtcgacttacacccatctatcaggcgcaacggtggttgatattgaagcgccgaatgctgcaggcgtttcgcacaacctgtatcgtgaatttaacgttggcagcaacggtttaatactcaataacagcgacagcgatattaatcatgcgacttttggcaatattgctaaaaacaacaatctgactaatggcggcgcatcggtgatcctgaatgaagtcacctccaataaagccagttcattaaatggcttcattgaagtcgccgggctgaaagccgacgtggtaatcgctaaccctaacggtattacctgctccggctgtagtttcgttaataccaacaaggcaatattaacgacaggtcaggtgaatttgaccgatgaaggcgctatcggcagctataccatcaccaatggcaaaatcaccatcgatgaaaatggcatgaacgccgctaacagctatgctgctctactcgccgacgcgattaaaattaatggtaaagtgcaggccaagaacgcccttgttagtgcaggtaatttcaccatggataacagttctggcgcggtgacctcagcgggtaaaaaagcgaccctgatcgaaatgacgattaacccgcaatacagcatcgacgtcagtagtcttggcggcattactgccaacagcattagcatgattggcaataacattggttttggcgtacgtaataatggctctattatctcaaacagctcactgcagctcaccagctacggaaacctgataaataaagggacgataaaaggcaacggtctgctaagccaggtttctacgtcacaggtatcaccaatgaaagcagtatcggcggagccaattatttaa

SEQ ID NO: 68997 - DNA, 760 bp, Glycine max
  Peptide Sequence Number=SeqID_185775
gaatgtggatcaaagtttaaagaatgatgtgatatcagttttggagatgactaaaggaaatgatggagggaaatatctgggtttccctttttttgtgggaaggatcaagaaggctatttttaacttcatcaaggataaggagcttgggggcttaggctttccaaatatctatgctttcaacttggccatgttagaaaaacaagggtggagatttagatcaaagcccaatgctttgtcaactagagtattcaaagccaaatacttccctataggggattttatgggtgctgacatagaatcgtggttaaggcacaaaggtcatgcagtgattcgaacatcacttataaatggctcggaggatttgaaagtgagcattttgatgaataaagaggctttgtgttggaactgcatgcttcttaagcaaatttttgaagcggaggatgttgagagtgcgtacaaagtgataatgaataagctagaggataatgaacacctagcaatacttggtgattggaggttgatttggaaagtgaatgttccaccacgtgatatcaaatcaagtaagaaattcctcttcaccttgtttttgaagctgcaaaacaaaggaaagatcaaatggctatcttgctatgaagcatatagaggaggaggaatgacaagtaagaaatttctcttcaccgtgtttatgaagctgcaaaagaaaggaaagatcaatggctatcttgctatgaagcatatggagggagggaggaatgacaag

SEQ ID NO: 68998 - DNA, 207 bp, Glycine max
  Peptide Sequence Number=SeqID_185776
atgagaattttacagagtattcgcgaactgaatgtcagcttcaagagctttgagggaatccttgaaggactttcgcatctcttctattgtgatgacgaaactcgcctcagaaaacttgaaccggttcctggattccttgcaaaacacaaggtgcaaaaagcaatcaacgaaagagtatttaagagaaagagggggaagagagagtag

SEQ ID NO: 68999 - DNA, 363 bp, Glycine max
  Peptide Sequence Number=SeqID_185777
atgtcacggaacttcacgtattgtgcaacaaagggtgtcaagtacctcgaagcggtcaatcaaaggttgcatgctatcaaacaatggtccccggacgaaattagggtggtcatatctttcttgatggtttctagaggaatcatccccttcgaaaaacatattacggcagcagggactaccagcaacaatatgttatcaaagagaaaaactctagatgagggttcactgttatcaagcaagtcagagacccagcatgatcacagattcacctccactccttatgttcccatggacacgagtatagggccccttttcaacttaccgtgtgtgcaaaaaggtgttggtgttgtgtacatcaaatga

SEQ ID NO: 69000 - DNA, 349 bp, Glycine max
  Peptide Sequence Number=SeqID_185778
taaccgcaattcctgaatcaaaagatctcaccaacatgtctctagccactctctttgggaaacttcaagaacatgaaatgaaacttatgagactcaaccaacatgaagagaattacaaaaagaagaagggaattgcactcaaatcctcatcttctattcatgaagaaagtgacaaagaagacatgaatgaacaaaataatttagaagaagatgatgatttcagtctctttgtaaaaagattcaataaatttctgaggaacaaagaaatcaaaggagatcgaactctagtccaaagaagaaaggagaagattccttctcagtttcaaaatgctatgaatgcaatcaacct

SEQ ID NO: 69001 - DNA, 215 bp, Glycine max
  Peptide Sequence Number=SeqID_185779
tggtgaatccactgtcttctcttgagcgtgaagtagttcccccatctccacctctgattatcatcttcgatgcatcatcagatgaagcggctgcccctcctaattcaccagccagagaaacagctgaccttcctacttccccagttagaggaattgccgatctttctgatttgtcatctggagaagttgttactctcactgattccccagtttag

SEQ ID NO: 69002 - DNA, 378 bp, Glycine max
  misc_feature (49)..(49): n is a, c, g, or t
  Peptide Sequence Number=SeqID_185780
acaaccgttcaccatatccatttgtgccatgatcaagtcaaggttggtnttgaggaagttagagatgcagattctcccattcttgtacccactgaagaggttcagttaatgagacagacacttgacaccttcgttgcttggccgacacatcttgtgaagcgtttatcagaacaaggggatgtgggactagcgaaacctccaaataggctggatcatgatgtcgatgatcccctatatttgatgacattgaccatcccacagctttttcttaagccgttgcaggttatgtggggtgctatcgtgtttggggtgtttaatgataacttccccttgtacataaagcatgaagatctgtctgaaatagaacacggtggttaa

SEQ ID NO: 69003 - DNA, 430 bp, Glycine max
  Peptide Sequence Number=SeqID_185781
tccgttggcacgcgaagatgccctatacggtaacccacacacactcatttgctattcgtcagactcagagtccggtagcatgcagagactaacgtcgtcttctgcacctttagacaatgagtctgatgacatgcgggggtatcgtatggttatctgcacctttcatcaaccagaggcaaacgagcccgttgacacagacagcgagtctgatgacatgcggcggtaccgtatggttatccgcgccttttgccaactagaggaaaacgagcccattgacacagacagcgagtccgatgacatgcgggggtaccgtatgattatccgcacctttcatcaacccaggcgaacgaggacgctggcggggacgatcgagtttgacagcatgtggaaacgtcgtggttatcccgtcttgtcactttcgaggcactga

SEQ ID NO: 69004 - DNA, 345 bp, Glycine max
  Peptide Sequence Number=SeqID_185782
atgacaacaaaagcaataactgaaagcagtaatgtaaatcacaaaaagtgtggcgaccttggtcatgtggctccgctccctcacaagaactcgagtaggtcagtcatatcctcgtccatatggggttcatccgtatcaccgggggattctacaggctcctcccctgtctgggcatcgggccagtctccaggccatgcgacctcagccccaaaatgctctggtgatgcaatcctccctaggaagggaccagtcactagaaccatgagcaagaggctccaagaagattgggctagagctgctgaagaaggccctagggttctcatgaacctcagggtagatttctga

SEQ ID NO: 69005 - DNA, 386 bp, Glycine max
  Peptide Sequence Number=SeqID_185783
catgtttgcattttagtggagaaaacaccgagactttttccagtctcacaagttatccagaactacgtaggtctgagttcctcattggaggatacgtaggagcaagagcctcgcttttgtcgaccacaccgccttttgttgccatgacccaagagctggtagcccgcggagacaccttacggttatccgcacctcgtcattcagtgatcccaagtgtgattgacgagcagagaccaatatggtcatctgcgccctttccggagatgtcagcattttccgatggagacttttcaagtctcacaagttatccagaactacgtaggtctgagttcctcattggaggatacgtaggagcaagagccttgcttttgtcggccgccccataa

SEQ ID NO: 69006 - DNA, 249 bp, Glycine max
  Peptide Sequence Number=SeqID_185784
atggcacgcagagaccaagtttggtcattctgcacccatgatacgcggagataccctatggttatccgcacccctttgccattcagacacagtcgtgtccgatggcacgcagaaaccaagtttggggctgacacagtcttctgcaccttttgttcctccgggaacaacaaagtcatttacatgcggaaatttcatggtcgcccgcgactctcgtcaaccgagaggagcgaaattagtgtcatacactga

SEQ ID NO: 69007 - DNA, 396 bp, Glycine max
  Peptide Sequence Number=SeqID_185785
atgccactctctatgtgtagaaggttgggagagttggagatcatgcccactaggatgactttacaacttgcttaccgctccattaccagaccatatggagtaattgaagatgtgttggtcagagtgaaacattttatcttcccggcagactttgtggtaatggatatctgtgaagatactgacattcctgtaatattgggaaggccgttcattcctttcgctaagcgcaagcctcgcgctaagcgcatctttgttcatgcgctaagccgtaagtctcaagcgcttagcaatcaacgctggcatctgaggctgatttggtctgctaagctggccaaggctgagctaagccaatttcaaatcaatttgaattcggctaagcgatggcctaaccactaa

SEQ ID NO: 69008 - DNA, 1184 bp, Glycine max
  Peptide Sequence Number=SeqID_185786
ggctgcacgccctcacctttagaggactacatgtcctcgcctttagagggctacacgtccatatcttcggagggcaacacgccttctccttcagaggactacacgtcctcgccttcagaggactgcacgtcctcgcctttagaggactacacatcctcgccatcagagggttatacgccctcgccttcagaggactacacgtcctcgccatcagagggccgcaccccttcaccttcagaggaccacacgttctcaccatcagagggttgcacgccctcagcttcagaggactacacgtcctcgccatcagagggtttcatgccctcacctttagaggactacacgtcctcgccttcagagggctagacgccgtcatcttcggagggcaacacgccctcaccgtcagaggactacacgtcatcgccttcagaggactacacgtcctcgccttcagaggactgcacgtcctcgccttcggaggacgacacatccacgcctgcagaggactacacgtcctcgccatcagacggttgtatgccctcgccatcagaggacttcacgtcctcaccatcagagggccgcatgccctcaccttcagaggactgcatgtcctcgccatcagagggctacacgccatcacctttagaggagtacgcgtcctcaccatcagagggccacatgccctcaccttcagaggactacacgtcctcgccatcagagggctacacgccatcagctttagaggactacgcgtcgtcaccatcaaagggctgcatgccctgaccctcagaggactacacgtcctcgccatcagagggttgcacgccttcacctttagaggactacacttgttcgccatcagaggactgcacgtcctcacgttcagaggactacacatcctcgcattcagagaactggacgtcatcaccttaaaagtgttgcatgtcctcgccttcagaggagtacacgttctcgccatcagagggatgcacgccgtcaccttcagaggtctacacgtcctcgccatcagagggctgcacaccctcaccttcagaacactacacgtcgtcccctttagagggctacacgccctcatcttcggagggctacatgccctcaccttcagaggactacacgtcctcgccttcaggggactacacgtcctcgcctttagtggacgaaac

SEQ ID NO: 69009 - DNA, 211 bp, Glycine max
  Peptide Sequence Number=SeqID_185787
gggaggtggttgccgcccagctcgcccaggcgagccaggttgcttcctccagaagcaacagccttctggaggaatattctggagggcccaagaaatgggaatccctgggggaaaccaagaagaacaccttaatcataaagaacatgcagcgatatcctcaattgcccaagattctaagcatagtatcgcttgacaacatcagagttcacgg

SEQ ID NO: 69010 - DNA, 336 bp, Glycine max
  Peptide Sequence Number=SeqID_185788
agatccttctctattggtgcgaatgtaatctcctctttcggataccgcaaagagagggatggctcttgggtgaagaaggatgctccagtacaggccgctgaagaccgctctccatcaccacattctcatagagatgactcttcatctcttatgcacaacattcttgacaggttggatggactccacaccttcgtcggtgaacgctttgactcattggatagtcgtattgatgccatggatgcacgatttgcaggaatggacacacgtatcaccaaacttgaggaggatgttagttatgttcgtcagtgctttgaccttccaccaccatcctcatag

SEQ ID NO: 69011 - DNA, 462 bp, Glycine max
  Peptide Sequence Number=SeqID_185789
accgaatttgaaatccctgaagcttttgatagtaggacaaagaagaaagttcttcagattgtcggcgagcggtggaggaagtttaaatctgatttgacaaggaaatgggcacttgcagccgacaaggacgaacatatgctcgtggctaagaaaacaaagaaaagactggaggaagctgctcagtccggaagcactgagggcgtcattgaccctccatctcctatcaaacgatacgatctcctgactgctgccattgggcaaccaaaacaccctggtcgtgtgcctgcagctggagccaatgtcaccatcaagcaatacttcggattagctccacgaaactcccacagttcctccttcatgcctcccgaagaacttgagcagctgactcaacaaatcagggaccagctagaggagttgatcacagaaaaagtgactcagcagctaatgttatccttaagctag

SEQ ID NO: 69012 - DNA, 318 bp, Glycine max
  Peptide Sequence Number=SeqID_185790
atgtgttgttctaccccgggtaacaacatcgaaagaatcccacttgaagccattgttaaaacaatgccgctattagagtgtatggtagatgataaagttttccagacaaagggaaatttctgtgcgagttggcagcatatcctattgagtaagatcccgtccatgatgatagcattgaaccaatttgttgactttctttctagggctattgattttcaaggtggaaataaagacattcaactgttggtgcacgtccatgcattgggaatgcagaaatctttcaacatgtctcagggggcgacacatatatgcaaataa

SEQ ID NO: 69013 - DNA, 327 bp, Glycine max
  Peptide Sequence Number=SeqID_185791
atggcgtacctaggcaccacaatcggaatctcctccgccaaatggcgcctcacggtcccgtctcttcctaagggcttcaatgaaatagactttgtcgctgtcgccgtcattttgctcatcactctcatcatctgctacagccaggagatactggcagagcaagaagttgatagagtgcatggattacgtgcgcagcatccggtgaagttcaacaatatggtggttatatcactgtcaatgaaactcaaggaagagcactgttctattggtttttcgaggccactcacaaaccagaacaaaaactcattctcttatggctcaacggag

SEQ ID NO: 69014 - DNA, 291 bp, Glycine max
  Peptide Sequence Number=SeqID_185792
atgcagttaggtcttgatcagacattagaagatgaaaggttggtttctataaatgagaccgagtggactaagatccaaagaaggattatgagcacgattcgattagcccttgctcttaagataaaacatgtgttgaaggagacaacatcaaaagcctcgtgggagaagcttgagaatatctatgcatcaaagtcactaaccaattgtctttatctgaagatagagttttatcaactcaaaatggagacgataggagatctccattaccacatcaacaagttcatttaccta

SEQ ID NO: 69015 - DNA, 108 bp, Glycine max
  Peptide Sequence Number=SeqID_185793
atggcttcgtctctgttactagcggtggtgtttgtgcttgatctggttgcttttgctctcgctgttgctgcagagcagagaaggaatactagtttgcttttgctatga

SEQ ID NO: 69016 - DNA, 480 bp, Glycine max
  Peptide Sequence Number=SeqID_185794
atgcagtcccagttgcaatcactgatccaatcacagggacttgcactgcctccagagcctgaggttggtccctcagctgctcgtgtcaacacaaaggggagttgtgttgatccctcaccgaccaatccagacacgggtgactcagacaaatgcaggttgtacatcgaagaaaatccttcccgcttggttgccctaggaagagtttatgagggatccacatcagttcacaacatccctttgttgcatggccaagtgaaggttggtgttgaggaggcacttaacaccttccttccttggtcgacacatctcgtgaagcatttatcagaacaggtagttgtgtctccaacaaaacctccagataggccggatcctgagcctctccaggttatgtgggatgctaccgtgttcggggtatttaatgaagacttcccgttgtacataaagcacaaagatctctttgaaattgcacacggtggttaa

SEQ ID NO: 69017 - DNA, 291 bp, Glycine max
  Peptide Sequence Number=SeqID_185795
atgtctcacaatgggcaagtcaggtcactctcactaagtgaaatcataggaagatcagtcagggtcacactgttttgtgagaatgctccaatcatgtgggatcggcacagacttacaggagcactcaaaccggatgacccccaaggcctacactccgaagagtctgtcagggcctctccctccttattcagtgcgcctcaagtgattaactcgtcggattcccacagtggatctcatcacaactcatcgcgcattaactcgtcgcctttaaagagtcttacagttgtgtga

SEQ ID NO: 69018 - DNA, 1272 bp, Glycine max
  Peptide Sequence Number=SeqID_185796
atgcaggttcctgccaatgttgctgtctggttcgccaacggttatctgctgtcagcggccatgaccctcgccatctttgccgcgctggcggcgcgcgtgggctatcgcccggtgtttctgaccgggcttgccacctttacgcttacctctctcggctgcgcgctggcgaagaccccggatgtgctgatcggaatgcgtattctgcagggcatcggcggcgcggccaccctgagcatcgccccggcaatcctgcgatccgttttccccggcagactgcttggccgcgttctggggctgcacgccatgcttattgcctccagcacggcgatagccccggtgctgggcggaacgattctgaacgcgctgagctggcagtggctgttcgccattaaccttattccaggctgcatcgccctgctgctggcatggcgcgctttaccgaaggaatcagcaggtgataaatcctcctttgatgcgccaggcgcggtgctctccgcaacatttctgggagccacgatcatgacggccaacagtcttcagcgcgtcacgcagcacattaatcacgaagccatcggctggggacttctcgcgctgatgagcgccctcgcctttacctggcggattcggcgggcaagtcaccctttattgccgcccgtcatattcaaaaacggacgctttaccctcgctgcgctaacctcgctggcctcgtttgtgagccagggcatcacctttgtcgcgctgccgttcctgtttcagagcgtgtatggctacagtccggtggtttctgcgctgctctttaccccgtggccgataggtattgtgctaattgcgccgcacgcggggcgttgggctgatacgatttccgcgccgctgatttcgacccttgggctgatgatatttgtcggtgggttggttgtgctggcgaccctgcatgaaagcccatccgtatggaacatctgcctgcgcagcctggtttgcgggatagggtttggctgcttccagagccccaataaccgggaaatgctcgctaacgtgacgcgggactatgccagctatgcctctggggtgtcgtctattgtcaggacattcggccagtgtctgggcgccgatacggtgggcgtgctgctggcggcaacacccggccaaaaccttgatgaccggatcgtgcatgttgcgctgtggatcgccgtcatagcctcgacgggcgccgtgttgtttagcgcgagcaggctgcgcccggcggcgctatgcttgcacgggcctacaagataa

SEQ ID NO: 69019 - DNA, 165 bp, Glycine max
  Peptide Sequence Number=SeqID_185797
atggagagttatttccatggcaagttttactccccacaaccagacgtctcagttgctaatttgatgaacattgggaaattatccaatgatcacaaagttattggaagattattcagaaacggagcatatggctatgaaatgactgagaggaaaaccatactttga

SEQ ID NO: 69020 - DNA, 282 bp, Glycine max
  Peptide Sequence Number=SeqID_185798
atggaaaaaaagaaaaagaaaaaaggctttgggctaggatgccgtgcatcagttcacgacgcgtttgcgaaacggcgtttggggcttcgattgacagagattgtggtgttggttagggttttacggagagtagctgtggatttggaaattgcttatgaaactgtgctgtggcgttatcgggagagagagaattgcggatttgcagttccctcccctttctgcggtgaagtcagtccaatgaggtgtcccacacggctgcttcttggtggccctaaaatataa

SEQ ID NO: 69021 - DNA, 288 bp, Glycine max
  Peptide Sequence Number=SeqID_185799
atgggaagcaggaatggttcaggttatgaagctgaaatggtatccatattctctcaaattgagtcccctgacagatcacttcatgaccatataattgaagctcttggaaagctcactgttgaacaaagaattccttatgttaccaaaaaagtattgagcaacattgtggaaccggcattgctatctcaagatggctctgatttggataagcctgtttctcaagagacatttttggaggaatttaagatagtcacaatgagtgtggctaatcgtgttaatgtaaattaa

SEQ ID NO: 69022 - DNA, 495 bp, Glycine max
  Peptide Sequence Number=SeqID_185800
atggctgaaaatatgccatcattcaagcatgggggagcctactggtttgttgatctcacaactccagatgccttttacattttggcagttttgactgcattgtcattcttactaacagtagagttcagggagcctagcattgaaaatgaaggtcagaaatatggctggatgatcccccacgtgtcggaacagtggggtgctcaaatgctgttggcattcaaaggaagggtgatggggtcattgactggaaaggtcgctagagctcccgcatggacggtggttgctgctgaaaaatgtgccgaaaaaggagaaatatcaccggaaagaagggcagcaagcaaaagtactcatcggaatgcagaaataggtcactggaaggaggacgacaagtggaaaggtctccagtggagcacgattttggttattcgtttgccaagaataacctacgctttgataccatataacaatgttttattgtgtaatgttgtgacttag

SEQ ID NO: 69023 - DNA, 510 bp, Glycine max
  Peptide Sequence Number=SeqID_185801
atgcgccttgtgtgtgaacttcacgcgccaggaccctacatggggttatgtgcgggtactgctcacctacaaagaaatttgcacacaaatgtatttgtgcgagggaccttggtgaatgccattatggaagcggagtacgaaggaatcttggaattcagaagccatgaaaaaagtgctaaacaggggactggtctgggtcaccggagggaagagaagcccaatgttgcggttgttggactgtgggtcagacgatgttttggttgctggaggggggcaattctgtgggtgtggttgcattggagaaaggaagacttagcggtgttcatgcgatcagaaaaacgcacgcagaaagaaataaaagaatggtgcatgatggcagtggcggtggtcactgataaggcattggaaaaggagaaagggttgctagaagacgggcagcgagcagaaaggtccacttgggacctagtccccgatggagaaccactttcgttattcctctgtcaagaataa

SEQ ID NO: 69024 - DNA, 425 bp, Glycine max
  Peptide Sequence Number=SeqID_185802
ataaaaaatatttactagttttgagcaaaatttctaaccggtataaagcgcttcaacacgtttcaactcagcttcaacgtttccaaatcagcttcaagggaagagggacgtgccagggggccaccactagtggacgtgcctggcaggctaccactagtggtcgcgcctggggcccaccactactggtcgcgcctggggccctaccactactggtagcgcctggcaggccgcctggcaggcagacacgaccacccttgtcccatcgtcttgtccagtcacgccacgtgtcgcgttctggcagaacgcgttcctcagaagttgttgctctgcctctgaaagtggggtgtggggtgtgtcgtgagttgagtgacgaagacaacagcgggaggatggggaatgaagggaaagatagaataggaatataa

SEQ ID NO: 69025 - DNA, 221 bp, Glycine max
  Peptide Sequence Number=SeqID_185803
atgggactcaccgaggaagagttctacgcgaagcagttcgagatcaacaacgacatcccggagcctctcatgactacgtgcacgccagctcctcccccgtctccttgtccgtacagaggaagcatggaccaggaagagcttgcgttcattcgcaaggcgcataaggtgcaggcgaggagggtgatgctggaggaggtggagagctttcaatattggattgg

SEQ ID NO: 69026 - DNA, 384 bp, Glycine max
  Peptide Sequence Number=SeqID_185804
atggtgttgaatatcagtgcatctcatatatgtactactcgacaagggaacgagttgaatgcgaagcagattaaggaatataggcagaaggttgaattggagctatcgaacatctgtaatgatgttatgagagtgattgatgagcaccttatccctttggctgcagctgggatgttgaaatgttctgcttgcaagaaaggagattattattgttatcttgccgaatttaagtcaggcaatgagaaaaaggaagctgttgatcagtctatgaaagcatatgagtctgctaccactgcagcagaggttgatttacctcccacacatcccatccgatttggtctagctttaaatttcttagttttctattatgagatactcccctga

SEQ ID NO: 69027 - DNA, 330 bp, Glycine max
  Peptide Sequence Number=SeqID_185805
atggggcgcgataaaggcatccctgtcgacatagctagggctgctgatgacgatgatgagggccattttgcagtagaaggaaatggaatcgaaggggttggtggcggcaagggtggagatgatggggttgaaggtggaatcgataaatttagtgtcgaggagattatggtgttccaaatgacgacgtttcagtgccgcgatgaggtggaggaaggaggaggagacgaaggggttatgaaggaaggaggacttggcggcgtgggcgtggagcaaggtggtgaggaggtgagggttgagagggaggaggagtgtatggatgcttcgttctag

SEQ ID NO: 69028 - DNA, 189 bp, Glycine max
  Peptide Sequence Number=SeqID_185806
atggaggtaggagatctagataaatggaaggtggaggggtgggtgaggttaagggagaacggtgacgtggtgaagcctacccatcgacaagcttattgtggttgggggtacaatgaaccaacatcctatccacattatcttcacgcaccccaacacaacatccctacatctctgttccacacagattag

SEQ ID NO: 69029 - DNA, 528 bp, Glycine max
  Peptide Sequence Number=SeqID_185807
atgtcttctgggaaagttggtgacaagaagtttgaaaatatttctagatcaaatatttcaaggaagaaaataaacaaagcatcaagatgtttgaatgaaaataagaggtcaacaatctcaaaggaaaccaaaaagtctgacggtgcagaaaataggcaatcattgggtgcaaaattatttgctttaatgcagaataattctgagcatattaattctagtaatgaggctgatgatgtagccaacaataccctggttgttaagcctactaaaaagctgagtagcacattgcccgcattagatgcagattcaaagagattgtttgctttgtttaaagaagctacttcatcggttactttggagaatgttgtaaaagagcacatatttgctgctactcatactcactcgttgaaaagtgttatggagaagaccatcacattggggaaattggaaggctcagttaaggctgttcgaacaactctaaggatactagaggatgagcacaatattcgggatgcagaagctgtttga

SEQ ID NO: 69030 - DNA, 390 bp, Glycine max
  Peptide Sequence Number=SeqID_185808
ggaacagatggccaactagaatctgatttttatggaatgttgtctgatattattcaattcgagtatactggcatcccattgatgaagttagttctattcaagtgtgattggtttgataatactccttatatagggacacaagcagataaaaagtatgacattgttgaagctccataccaagatgatgagcttgtagggcttcaagaagtattggaacttgaccctgatgtcattaatgaatctcttgcggatgttgatggaggtggagaagagatagatgcagatttactcaaacaactagacttggttgaactagacgaggatgaatgcatgttaagtgagaatgatcatgacattgagagtgattttgatgatacagatacttcttag

SEQ ID NO: 69031 - DNA, 318 bp, Glycine max
  Peptide Sequence Number=SeqID_185809
atggttaaggtctggaagccatggtgtgttttgatttctgtgctgcatttgttcctccacaccacatcttctgatttcatcgtcaagaatctaccagtcatcgatcgtcagtcatggttgttgatagccgatcatcaattgtctatcgccaatcgtcggtggtcggagatgttagtcgcactcgtcaatcgccaatcatcaattatcgatcaccggtcatcgatcgtcgatcaccaatgtaacgatcacaatcatcgttcatcggttgttgatcctcaacaactgtcacggtcgccgattaatggttgtgattgctga

SEQ ID NO: 69032 - DNA, 255 bp, Glycine max
  Peptide Sequence Number=SeqID_185810
atgacaacggaatggagaaggaagaaagatgattggagacactacttcaaggagaagatgagtcaaaaacaagctcactaccataggaagccatggataagagctttaagcttactaatccaagatcaagtccaagattctccactaagtgtgcttaggtgtcatgacacatgtaaagcattgaggacatgtacaaagtgtggctatatgatgtggcaatggggtgtagcaagcaaatgctcacctcccccttaa

SEQ ID NO: 69033 - DNA, 204 bp, Glycine max
  Peptide Sequence Number=SeqID_185811
atgggacttaataggggttgggaagaagcagcatcaatgttttctagggccgctgtggaattaaagacgagcaatcctgcactgctcgaaactgctgggaaatcttgggataagaaacctaataattctaactcctcaatccaagtagtgaagataaacaatggtgaaattgtagagaagaaatccacaccggtagaagaataa

SEQ ID NO: 69034 - DNA, 311 bp, Glycine max
  Peptide Sequence Number=SeqID_185812
ggatcgcgcccgcaagacacccagtggacccggagaaatccaatagggtcttaggatttctagctctaattatgggcctatgcgtagggcgagacaccacaacagccaagggatggccggcagtgggcaacagacgcaccgtcgccacctccagagcccctcagctcatctacaaaggctggagcgttgcctacgacccgtggccgactagcaggcaaccaagtccaaagccaaagataagcaaaattactatgcctatgaccgacaagtcatcacgcgttcggctcaagacgttaaagaagcgctactag

SEQ ID NO: 69035 - DNA, 683 bp, Glycine max
  Peptide Sequence Number=SeqID_185813
aagggagtcaagtcccactacccctgttagagatgcttcaccttcagcaccagatgattctcttacacctgagtacccactggatccaaattgtgaacatattgttgatcagaggcctttcattcgtgcatataaaggagagtttcaaccaacatatgggtgttctaatttcatatcaaatatcattagggaaaaatttgatgaactagctgcaagttggttgaaggtgtcagttgaccttcgcgataggtggtttggagagtttaagaaagagtataggtggcacccacaagaaaagcgagccattagagctgtttttgagacaaaagccttggacgaacattggggttctacagatttcctaaacaagagctctactgccaaggtgaatcgatctgttgatagaggagcctcaacatactatggtggttccgtatctattgaaactcactttgaaaagttgtcaaaggagtttcaaagaccaccaactacttggaaggtgatggagaaaactaagaaattgaagtcgggagaatgggtcaatgacaagtcccgcgaatttgctaaaaaggaaggcacagctacacaggattcctctaacactgctacttctgttaatgataatgaaatatatttgaatgttgttggaggtccaaattacaaggggaacatgtacgggctag

SEQ ID NO: 69036 - DNA, 888 bp, Glycine max
  Peptide Sequence Number=SeqID_185814
atgcgcgatccatcactggctgccgtcatcctgccgcgctccggtctcggtcacaaacacggcatcgtactgggtaacctggtggggctgattgactccgactatcagggccagctgatggtttcagtgtggaaccgtggccaggatagcttcacgctgcagcctggcgatcgcctggctcagctggtgtttgtaccggtggtgcaggccgaatttaacctggtggaagattttgacgccagcgatcgcggcgcaggcggtttcggtcactctggccgggtgttgaaggtcatggcagaaaaaaaagtcgcgaaacggaatcgtcgcgaagagattttgcaggcgctggcgcaaatgctggagtcgggcgatggcagtcagcgtatcaccaccgccaagctggccgccaatgtcggcgtttcggaagcggcgttatatcgccactttcccagcaaaacgcgcatgtttgatagcctgattgagtttattgaagacagtctgattacccgcatcaatctgatcctgaaagatgaaaaagagacgatggcgcgtctgcgcctgatcgtgcaattgctgctgggatttggtgagcgtaatccagggctgacacgcatcctgaccggccacgcgctgatgtttgaacaggatcgcctgcaggggcgcattaatcagctgtttgagcgtatcgaagttcagctgcgccaggtgatgaaagagaagaagatgcgcgacggcgaaggtttccagactgatgagacgctgctcgccagccagctgctggcgttctgcgaaggtttgctgtcacgctatgtgcgctcggagttccgctatcgcccgaccgccgatttcgacagccgctggccgctgattgccgcacagctggtttaa

SEQ ID NO: 69037 - DNA, 761 bp, Glycine max
  Peptide Sequence Number=SeqID_185815
cgctactgggccgtttctatgcgcaggcgctggtggatggcggcgtcgatttcgacctgctgtttggcccggcctacaaaggcattccgattgcgaccactaccgccgtggcgctggccgatcatcatgaccgcgatgtgccgtactgttttaaccgtaaagaggccaaagatcacggcgaaggcggtttactggtgggcagcccgctgcagggcaaagtgatgctggtcgatgatgtgatcaccgccggcacggcaattcgtgaatcgatggacatcatcaacgcccacaacgccacgctggccggcgtgctgatttcactcgaccgccaggagcgtggccgtggcgagatttccgcgattcaggaagtggagcgcgattatcagtgcaaggtcacggcgatcattacgctgagcgagctgattgattacctggcggagaagccagagatggccgaccatctggcgaaggtgaaggcgtatcgcaaagagatgtttgagcgtagggtgcgcattgatgcgcacctggtggcaaaggtgaaggcgtatcgtaaaaagatgtttgagcgtagggtgcgcattaatgcgcacctggtggcgaaggtcggggcgattgcaaagagtacggcatttaaggtttgccgcggtcgccatgaatggcgcccctacagtcgcaggatgccagggcgtagggtgcgcattgatgcgcacctggtggcgaaggtcggggcgattgcaaagagtacggtatttaaggtttag

SEQ ID NO: 69038 - DNA, 131 bp, Glycine max
  Peptide Sequence Number=SeqID_185816
aggctgatggtgctttggataaagcaagaaagcacaagaagagacagctacaagatacacttaatcttgtcataaagaagaggaggattgtcctttacttgtgtgctgtgcacaattatgtgctatcttga

SEQ ID NO: 69039 - DNA, 924 bp, Glycine max
  Peptide Sequence Number=SeqID_185817
atggatgttgatggtgctaaaggtggttcacatgatgaaaatgaagtacttggaactggtgtacaagatacaaaaattgaagttttggaaacaagagttgaaacaaaacctgaagttgttggaattgaaactgaattgaacaatgatgcagatgatgatgaagttaaagaacatgatgggggtactgagttttctgatcattctgaaagtgacccagactatgtatatgtgtctccaaaagatgatgggcaatcaagtgacacattggcagatagttaccagtctaaagaatttcaatcccttcctaacagtgatgatgaaggtgactccaattctaaaatcatgtatcctcaatacaatcctacaagtagttttggacaagtgcagttgaaggctaggatggagtttgatactatcaaaatgtttattaaagctataagagactttactattttccatggcagagatctgaaatgggtaaaagttaacaacattcgagctagagcacgttgtaaacaagttggatgttcatgggaaatttattgttcatggtttgaagttataagaagctttcaaatcaagacttttttggaggagcacatatgtgtaagggtcttcaaaaataaacaagctacaatgaaatgggtggcaaaaaaggtggcggataaacttaggtttcatccaaacctaaatcatgtggagacacatgaacatcacagagaacactatggtgtgcacattgatgaaagaaagatgtttaggactatcaaagaggctcgatcactagttgaggggttgcttcttgcaatgcaggaagttatgctaggtgttaaacacaagtattgtgttatgcacttatggaggaatttctccaagcagtggaaaggcaacaggttaagaggcatagtctggaaatgtgcataa

SEQ ID NO: 69040 - DNA, 621 bp, Glycine max
  Peptide Sequence Number=SeqID_185818
atggtggccgtaatggtgccatcaccgttgtgttttccgtcgtcgtcatcatccatttggattttgaaatctggaacacagatgtgtgatgaaatcactcttattttgcaccataatgataaattcatacaaaatgcaaatggggcattgagtatgtcggtggtgaattctgtgtctggaaagaagttgaaacatatttgtgtagaaaaagtggttgaggctgttcctgaggactctactgagaatggtactgaagatatggatgttgatggtgctaacaatgtgggtaaagaaactgaagttgttggaattgaaactcaagttaacaatggtgcagatgctgatgaagttaaagaacatgatgaggatgttaacttttcttatcattctaaaagtgacctagactatgtatatatgtctctagaagatgatggacaatcaagtggcacaagtaatgataattaccactctgaagaatttcaatctcttcccaacagtgatgatgaaagggacaccaattctaaaattgtttatcatcaatgcaatcctagaagttgttttggacaagtgcatttgaaggttgggatggagtttaatactatcaatatgtttgttgaagtt

SEQ ID NO: 69041 - DNA, 366 bp, Glycine max
  Peptide Sequence Number=SeqID_185819
atggtgccgttacgaccaaccaaaaataacatcaaaaaaatgacatacacatacaaaaaaagtgatgaaaagcgtagaaaaatgagtgaacaaacgaaaaaatgtaaacctgggtgtgcgatagagaagaagaaaatgctatggcgatcgtcgtcgggaacacagtgcgttaaaaaaggaagcaccttggggaaggaagcaatggaagtgtgcgagaagaagaacaagagtcagcgttgggaaaggaacgccaaaagaagaaaaagaggcgtaatgggggaaagagaagagacatcaaggaaaaggggagcatcgaaccaggttgtcaccctccccctcaccaatcccacagccaaaaatttatag

SEQ ID NO: 69042 - DNA, 393 bp, Glycine max
  Peptide Sequence Number=SeqID_185820
atgaaaggtcggattagggttttcgttctctaccggaaccgcaagccaagttggcagattccgctttggttgaaggattcctctcggtgtgggttttcaatggagaacaatgatggtttgtggtggctaatggtggctgtgggtgatggagaaagttcttggaactttagaaatggctttggaagaaagaaagaagaagaaatgacacatcttctcaaagattccaacggtcagatcatgcacaattgtcttgtgaagttgcaaaccaaatttggagaagatccaacggttaacgaaggctgggcagcgtttttaccgaggcagcttcatgtagttttctctagaagcttcattaagaggcttcctccagaagcttcattaagaggcttctag

SEQ ID NO: 69043 - DNA, 498 bp, Glycine max
  Peptide Sequence Number=SeqID_185821
gcttttgacaatttgaaagccgcaattaccaaggcaccagtactggcattgcctgatttttccaaagcctttacattggaaactgatgcctctggtattggcattagggctgtattgagtcaggaacaacacccaatagcttttttcacaaagaagttcacacctaggatgcaaagacagtcagcttatattagggagtcctatgccatcacagaagcagttgcaaaattcagacattatttacatgggcatcgatttgtgatcaaaactgaccaaagaagcctcaagtcactcactgagcaagcaatccaaacaccagaacaacagaaatggctacacaaattgctaggatatgacttctctattgaaaacaaactggacaatgagaatttagttgcagattccttgtctagatcatttttcatggcatggtctgaaccaaaacttaagttaattcagttgttgaaagaggcaatacaagctgactctcagttgtag

SEQ ID NO: 69044 - DNA, 672 bp, Glycine max
  Peptide Sequence Number=SeqID_185822
atgaaaaatcagatgaaaggttgttttgccgccgtactgttcgcctgcgcgggcagcgcggcagcggctaccactacgctcaacgccctgtttatgacgcaggcggcctacagtgaaaacgacatccgcgccatgactcaggcgtttcagacagcgcacccggacgtgcaggtcaatctggagtttgttccttacgaagcgctgcacgataagattgtcgcggcacgcggcgcgggcggcaacggttacgatgtggtgctgtttgatgccatctggccggcggaattcagcaagttcgacctgctgcaggatgtcagcagccgtatcagcgcagatgaaaaagagaaaatcttccccggcgcaatgaacaccgtggtgttcaaaggaaaaacactgggcatgccgtggatcctcgacaccaaatatctctactacaacaaagcgatgctggaaaaagccggcattaaagatctgccgcaaacctggcagcaggtgctggatgatgcgcgcatcattaagcagaaaaatatcgttaaatatccgctggtatggagctggtcacaggcggaagcgctggtgtgtgactacaccacgctggtctccggcttcggcggcaaattctataacaacggcaagctcgatttctctacgccagcctcgctgcagcggtga

SEQ ID NO: 69045 - DNA, 1044 bp, Glycine max
  Peptide Sequence Number=SeqID_185823
atgagcaccaaacaaattgtagatgccaattaccggtttattgccgcctatcaggagatcaacgtcagaattgcacagcgacagcaagcgcttgcaatattggtcacactgacggtcagtttactggctgccctggtggctctgaagccaggcgccggggcgagcccactaccagttgaatgttataaagccgagcgtgccattactaacttgcgccagtttctgtcagagttggagcagcttgaaaacgccaatacatgcttgccgagctataacaccgaccccagagcatccgctcattatttggctgactgtgattgctgccttggtggctttagtcgccttgttgtggattccacgctggagttatcggccgagttgaatgtgagagcacagatgagcaacatcgcgatagcgtcatattactcagccagagcccaagaatatgatcgcgtttatttgaaaccagagcgccaggcagatttaagggaaattgagcgctggttaccttcagtgttcaaaggtcatcacctgatcgagatggcttgtggtacaggctactggacgcagtttttagcccccgtcgtgcgcgcgttggttgggatagatgcatcacctgaggcactggcaattgctaatacgcgtgtgaccgcgccacatgtgcagtttttgattggtgatgcgtatcggcccgcagtaagaccaagccatttttcagctgcttttgccggattttggctttctcacgtgccgcgtgagcatcttggcctatttctaaatgcactccatcaaaccctgatgcctggcgcacgtgttgtctttttggataatcgttatattgaaggtagtaatacgccaatcagcgagcaagatgcatgcgggaatacgtatcaaatccgctgtttggaagatggcaccacacatcacatcttgaaaaattttttaaccgagcatgagctacgtagcgtcgtcgaatcttctgctactcagcttcagtttcatagttggcaacatttttgggcagttgagtatgtgctagcttag

SEQ ID NO: 69046 - DNA, 1481 bp, Glycine max
  Peptide Sequence Number=SeqID_185824
atgacggccagtttgcaacgtgccaccggtggccgtgcactgtataacgtcattaccggtggtggtggtccgcaaactgtggtggggagacccggcatctgggcgggtggtccgttctcttacaatggccagttctaccaggtcgaagatgcaggcctgccagatccgttgtccaaagaagagtacccagaaatttatttctccggctcttctgatgccgcgctggcatcagcctctaaacatgcggattactatttgtcatggttggagcctttggatttaatcaaagaaaaattcgcccgtgttaaagagcgaaccgatcatctgggtcgcaagatcaagtgctccatacgcgttgacatcgttgcgcgtcccactgaagaagaggcctggcgtgaagtgagtcgtggttttgacaacatccctaaagaggtgttggaccgctataaagcacaaaacgctggagactctgttggtgccaaccgccaacgcggcttgcgcccccaaaccatcaacagctacaaagactttatcctgtcacctaatatctggacgggtttcagtctgttacgcggtggccaaaccctgggcattgtcggcagctatgaaaacgtggcagcaaggttggacgaactggtgcaattgggtacggatgcgtttatcctcgcaagcaccccgcacctggaagaagcttaccgtgtaggcgaagaagtcttgccgctgtcaggcgccgtgactatttctggagttagtcatatcacatttgtagtgcgtgatattgagagggcagcagagatatggattgaagagttaggggcagaggaaggcgatccaggctccagatcttaccgacatgttgctttgcaagcagatagcgctgatttattcgaagtggaaaatcgtttgcgcttactaggcgttgagattgcgccgggtaggaacggcttgaccgctataaaaaagggcgacatgactgacgctgtcatgctgagctcacagtatcggatagaaaagagaatgagtattcctgccgcaattaaacgaacttcgcgtttgactggcgattttttgttgagatctggccagcacagccatacctactttgataaataccgttttgaagcagatcccgtcttgcttaagcagattgcacaggccatggttccgttaattcctgaaggaacacaagtcctggctggcctggagctggggggtatccctattgctacagtgttaagtcagttgactggcatccccactgcatttatcaggaaagcagccaagccttatggcacctgccgttatgcggaaggcgctgagttaaaagataaacgttttgtattgatagaagatgtggtgtcaagtggtggcgccattttagaggcgatcaaattgctcagtgacgatggcttgacggtagattctgccatttgtgtcattgatcgtgaggctggcggtcacgcggctttgcagtcggcggg

SEQ ID NO: 69047 - DNA, 828 bp, Glycine max
  Peptide Sequence Number=SeqID_185825
atgggcttcccagccaacggcgcctctgcggcccagcccctaaacttcctcatctacggccgcacgggctggattggcggcctcctcggctccctctgccgggcccagggcatctccttccattacggctcgggccgcctcgagaaccgggcctccctcgaaaccgacatagccctcctcaagccctcccacgtcttcaacgccgccggcgtcacgggccgccccaacgtcgactggtgcgagtcccacaaagtcgagaccatccgaaccaacgtcgtcggaaccctcactctcgccgacgtctgccgcgaccacggcctcattctcatcaactacgccaccggttgcattttcgagtacgactccgatcaccccctcggatccggtatcggcttcaaagaaaccgactctcccaatttcaccggttctttttactccaagaccaaggcaatggtagaggatctgctgaagaactatgataatgtgtgcacattgcgagtgaggatgcctatctcatccgatttattgaacccgcgcaattttatcactaagatcactcgatatgagaaggttgtggatattccgaattcgatgactatattggatgaactgcttccaatttcaattgagatggggaagaggaatctgactgggatctggaactttactaacccaggagtggttagtcacaatgaaatcttggagatgtacagagattatgttgacccgaacttcacctggaacaacttcactctcgaggaacaggccaaggattctcttattaagtatgtcttcgagccaaaccagaaggttaaagctcaagtctaa

SEQ ID NO: 69048 - DNA, 189 bp, Glycine max
  Peptide Sequence Number=SeqID_185826
atgttttctctcacctatagccatcaggaacgtagagagaagcagaaagaaaggtctaaggaagtgaaatcttatttctctcctcttcgaaggaaatcaaagcacaccggagagaagtcttcttatagagaaaggtacatgtcttcctacggagagaggatcctaaacacgaccacgggttccaaataa

SEQ ID NO: 69049 - DNA, 657 bp, Glycine max
  Peptide Sequence Number=SeqID_185827
atgtacctatccaacgtcctttttggtttccctcttctcctttttacagaaccaaaaatcttcaatggtctcttgccaatacatccagcaattatcaaggcgctgagctggaagcaaggtattgatagggatgacccatcatcaagtcgaggcacctcatggtttaaaaaacaatattctgatggggcctctggaaggtaccggaatagcaataaaggatcaagtcatcggtacagaagagatccttctttttgtgaagatgattttgatgttgaaaccattctccgttctgcctttggtgggaatagattcttctattggtccttcatcaatgaggaaaatcctcagtggaggaggtctgaacgcttttctaattttgagaaatcatggagctggagatatcgaaacgaaaatgattatgactcttcatctgagtctgatagtttagattcagatttagtttctgatagattagcccttggattgagtgcttcaggttccctgaaacttgaagatgtaaaaaatgcgtaccgggtctgtgctctaaaatggcatccagatcgtcatcaaggctcttcgaaggctatagcagaagagaagttcaagctttgcagtgcagcttatcaatctttatgtgataagctggccttggattaa

SEQ ID NO: 69050 - DNA, 762 bp, Glycine max
  Peptide Sequence Number=SeqID_185828
atgatgcatcgtcagattgagatggagaattctgagctcttccaattcctcacaaacaccaacgatgctttcttcaacactgcatcatatggcctccctgcggcacctgcagcatcaaccatgcagcacagcttctctggctccttttcttattaccctttggaagcatctcatgatcatcatgccccttctcatgaagacaaagcccttgctgctttgaggaaccacaaagaggctgagaagagaagaagggaaagaatcaactcccacctcgataagcttcgcacccttcttccttgcaattccaagacggacaaggcttcccttcttgccaaggtggtccaacgggtgagggagttgaagcagcaaatatcctcactatccgattccgaagcgtttccgtcggagacagatgaggtctccgtcttgtccaccagcggtgacaacgacgaccacggtggttgtgacgacaatgacggacgcctcatattcaaggcctctctgtgctgcgaggaccgctccgatctcatccccgagctcatcgaaatcctgaggtctctgcgcctgaaaacgctcaaggccgaaatggccacgctcggaggaagaacccgcaacgttctcgtggtggccacggataaagaccatagcggtgaatcgatccagtttctgcagaactcgctgaagtctctggtggaacgctccagtaattccaacgacagatccaaacggcgccgtgtcctagaccgaaagttcattgcttaa

SEQ ID NO: 69051 - DNA, 324 bp, Glycine max
  Peptide Sequence Number=SeqID_185829
atgggatccatcagcaatgaggggtttaatggctttcagcaccagtgtggaagctcttatacagaaagagctacaggaaaatcactccattttgcaatccctactccatcatcgtactgctctcatacagctactaatcacattagaagagaggacaagatattatgctgggtggtgggactgaagcagcaattgtgccaactgcctagtggtgttggaagcttcaattgcctgcagcctacaggactttgtcttagaggaacaaagagccaaaaagagcttcaagaccatgagacaatggtaatgatggttttcaatggatga

SEQ ID NO: 69052 - DNA, 414 bp, Glycine max
  Peptide Sequence Number=SeqID_185830
atggatttgcaagatgactgttgtgcaacaagattctctaacctttgtcttctggaaaagaattgtataatgattgtagttggctgcctcattgaacatgataacaaggtccttctttgcaagaggagtattcaaccatctcatggcctttggacccttcctgctggttatttggaaattggagagtctgctgtggaaggtgccattagggaaacaagggaggaagcaaatgcagacgtagaagtaatttctccatttgcccaattggatattcctttaattggccaagtagagaattttgatcatgattatggaatgtttgaggcagagttacatgatattcttagcaaagctgaagaagcaccatttttcacctggttattttctctaaatataatgtattgtctggtttga

SEQ ID NO: 69053 - DNA, 252 bp, Glycine max
  Peptide Sequence Number=SeqID_185831
atgtgcgcaattgaatttcgaacaacatatccaaatttcatgaaactccaacgatattattttgaaattctcaacggtgagaatgttcgaaattgggttgagaacatagtactcaaatttcacgacgatccaacagtggacgagtccgagatcatcatttttctgagacaggtttggtgggctgcgggaaaaagaaagagttttgagaggagaaggggaaaaatgaaaatgaggccaaaaagaggcacctga

SEQ ID NO: 69054 - DNA, 183 bp, Glycine max
  Peptide Sequence Number=SeqID_185832
atggagaagctgcaacaccatagagagaaagccttgagtggcgcaggtgatggctacagaagcgatgacactgacggtggccacaaaagtgacaacaccagagagagtcgcgacaacaatggagaaagagccttgagtgacaccgatggtggctacaaaagaggtgacacacaggagagatag

SEQ ID NO: 69055 - DNA, 1365 bp, Glycine max
  Peptide Sequence Number=SeqID_185833
atgggatcattgcacaaggacccaaatgttttccactttagccatccacatcctttggactgtaccaccccaccctccacagaaaacaataatattgtaagctgctttggatgcaagctaaaagttaagcatggtgaggactattaccagtgcaaaacatgtgctttttctcttcaccatgtgtgctacaagatgcccttgatcacaaaccacccttcacatccaagccacgacctagtccttcttgctatacctttatcatcatcatcaccttacaccaaagccaccctcaactgcgtggcatgtgggaaccatgtcacgggcttttgctaccactgtgccgaatgcagcatcttctttcactcgttgtgtcttgcacttcccctgtccctcgaaatcaccttccacccccacaaaatcaagcttgagttttcaccaccgtatgatttcttctgtgacttgtgcaacaaacccagttacaataatgggtggctatataggtgcaacatgtgtgaattcgatactcatatagtttgtgcctttgaaaacttggagccccacttgtttcaaaacccgtctttccctcaatcaagccctttgttaaggcaactcacgagttaccaagtggaacacaaaagggttagtgcaagtgttggtgatagttgcaaagggtatgagtatgagatcatgagtttggtggcacaacaaattggtgggggaatcagagaaaattctgatggtgcagtcgttggatgggacaagagattatacagtagtccaaggaaaaagcataacaaaactgggagtgggaagatgaagattattagtgaacttgaattacaagaaaaagaactaagtcctgctgaacttttattgaagttagaagaaagaacaccacttcgggataaattgactccactttctgatcattcggaaacaccgtttagtaaccaatatagtgactcatatttttcaatagatttggcaaagtcatattcaacccatcatggacgtagaagtcaggtaccaagagaagttggtagtgaccagataattcgagctgttactatgccagagagagtaattgtaagcaattctggacaacgtgaagaaccattcggtctagtttattggccattcaacgattcataccatgtggggcaacagaataaggtgaacaacgcagcgttttacatcaaagaaggaccaactactgattttgggaaatcaacttcaagccagagaatcgtcaagaaaaatcctaaccaaaacattgccaaaaggtctgttgatcaagatcaaacaattgccaaatcagagtcactaaaagacaaaaatcattccacatattcaatccatatataa

SEQ ID NO: 69056 - DNA, 219 bp, Glycine max
  Peptide Sequence Number=SeqID_185834
atgagtgtttatgtttacaattccaatgcagattgcaaaacaagtctcaatctttctttctgcaacgcaactacctaccaatttgatatggtaggtccacaagagcagctgaggaattcgcagatatataaggggctcacctgcttatcacgactcatgaatgcatatggtgatccagtgtataggcacgaatatcagaaggacttgtacccggcctaa

SEQ ID NO: 69057 - DNA, 444 bp, Glycine max
  Peptide Sequence Number=SeqID_185835
atggttccagttttagcaattttagtttgttctctcataaattccaggtcacgatgctataactaccccgcaatgcaatttggcttggaaagcaacaaaggcataagagtacgatttttcagaagaagagtgaccaatgtagatcctgctccaacaatctacagtgctaccattagatcacggaagggagtggaaatcacagtgaagcctactagcctcattttttctaaaaacctgcagaagatgagcttcaaagttcaaagtagttgtgattgtgaaagccacatttactgcaagtcaccacgctatccaattgatcccgcacttctcccttcacccgaaacctttttttacctcggtttgacagatgaacaatccaaaacatcaaaactacggaaatcccaaccaagaatcagccacgtgcccccaaccaacacacgttag

SEQ ID NO: 69058 - DNA, 1704 bp, Glycine max
  Peptide Sequence Number=SeqID_185836
atggagaagatggagcatttcagccacatccaccctcttctgttaaagcaggaagacagcaattacaacaaccaagtcctttgctcaggttgtgaaaaactaatttcaggtcctgtcttctgctgcgtccaatgcaactacgtccttcacaaaaagtgcgcacaaattgcacgccatgtgaaacacccatttcaccctcaacacccccttgttctcctttccaccaccccttatgaaggaccatacatatgtgattcctgtagaggcctcttcattaacttcgtataccattgttatcattgcaactatgaccttgatgtctcatgtggttctcagtttaaccctgatgatggccacaagcatgagtttttgtctgtgacaaatccacaatcttttgtttgttatgcttgtggcatgcatgcaaacgagggtcttgcttgcttatgcaccatttgtcagatttgggttcattctagctgcgctgaattgcctcttgctattagaataaaaggtcatgaccaccctttgaagctcacttatacccttcatgtttatggtttctggggtaacttaacttgtggtgtttgtaatgaagcaatgagtccagcttttgcgggttacttttgctcaacatgcaaatttgccgtgcatttgaagtgcccgcaacaatatttaagaggagagtacgaagatgaggaatcattcacaggctatgaaactgaggaatctcaagatattgattttacttttagtttctttggtcatgaacatttgttgaagttcacggaggaagagagtgatgatgatgtgaaatattttgataaactctgtgatgcgtgtgtccgacccatcatgccacctttcttttcctgtgaagaagaaaattgtggcttctttttgcaccaaagttgtgccgaattaccaagaacgaagcaacacccgtttcacacgcaccctctaactcttcaatccaaggctccttatgatggcatttacaagtgcgacggatgcagaagattgagcaatggttttgtttaccgttgtgatgtgtgtcaattcgaccttgatgtttgttgtggtacccttgaagagagaattgaacatgaaagtcacgtgcatcccttgttcctcaagaagacaagcgtttctaggcagtgcaaaggttgtcatctttggtcgaagcttgtgtatgtgtgtgatgtttgtgaggatttttctgttgattgtggatgtgctactctaccgagtaagacttggcacatgtatgacaagcatcctctaagtctaaactatttcgtggaagggagtttgagggaacatgaatgtggcatttgcaatgagaaaatgtctccgaagcaatggttttattattgtgatgattgtgactctggtgctcacccttcttgtgttgttggcaagtctaggcgtgtgaagtttggaggcagtttcaaatatgatgttcactcacaccctcttgctttggttgaagaaactgagcagaacaatgaatgcggagcctgtggtgaacgctgcaatggatggacacttgaatgtggccaatgcaaaggctactttcaccgggaaggacagtgtttttggaaagaatttaaaaagagtgcaaagtatttggagttatcaggaatgatgagacacaggtatgcagcaaacgtgttggcctccacgcccaatgctaccacaaactga

SEQ ID NO: 69059 - DNA, 288 bp, Glycine max
  Peptide Sequence Number=SeqID_185837
atggattctgccgaaagattaattgaggaccttgagtcatatattcataatcacctaagaaatggtgtcagtacaaattcaactcgtgatgggaatgttactgcaactgattccacacctgcagcttttacatctcattttagtaggaatgttgacaccactgctgatattggcttagaaattcagacaacagataaggaagcattcgtgtttcaacttcaaagaaagtttcaaatgatcgcagaagaaggagatcaagatgaaggtcttttatgtaaggagatgtaa

SEQ ID NO: 69060 - DNA, 825 bp, Glycine max
  Peptide Sequence Number=SeqID_185838
gacgaggttgttagaagggaaggtgagagtggagaagactcgggagagaagggtaatcatagcagaaaaggacgctcttttggttcggaaaaaacacaagctgagttgttgccaccgttaagcccttcttctactcaagatgggagatggtacgagggagagaaggcgattccgctgaagaaaaggagagggaacttcgaggagaataataacaataatgctgctactcatagcaagaagatgaaggcaaagatgaagacgaagatgaacaagaaatgttcgacgcgcaacaaggaggatagcatgggagaggaattagacgaggaagatgaagaagagaagaaggtagaagaaacaaaagcggaagtgaatattgtgagtaaaaagagagcaaggggtagtgcactcatggaaggttctaggtgcagtcgtgtgaatgggagagggtggaggtgctgccaacaaacgctggttggttactcgctgtgtgagcatcacttggggaagggaaggctcagaagcatgacaagtgttagaagccgttccattgcttcaactgcaccaaaggaggtgcacgtgcaccacttgcctgacccatcttcttcttcttcttctcctcctccttctttttgttctcttgatcatgagaatcaaattgagtgtgttgataatgctgagccctttggggatgaggagaagaagccagagataataatgacgaagaagaggatgaagcttggcatggtgaaagcccgttccataagcagcttgctggggcaaacaaacacccagattgctgctgtagctcatgagaatagcaagtaa

SEQ ID NO: 69061 - DNA, 270 bp, Glycine max
  Peptide Sequence Number=SeqID_185839
atgacgaatgcaaaaaagagaaactcttccaaaaataggcgtatgtcgctttatgtaacggctacacggtattctttagtaaaaggcgaaagaatagttcgctttgtagccattacacgactccgtaattttgagagactagaagctttcttttttataccatcaatagttatcttcctctcagtacactacacgatgtgggctttaataagaagcatagacaagcacactcgactcgtccttgtggtgtcgttcttccctcattgctaa

SEQ ID NO: 69062 - DNA, 636 bp, Glycine max
  Peptide Sequence Number=SeqID_185840
atgtctaaactttgtaccttgtgtgcgtgcatgcttgtgttgtgtgcactcctaaagctatttcttttgtttatgtcattctccctagcagttgaggcacttcatgcattcatacaagatgaatcagagcacaagcattacttgattgtttctgcagtgaccaatttatttgtgaatcttgttggtgtatggttcttcagaaactatgctcggattaatcttgcttacagaaatgcagaagatatgaatcaccactctgttttcctgcatgttcttgcagattccattcgcagggttcagaatgcagaagtcttgtgtttaggacttgtttctgttgcagtttttatgcttgttctgcctctctttagggcaactggtggtatcttgctccaaatggcacctcccagcatcccaactactgctttgaacaaatgcttgagacagatttctgctcgggaagatgtaatggaagtctcccaggctcgtttttgggaattagtgcctggttatgtggttggttcacttataatacaggtaaagaaagggacgaacgatcggccaatactagaatttgtgcatggtctataccatgatttgggtgtacaggacctcacggtgcaaactgatgatgcatga

SEQ ID NO: 69063 - DNA, 317 bp, Glycine max
  Peptide Sequence Number=SeqID_185841
atgaggatccggaaaaggccggtgcttttcccttcttggctctcgccgttgcgtctctcagatccccacctgatcaaccggtcaccggtggtggtgcaactaagcgacgctacttccaccgcaccgaaactttcttcttcttctgctgctgcagtgttccctcaccatgctgcttccgcgccttcgtcgagcttggatcgttgccagccgtctgatcagcctctcccttcgatcgggaaacgaagcaacggctctgatgatccctccggcatcggtgaaagtggggcacacggacagcacaacaagcaagacccttt

SEQ ID NO: 69064 - DNA, 519 bp, Glycine max
  Peptide Sequence Number=SeqID_185842
atggtgattgacaataacgatgatgatgataatgaaagtgacactggtggtgtcggcgatgtcgatggtggtgacagtaacgacatggtggtgatagcggtgttggtcatggcagtcaatggtggtgacgacaacattggtggtggcaatgacgacattggtgatattgttggtaatggtggtggtagtgacaataacagtgacattaatgataatggttatggtaatatcagtggtgatgataacaacaatgacaattgtggtgatgatagcaatgttggtggtgacacaaagtggaggcgacgtgatggtgatggtagttgctacgacactggtggtagcaacaattatagaagcggtggtggtaacaataatgatgacagtgacattaatggtggtggtagcaatgctggtggtgacaatgacgatgacggtgatggtaatattagtaattgtgatgatgacagtgacaatgacaatgatgatgatgataataaaaaatgtcattgtcaaatgtaa

SEQ ID NO: 69065 - DNA, 195 bp, Glycine max
  Peptide Sequence Number=SeqID_185843
atgactatagtgaggtcttgtgttaggattgggaaagatgtgaaagtggtgaacgaaccattgcttcgaagtggggaggagaaaagtgaaagcgcgatcatggcgaaggttcacaaacgagagcgccaatggttggatggtattttgccgataatagatgatgtgaacatggctaagcattttctgaggggttaa

SEQ ID NO: 69066 - DNA, 996 bp, Glycine max
  Peptide Sequence Number=SeqID_185844
atgtcttcttttacttattccctattcaccaccattttcttagtgctaacaatctttcttcatccatcaaatgctcaactgagttcaaccttctactccagcacgtgccccaacgtgtcttccgttgtgcgcagtgttgttcagcaggctctgcaatctgatcctcgtattgctgcgagcctaactcgtcttcattttcatgattgctttgttaatggatgcgatggatccattttgttagacgtaggtggcaacataacactgagcgagaaaaatgcaggtcccaacaacaattcagctcgtggctttgatgtagtggacaacataaagacatctgttgaaaattcatgccctggtgttgtatcttgtgctgatattcttgcccttgctgctgaagcttctgtgtctttgggaggaggtccttcatggaacgtacaactaggaagaagggacggtttgattgcaaaccaatctggtgccaacacatccattcccaatccaactgaaagcctggccaatgtcacagccaagtttgctgcagttggcttaaacgtaactgatctcgttgcattatctggtgcacacacttttggccgtgcgcaatgtagatttttcaaccagagactgttcaacttgagcggcacgggtagccctgatcccacgctgaacgcaacctatttggcgacactgcagcaaaactgtcctcaaaatggaagcggcaacactctgaacaacctcgacccttcgtccccagacaccttcgacaacaactacttccaaaaccttctcagcaatcagggccttctccaaaccgaccaagagctcttctccaccaacggcgccgccacaatctccgttatcaacaacttcgccgccaaccaaaccgcgttcttccaagcctttgctcagtctatgattaacatgggtaatattagcccgttgactggaagccggggtgaaatcagatccgattgtaagagggtcaatggaagttaa

SEQ ID NO: 69067 - DNA, 279 bp, Glycine max
  Peptide Sequence Number=SeqID_185845
atgcagcacaatctcttcgtatctgttatggacaacacatatatggtccacaaaatgcagacgcagatgggtttgctaacgagtaatgacctagctggttactgcaacagtgcagtcccttcccataaccaccagcacaagctgacactagaatgttgcttcaaaactataaaatccttaagggttaatcttttctctctccatgcactgaattcacactccaatactcggcctccttatttgactattcctctcactctgacccaacttcaacgttag

SEQ ID NO: 69068 - DNA, 263 bp, Glycine max
  Peptide Sequence Number=SeqID_185846
atggtaacaggcatacttagcaaggcccaagtggagaaggacgaagaccgaagtggaaaaggacgaagccccaagtggagaaggatgaaggtgcaagtggataaggacaaaggcccaagtggagaaggacgaaagatccaaacttatcaaggtaatccttgtggcatctaccctgacttatcttctttcattggaagtggcgtcatccaaatctccgtagcctgtatcaagcgatccgctcctagtcaggatcacatcatctg

SEQ ID NO: 69069 - DNA, 879 bp, Glycine max
  Peptide Sequence Number=SeqID_185847
atggagctagctttgagcttaggcgacacacccaagcccttctctttgcccgcaaaaaatgattctgtgagtttcaaaatagcactgggtgacgacaaaagggtttcttcagatccacccgttcagctcgaccttcttccttcaacaccagttcttccttcttcacgccttcgaattccatggctctccgatgcactgggtatggaacgtgtgacatcagagattccggtgagggcggtggatgacactgacgatggtgctgcactttcatcccccaacagtgcagtgtcatcttttcagatggatttttgtttcaggaacagtagaaagtcttgtgagggtgccagcgacgaggacgacgaaaatggctcaacaaggaagaaacttagactctccaaacaacaatcagttttcctcgaagagagcttcaaagaacacaccactctcaatcccaagcaaaaacttgcgcttgcaaaacagttaaatctccgtccacgtcaagtggaagtttggtttcagaacagaagggcaaggacaaagttgaagcagacagaggtggattgtgagtacttaaagagatgttgcgagagtctgacagaagagaataggaggttgcagaaggaactgcaagaactgagggctttgaaaacatgtcagccatttttcatgcagcttccagctaccactctcaccatgtgtccctcctgtgaacgcgtcgccaccaacaccaccaccaccggcgccgccgccgcagctgccacaaccaacaattataataatgtcgcttctgcccccatggccaccaacaataatagcgtttctcaaatctctgccgtgttgtctgttgatcgacaagcccgtaatattgccctgacctaa

SEQ ID NO: 69070 - DNA, 1848 bp, Glycine max
  Peptide Sequence Number=SeqID_185848
atggctgatgccaccaagtatgttcccatcggtggtggcaatgtggccacggacctcaagagcctctctttcattctcaaaaccaaaaaaacagtggctgctgcatacgctttcatactcgccttcgtcgctttcactgttttcttagccttttctccttccccaaacgcttcctccccctggttcaccaacatattctcccccgcatccaccaccgatggttcctacaagcctcaaattcccaacattttctctctccttttcccaaactcctctgatcccctgcacaataacactaactcttctagatctccttatccaaacacaaccactgaatctcaaacactcaaagaaacctctttggaaaacagaacacaaacaaccttagtgaattcaacccaagatgcagttcctgttccaaccacaaaccagaccacggattctcacgcgccaagtttggaggtgaagtttccaccaccccttgctagtaaggaaccaccaggtgttgtaaaaaaccagacttttaactctggtgaagctaaacctatgagcacaaatcaaactacaaatgctactgcaactgcaaccaatgtttcagtgagtttccctgtccagaatgttccaaatcagaacacgagttctaattcttcggtgaaggtggattcggtaaagggtgttgttgtgtcgaatgataattacacggcttctctggcgaggaaacagagcaatgggaagaaggatcacgctaaggggagcgatgaatcgatggagtctctgatgaagtgtgatttttttgatggagagtgggttaaggatgatgcctatccactctataagccagattcttgctctttgattgatgaacagttcaattgtattaggaatggaaggcctgataaggattatcagaagtataagtggaagccaaaggattgcacccttccaaggttggatgcgcatcgaatgctgcaattgttgagagggaaacgactggttttcgttggcgattcgctcaataggaacatgtgggagtcattgatttgcatactgagaaatgctgtgaaaaataaacacaatgtttttgaagcaaatggaagagtccattttagaggcgaagccgcatattcatttattttcaaagattatcacttctcggtggagctttttgtgtctccattcttggttcaagaaggggaaatgactgataagaacgggacaaagaaggaaacacttcgtctcgatttggttggtaaatcttcatctcaatacaaagatgcagatattctcgtcttcaacactggccactggtggactcatgataaaacttctaaagggcaggactattaccaagaaggtagccatgtgtatgctgaattaaacgttcttgaggcattcagaagagctttaacgacttggagcaagtgggttgatgccaacataaatccgtccaagaccatggtcttcttcagaggctattctgcttcccatttcagtggtggacaatggaattcaggtggacaatgtgatagtgaaactgatccaattgacaatgagaagtatctaaccgagtatccagataaaatgaaggttttggagaaggtgctaaagaatatgaaaacccatgtgacctaccaaaacatcactagaatgacagatttccggaaggatggtcacccctcaatatacaggaagcaaaatctatcaccggaggaaagaaaatcacctttgagattccaagactgcagccattggtgccttccgggtgttcctgatttatggaatgaagttctctatgctgaacttctattgagagagtatcagaatcagcatgagcagaagcataggtaa

SEQ ID NO: 69071 - DNA, 423 bp, Glycine max
  Peptide Sequence Number=SeqID_185849
atggagtcaccatatcaattaggttgggatcatgagctgaagggtgataaagctgcaaagagtggtgaaatagaagcagagtcaggtgatgagcataactacacagagaatcataaaccatgcaacatgtccaaggagagtggaaattcaatcccaatcccacacaagggtcaaggaatagctgaaaaactcacattggagtttacatttcacttatggtgcctgatgggacttcatgggacttctagttcccagtgtggtgtcagaaagttggaccttcaatgtactgagaaaacacaacagcaaaccattgaaattagtgcatttggaagattttatttacaacttatcttatggcatacatacttatgtaagtatttgagaaagcttatggcttatgatatgtccataatgtgtttttag

SEQ ID NO: 69072 - DNA, 198 bp, Glycine max
  Peptide Sequence Number=SeqID_185850
atgggtccacactcagatcaagtgtttttctgggtggttgttagtttaggaggaagggatattcttcaaataaaccatcccgtcggcccttttggcacaaagtttttctccgcaattgagacgtcgaaatgtgatctttacattcccgttagcaagctgaagcaaacatgcgcgaggagattcaatatgagacaatga

SEQ ID NO: 69073 - DNA, 117 bp, Glycine max
  Peptide Sequence Number=SeqID_185851
atggggagagttaacctagggttaaaagtgagaatggtagtgatgacttgtgggaaagcttggactgagcaaatgaggaaaatgagtgaccaaagtgaaagcaagagccatttctag

SEQ ID NO: 69074 - DNA, 174 bp, Glycine max
  Peptide Sequence Number=SeqID_185852
atggtgagcaaagtttggagctttaatgggcaacaatggtggatgagaaggggagaagaaaagcaacgtgagaaggtgaggagggcttctgaaatttttgctgagttccagtccctcgcgtttctctgcacccgtcggggcccgttttcgaaattatggatttctcttcgttaa

SEQ ID NO: 69075 - DNA, 321 bp, Glycine max
  Peptide Sequence Number=SeqID_185853
atggtgggttactcaccttcaagctttgctaatttagtttttgtcggcaaaaggattgaagtgggtctgaaaagaggcgaatttgattatcctgctttgacaaataaaaagcctggggcaaatagagaggatgagaaggaggaaggaacccatgctgtgactgtcgctcttacatggccaaatttcccaccagctcaacaatgtcattactcagccaatatcagcccttctcattacccaccatccaatcagccacaaagtctgcctgccgcacatccaataccaaactccacccttaacacaaaccaaaacaccaactag

SEQ ID NO: 69076 - DNA, 1098 bp, Glycine max
  Peptide Sequence Number=SeqID_185854
atgttgtgctgcggaggtgcagaggaggagagcagcgggcccccggcaaaccaatacccaactgcaccacctagagggggtagcacatacggaggaggtaatgatagaggagagcctaggggaaatgttgcgaagagtggtgccccgcagaaagtattgccgattgagataccctctatgccattggatgaattaaacaggttaacaggaaactttggtacaaaggcttttattggcgaaggttcttatggacgagtttactatgcaaaattgagtgatggtactgatgctgcaattaagaagctggataccagttcttccgcagaacctgactcagattttgcggctcagttatcgattgtttcaagactgaagcatgacaattttgtggagttgattggatattgtctagaggcagataacagacttttggtttatcaatatgcaagtcttggttctttgcatgatgtgttacatggaaggaagggtgtacaaggggctgaacctggtccagtattaagttggagccagagagcaaaaattgcatttggtgcagctaaaggtctagagtttcttcacgaaaaggttcagccttctattgttcatcgcgatgttagatctagcaatgtcttactgttcaacgactatgaggccaagatagctgatttcagcttaacaaatcagtcttctgacacagccgccaggctacattcaacaagagtcttgggaacatttggctatcatgccccagagtatgccatgacagggcagataacccagaaaagtgatgtttacagttttggggttgtgcttttagaactcttgacaggaagaaagccagtagatcacacaatgcccaaaggacaacaaagtcttgtaacttgggcaactccaaggcttagtgaggacaaagtgaaacaatgtgtggatcctaagctaaacaatgactatcctccaaaggctattgctaagttgggtgctgtggcagcactttgtgttcagtatgaagctgacttcagaccaaacatgaccattgttgtcaaagctctccagccacttctcaatgcaaaaccagctggtcccgactctcatgcttga

SEQ ID NO: 69077 - DNA, 114 bp, Glycine max
  Peptide Sequence Number=SeqID_185855
atggggggcgccttgtttaagcatccaggaaggagaatcttgagcttgctgacaacgttgaagtatgcagcggatatggagttgaataatattatttgtcaagagacaagctaa

SEQ ID NO: 69078 - DNA, 2529 bp, Glycine max
  Peptide Sequence Number=SeqID_185856
atggaggaagaagaagaccagcagaagcttccagatctggtgaaggcactcgtccaccacctactctccctaaatctccccccaaattcccctcccctcaaccctaactcccccgaattccgcaactccctccgctacgccctccgcatcctctccagccgcctcaccccctccgttgcccccgacgccgccgccatcgccgactccatcaagcgccgcctcgcctcccatggccactcctcccaagccctctccttcgccgacctcttctccaaattcgcctccaaagcccaaagtgtcgacaaaaaatgggccctcatctacctcctcaaaatcatctccgaagatcgccacaacaacaccaccgccaccactctcctccccaacctcaatttctccgaaccagcaacctccaacaaaccctccaacaacggcggcgtcctattagtctccaaggaccccgagaatcgccgcgacatcgcgtttctcgagttcgtcaaattagtccgggaagaaaacgaggtgtcggaagaggttctcgtccaagacgtgctctatgcttgccaaggagtggatggtaagtttgtgaaacttgacagcgagagtaagcgttatgtgatacccgtttcaattacggttcccagagcccctaggagtatggtttacaacctctgtgagttgggggttttgtttaggaaggttagcggttacatttcgcggagtatggatcggttccccaatgaagatgtgggaactgtgggccaggctttttgctccgctttgcaggatgagcttagtgagtattataagttgctggcggttcttgaggcgcaggcttcaaaccctattcctttggtttcggaatctgcgagctccaggaactatctatcgctgaggaggctggcggtttggctggctgagcccttggtgaagatgaggctgatggctgatttggttgagaagtgtagggttttgcgcggtggggcaatggtgggggcgattcatttgcatgcgcagcatggtgatccgttggtccatgaattcatgaggcggttgctgcagagggtgtgttcttcgctgtttgagatggtgaggaggtgggttttggaaggggagttggaggatatctttgctgagtttttcattgttgggcggcctgtgaaggctgagtccctctggagagaagggtataggctccatgatgccatgcttcctttgttcatttcgccttctcttgcgcagaggatattgaggaccggcaagtcgattaattttcttcgcgtttgttgtgaagatcgtggttgggctgatgctgcgactgaggttgttgctgatcacggaacaatggcgagaagaggtggttttggatatggggaaacggatacccttgagtttttggtggatgaagcttcaaagaggattgataagcatttgttggatgtgattttcaagaggtacaagttcaaagaacattgtcttgcaattaagcagtatttgttgcttgggcaaggtgattttgtgcagtatctgatggatattgttgggcctgagctttctgagccggctaacactataagctcttttaaactttcaggactgctggaaactgcaattcgggcttctaatgctcagtatgatgatcctgacattttggataggctcagggttaaaatgatgccacatgaaagtggtgataggggctgggatgtattttcattagaatatgatgctagagttccactggatacggtgttcacggaatctgtgatgacaaggtatttaagaatttttaattttctgtggaagcttagacgagtggaacatgcgcttactggagcctggaagaccatgaaaccaaactgcattacctctaattccttcaccagattgcaacatgcagtaaagatgcagttagtttcgacattgaggcgctgtcaggttctttgggttgaaatcaatcacttcatttcaaacttgcaatattatataatgtttgaagtgttggaggtatcatggtcaaattttttggctgagatggaactagccaaggaccttgatgatctacttgctgctcatgaaaaatatctgcattctattgtagagaaatctctccttggagagctttcccagtctctttacaagtcactatttgtaatttttgatcttatattacgttttcggagctgtgcagatcggctgtatgaaggtattcatgagttgcaagctagaatcacagaatcttccatatcctctcgagaccagaataaatcacgatctcaaaagcaactaagtgaaaaatctgcagaacaaggatcctggattgctgatgggaggaaagccctgactcaacgagctggtgaatttctacgaaatatggagcaagatctggatgcaattgctaaggagtattcgtcattgcaagagggattcatttctcagttgcctgtacagcagcatgttgatctaaagtttctctttttccgtcttgacttcaacgaattttataggcggttgtgtcctagcatgtag

SEQ ID NO: 69079 - DNA, 1065 bp, Glycine max
  Peptide Sequence Number=SeqID_185857
atggctcgttacggcgagggcgacaagcggtggatcgtggaggaccgccccgacggcaccaacgtccacaactggcactggtccgagaccaactgcctcgactggtccaaaaccttcttcagcaacctcctctccaacctccctatcctccacggcgaggctaacctcttcctcaaaacgacgtcgctccgctccctcgacggcgaggcctacgtcaacgtccgcaaggggaaaatcatccccggctacgagatcagcctcacactcaattggcagggcgaagccaaagattcccagggaacctcgcttcttaaagtcgacggcaccgtcgagattccctacatctccgacgagaacgccgacgaggatcccgaggttagggttaccgttaacgatgagggaccggttgggatgaggattaaggacgccatgctttccaaggggaagcccttgatcttggagaaggttagggtttgggtccagagcatggccaaaggtggtcctgttaaggatgaattggaacccaagaaggttgcgccgtcgttgtcgccgtctccgccgacaacgacaacaacaacaacaacgacaacgactgctacgaagaaggaggagaagaaagagaaggagaaggagaaggagaagaaggggaggaagagtattggcatgacggagaggttcaattgcagggccaaggatttgtatgaaattttgatggatgagaataggtggaagggttttacacagagcaatgcgagaattagtaaggaggttggcggtgagtttagcatttttgatgggtcggtgaccggaactaatttggagttgcaggaggctaagttaattgttcagagatggaggtttgggagctggaatgatggagttcaatccacagtgaggcttgtgtttgaggagcctgaagccggtgttacggttgttaagctgacacatactgatgtgcctgaagaggataggtatgggaatgctaccgtggtggagaacacggaaaggggatggcgggatcttattttccagaggatacgtgcggtttttggttttggaatttga

SEQ ID NO: 69080 - DNA, 141 bp, Glycine max
  Peptide Sequence Number=SeqID_185858
atgccgggattagcgcaaaggaatgaacatctcactaatggctcatccacaccgacgtgttcgctttctgcaaatggattctggtcgaagaattcggacgacgttagctacaatcagctccagaaggttttggatttataa

SEQ ID NO: 69081 - DNA, 582 bp, Glycine max
  Peptide Sequence Number=SeqID_185859
atgtactgttccaggtgcaatggtttgcttcttgaaggttttctgcagattgctatgtatggtaaatctttgcaacaggaagggctggatgctcactttccttgcaacagatctggaggtttgagaaagctaaataatgacagatcaagcattatcaatggatgccaagatgaaattcaagatccatctatccatccttggggaggtctgactacagcacgtgatggctcattaacacttatgagctgctacttgtattcaaagtctttgaaaggactgcagattgtatttgatgaggcacgtgctagggagcgggaaagggaactgctttatcctgatgcctgtggcgggggaggccgtggttggataagccaaggaatagttagttatggcagaggacatgggacaagagaaacttgtgccctgcatactgccagactttcatgtgatacacttgtggatttttggtcagcactgggagacgagatgcggctttctcttctaagaatgaaggaggaagattttattgagagacttatgtacaggtgtctatcgattttttcattccttacactgtcctaa

SEQ ID NO: 69082 - DNA, 3201 bp, Glycine max
  Peptide Sequence Number=SeqID_185860
atgcctattaggtttgatagcaagagattttgcagagattgtagaagaaatgttattcgagaatacaaggaactaaaagaactgaagcgcattcgcagagaacctcgttgcaccagctggttttgtgttgctgactctgcctttcaatatgaggtatctgatgactcagttcaagctgattggcgtcagacatttgctgatgcagcgggaacctatcatcactttgagtgggctgtggggacaactgaaggaaaatctgacattttggaatttgaaaatgttggattgaatggatgtgttcgagccagtggcctggatcttggtggtttgagtgcatgttttgttaccctccgagcttggagattagatggacgctgtactgaactttctgttaaagctcattcgttaattgtaggagatggttatgttacaatcacaaaaggggaaagtatcagaaggttctttgagcatgctgaagaggccgaggaagaagaggatgatgattcagttgacaaggatggaaatgagcttgatggagaatgctcccgtccccaaaagcatgcaaaaagccctgaacttgctcgagaatttctgctagatgctgccactgttattttcaaagaacaggcatgtttagcactagttgaaaaggctttcagagaagggacagcacgccaaaatgcacatagcatattcgtttgtcttgcactaaaactgctggaggatcgagtgcatgtagcatgcaaagaaatcattacgttggaaaagcagatgaagcttcttgaagaagaagaaaaggaaaaacgtgaagaagaagaacgcaaggagaggagaaggacaaaggaaagggagaaaaagcttagaaggaaggaaagactaaaaggaaaagaaaaagaaaagaagtgttcggaatcaaatgatgctcttggttctcctgaaatctcaaaggaagaattgtctgcagttgctgatatggagcaaaataatcctattagctgcaggagtttagttattgaagcaaatgaaactaatctattgggggatgattctcctaacatcgaagatgaagaattctctagtgagtgtaatactttgaaaccacatgacctctctcatgatgattgcggggaagaaatttcaaatacaaaagatgagatgggtcagtctacaattgaacaatcaatgctctctcatcgaagactaagatgtaggaaagaatttcaacttgatatgcctatgaagtggtctgacagacggcgatatgcagttgtttcagaaaatagtgtgatggttggcagatctgagccaagacattatggagagagttttgtgatatcatccagggtaatgaatgggttgagtaggcaatcaagaataaatgtcccaacaaaatccaattgtcgaaatgttggtcctcccaagtataatgagaagttttatagttccaagaatcggacgaatgacagatgtgatattcattcttgcagttgtagcttgaatagtgaatataagactagggttgagcaacattctcctatgactagagttagtcgggagacaaaacctatcagtcagtctgaatctgcaggagatacatccaagcaattttgtcgtggtaataagaataatcaagtagactatatgcatgagagtaatggaagagccaaaagcaaaatcatctcggggaactaccccagcagggatttgtttcaatcgaagaaagtttgggagcctacagaatctcaaaagaaatatctgcgcagtaattctgactctgatgttattttgagggccactaaagttcaaggagctcagtctgatctgatcaagttgtctattggagaagctgttgattcaggtgaaaatgatgacgaggaatgtaattcaaaaagatttagtggagtggatgaacgctgtcaagatgattttcacgtagaagctaaaggttcttgtagctctacggaaattgctttggaggaatctggaatatgtccaactggaggctttgccttaaataattcttctgattcaactcaaagtagcacttttagttctgataactgctcatcatgcctaagtgagggtgataataatacaacctcatcaagccatgaaaatacagaatcctcaatcacatcagattcagaagatgctagccggcaatccgaattaagaaataatttggattgcgtcgaaactgtcttgtctcattgtcatgatgtttctatagtgaatagccagaatgcaaatggtgagggtttgacaagaaatccaagctcactaattagttcatccttggatggtacaagaaattatgcattggggaatcctattgtggaaactgcccaaaattttgacaattgtttttccaccactaatgtgtgttctcaatctcaaagtatgcttccaccggtgtcaaaccaaaatatacattttccagtgtttcaagctccttcagcaatgggttatttccatcaaaatccagtttcatggccagcagctcccacaaatgggttgatacccttcccacactcaaatccctatttatatgccggccctcttggatatggcttaaatgaggaccatcgcttctgcttgcagtatggagccttacagcaaccaacctccttattcaaccctggtgttccagtttatcagccagttgccagcgctaatgtcttaaatgcagaggagcggactcgagtttccaagacagcttctttgccagagcatcttaatggatcttttgcagaaagggtctttccagctggacctatttccaaaaaaccagcatcacatggagaagttaggcatgataattctgccaagtcacttgagaataacaatgatttttccttgtttcattttggtggacctgtagccctttcaactggatgtaaatcggcattcacatctttgaatggtgatactgttggtgatttttcctcaaaaagctctgcagatcatgtcgaaaaggttcataattgcaataagaaagagactcccgccatggaggaatacaacttgtttgcaacaagtaataacctaagattgattggaagtggcataaacacctttcagaatgatccaagtcttgttcggccatatttgctctattctactttctttggtgctttcgcctttttgaggcgaaaattccgaaatattcttaaagtaatatttgtgagaattgaagtttga

SEQ ID NO: 69083 - DNA, 384 bp, Glycine max
  Peptide Sequence Number=SeqID_185861
atggctgagatagaagaggtgcaagagcaaatgaaggccgatattgaggccttgaaggatcaaatggcctccatagtggaggccatgttaagcaggaagcgaatgatggaaagcaatacagtcccagttgtcgccaccagcgtcgccaccgaggcggatcctacccatccatccgccataaaccaagcgaaccagccaatctcggacatggtggatcaaggaggagaagtgctaggcagcataggcggtccacacatagggcataataagaatgcttacccctatagcttaccccccaactacacaccgcccaatgtggtgcctatgcccaacgagaacgctaaccgcgctgttcctgttccctttgagggccaacaaccttag

SEQ ID NO: 69084 - DNA, 330 bp, Glycine max
  Peptide Sequence Number=SeqID_185862
atggagatgcagcggaagacaaaggagaagaggaccggttgtagtggtatgcctcagcccaacatcgtgggggcttctcaacaccgcccattgcaacctctacgcttctccgtggggagattgcctccgtcagtggaaggaagggagaaatgggagctcatcgaggagaggctaatggccattgaagggtttggtgactacccgttcactgacatggcaaagttgtatttgatgcttgacgttgtcattcccccgaagttcaaggtacctgattttgataagtacaaggggactacttgccccaagaatcacttgaaaatctattgttga

SEQ ID NO: 69085 - DNA, 1413 bp, Glycine max
  Peptide Sequence Number=SeqID_185863
atgagttactccaggatattgaactctctattgttagtagtgttattggttacatgtgcaagtggggaggacccttatagattctacacttggaatgtcacctatggagacatctatcctcttgggatgaaacaacagggaatattgataaacgggcagtttccagggccacagatcgaatctgtgaccaatgataacttgatccttcatgttttcaatagtttggatgaaccttttcttatctcctggaatggggtgcagcagaggaggaattcatggcaggatggagtgtatggtactaactgtcctattccaccagggaagaacttcacttatgttcttcaagtgaaggatcagattggtagctacttctactttccttcccttgcattccataaggcagcagggggttatggtggattcaaaattgctagccgctcagtgattcctgtgccttttcctcctccagcaggagatttcaccatattggctggagactggtacaagagaaatcacactgatctgagggccattctagatgggggaagtgatcttcctttccctgatggccttatcatcaatggtcgtggttccaatgcttacgcattcacagtggatcaaggcaagacttacagattcaggatatcaaacgttgggctcacaacttccatcaatttcagaatccaagggcataagatgctgctagttgaggtggaaggaatccatactctccaaaacacttatgattcccttgacattcatttggggcagagttactcggtgttagtaactgctgatcaaccacctcaagactattatattgtggtctcaacacgtttcacctcccaagtgttgactgctacctccattcttcattacagtaactcacctacaagtgtttctagtcctcccccaggaggtccaactactcaaattgattggtctcttgaccaagctcgctctctcaggaggaatctgacagcaagtggaccaaggcctaatccacaaggatcctaccattatggtttgataaacacaactcgtacagttagacttcaaaattctgcaggaattatcaatggcaagcagagatatgctgtcaatagtgtttccttcatccctgctgatacaccgcttaaactggctgattacttcaagatcccaggagtgttcaaccttggaagcatcccagagaaccctactggcagtgactgttacctccagacttctgtcatggctgccgatttccgaggttacgcggagatcgtgtttgagaatcctgaagacactgtccagtcatggcacgttgatggccaccacttctatgttgttggaatggatggaggccaatggtcaacttcaagcaggtcaaattacaatttgagagacacaatctctcgttgcacagttcag

SEQ ID NO: 69086 - DNA, 239 bp, Glycine max
  Peptide Sequence Number=SeqID_185864
accaaaaccctcgaattctgtccgacgttgccggaagctataatgcggtcaatgtttcggtgttcggcgcaatcgagcacggaccagtccttctcgatgatttctgggatggaaacgaaggacgcgccctcggggagggaaatgggggcgtcgaggctgtggaagatgggttggtgtttggtttgaagaagggggcggaacttgcatgctggagggggagtgaagacgaaggtacctaa

SEQ ID NO: 69087 - DNA, 297 bp, Glycine max
  Peptide Sequence Number=SeqID_185865
atggccggacactatattcctttagtcgtgctccttgttcctatgcgtcttactccagtgtttgatatgatgttttttcgaaaaatatacttacaaaagatgttaagggagaaagagtattacgaaaggcagtttgccaccctaaggtcttttgaggaggttgattcaactgaatcttcaaatgtcattgaggatgggtcagtggatgcggaacaagtgcagtctgaaagggcaatgaaaatatccaattgggcaaacgtttttttactcgcttttaagagcctgattcgcaactaa

SEQ ID NO: 69088 - DNA, 186 bp, Glycine max
  Peptide Sequence Number=SeqID_185866
atggcgatgctctctacttttatgctttgttcttttcctaaaaacagtagacagatgcggcgtgcctataccaaacttttttactgctgtaatgttccccagtattcgtccagatatgcttcatctttaaacttaaaggaactttccttttttggttcttattatctaacaagtgcaagatactaa

SEQ ID NO: 69089 - DNA, 774 bp, Glycine max
  Peptide Sequence Number=SeqID_185867
atggagaaaagaagtcaattacaccacatcttcaagaaattaacaataattgaaagggagaactccttagccatcttcaagaaactggagatgaatccaaagaaattgttccaaaccgtgtttctccaagccctagctcttgggtgcctaatttccacatccttgtttgttgaaaccctctcggttcaagatttttgctctactttgaccaagaatcacaccttactggtatttgcaacagttaagagtggttccatagctattgctgcatcaacactggattctctgctagatcttatggctggtgaggatcactattttgatgtcataaccaacatagttggtttggttgctgctgtccttggtgataaatttagttggtggattgaccctattggcgctattttgcttgcactctatacaatttcaaattggtctaaaactgtgcttgaaaatgttgtttccttggttggacaatcagctccacctgaagtattgcagaaattgacgtaccttgttttaagataccatcctcaaatcacacgtattgacacagtccgtgcctacacttgtggagttttatactttgttgaggtggacatagaactaccggaggatcttccactgaaagaagcacatgcaattggagaatctttgcagataaggatcgaagaactccctgaagttgagagagcctttgttcatcttgacactgaatgcgagcataagccagagcactctgttcttagcactcttcccagcagccagatataa

SEQ ID NO: 69090 - DNA, 114 bp, Glycine max
  Peptide Sequence Number=SeqID_185868
atgaatcgaggtacttggggacgggcacgaatggacgctaggcccatgatcaacagatcattgtcccacgtccagctccggacaatcgagaagcgctattgggaggcagcctag

SEQ ID NO: 69091 - DNA, 324 bp, Glycine max
  Peptide Sequence Number=SeqID_185869
atgtggctttgctttggaaataggcaatgccctgagtctccaatctgtgatggaataatggtagcacgtctaagggtggaagcccattctgcaagatttcattattcggcgggttttccctcgaaacttgcatcggtgtcaatcttcttgcctccatctaagacagaaaatccaccgttctctgttgctgctggtgatccatttgcctcgtataaggatggtaacactcgtgttggcctgctccgtgcttaccaaacctatatgctggtgacaaagtggcaccaacagggtggcgcgcttgattggattcaccgaatggtttag

SEQ ID NO: 69092 - DNA, 252 bp, Glycine max
  Peptide Sequence Number=SeqID_185870
atggctgtaatctcaatctgtggtagcaagagcaaaatgatcctccgcgggatcaactatagcgctgctggaagcggagtaaggcatatggaacagtatccacggggaaccgtggatgtactctcccagatgaaggcaagagctccggcatcgatgctagttccgagggaaaaccctccgattgaaacgcttgcagaatgggctgcctcacttagattcgaaaatggaatgtggattgaacctgaagcctag

SEQ ID NO: 69093 - DNA, 273 bp, Glycine max
  Peptide Sequence Number=SeqID_185871
atggaggttgcaattacgagattgccgccggagacgttgctggcagaggagctcagcgcggtcaagaagaagttggagaggattagggcggacgatgagagaacaaagaaaatactgaacgagaaacacgctttgctggacgcgtggatgaaggaactcaagtatcactgcatgagagtttctccaatgagaacgcttagggagaaggaacaaggaaagatcgtgaacgaagcgccatcacaatcggagtcgattgaagaaagtgagaattaa

SEQ ID NO: 69094 - DNA, 636 bp, Glycine max
  Peptide Sequence Number=SeqID_185872
atgggtgagtacgccatgcgcgctgaggcaggcaatcagaatcccccggacagtggccccacccccgacgtttcggtggtggtgcccgtgtacggttgtgaaggttgccttgaacagctttccgaacgtgttgccggtgcgatctcgggcatgggcctgacgcacgaactgatcctcgtggacgaccagggtcccgatcagtcctggcagcggatctgcgaactcgggaagctgtcttcccgggttcgcggcctgcgcctgtcccgcaacttcggacagcatgcggcaatcagtgccgggctgcagtacgcccagggcagccgtgtcattgtcatggattgtgacctacaggatgtccccgaggaaattccctcgctgctggcaggcctggaaggtgacaacgagatcgtgctgggccagcgggtggaacgccaggacacctggctgaagcgaagcggttccagtgccttctacaaggcactgggatggctgaccgataccgactatgatccttcgacggccaatttcggtgcctacagccgcaaggctgttgatgccatgaatgcgatgcctgagacggatcgcttcctccctctgatggcccgctggactggttttaaaaccctgcgcgtaccg

SEQ ID NO: 69095 - DNA, 300 bp, Glycine max
  Peptide Sequence Number=SeqID_185873
atgaagaacgttgttcaagatgcctatagccaatacatggtggaatatgcttttattgatgatggaaacatgcattcttctttgactttaggacttgtgaacatgtacagttctgtgactataacaacaaaggcaattactatgacaatgcacataattcgaaatgactttattatgtcaatgccaggtgactttttcttaggttattccatgccatgtaagaaaaattttagctatttcgtttctaactccctcaggcacatgttgtcttacatggcaattaattctatgaccggatga

SEQ ID NO: 69096 - DNA, 393 bp, Glycine max
  Peptide Sequence Number=SeqID_185874
atgatcaagtgggagaatgtgaagattccccatagcaaagctcacatagtcatagtgaatctaaaggatgaagaccatgatttgagcaagaactcgtcacaacgattgtcatccaacgatgataccaaggatgaggttgaggatactgagttagaggactccgaggattccctacctactactgagtctcctaggatagtgttgaggaggattagtacctttccatcggggatgggacctactttgagacccactgttggtgtagaggaggcgatgacatcgatcaaggtagtgcttaggattcacgagtcagaggaggagaagaatccagagatgatggaggaggcccctaaggaggcccttggtaatgatcttcccaaaggttctatctag

SEQ ID NO: 69097 - DNA, 402 bp, Glycine max
  Peptide Sequence Number=SeqID_185875
atgactgggagagaagcaagtaagattttgttaaccggaaaagatgggattgtgagtttgaatctgttttacactggccagcaagttctgggccccaccactttgctgcaaaccactggagaggcacacaaaaggctaagaaggctgatcggtgaacctttatcaattgatggactgaaaaaatatttccattttatcaatactcaggcaatggaaacattaggtcaatggcaaggaaggaaagtcctgtttactctaaaagtgattggacatatgatcatgagtttagagccttctggggaggaacaggaaaagtttaggtcaaattttaagattatctcttcctcatttgcctctttgccatttaaacttccagggacagcattccatcatggtatcaag

SEQ ID NO: 69098 - DNA, 4527 bp, Glycine max
  Peptide Sequence Number=SeqID_185876
atgactaatactgatgagtggataacgacgggcactatacctactgatagcaacagagcaacaccagaagaagacacagaggaagcaacagacataaacacaggggaggcccctggccctcgaagccagcaacccgagcacgagtaccgtaccaatttggtgctctcgttgctcttcaccatggtagaccctgaacccgcctcattttcgtcggacaagctggaggatgtcctcagccgactcactaaacagcagctatatcttggagagtctgtcaatgccatgactctcaagattgacgaactcattcaacgagtttctccagtgttctccaccacgccacccactccaccgccgttaccaccgccggcacctacacccatacacagattgaaattagatgtgccaagatttgatgggtcagacccacttggctggatttacaaaataactcaattctttgagtaccatggtaccccagactcagacaaactcaccattgcttccttttatatggaaggtcgcgcgcttgcctggtttcaatggatgaacacctctgagcaatttccgtcatggcctgccttcttgcatgcactgcgcactcgctttgccccttcacaattcgaggacccttccggagctttgagcaagcttacccagaccgggacggtaacccagtacctctctgactttgaggaccttgctaatcgcacgacggggttgccctccaccttccttcttagttgctttatctccggcctcatcccggagatacggagagaagttcaagcccaccagccggccaccctggttcaagccgcgggtctcgcgcgcttgcaggaggagaagttctccgagatgcgtcaacaccctcgtcctcgtccttcccctttgccccaattccagagatcaccctcagtgtttccctcctttccccaagtcaaccctactgcccccgtatcctctccacccctttcccctatcctcaagacaccctcaccgccactttcttcgaccttaccacctctcttaccacccccgcccccgcgaccaccgccccaaacctggaaacggttgtccccagaggaaattgcctctcgaagggaacgtggcctctgtttcaattgtgaggagaaattccatcgagggcaccgctgctcctctaggttttttctcctcataactgatgaggaagacccgcccctttctcatatacccaattttgacccgcccattactttaactcatgacccggtacctatccaacccacagacccacccgaaagcccactttcatactcagcccaaatttcacttaattcccttgctggccatgtcgctccggagacaatacgcttcatcggtgccatctccggccaccctttgttgctactggttgatgggggcagtacccacaactttgttcagcaacaattggtgacccaattgggcctctcttgccggaccacttctcctttgcgtgtaatggtgggtaatggccaatatttggagtgtcattccatatgtgacgccatttccgttcagattcagaatcacagcttcacggtcgacctccatgtcctcccaatctcgggtgccaacgtgggagaccccgaagctagcctgagctccatgacttcatcccagttttgccgtctttgtcggacacagccccagggcctttattttcagatcacggtcctttctgatgacaccccaccttcttccccagacaccttacccccttcccttcaagctctgctcaccaagtacgatgtcctctttcaaccatctccgacacttccaccaccacgtcccactgaccaccacattcatttactacccctatcaacgccggtcaacgttagaccttatcgttacccccatttccaaaaacaggaaatcgaattgcaagtcgactcaatgcttcagaagggtttgatccaacccagtacaagccctttttcctccccagtcttattggtgaagaagcatgatggatcatggagattttgtgtcgactaccgggcactgaattccctcaccgtcaaggacagatttccgatacccaccatagacgaattacttgatgaattggggggcgctcaatgcttctccaagctcgatcttctccaaggttatcatcaaatacgcatgcattcagaggatatccctaaaactgcatttcgaactcatcatggacattatgagttcagagtgatgccctttggcctctgtaatgctccatcttcctttcaagctacaatgaacctcattttcaggcccttccttcgtcgcttcgtcatcgtcttcttcgatgacatacttatctacagcagctcttttgatgatcacttgcaccatctggacttaactttccaggttgaatatttgggacatttagtttcccaacgcggagttgagcccatgcctgataagattgttgccattgttaattggcctcaacctcactccaccagagctgttcgaagttttttggggctcgccgggttttatcgtagatttattcggggatatgccatgattgctgaccctttggttaaggccacctcggacccctttcgttggaccccacaagctcaacaggcctttgaagacctcaaatcggctttgtcaactactcctgttcttgcacttccagactttcaggagcctttcacagtggagactgacgcttccggcaatggcatgggcgctgtcctatctcagagaggacaccccattgcttatttcagcaagccattccctaagaagctcctcagggcctccacctatgttcgtgaattatttgctattacctctgcagtgaaaaagtggcgccaatatctcttgggccactcattcaccattgtcaccgatcataggagcttgaaagagttgctcacccaagttattcaaacacccgaacaacatatgtacctggcccgattaatgggatttgattatcaaatccagtaccgctccgggaagcacaaccaagcagctgatgccctctcacggtcaccggaattcactccttcactttcgttgctcttatctattccttgtttgagctttcttgatgaattacgtcagcagctcaccaataattctcagtattgtcagcaccgacaggacatcatcaattctcccaccacctaccccgattacactcttagtcagaatttcatcctttacaagggcaaaatttggttaccccgcgagcttcctctcattcagacactcatgctagagtaccacgcgacgccgatggggggccatatgggcgtcgcaaagacgatagctaggctatcggaaaatttcacatggccgggactccgttctgatgttgcgaccttcgtggccaattgctctgactgccaattcaccaaatatgagacgaaacgcacagccgggttgctttgtcccttacctgttccctttcggccatgggaggacctctcccttgatttcatcactgggctcccttcatatcagggcaaaacggtgttacttgttgttgtggaccgattttctaagggtattcacttgggcaccttacccaccgcgcatacggcacacatggtcgcctctttgttcattgacatcgtggtcaaactccatggtcaacctcggagtttagtttcagatcgcgatccacttttcctgagtaccttttggcaggagctttttaaattgagtggtacaaggcttcgaatgagttcagcctaccatccacagagtgatggcacgggctctacgccgtatgagataacgtttgggcggaaacctttctcttttccagactatatcactggctcctccaaactagatgcggtggatgatactctgaagcaccgtgaggaagtttttctttgcattcgtcagaagctattaaaagcccaagctacgatgaaacgcactgctgatactaaacggcgtgaagttgactatgaggttggtaattgggtacttttaaagcttcggccctaccgacagcgttcggccaaggatgctcagcacagctccggcaagttagctaagcgcttctacggtcccttcaagattctcgagagaattggtaaggttgcttattgtttggaattaccagagggcacgcgaattcatcccatattccactgttcacttttaaaacctttccatggggatcccgccatcagtcagaccccctcacttccagaccaattcttcaataatcagccaattatttctcccttggcaattttggatactcgtcgtgctgcaaccactgagggaccatgggaggttttagttcaatggaaggggttacttcctgatgacacctcttgggaagattgggatcaactgaagcggacctatcaccttgaggacaaggtgattctccaagggccacgggaagatgatagcaacagagcaacaccagaagaagacacagaggaagcaacagacataaacacaggggtaccaacagcaaaaccgaaaaggaagattaccaggcccgcatacctcagagattatgcttga

SEQ ID NO: 69099 - DNA, 696 bp, Glycine max
  Peptide Sequence Number=SeqID_185877
gaggaacacagacaaattgtcatcaacagaaagagtggaacagatcttacttgggctgaagttaataacatgccttacacggctaaagtgagcaacaataactttagcttgcaagtgatcagtgaaacacttcgaagagccacaatactaccttggttttcaagaaaggcatcccaggattttgaaattgatggttataaaattaagaaaggttggtctgtcaacctaaatgttgtttctatacaccatgaccccgaagttttcccagatcctgaaaagtttgatccctctagatttgatgaaaccctgaggcctttcagttttcttggatttggtagtggaccacgcatgtgtcctggaatgaaccttgccaagctagaaatttgtgttttcatccatcatcttgtcaacagatacaattggagacctctggagaaagacaattctgtgcaaccaacgcttgtaaggatgccaaagaacaagtatcctattatagttgaagcactaggacacgattcctccagaaactacaaacaaacaacagaagaaaagatagcacagaaaaatgttgtatatgaacagaatcatttatgtaagtggtacggtactcgtgctcgggttgctggcttcgagggccaggggcctcctaagaagaagaaaagggataaagggagtcacgaaggaatatctgcataa

SEQ ID NO: 69100 - DNA, 3312 bp, Glycine max
  Peptide Sequence Number=SeqID_185878
atggaatcatggatgtggtgtttccttctctgttcccatttgctcatcctttatttttcaccctctcattccttatgccacccccatgacacctctgccttgctccacttcaaaaactccttcattatttatgaagatccttattatgatgcatgtgatactgctggttatttttcaaagacgagaacatgggaaaatgggacagattgttgctcttgggctggagtcacctgccaccccatctctggtcacgtcactgacctcgacctcagctgcagtggtcttgtcggcaatatccatccgaacagtacgcttttccatctttctcatcttcactcactcaaccttgctttaaatgattttgatgaatctcatttgtcatctctctttggtgggtttgtgagcctcactcatctcaacttgtctggtacgtactctgaaggggatattccttcccaaatttctcacctttccaaattagtctcacttgatctctcatataatgggttaaagtggaaggaacacacttggaagagattgctccaaaatgcaacagttttaagggtgcttcttttggatgaaaatgatatgtcttccatttcaatcaggacactcaatatgtcttcctctttggttactcttagtcttcgagagaatgggctaagaggaaacttgacagatggcagtctctgtttaccaaatcttcagcacttggatctttcatataatcgggcccttaaaggtcagcttccagaagtgagttgcagaacaacttctcttgatttcttagatatttcaaattgtggtttccaagggtcaatccctccctctttctccaacctcatacatctcacttccctggacctttcagataacaacctcaacggttcaatccctccctctttctttaacctcacacatcttacttccttggatctctcagataacaacctcaacctcaacggttcaatccctccctctttctccaacctcatacatctcacttccctggacctttcaggtaacaatctcggttcaatccctccctctttctttaacctcacacatctcacttccctggatctctcatttaacaacctcaacggttcaatccctccctctttctccaacctcatacatctcacttccctggacctctcaggtaaccacctcaacggttcaatccctccctctttctccaacctcatacatcttacttccttggatctctcatataacaacctcaacggttcaatcccatcctcactcttgacccttccacggctaaactttctgtatctatacgataatcaactcagtggtcaaatcccagatgcgtttcctcagtcaaacagctttcacgaattgcatttgagtgataacaaaatagagggtgagctgccttcaacactttcaaatcttcaacatctcattcacttggatctttcatataataaattggagggccctctgcctaacaatataacagggttttcaaacctaacatcgttatggttaaatggaaacttactgaatgggacaattccttcttggtgtttatctttgccatctttgaagcagttagatctatcaggaaaccaactctctgggcatattagtgcaatctcatcatattccttggagacattgtttttatcccacaacaagttacaaggcaatattccagaatcaatttttagccttgtaaaccttattttcttaggtctatcatcaaacaatttaagtggatctgtcaaatttcatcgtttctccaagcttcaatatttggaagaacttcacctttcatggaatgatcagttatcactaaatttcgaatccaatgtcaattataatttctctaatttaatgttgttgaacttatcttctatggttttaactgaatttccaaaattatcgggaaaagtcccaattttagaatcactctatttgtccaataacaaacttaaaggtagagtgccacattggttgcatgaaatatcgttatctgaattggacctctctcataacctattgacacaatcattgcaccaattctcgtggaaccaacaactcggttaccttgatcttagttttaactcaatcactggtgacttctcttcctcaatttgcaatgcaagtgcaattcaaattctcaacttgtctcacaacaagttgacaggaaccattccacaatgccttgcaaactcattatcccttcaagttttggatctacaactgaacaagcttcatggcactttgccaagtatcttttcaaaggactgtcggctcagaactctggatctcaatggcaaccaactattagaaggtcttttgccagaatctttgtccaattgcattcatctggaggttttagatcttggaaacaatcaaataaaggatgtgtttccccattggcttcaaactctaccagaattgaaagtattggttttgcgagccaacaagttgtacggtcccattgtcggtttaaagatcaagcatggattcccccgtttagtcatctttgatgtctctttcaacaacttcagcggcccaataccaaaagcctacatacaaaaatttgaagcgatgaagaacgttgttatagataccgatctgcagtacatggaaatttctattggagctaagatgtacagtgattctgtgactataacaacaaaagcaattactatgacaatggacaaaattccaaaaggctttgtcagcattgatttatcaaaaaacggatttgaaggagagattccaaatgccattggagagcttcatgccctcagagggctcaacctttcccataacagaattattggtcctattccccaatccatgggaaatttgacaaacttagaatcattggatctctcctcaaatatgctcactggtgggatacctacggaattaagcaacttgaacttccttgaagtcctaaatctttccaataaccatcttgctggagaaatacctcgaggacaacagttcagtacttttaccaatgattcctatgagggaaactctgggttatgtggactcccactgacaatcaaatgcagcaaggaccctgaacaacattctccaccttcaactaccttgaggagagaaggaggatttggatttggttggaaaccagtggctataggatatggatgtggaatggtctttggagtgggaatgggatgttgtgtattgttaataggaaagcctcaatggcttgtgagaatggtcggaggtaaacccaataaaaaggtgaaaaggaagacaaggatgagatctaatgaaaatggtagcagaatgaattag

SEQ ID NO: 69101 - DNA, 819 bp, Glycine max
  Peptide Sequence Number=SeqID_185879
atggataaggagaacgctttcaacttccccgataatgaaagtacggggagtaacggcgacaacgatgtcactactcccttcaccgagtgccaaatatgctcaaatcccatacccccaaaccctaatgaacaaacgtcaagtaaacactcactgcaaggtctcataccaccaccgcgatcactttcaattaacgctaacaatagccttgcaggggtgattccttcaccacctcagccaaacgcttatagaacctatgcagaagtggttcgctcactcccgccaccgagaacaaacagaaccactcctgcggtttcaatcggatcacaagatccgatacatgcagcgttatggatgaatgacaacgctgctggtagtagtggaaccgcagccgcagctgcgtttccaatctctccacaaccagcagcgttaggctccttcgatttcgataaggctgctagaagtggagaaagcctataccatattttccatccatacctaaggcagatggatccacagccaccagcgagaaccgtggatttgctgtctcgattgggggccgttagatcggaacctcctcattcgaggcagatggatgagcagccactgagaacagtggattttctttctaatgtgaacaatcagccgtggggaacggttgattatctggctcagatggaggcagccagttcagcaccggcggcgcaagttccgagggaaaaccctccaattgaaacgattgtgcaatgggcatcctcgcttagagtcggggacggaagaaggcggaaggtggatttgaatttgaagcttaagatggtttag

SEQ ID NO: 69102 - DNA, 201 bp, Glycine max
  Peptide Sequence Number=SeqID_185880
atgaagaacgttgttatatatgccaatccgcaatacatggaaacttctgttattgttagtgacaccaacaacattgatcatgaaaccaactacgctgattctgtgactgcttattggtcctattcccccatccatgtgaaatttgacaaatttagaatcattggatctctcctcaagtatgctcactggcgggatacctag

SEQ ID NO: 69103 - DNA, 525 bp, Glycine max
  Peptide Sequence Number=SeqID_185881
atgaagaacgttgttatatatgccaatccgcaatacatggaaacttctgttatggttagtgacaccaacaacactgatcatgaaaccaactacgctgattctgtgactatttgtaggagagatattccaaatgccattggagagcttcactcactcagagggctaaacctttcccataacagatttattggtcctattctacaatccattggaaatttgacaaagttagaatcattggatctctcctcaaatatgctcactggcgggatacctagagaattaagcaatttgaactttcttgaagtccaaaatctttccaataaccatcttgcatttgtgggagaaatacctcaaggaaaacagttcagtactttttccaatgactcctatggtagaaacttggggttgtgtggactcccattgacagcagaatgcagcaaggaccttgaacaacattctccaccttcactaaccgttgggggagaacagggagttggatttggttggaaaccagtggctatgtga

SEQ ID NO: 69104 - DNA, 232 bp, Glycine max
  Peptide Sequence Number=SeqID_185882
caaggaccctgaacaacattctccaccttcaactaccttcaggaaagaaggaggatttggatttggttggaaagcagtggctataggatatggatgtggaatggtctttggagtgggaatgggatgttgtgtattgttaataggaaagcctcaatggcttgtgagaatggttggaggtaaactcaataaaaagcgtgacatggctttagaagctgaggtccaaggggcgtaa

SEQ ID NO: 69105 - DNA, 2442 bp, Glycine max
  Peptide Sequence Number=SeqID_185883
atggaattcatgtcctttggcctaggtatagatgtaaacctttgttcatgggaaaatgggacagattgttgctcttgggctggagtcacctgccaccccatctcaggtcacgtcactcagctcaacctcagctgcaatggcctttacggcaatatccatccaaacagtacgctttttcatctttctcatcttcactcactcaaccttgctttcaatgattttgatgaatctcatttgtcatctctctttggtgggtttgtgagcctcactcatctcaacttgtctaattcgtactttgaaggggatattccttcccaaatctctcacctttccaaattagtctcacttgatctctcagataacaacctcaacggttcaatcccatcctcactcttaaccctcacacatcttactttcttggatctctcatataaccaactcagtggtcaaatcccagatgtctttcctcagtcaaacagctttcacgaattgcatttgaatgataacaaaatagagggtgagctgccatcaacactttcaaatcttcaacatctcattctcttggatctttcagataataaattggagggccctctgcctaacaatataacagggttttcaaacctaacatcgttaaggttaaatggaaacttactgaatgggacaattccttcttggtgtttatctttgccatctttgaagcagttagatctatcaggaaaccaactctctgggcatattagtgcaatctcatcatattccttggagacattgtctttatcccacaacaagttacaaggcaatattccagaatcaatttttagccttctaaacctttattacttaggtctatcatcaaacaatctaagtggatctgtcaaatttcatcgtttctccaagcttcaatatttggaagaacttcacctttcatggaatgatcagttatcactaaatttcgaatccaatgtcaattataatttctctaatttaaggttgttgaacttatcttctatggttttaactgaatttccaaaattatcgggaaaagtcccaattttagaatcactctatttgtccaataacaaacttaaaggtagagtgccacattggttgcatgaaatatcgttatctgaattggacctctctcataacctattgacacaatcattgcaccaattctcgtggaaccaacaactcggttcccttgatcttagttttaactcaatcactggtgacttctcttcctcaatttgcaatgcaagtgcaattgagattctcaacttgtctcacaacaagttgacaggaaccattccacaatgccttgcaaactcatcatcccttctagttttggatctacaactgaacaagcttcatggcactttgccaagtatcttttcaaaggactgtcagctcagaactctggatctcaatggcaaccaattattagaaggtcttttgccagaatctatatccaattgcattcatctggaggttttagatcttggaaacaatcaaataaaggatgtgtttccccattggcttcaaactctaccagaattgaaagtattggttttgcgagccaacaagttgtacggtcccattgccggtttaaagatcaaggatggattccccagtttagtcatctttgatgtctcttccaacaacttcagcggcccaataccaaaagcctacatacaaaaatttgaagcgatgaagaacgttgttatagataccgatctgcagtacatggaaatttctttttcttatggtggaaacaagtacagtgattctgtgactataacaacaaaagcaattactatgacaatggatagaattcgaaatgactttgtaagcattgatttatcgcaaaacggatttgaaggagagattccaaatgccattggagagcttcattcactcagaggactcaacctttcccataacagacttattggtcctattccccaatccatgggaaatttgacaaacttagaatcattggatctctcctcaaatatgctcactggtcggatacctacagaattaaccaatttgaactttcttgaagtgctaaatctttccaataaccatcttgcgggagaaatacctcgaggacaacagttcaatactttttccaatgattcctacaagggaaacttggggttatgtggactcccattgacaacagaatgcagcaagggccctgaacaacattctccaccttcaactaccttgaggagagaagcaggatttggatttggttggaaaccagtggctataggatatggatgtggagtggtctttggagtgggaatgggatgttgtgtattgttaataggaaagcctcaatggcttgtgagaatggttggaggtaaactcaataaaaaggtgaaaaggaagacaaggatgagatctaatgaaaatggtagcagaatgaattag

SEQ ID NO: 69106 - DNA, 429 bp, Glycine max
  Peptide Sequence Number=SeqID_185884
atggagttggaggaaaatgtgaacaaggaggtggtggaggaagttccaaaagaagaagatggagatcataagctcgatagaccaataatcgctttgtcaaatatggagcttttgagatgggcttcaccatgtgtcagttttggaaaattccttaagattgataaattgacttcaatccaatcaagaggaaagtttgcgagcatctatgtggagttggatttagagaaaccccgggagactcatatctatgtcaaaggacataaactgtttcttgaatatgaggacctccattcgatatgtttcaagtgtggacgtgttgggcacaaaaaagatgattgtactgaattacaaatgatgatgacggaggatcaaatggggaaggcaatggaactaaccgacaacaatgaagttacaagtcgagcaatctaa

SEQ ID NO: 69107 - DNA, 333 bp, Glycine max
  Peptide Sequence Number=SeqID_185885
atggatattagtagcacattttcgatggaggatggaagttccaaaggcaagaggtgcaatgctataagtcatccagatggcatttggtgcatctggaatccagaagattggacaatgaatgttcttatgaacccacatcaattggtccatatgaaggttagatggagaagtacaagtgaatggctacttactgccatttatggggctccacaagtggctaggagacaaatgttgtggcataagctaaatgatattagttttgatgtgactggtggttcgggtgtgattggggactttaatagtactctctctcctctgaaagtattggactag

SEQ ID NO: 69108 - DNA, 918 bp, Glycine max
  Peptide Sequence Number=SeqID_185886
atgagttttcatgatacatcaaacacggggcttggacttggtcttggtcttggacttgttagcttccatgatcaatcagagaattgcatgaagagtactaatgatcccttgagagaaatccataagataaaaaaggtggagaatccatcaaaatgtaacagcacatacccttcacttacattaggaccaccagatgatgatgatgatgatgatgatgaagtgaataatcaaccaccaagttcaaaaactgagtcctatgaatattttcgtccccatgtttcttctcctagtgcggtgtcttcattttccaactattctagcatcaagagggaaagagatcaggttttgtgggaaaaagaatttgaggtagaggtagagaaagttccaacaagggttggtgatgttgacgaagatggtaaccccagaaagaaacttaggctcacaaaagagcaagccgcagtcttggaggaaaatttcagagagcattctactcttaatccgaagcaaaagcaagaattggcaatgaagctgaatctgcgagcaagacaagtagaggtgtggtttcagaataggagagccaggacaaagctaaagcaaaccgagtcagattgtgaactattgaagaaatgttgcgatactctaaccgaagaaaataagaagctgcaaaaggagctgcaagaactaaagtcaatacaagcaacgccaatgcccctttatatgcagattccagcagccacactttgcatttgcccttcttgtgagagaatatgtggtggcaacaacaacagtgatggcggcaacaataataatggctcttcacacacgacatcgttgctcattggctcaaagacacatcatcattccttttacaaaagtaacaagtatccattcccccactcatcatccgcagcatgctag

SEQ ID NO: 69109 - DNA, 174 bp, Glycine max
  Peptide Sequence Number=SeqID_185887
atggtcgttcaccacggtcgtggtcaattcatgagggtcgtggtcaaccatgaggaccttagtcaatccacaacgccccaaagcttcgatgccactttcgaccataattgtggtgaattttaccaatgtcgtagtgcatcttttcaaagtgatatctttaggaaggattgctag

SEQ ID NO: 69110 - DNA, 456 bp, Glycine max
  Peptide Sequence Number=SeqID_185888
atggacatactcgaccttttaccaattgtaaaggtaaataaggacatcttcaatgaaaagaataaaaggataggtaaggcaaaaggactttgggttgaggatttgcccaacaaattatgggcataccactgtactccagaatccacaacaagagaaacttctttcagactgacctatgtcattgatgccatgatcccagtggaaatcggtgaaccctcagcaagaagagcatattttgaagaaacactcaataatgaaagcttagccttccaattggatatgattgatgaagtcatagagcatgctcaaattcaagaagaaacatgtaacaggaaagcaactcagaaacatgagtcaaagttgaagagaaaagaattctcagagtgcgatctggtctggaaaatgagagaaaaagctagcaaggatcatgctaaagggaaacttgctccaaaatga

SEQ ID NO: 69111 - DNA, 324 bp, Glycine max
  Peptide Sequence Number=SeqID_185889
atgtcaaatataagacatagtctccgtcgtaggaaactgcatgttcatggcatcgcagaaggcaatgagtggcaaggacatttacccacgcgagctgtagtggtggacagtggtgcgattcttgaaggatctcaaatctatgagtcttggagttcctccgccatgttgatgctggcgtggtcggagccaagcgtcagagggccactacagctagcggcggacgcgcaaccgctgttggcgaagattggggtgttggtggaggatctaacgttgttaccattactcaacatggcgcgtagaagcaaatcgaggggctggcgatga

SEQ ID NO: 69112 - DNA, 120 bp, Glycine max
  Peptide Sequence Number=SeqID_185890
atggttcaaaatttcagaagtgaatggctagatgctacggaagtttggaaggccacacacatgagatctaatggaacttggtgcattccaaaaggcgaagaaatcatgaggaagctttag

SEQ ID NO: 69113 - DNA, 828 bp, Glycine max
  Peptide Sequence Number=SeqID_185891
atgtcgaggagaccggggaatcctactagaaggttcggtgacaatggcggtggattgttctcttcgaaatctaggtcgccaccggttttgtctattgcgcttgtaattgtgggaggtttgtttctcattggctatatgtatagaggctcaggtggatctagcagccgtatagattctgttagcagggttgaaggtgattatttgtgcagtggagaggtccaacaagcaattccccttttacagaaagcatatggagatagcatgcataaagttttgcatgttggtcctgatacttgttatgtggtctctaaattgctgaaggaggatgaaactgacgcctggggaatagaaccatatgatatagaggatgctgataataattgcaaagcacttatacgtagaggcagtgtgcgtgtgtctgatatcaagtttcctcttccatacaggccaaaatctttctctcttgtaattgtttcagatgctctggattacctgtctcccagatacctcaataaaactcttccagatttggtgagggtagcatctgatggtgtagtgatatttactgtcaataatctcttgggtgtgtcactgacatctgataatatctataatgaaggttttcccaccactcaaaaggccaaggtagcggatgtttctaaatttggaaaagcggccaagatgaggagttcatcctggtgggtcaagtttttcctccagattaacttagaggagaatgaagctgctgttaagaagtttgaactggcttcatccaagagttcatatgttccgaaatgccagatattccacttgaagtcactccattga

SEQ ID NO: 69114 - DNA, 534 bp, Glycine max
  Peptide Sequence Number=SeqID_185892
atggcagaccataatgagccgagtgaggttaagatgcagattgggatcatgagggagaaacttaaagaagcaatgccagtctcagttcaagaatttccttggaaaaaagctgagcaaatactcctagacagactacttaatcttgcacaagagacagtgaagtggtctcttgttttgtttttcatctttagctctgtatcggatgttgtatatacattctccataaaccgtgaattggttattcccattggcctctttgttggccttcttgtggctggtttcttgaaagagatatcgcaagacttgtttcatagacccgaggaaaaggatttgaaatggcatcttctgggcatgtattgcatttttgtgtttgccaagtttatgtcaacatggtttgcaacactacctcgagtgtttcttttgcatgttgcaaatgggggactgatacaggctttgtggcattcgacaaattttatggaagatgaaaagaacaaacaagaaactagcagttcctctagtttgcatgcttcatga

SEQ ID NO: 69115 - DNA, 351 bp, Glycine max
  Peptide Sequence Number=SeqID_185893
atgcgagtgaggacaaagcacgctaaaaagtctcgtgttggtttatggggacagtcattgatcttggaagtaaccaaagcatattatcgaggtcttaaaaagggctacctatggaaggagttttggagtgagattgatgtaggagatggcggtgatatgacaattagtggcactatactagagaacattgtaggactttccgcccttaatccaagaaaagaaagggaacagttggactttgccataattatggacttccctaggaggatggacatcaaggcaattcttaactttccttattgtggaaatgttgagaaagctttagagggtgaatactgtgttaagatttga

SEQ ID NO: 69116 - DNA, 201 bp, Glycine max
  Peptide Sequence Number=SeqID_185894
atgtcaatagcatgtctcaaacaaggaataattgtatcagtgccgatggaagtggcggcagggcagggcacatcggcaaaactgcaaaagcatggcggggtaggtgaggatgacagggaacctattgaagacgtaggaatcgatggagatgaaggaacatcccacataacagtccttccccctcactccaccgatcaatag

SEQ ID NO: 69117 - DNA, 429 bp, Glycine max
  Peptide Sequence Number=SeqID_185895
atgaagaaaaaaaaaagtgcagagactgttggtgtcggttggtggaatccaacggtgcgtgccgagccggtgattgacaatcagccaggccttattggaaatgggccattcgtggcccaatatgtggaaaagttaaaccggatgatgtggtgccacgtcatagtgcttattcggattaataatattaataaccgaaccggttctgaaatgaacaaagacgaaagcgataggaacgaaaagaaagcgcaagatattaagctttggggagttttcatcttcggattaatcggcgccaccgtcactgctttctccctgtccaggtcgcaggcaaaaggaggcagctctttccgaacagcatttcaagaagaagcatggaagaggtacaataagcgattgcaagaggagtatgaggaggagatggagagggtg

SEQ ID NO: 69118 - DNA, 169 bp, Glycine max
  Peptide Sequence Number=SeqID_185896
gtgtagccatccgttgaaagatctgaaggtttctagccttaacttccaaatctcctacaacgcaataggaagcaaaacaccaaactccttaagttgttggttcatccaatctagccaaatcgtgccagctccactcagccttggaggattaatatgccgctacagttag

SEQ ID NO: 69119 - DNA, 171 bp, Glycine max
  Peptide Sequence Number=SeqID_185897
atgggggatcccatcagcagactctccttccctgaaaacaacgaaactttttcaagcctcacaagttatccagaactacgtaggtctgagttcctcattggaggatacgtaggagcaagagcctcgcttttgtcgaccacaccgccttttgttgccataactcaagagctg

SEQ ID NO: 69120 - DNA, 396 bp, Glycine max
  Peptide Sequence Number=SeqID_185898
atggtgaagtactcaagggagcctgacaatccaactaagtcttgcaaggctagaggcgccgaccttagggttcattttaagaacacaagggaaactgcctttgcaatcaggaagttgcccttggtcaaggctaaaaggtacttggaagatgttcttgcccacaagcaggcaattccattcagacgtttttgtcgaggtgttggaaggacagcccatgctaagaatagacactctaatggccaaggacggtggcctgtcaagtcagcaaaattcattcttgatttgctcaaaaatgctgagagcaatgctgaagtgaaagccgctgccgctgagagtgccaccacagagcggaacgccacaaatggtgaatatcaaaattcgctgttccaacggtga

SEQ ID NO: 69121 - DNA, 1432 bp, Glycine max
  Peptide Sequence Number=SeqID_185899
atgagttgttattctctgaaactattttatgcacttttgctgcttttattgcatgctgctggatccattcttggattcaacagccttcccaatagcgcagaaattaagtgcattgagagtgagagacaagcactcctcaacttcaaacatggcctcaaagatgactctggcatgctgtctacatggagggacgatggcaataacagagactgttgcaaatggaaaggcatccaatgcaacaatcaaactggtcatgttgagatgcttcatctccgtggtcaggatacacaatatttgagaggtgcaatcaatatctcttcattgattgcccttcaaaatattgaacacttggatctcagctataatgcttttcaatggagtcatatcccagaattcatgggctcgttcgccaacttacgatatctcaatctctcttattgttcatttggtgggagtattccttctgatcttggaaagcttacacatttactgtctctggatctaggtaacaattatttactccaaggacaaattccttatcaacttggaaatcttacacatttacaatatcttgatctaagtggtaattatctggatggggaactcccatatcaacttggaaatctctcacagttgaggtatcttgatcttggttggaattcattttcgggagcactccctttccaagttgggaatcttcctttgttgcacactcttggacttggtggcaattttgatgtgaaatctaaggatgcagagtggttgactaatctgtcttccttgacaaaacttaagctaagttcactacacaacctttcctcttctcatcactggctacaaatgatcagcaagcttattccaaacttaagagagttgaggctatttgattgttctctttcagatgcaaatattcaatctctgttttattcaccttccaacttttccactgctcttaacatccttgatctttcttcaaataagctcacatcctcaacatttcaactgttgtcaaactttagccttaatcttcaggagctttatcttggtgataataacattgttttgtcatctcctctctgcccaaactttccttctcttctgatccttgacctttcctataataatttgacatcatcagtctttcaaggtggtttcaacttcagctcaaaacttcaaaatcttgatttgcaaaattgtagtcttaaggatggaagttttcttatgtcatcttctttcattatgagttcttcatcttctcttgtttcccttgatctctcctcaaatctgttgaaatcatcaactatattttactggctcattaactccaccaccaatcttcataaccttttgctttataataacacgttagaaggtcccattccagatggatttgggaaactaatgaactctcttgaagttcttcacctcaccg

SEQ ID NO: 69122 - DNA, 699 bp, Glycine max
  Peptide Sequence Number=SeqID_185900
atggggtctctaatggcctctcttactctcactcttgtattggcaatagtttctctaagcttgtcatctcaagcctcagctgacaagtacgactattcatctccaccaccaccagtttacaagtacaagtccccaccaccaccctacaagtattcatctcctccaccacctcctaagaagccttacaaatacccatcaccaccaccaccagtttacaaatacaagtcaccaccaccaccctacaagtacccttctcctccaccaccacctaaaaagccctacaaatacccatcacccccacctccagtttacaaatacaagtcaccaccaccaccagtttacaagtacaagtccccaccaccaccacctaagaagccctacaaatacccatcaccaccaccaccagtttacaaatacaagtcaccacccccaccctacaagtacccttctcctccaccacctcctaagaaaccctacaaatacccatctcctccacccccagtatacaagtacaagtcccctcctcctccatacaagtactcttctcctccacctccaccatacaagtacccttctccaccacccccagcttactactacaagtcacctccaccaccacctaagaaaccatacaagtatccatctccacctcctccacactatgtctatgcatcaccacctcccccataccactactag

SEQ ID NO: 69123 - DNA, 195 bp, Glycine max
  Peptide Sequence Number=SeqID_185901
atgacatctcatatagagcagtttagaacaacaccatatacagaagcggagattaagacagcatttaggaccaaggcaaagcagtatcatcctgaccagaaccaggataatagagaggctgctgaggccaagttcaaagaagtaatttgttcatatgaggccatacaacaggaaagaaaaaaccagaatctgtaa

SEQ ID NO: 69124 - DNA, 589 bp, Glycine max
  Peptide Sequence Number=SeqID_185902
atggttgatctagtgacaagaaatttgaataatttacacaagcttttaaattctaactttgttgtcatccattttaagagtattttgtgtgataataatgacaatgattgtgataccaacaacaatgttgacgatagacatactagtggtggtcaccgtagtagtgacaatgctaacggtggtggcagtgacgacatgttggtaatagtggtgttggggttgacaacaagtgatgaaagtggcggtggcaacgttagcaatgatggtaataacaaaggtggtattagtgatgcaagtgggggcgatgtgatggcggtagtagttgtgaaaacgttggtggtgattgtggtggcggtgacggtgacggaggtggtattgttgatagtggtgacaatgacgatgacgataacattgatgtggtgttggtggtggcaacaagtggtggtaatgcgagggtgtggtggtgacaataacgatgatcgtgacactcatggtgttgacaataacaataccggtggtgatgacgatgatagtgacagtgaaaattttgttggtggtagcgatactgacgatgatggtgatggtggtg

SEQ ID NO: 69125 - DNA, 273 bp, Glycine max
  Peptide Sequence Number=SeqID_185903
atgacgccgccacaaagagtacgtgagagtgagagtgatagcgtgagagtgagaaggagtgcgagcaagaatgagagaggaagaaagaaactgttgaatcaatcaaacagaaccatcaaagtcattatgtgccccattagattatttaagtaccttgcacaaaagccacaagtgtcaacatcccaggtcaatcgtatcctcctcggtcttgctcaagctacagtctctatgacttggcataaggatagtcatcctatcaaatatatcaagtaa

SEQ ID NO: 69126 - DNA, 582 bp, Glycine max
  Peptide Sequence Number=SeqID_185904
atgaccctacccttatctgaccgcaagtcccggcgaagccccaaaacatatcaccaaaacctcatttccgatgccgccatccaatgcggctcgtcgttctccggcgcggtgttcaacctctcgaccaccatcgtcggtgccggcatcatggctcttccggccgccgtcaagcaactggggctaattccaggcttagtcatgattattttgtgtgccatgttaacggaatcctccatttccatgctcgtgcggttcacacgtgcgtcaaaatcctccacctattctggggttgtacgtgacgcttttggtggccttggtcggaacctcttgttgctttgcatcatcgtaaacaacgtgggcatgctcgttgtgtacatggtcattatcggtgatgtgttctcaggatcatggtcagaaggagtgcactattcaggggttgtggaagaatggtttggtcaacgttggtggtcaacgcgccctgttttgttgtttctcacagcgattctggtcttggtgcctctggcatcattcaggcgtgtgggtacgtctgtttcttcctttcatggcattaatacggaataa

SEQ ID NO: 69127 - DNA, 579 bp, Glycine max
  Peptide Sequence Number=SeqID_185905
atgaaggccatagtccggacatcgctcttactatgctcatctgtgtacatagcaaccagcctttttggttttttcttatttggggacaatacactagatgatatacttgccaactttgatggggatctaggagttccttatggctcatttcttactgatatagttagagtgagctatggcattcacctaatccttgtgttcccaattgtgttttactcgcttcgcctcaacatagatggtcttatgtttcctcatgccattcctcttgcctttgacacccagagattctatttggtgaccacagttctcatggcttttatctttgttggagccaattttgttcccagcatctgggatgccttccaattcataggagccacagctgcaatttctgctggatacatttttccagctgctattgctcttagggatactcgtggggttgcaacaaagaaagataggttgttatcttggtttatgatacttttgggtgtctcatgtagcactgtggccatctttagtgacttgtatagtgtctacaacagtagtgaagcagaggtagctgaaaaatgggcttga

SEQ ID NO: 69128 - DNA, 225 bp, Glycine max
  Peptide Sequence Number=SeqID_185906
atggtggtcttgcacgtgtccttcatgaaggtgcaaaagggatcgagaagcatgttgtgcaattgtgttctagcagaagactatgaccagcctgactatttgtgcaagattgattccgaaggaaaagctaagaaggttactggttgctccggtgtggttgtgaaggatttcggtgaggagcatgaagcctataacgtcgttctgcagcatgtgaaatctcaatga

SEQ ID NO: 69129 - DNA, 273 bp, Glycine max
  Peptide Sequence Number=SeqID_185907
atgagttgtaaggctgataagaatcctgaaactgctcaaatacagggacctatgatgagaataacttttggcattttcataaaatttggtgagaacttctctcagggttccttgttgaaccaatctcagacttatcaaggtaatcattgtggcgtctaccctgacttatcttccttcactggaagtggcgtcattcaaatctccgtagcctatatcaagcgattcgctcctagtcaagatcacatcatctggtatcagagtttcgactcttga

SEQ ID NO: 69130 - DNA, 1489 bp, Glycine max
  Peptide Sequence Number=SeqID_185908
aacccgctgccgttccccggcgaagaatcccagtcgacgcccgccgatacggtgccggcgtccccctcgaccggtaccggcccgaacccggtaccgccgcccgcgcacgcgcgtccggccggccgccgcccgctgtgggctcgcctgctgggccgcctggtcgagccgtggctgtcgctgaagatcgagccggaagacccgggccagtacaacgatggccgcccggtcatgtacgtgctggaagactacggcctgtccaacgcgctgatcctggacaaggcctgccgccaggccggcctgccgtcgccgctggtgccgctggccggtgatccgaccggccgcaagcgcgcctacctggcgctgtcgcggcgcagctccagcaactcgctgatccccgagcagcgcggcgccaagacccattccgattcgctggccaaggtgctgcaggcgcatcgcgtgcgcgacgacctggacgtgcacctggtgccggtatcgatcttcgtcggccgtgcaccggacaagcagagcggctggttcgcggtgctgttctcggaaaactgggcactggtcggccgcttccgccgcctgctggcggtgctgctcaatggccgcagcaccatcgtccgcttcgcgccgccgatctcgctgcgttccatcatcgacgagggcctggagccggaacgcacggtgcgcaagctgcagcgcgtgctgcgtacccatttccgccgcatccgtgaatcggtgatcggtcctgacctgtcgacccggcgcctgctggtggaccaggtgctggcggccgaaccggtgcgcgaagcgatcgcctcgcaggccaagcgcgacaactcgaagccggccgacgcctggaagaaggcgcacgcctacgcctgggaaatcgccgcggactactccagcccggtggtgcgttcggccagcttcatgctcagccacgtgtggaaccgcatctatgcgggcgtgctggtgcaccacctggacaagttcaaggccgccgcaccgggccacgaagtggtctacgtgcccagccaccgcagccacatggactacctgctgctgtcctacctgctgtacgaccgtggcatcgtgccgccgcacatcgtggccggcatcaacctgaacctgccggtggtcggcaccctgctgcgcaagggcggtgcgttcttcatccgccgctcgatccgtggcaacgcgctgtactcggccgtgctcagtgagtacgtcgcgcagctggtggccggtggctactcgctggagtacttcgtcgaaggcggccgctcgcgtaccggccgcctgctgcagcccaagggcggcatgatctcgatgacgctgcgtgcgttcctgcgccagccgcgcaagccggtgctgttccagcccatctacatcggctacgagaagctgatggagggcggcagctacctggacgaactgtccggccggccgaaggaaaaggaatcgatctggtcgctgctgtggg

SEQ ID NO: 69131 - DNA, 2022 bp, Glycine max
  Peptide Sequence Number=SeqID_185909
atggcaacttcgttgaaatggtgggggaaggagagtcacaggggcaccccagtggtggtgaagatggagaatccaaaatggtcgatgttggaactcgagggtccttctgatgaagacttcatcattgggaatgataatgataacaataataacaatagagacaacaaaggtagagggaaaaacgcgaagcaactaacgtgggttctgctacttaaagctcacaaagccgcaggttgccttgcttctgtggctcctgcattattgggtctggtcgccgccgtgaagcgccgcgtggctgccggaagaaccgacgccgacaccgacggtggcggcggcggtggtgggagggagaaggagaaccccaccgtgaagagtagattctataactgcatcaaagtgttcctctttgtgtctcttatgttgctgttttttgaggttgctgcgtacttcaaagggtggcattttgaggctccgaggttttggggtgtgaagggtgtgtttgattgggcttatttgatgtggagtttggataggttggtgctgtgtttggggtgtttctggatccggttcaagaagatcaaaccggttcccaagggtggggatgtggatcttgagtccggcgagaagggtttcttccccatggttcttgtgcagatccccatgtgcaatgagagagaggtttatcagcaatcaattggtgccgtgtgtaatttggattggccaaaatcaaagttgttgattcaggttctggatgattcggatgacataacaacacagtcgttgatcagggaagaggttcagaaatggcagaaagagggtgccaacattgtgtacaggcatcgggtgattagaacgggatacaaggctgggaatctgaattctgccatgaattgtagctacgtgaaagactacgagtttgttgccatttttgatgctgattttcagcccaccccagatttccttaaaagaacgattcctcattttaaggataacgacgagttaggacttgttcaggcaagatggtcctttgtgaataaggatgagaacctgctaacacggttgcaaaacattaatttggctttccattttgaggtagaacagcaagtgaatggggttttcattaacttttttgggttcaatggaacggctggtgtgtggagaataaaggcccttgaggatgctggtggttggttggagaggaccacagtggaggatatggatatcgctgtacgtgcccatcttcatggctggaaatttattttcctcaatgatgttgagtgccaatgtgagctacctgaatcttatgaagcttatagaaaacagcagcatagatggcactctggcccaatgcaattgttccgtctttgtttgcccgacataatacgctccaagataagcatatggaaaaaattcaacatgatatttctcttctttcttctaagaaaattgatattacccttctattcatttacccttttctgtataattcttcccatgacaatgtttgtaccggaggccgagcttcctgctttggttgtttgttacatccctgccaccatgtcgttacttaacatccttccagcccccaaatccttccctttcattgtcccttaccttctcttcgaaaacaccatgtcggttaccaaattcaatgccatgatctccggtcttttccatctcggaagtgcatacgagtgggttgtcaccaagaaatccggccgttcctctgagggtgaccttgtttccttgattgagaaaggaccaaagcatcatcaaagaggctcctcagcgcctgatcttgcggaaataaaagaagaaatccagctacaagagaaaaaggtggggtcaaagaagaagcataacagaatatacatgaaggagcttgctttggcctttctacttctaacagcttcagcaaggagtctcctttctgctcagggaatccacttctacttcttgttattccagggcatatcattccttttagttggtctagacttgattggtgaacaggttgattga

SEQ ID NO: 69132 - DNA, 267 bp, Glycine max
  Peptide Sequence Number=SeqID_185910
atggggaaactcaggatcatccccaagttgtcccctcgctactatggaccctttcaagtgttgtctcgtgtagaagaggtgacctataaacttcaattttcagactcagctcgaattcacccagtttttcatgtttcacagctcaaacgatcagtgaagagtggttctactaccactactttgcctcgtaggctggctgttgctgaatataagcctcctagtcttgaagctagtttggcaactcagttattttccttaccagcttag

SEQ ID NO: 69133 - DNA, 1737 bp, Glycine max
  Peptide Sequence Number=SeqID_185911
atggctatagttgaatccgtggggaagattcctttgcaagacccacctgaggaggagttttgtgctgctgacctgacttggaccaagtttggtaatgctgagcaccatgatgaggttgccctcattccctatgacagagttgatgcttttataattggtgaatgtactaatgtggagtgcccgactcggtttcatatcgagagaggaaggaaacggactattggaagcttgaaggagtacaaggacgatgagtatctggagtacaggctgtactggtgctcgtttggccctgaaaattatggggagggaggaggtatattacccagtcgaaggtatcgacttaatactcgaaatcgtgctgctagacctcaatcaatgcgaggttgtacttgtcattttgttgtcaaacgtctttatgctcagccatcactggcacttattgtatacaatgaaaggcgtcatattaacaagtctggttttatctgccacggaccacttgatagagatgccattggcccaggcgccaaaaaaattccgtatatttgcaatgaaattcagcagcaaactatgtccatgatatatttgggcatcccagaagagaatatcttggagaaacacatagaaggaattcagcgatattgtggttcagatgcaaaagtcagtagccttgcttctcagtatgtccacaagctagggatgattatcaaaaggtctacccatgagctggatctagatgatcaagctagcatccgcatttggattgaacgcaatagaaagtctgtattttttcaccaggatacttcagagtctgaccctttcatcttggggatccaaacagaatggcagctgcaacaaatgattcgttttggtcatcgaagtgttgttgcagcagactctacgtttggtgtgaagagacttaaatatcccttgttcacactacttgtttttgattcaagacaacatgcacttcctgtcgcatgggtcattacacgtagctttacaaagcccgatgtgtctaagtggttgaaagctttaattgatcgagctcgtagtgttgagcctggatggaaagtcagtggatttttaattgatgacgctgcagctgaaattgatcttttgagagatatattttgctgtcctgtcctattttcactatggcgtgttcgtagatcttggcttaggaatattgttaagaaatgtagtaacattgagattcagcgggagatttttaagcgtcttgggagaatagtgtacaacatttggggaggtattaatgcatcgcttgccttggaacaattcttgctggattttgttgaccaaactgctttcatggaatatttcaaagtcatgtggttgcccaagcttgaaatgtggctttcaacgatgagaaattttccattagcaagccaggaagcttctggagcattagaagcctatcatgttaagctgaaagccaaactttttgatgattcacatcttggagcattgcaaagagtagattggttagtccacaagttaacaactgagttgcattcaagctactggcttgaccggtatgctgatgagagtgattctttccagaatgtgaaggaaaaatatattgcttctacatcatggcatcgggcacttcaaattccggactatgctgtttccttggatgataaagaccacctctttgccaaggttgtgagccagaaagacagtagcttaacacatagtgtggaatccaggatctga

SEQ ID NO: 69134 - DNA, 363 bp, Glycine max
  Peptide Sequence Number=SeqID_185912
atgaattgtgttttcattcatccgtcctccacccacgagtttggagccatgcgtagtgattgcttagtgcaattctccattctcaacccttttccggagcccatgaattgcgttttcgttcatgtgtcctccacccacgagtttggagccttgcgtagtgactgcttagtgcaattctccattttcaacccttttttggagcccatgaattgcgttttcgttcatgcgttttccacccacgagtttggagccatgcgtagtgattgcttagtgcaattctccattctcaacattttttcggagccccatgaattgcgttttcgttcatgcgtcctccaccttcgagtttggagccatgcgtag

SEQ ID NO: 69135 - DNA, 894 bp, Glycine max
  Peptide Sequence Number=SeqID_185913
atggctacctatagttggtcaactgagatattttcatttttggttctaacgttgttgtcgacaagcagtcacacaatggttgctggagcacgcaatcttctcgaatcaaccttgtcaaaaccagaagtgccaacacttcccaaacctcatgagttgccaccattgccggaaatccctgaattgcccaagtttgagtcgcctaagatccctgcactcccgaaacctgagctacctaaggtccctgaactgtctaagcctgacatgtctaaagttcctgagttgcctaaagtcccagaaaggcttaaagtacccgagatatctaagatccttgaattgtctaagcccgagttgcctaaaggaccagaattacttaagcctgagttacctagtgtacctaatatccctaaggttcctgaattgcctaaaccagagttgcctgaagtcccaaagttgcctaagcctgagttgccaaaagtaccagaattgcctaaacctgagttacctaaagtacctgagatccctgaattgcctaatctcgagttgcctaaagttcctgaattgtctaagccagagttaccaaaagcacctgagatccctaaggtccctgaatttcctaagcccgagttgcctaaagttcctgaattgcctaagccagagttaccaaaaatacctgaaatccctaaggtccctgaatttcctaagccagagttgcctaaagttcctgaagtgcctaagccagagttgtcaaaagtaccaaagctacctaagtctgagttacctaaagtacctgagattcctgaattgcctaagtccgagttgcctaaaataccggagattcctaaggtccctgaattcccaaaagttcctaaagcattttcaaccaccaatccttga

SEQ ID NO: 69136 - DNA, 201 bp, Glycine max
  Peptide Sequence Number=SeqID_185914
atggaagcaccaattggtagggatgaagatattcctgaattggaggacaggaatcaacctccagaagcagcgagattaagaaatattaacaatgctggaaaaacaggaaacaagatcaattctgccgtgatctctgggggacaagaatcgcaaagcaaacgttcgtgcgagacaagcacgatgaggaaggcactatcctaa

SEQ ID NO: 69137 - DNA, 354 bp, Glycine max
  Peptide Sequence Number=SeqID_185915
atgtctaaggttcctgaattgtctaagcgcgagttgcctaaagtctctgaattgcttaagcccgagttacctaaagtacccaagttgcctgagatttctgaattgcctaagcccgagttgactaaagtacctgagttgcctaaggttcctgaatcgtttaagctcgagttgactaaaatacctgagttgactaaagtatctgagttgtctaaggttcctgaattgcctaaacctacgtttcctaaagtacctaagccagaattgcctatggtccttgaattgcctaagctcgaattgtcaaaaatacctaaaatacctaaggttcctgaattccttaagctacttaagagttaa

SEQ ID NO: 69138 - DNA, 3858 bp, Glycine max
  Peptide Sequence Number=SeqID_185916
atggcagacaacacttgtagccacaccctctcgcgccttgaagaagctgtcaccctcctcacacaaaaccaaaccacactcacagccactcaaaattccctacatacccgtctcgacgaggtcctagctcgtctacagtccctcgaagcttcttccccctccatgtctccccggccctccacgccacgcatgaaccttgatatcccccgtttcgacggcactaatgctctggcctggattttcaagataacccaattttttgattaccatcgcacccccgaggacgaccgtcttcaggtagcctccttttaccttgaaggcgccgcactaagctggtttcagtggctctaccgcaatgaccaattaccctcttggtcttcatttatccaagctcttgagctccgcttcgcacccaccctctatgacgatcctcgcggcgccttgtttaagctctctcagcacggttcagtatccagctacctcgccgagtttgagtctctggccaaccggatcgtgggcttacccaccccttttctcctcagctctttcatttcgggcctccaccccgacatccggcgcgaggtactggccttacaacccctgtccctcgtccaggaggtggcgctagcccgcctccaggaggacaaactattcgacgctcgccgctcctcacgccccaaaccatccccccttaccttccccgctaacccacaaccactcaccaccatcacccctcctcccctgttaccctctcccccaaaacctacctacaaacgacttacccaggcagaaatggcgtctcgccgcaaacgtgggttgtgctaccactgcgacgagcgctatggccccaaccaccgttgccgtgccaagttcttcctcctcattgctccccaggacgatgacgacccctttccaccagactcccctgataccattgacacaaacccacctccaccacccccaccagaccccgaccccgcccaactcactctttacgctttgtctggccaaccaacccccgccacccttcgagtcataggcaccattaagggccacgacacggtcatcctcgtggacggaggtagtacacacaacttcgtccacgaccgcctagcccacttcctcaacctcaaccctcagaccatccctcttttacccgtcatggtcggcaacgacaccgaggtccattgcgacaaggtttgccgcaatgtcgccatttccatccagggctgccactttacccttgacctacatgtaatgacgttgggcggacccgatatcgtccttggtgtggcctggctcaagcttttgggcccaataaccacggactattcgcacctcacaatgacctttcaccaccaaggcaagcccatcaccatccacggggaacttacctcaggcccaattgaaatccctcacgaccaagtccggagcctccttaccaccaaccgggttgcggccttatttcacatccagcttctctcccctgacccgccatccccaaccttaccatccacaccccctccccttcgttccctcctcaccaaatattccaccctgtttcaacctccggcacacctaccccccactcgaccaacataccactccatccaccttgaaccaaattcccaaccagtcaacgtccgcccctatagatacccatattctcataagtgcgagattgaacggcaagttgacgacatgcttcgtcgtcaactcatacgtcccagccgtagcccgtattccagtccggtgcttcttgtcaagaaaaaggatgggacatggcggttctgtgtggactaccgtgcactgaactcgctcacgatcaaggatcgatttcctctacccaccattgatgaactccttgacgatttgggcaattcttcttggttctcgaagatggaccttgcgcagggattccatcagattcgcatggaggagcaagacatacccaaaactgcattcagaacacatcaaggccattacgaatacatcgtgatgccctttggcctctgcaatgcgccatcgactttccaggctacaatgaatgagctctttcgcccatttatccgcaaattcatgctcgtcttctttgacgacatattggttttcagtagcgatttccaggctcacctccaccacctggagtgtgttttcagaaccttgcaacaggggcaattccatttgaaagcttccaaatgcatcttcgggcaacggcgtattgagtatctcggccatttcgtctcttcccagagagtagaacccgacccgtccaagattaaggctatgctacaatggcctcctccgactacacccaaacaacttcgcggtttcctaggactaaccgggttctaccggcgtttttttcaccgttatgcccaaatagctgaaccattgacccaactcctgcgtaaggacgggttcaaatggacacccgaggcccaaactgctttcgccaagctcaaggaggccatgaccgccacacctgtgctcgccttgccggatttcaccatccctttcgttctggagaccgacgcctctgggtccggcatgggtgatgttctgatgcaaaggggtcaccccattgcttactttagtaagcaattctgccccaagctcctccgatcttttacatacatacgggagcttcacacaatcaccaccgccgtcaaacgctggcgtcaatatctcctgggccacaccttcgtgattctaacggaccataagagtcttcgcgagttgatgactcaaccggttcagaccccagaacaacatgtatacctggccaagcttcttggttacaattattctatccagtataaggctggccgtaacaatgtagtagcagatgccctctcgcgccttcatgaaccggactccgtagctgcatgtttccaaatcatctccatgccccacccacaattccttgacgagctcaagagggaattatcgggatcggacgaattcaagacactcatgctccaagttcgcaaccatccttccgattatccgggtttcaaaatcagagacaacctgctcctttttcagggcagcatttggcttaatcagggcaacccttttattccccttcttctggaggaatatcacaaatcccccctcggtggtcacatggggcttgctaagaccctgggtcgtctccagcaaagctttttctgggaacacatgcgccgtgatacccagaactttataaagcaatgttcgaattggcttcagaccaaatacactccaaagaagcccgccggccatttccagccaatcccaccaccatcacggccttgggaggatttggccctcgatttcatcactgggttacccatttcgaatggcgctacagtcatcatgacggtggttgatcgtttctccaagggcggacacttcgggactctgccaacccatttcacagctcacatggcggcccacttgttcattgacctcatctgcaagcttcacagtttcccacggagcttaatctccgaccgtgaccccctcttcctcagcaagttctggcgggagctttccaaactcagcgggaccaagctgcgcatgagcatggcttatcatccccagagcgatgggcaatctgaggtgctcaaccgcgtcgttgaacaatatcttcgtagcttcgttcatgcaaaaccagcaaattggcacaaatttttgagtttggcggagtggtgctacagtacatcgcgccattctgctacggggctaaccccatacgaggtcacttatggtaaacccccgccggcgatccctgactaccttccgggaacgtcggatgtcgaggcagtggatttcctcctcacctcccgacaggacatgttcaccaccctctga

SEQ ID NO: 69139 - DNA, 1148 bp, Glycine max
  Peptide Sequence Number=SeqID_185917
ttcaacatcacctggatgctgcatacgccgctgacaaaaacgctgccggtggggctggcagacagctatgcctcaatgcgactggaagtgggatcggcctacacgctgatctttattctgctgattctgccgctgctgctgatgctcaacgcggaggcggcatgaaccctgcggccgtaaccgttacgctgcgccactgtgcgcggcactttaatcaccagctggcactgcagccgcttgatctgacggtgcagcctggcgaaaccctggtgctgctcggtccgtccggctgtggcaaaaccaccacgctgcgcatcatcagtggcctggagcgctgtgacgacggcggcgaagtgtggtttgacgatcgtaacgtgacagcgctgccgatcgagaaacgcaacgtgggcatggtgttccagaactacgcgctgtttccccatctcaacgtggcgcagaacgtcgcttacggcctgaaagtgcagggcgtggcgcgcgccgaacgcgacgcgcgcgtgcaggagatgctggccctggtggatctcagcgcgctggcgcagcgcagcatcgacaagctgtcgggcggtcaaaagcagcgcgtagcgctggcgcgtgcgctggcggcgcgtccgaaggtgctgctgtttgatgagccgctggcggcgctggatgcgcgcctgcgcgaccggctgcggctggagattggcgcgctgctgaaacagctggcgatcaccgccgtgtacgtcacgcacgatcagcaggaagcgatggcgctgggcgatcgcattgcggtgatggagcagggacgtctggtgcagatcgatacgccgcaaaatatttaccagcgcccggcgtcacagtttgtggcggattttgtcggcgcgattaactgtgtcggggtcgatgcgcgtggcaatccgcagcatttttgccgccctgaggatgtgctgctggcggcggaccagcgctacgcacgccctggttttatcctcggcaccacctttctcggcgctgcgcagcggctgagtattgatatcgggctggcggcgccgatccaggtggatcgccacgcgcgcgaagcctggcacgccggccagccggtaagctggacgctggcgcaggatgccgcgctgcacttttctgcctga

SEQ ID NO: 69140 - DNA, 2658 bp, Glycine max
  Peptide Sequence Number=SeqID_185918
atgaatccactgaaagccggtgacaccgcaccgaaatttagcttgcccgatcaggatggcgaacaagtaaatttggccgacttccagggacagcgcgttctggtctatttctacccgaaagccatgacgccgggctgcaccacgcaggcctgtggtctgcgcgataacatggatgatttaaagaaggcgggcgtggaagtgctgggcatcagcaccgacaagccggaaaaactgtctcgctttgtcgagaaagaactactcaacttcaccctgctgtcggatgaagatcatcaggtttgcgagcagtttggcgtctggggtgagaaaacctttatggggaaaacctacgacggcattcaccgcatcagcttcctgattggcggcgatggcaaagtggagaaggcacccgtttttttatcctgctgtgacgctgcccggttaatagcgcgaaaccgtgctggccagcgcttcctgcccggcgatcaccacgcagttccgtccggcgtttttcgcctgatacagcgcatcatcggcctgcttcagaatctgttcctgactgccgtgcgttggctgccagctggcgataccaatcgaaatggtgatctgcccgaccggatcaatccagccgccggcaatgctggtgcgcacgcgctccgcaatcacccgcgcttcatcaggggcggtggcgggaagcaacatcagaaactcctcgccgccgttgcggcacaccacatcggtctgacgcgcgctctggcgcagcgtgcgcgccacctgtttgatcacctcgtcgccaacatcatgcccgaagttatcattcacccgtttgaagtggtcaatatccagcgccagcacggcaaacggctgctgcatggtatcgaaatagtcgagcaccgcgctcaggccgcggcgattgagcaggctggcgcggatcacgccaatttcaccggaaacgccctgggtatccatctggctggctttacgcgccagctgccacagtggcaaggcaatcagccgggccagaatcaccgccaccagcagtgtcagcagcgcaaacggcaccgaattcttcagcacctggagcagcagcccggagagcggcgccagcgtgacgtttgtcggcttgagcgccaccaccatccagccggtggtgggcaccacagcgtagcccgccagcttcgccgtgccctcttccgtcagctgaacttcgccattgctgtgctcctggcgctgacgatcgctgacgatgcccggcacgtttttgccaatcagctgattgttctggtgatacagcacgcggttttcgcgatccagcacataaacatgggtgccgtcacgatagtactgctcgccgagcagtacgttgagaatgctctttttcttcagataaatagtgccaccgacgtagccaagatagcgcccatcggtgctccataccggccaggaaacaaacaccagcaggttattggtggcagaaatggtgggccggctgaccatcggctggcgctgcgccagcgcttcgcgcgaagactggctggtgagctgcatgcctttcagcatcagcgattccggcgaaatggctttaatcacgccgttgctgtcgacaatcgccaccgagttaaagctgctggtctgttcgcgcagtcggttcacttcctgctgcagcagttcgggattatcgaaatctttacccagctgattggcgctgtagtgcagctgcgactgcgccagctggaaaaacacttcggtggtggccgccagtttggtggcgtaagcgcgattggcttcgagggtgctttcgatcagcaccatgcgctgtacgcgccaggtggcgtacagcgtattagccagtgtaatgacgatactggtgatcgccagcagcgcaatcagcgtgcgcagatcagtgtttaccctggaacgcttttttattgtgctattactggtgctaatcaattaaaccctgcgcatcgtaaaacggccacggtcctggataatcgccgattgcgcacagatgcgtactcatcccctgctgcggctgccagcgatgcagcagaaaaccgggcggttccagcacaaagttcgccggaccgtggtcacgcaaatccagtgccacctgatgcgacacaccgggcgccacgcaggccagcgtgccggcaaaacgcgcctgcaccgagcggtgcaggtggccgctcaacactcgttccacctggggatgctgaccaacgatggcagccagcgccgccggattgcgcagcggctgccgatccatatggccaatgccgctcaggaacggcggatgatgcagcagcaccagcgtcggcaaatccggctcacgctccagctgctctgccagccattgcagctgtgcgtcatcgacgtagccccacggctgatgcggtagtgatgctccggaaacgcggcgcgcagctgctggcgatcgtcgtgattgcccggcatcagcaggaacggcagctgcagatggcgcagcgcctcgcgcagcgtctggtactcttccgcagtgccaaaatccaccaggtcgccggtaatcaccaccgtatccggtcgcggcaccagctgattcagcgtgtcgatcacccgcagcagcgcagcgtgcgtatccacttttttataggagagacggccatgggccttgatgtgtaa

SEQ ID NO: 69141 - DNA, 3637 bp, Glycine max
  Peptide Sequence Number=SeqID_185919
atggcgttccagctgccggagagcagcataataaaggtgaactcgtcgcccagcatcgccaggcggctgtcttcaatattgcaaccacagctgctgacgtggcgggtaatggtattgacgatacccggacgatcaacgcccagagcggtgatcaccagatggtgcggctgtgactgcggcaaaatggcgtttcctcccatgttcaccggaagtattgttgcgctcattacgcctttgaatgaaaaaggtgatgtctgccgcgcaagtctgaaaaaactgattgattatcatgtcgccagcggtacggcggcgattgtttctgttggcaccaccggcgaatccgcgaccctcagccatgaagagcatggcgatgtggtgatgcaaaccttggagctggccgatggccgcattcccgtgattgccgggaccggcgcgaatgccaccgccgaagggatctctctgacaaaacgctttaccggcaccggcgtagtcggctgcctcaccgtgaccccgtactacaaccgtccgacgcaggaaggtctgtaccagcacttcaaagcgatcgccgaaagcaccgatctgccacagatgctgtataacgtcccgtcacgtaccggctgtgacatgctgccggaaaccgttgcccgcctggctgaaatcaaaaatattatcggaatcaaagaggccaccgggaacttatcgcgtatttcgcagatccaacagctggttggagatgagttcattattgtcagcggtgatgacgcgacagcgctggactccatgcaactgggcggcaaaggcgttatttcggtcacggctaacattgcagcacgtgaaatggttgaactctgtgcgctggcacaagagggcaaatttgccgaagcgcgtcgcctgaatcagcgtctgatgcacctgcaccagacgcttttctgtgaaccgaatcctatcccggtgaaatgggccgcgaaacagctaggattaatcgccgatgacacgctgcgcttgccgatgacgccgctgaccgaagccggtcaggcgaaaaccgcgcaggcgctgatccaggcggcttgttccagcgatcagcgttataagcgccaggtcagcggtgatgaatcttacctgcaggcgcctgaactgcatgatttaaaagccccggcgggcatgattctgccgctgcagaatggtgattacgatgtgccgcacagcgtggcgaaaggcgcgctgggtaaagagctcgacatccgtccaccggcgcagccgctggcgctgatgaacggcacccgcgcgcaattcaccggtaacaccggcgtgctggcggttgacagcagccgtggctccatctggtcgcaggtggtgaacgtggtgcagtcgtacaaattcccggttgcccagcgtgatgatgcggcgcagcagctcaccaccgactgggtgcagtggaaccgtgctgacgaagataaccagtatcgcggccgttaccagatcagcgtgcagaaccagggctatcagcaggtgctgaccgtacgtctgctggaactgcagcagcagggccagacggtcaccacgccggtccaggttcagcgctataccggtcagatgctgaatgacatcagcaccggtctggataagatcgataccgccagccaggatgcggctgccggacgtgccagcggacagattgatgtccagagcggcgcggacgacaccggtctgccactgctggtgctgcgctcaccgtttaacgtcacctggcagcgtctgccggcggctctgaagcgtatgggcatggaagtcaccgatgacaaccgctcgcagggcagtctgaaagtgacctacaagcagccgggcagcagcgcgtttgacgccatcggcgcgaaagatccggagctgccaaacggcgactacaagttgcaggtgggcgatctcgataaccgcagcagcctgcagttcatcgatccgaaaggacacgtactcacccaggcgcagaatgatgcgctggtggcggtaaacgattgcgtcaggcagtcatcgcgcggtgaaacaccgctgaacacgggttctttcatgtttggagttaacaagatgcaaaagcgagctgagttgtatcgcggtaaagcgaaaaccgtatacagcaccgacaatccggatctgctggtacttgaattccgcaacgatacgtcagcaggagacggtgcacgaatcgagcagtttgatcgtaaaggcatggtgaacaacaagttcaaccatttcatcatgaccaaactgcaggaagcgggcattccgacccagatggaagcgctgctttctgataacgaagcgctggtgaaaaagctggagatggtgccggtagagtgcgtggtgcgcaaccgggcggccggatcgctggtgaaacgtctgggcgtggaagagggcatgctgctcaatccaccgctgtttgatctcttcctgaaagatgacgccaaacacgacccgatggtcaacgaatcgtactgcgaaacctttggctgggtgagcaaggccaacctggcgcgcatgcaggagctgaccttcaaagccaacgaagtgctgagcaaactgtttgatgatgccggtctgattctggtggacttcaagctggagtttggtctgttcaaaggtgaagtgacgctgggcgacgaattctcgccagacggcgcgcgtctgtgggacaaagagaccatggacaagatggacaaagaccgtttccgtcagagcctcggcggcctgatcgaagcgtacgaagaagtggcacaccgtctgggtagttcggacgcaaacctctcagcgcatgaaggtcgccctggctggcggccttttttattgtctgtttacggccttcacgctgcgccctgcgcgcaatctcgctccgctggcatcgcattgctggagcaggccatgcgctggcaagggcgtcgtgaaagcgacaatgtggaagatcgtcgcggcgattcgccgggttttagttctggcggacgccagattcgtctgccgcgcggcaagggcggcattattctgctgattgtggtcgcggtcgctggctattacggctacgacctcaccgcgctgctggaaggcggcgcgccggtgtcgcagcagcagcagcgtcaggtcaattcggcgcaggataacgaggcggccaaattcacctcggtgatcctcgctaccaccgaagatacctggggcaaactgttccagcagatgggcaaacaatacgcgccgccaaagctggtgatgtatcgcggtgcgacgcgcactagctgcggcaccggccagtcggcaatggggccgttctactgcccggccgatcagacggtatatatcgatctctccttctatgacgacatgaaaaccaaactcggagccgggggggattttgcccagggttacgtcatcgcccacgaagtagggcatcacgtgcagaaactgctgggtatcgaaccgaaagtgcgccagatgcagcagggcgccacgcaggcgcaggtgaaccagctgtcggtgaagatggagctgcaggcggactgctttgctggcgtctggggtcactatatgcagcaggagaacattcttgaggtgggcgatttgcaggaagcgctgaacgccgccgaggcgattggcgacgatc

SEQ ID NO: 69142 - DNA, 324 bp, Glycine max
  Peptide Sequence Number=SeqID_185920
atggagcaagaaaatcaattcttctcactctcagaccctaatctcatccttcgtctctcactatcaatgggtggctccatagagaacactagatttggggcaagtgatgatgatgctactaaagtagaggatgattttgtctttgatatagatcctagcttgctagtggattcccgcaaacttttaattggcgaactgattacagaacattcacattccattgtctaccatggatggtgggtgattatgcatgaattggaaaaagatggaaaaggaagcatgcgaagaagggttggttggttggagaagatgcaatcatcatag

SEQ ID NO: 69143 - DNA, 219 bp, Glycine max
  Peptide Sequence Number=SeqID_185921
gatccagctacaggagaaccgggaacggagagcttcccccgccccccttttttttccgcccgactctttgctcttaagaatactgggttctatggtcggtccgcgacccctggatgccgaaggcgtccttggggtgatctcgtagttcctacgggggagatagtgcatcaagctgttcgcaagggccagcttgatcctcttccccaggatcccaaatga

SEQ ID NO: 69144 - DNA, 303 bp, Glycine max
  Peptide Sequence Number=SeqID_185922
atgaattacaagaagaagcttagaggaattagcaaaagtgaaaaggcccttgaaactaatttgcattgcttcaattataaagagcttcaaagagctaccaatggtttccaaaaagagctaggaagagggtcttttggtgttgtttatgaaagagtgataaacataggctcagctattccaatagcagtgaaaaaactgaacaatttgcttttccaacaggttgagaaggagttcaagaatgagttacaagtcattggtctcactcatcacaagaacttggttcggttgattggttatttgtga

SEQ ID NO: 69145 - DNA, 219 bp, Glycine max
  Peptide Sequence Number=SeqID_185923
atgggaaatctcttctttaaaacaccaaaagttcctttcaattaccttttacggagatgcatgtctaaggcgagcgaggcgagtctcacgggtgcgtcttccaagggaggaaaatgcgcggagtcgccaccaacgtttattgaaaggaaaatgttagaaaaaccaaaggaaaccggtcatgaagaatattccagattcgggagttatctttacgtttga

SEQ ID NO: 69146 - DNA, 402 bp, Glycine max
  Peptide Sequence Number=SeqID_185924
atgatggcacatcgaaaccccccatacttagcctttggcactcctgggcaaaatgaaacaaagaacaaaatccaaggatatgaaagggagacaaaccaaaacattcacatatttctcaatgaacatcaaggaatgaaaggaatggcctttgagaaacaacatttcattcagcatgtccaacatttaaccaatatacaattgagcttcaaaacaaggaaagggaaacaaggctcaaaagggctatcaaaggaattaattcaaggtaagtccatttggctagaagcttataagaacaaaattgcctcagtcatttccaaatatgcatgtgaattaggaagcatcaacaagaatcaagccaaggctattgtgcaagcaatcaatgggacaaaacacaccaaatga

SEQ ID NO: 69147 - DNA, 445 bp, Glycine max
  Peptide Sequence Number=SeqID_185925
gattggtttcgagaatcacaagaggggttcaacaaatcagacttgccaagtcaatgcacttatagatataaggtgtacattgaaggttctgcttggtcagtcagtcaaaaatacattctgtcatgtgactctaccactctacgtgtacggctacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgatcctccaactttgtatgcaacattacagagaaaggaaagctcaattcaacaagttgaatcatttgagaaaagttgttgggataatcaaaccataacatcttaa

SEQ ID NO: 69148 - DNA, 192 bp, Glycine max
  Peptide Sequence Number=SeqID_185926
atgggcaatctgataacccgtgacccagcattgaaactcatgcaaacaaccaacatcacgcattcaacaaagcaaccagagaatgcacagaaaaacatagtagactcacagctcactggccgaaaggttcgacctgctctgataccactaaatgtaacgacccgcctcgtcgctacgatatcaacactctaa

SEQ ID NO: 69149 - DNA, 348 bp, Glycine max
  Peptide Sequence Number=SeqID_185927
atggtccctggtgggagcaagatggatacagtatccatgcttgaagaagccattcagtatgtgaagttcctcaagacccagatttggctccaccaaaccatgatcaacttcatggacaatgataattacaatattaatgataataatgagtcttcttctttactgtaccctaataacgattgttgctacttcccttctgaacattttgtttcacctcagcaaaatgcaacgtttgattatagcaacatgcaggatttgcagcatctgcagccactggcagcacaatgcggcttccaaggtgaagactcgaactattttgatgcctctttgaaatattggccagcttga

SEQ ID NO: 69150 - DNA, 111 bp, Glycine max
  Peptide Sequence Number=SeqID_185928
gtgatgctgcaaaagcacaatgcagaagcacatatgattcagtatagaaatggattgcattgcactgctaggatattgaagactgaaggagtatggctaattgacctttaa

SEQ ID NO: 69151 - DNA, 105 bp, Glycine max
  Peptide Sequence Number=SeqID_185929
gtgcagggcgtgacaccacagcagcccgaggttggccggcagcgcgcaataggcgcaccgcctccacctctagagttcacctctgttcatccacaaaaaggttag

SEQ ID NO: 69152 - DNA, 204 bp, Glycine max
  Peptide Sequence Number=SeqID_185930
atggttacttccatacttcaacttgactcgatgaaccttttcgtaaaagcacgagcttggttcaaccccataacccaggaaatggcaattttgatcgccaatacttcatcaacaattcatagggatgaaagactcgggaatatgcatgcaatgtatggaaaatttgaaggggaaaacgcaagggtcacgcatgagcaaacatga

SEQ ID NO: 69153 - DNA, 366 bp, Glycine max
  Peptide Sequence Number=SeqID_185931
atggctaaaccaagcagccccgcaaacttggcatcagccatcatttgtttctttgcctcaaagaagttcccccatagactaaaagcatcaccggggaaggtttgcaaggcaaaacccttcaccacacccttccgtcatggtccatgttcatggatttttcaaagcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagggtgcatga

SEQ ID NO: 69154 - DNA, 738 bp, Glycine max
  Peptide Sequence Number=SeqID_185932
gacaatgtagaggctaacttagtttgggaaataagggtagagcaacaacttaaaaagaagtctacgtcaaaatcttatggctctcactcttatccaaagaaagaccaaggtcaaggcatcttaggggtgacaccttctaagcccaaagatgataaggggaagacaatagaaaaacaagcccctaaggctagtatgcaagagaaaactagctctataaagtgctttaaatgtcttggaagaggacacattacttctcaatgccccaccataaaaaccatgattataaggggccaagacatttatagtagccaagatgaggctactacttcaccttcctctagtgaaagtgaagaagcaaaatgggaagaatctagtgaagaaatctacccccaagaagaaggacaaccattagtggttaaagaaaagtgtaaggagacacttgctagcattgccacacctcttgggcttgagtttattcctcaagtaaaaaagttgttggatgagggtttggttcgcaagagcttaaatccttgtgctttgttggtgcccaaaatagcaccactcattgagttggtgagaaaccatgttctttcatgggaagatgcccaggaaatgggtgttgagggaaggagcccagagtatgaagaacctcgggatttgaggtcaaatcctttccaaggtggagggaatgatgtaatcctatccccgcaagggcattgggtagaagactccaagtag

SEQ ID NO: 69155 - DNA, 1066 bp, Glycine max
  Peptide Sequence Number=SeqID_185933
gatacagttcctcactttggaagggtcacacgccctcaccgttgagagggcttcacgccctcgccatcagaggattgcatgtcctcaccctcagaggactgcacgtgctcaccttcagaggactgcacgtcctcaccctcagaggactgcacgtcctcaccttcagagcactgcacgtcctcaccctcagagggctgcgcgccctcacctccagaagactacatgtcctcgccttgagagtgctacacgccctcgccttggaggactacacgtcctcaccatcagagggctgcacgccctcacctccagaggactacacgtcctcgccttgggtactagttaccctcaccttcagaggactacacgtcctcgccttgagaggactacacgtcctcaccatcagagggctgcacgccctcaccatcagaggactgcacgtcctcgccttcgactacacgccctcgccatcagaggactaaacgtcctcaccttcgtagggatacacgccctcaccgttgagagggcttcacgccctcgccatcagaggactgcatgtcctcaccctcagaggactgcacgtcctcaccctcagaggactgcacgtcctcaccttcagaggactgcacgtcctcaccctcagaggactgcacgtcctcaccttcagaggactgcacgtcctcaccctcagagggctgcgcaccctcacctccagaggactacatgtcctcgccttgagagggctacacgccctcgccttggaggactacacgtcctcgccttgagaggactacacgtcctcaccatcagagggctgcatgccctcacctccagaggactacacgtcctcgccttgggtactagttaccctcaccttcagaggactacacatcctcgccttgagaggactacacgtcctcaccatcagagggctgcacgccctcaccatcagaggactgcacgtcctcgccttcgtagggctacatgtcctcacatcagaggactacacgtcctcaccttcagacgactacgcgtcctcatcttagaggactacacgccctcgccataa

SEQ ID NO: 69156 - DNA, 589 bp, Glycine max
  Peptide Sequence Number=SeqID_185934
atgggtaaggctcatatgacggggatcaagggagccccgtatcgaagacgtttggatgccctgactgtgattgacgtgtgttggatgccctatggtgagcaccggggagtcagggcctttgacttgatatcatcgttcacccgccagctcagatggggtcagattgtggtgtacgttcgacttgagcgggttcttcgacagtttggctaccttcagacggtccctccgccgccggtttgtgattctttgatgggtgatgatatagatgaccgatggctgcatttttcagaccatttggtgccttcaggggagctttgtgtagttcctggacactacatggagtggttttttcagatatcgcacccatttgtcacgtggatcgaggagactattgcaccgagacacccatttgtttcagtcgcgaccgatctccctacgcattcagtggttcactgcgaaggatgtcaggggatggctcaggatttaggagcgattgctgaggatttggagcgggtcatcaacctcaggatggtcactgagggcactgacttacatgacatcatgactcgttgtctgaggagagctagag

SEQ ID NO: 69157 - DNA, 597 bp, Glycine max
  Peptide Sequence Number=SeqID_185935
atgaagagccctaccattttcattctctttctactttctgccttctacacctcactcctaccttcagccaccgctcaagtcgtggttgacatggaagtaatagagtcatcatatggtggaataagagtagccgcaactggaaaagaaagatgccctctcactgttgtacaatctgccgatccgtatgataaggggattgcaacaattatttcaaccccatatcgagttcctgttatccgcgaaggctttcctttgaacattacgttcggtaattttgcagttatactgccttgtgtcccccttcgttctgagtggaccgtcgttaatggccaaccagaaggacccgcagttaaaattggttcgcccccaaatgcagaaaatggttggtttgaaattgagaaattgttaacttcgggctataagcttgtgttctgtacgcggcctgagcgtagctattgtcaggatattgggattcatgtcgatgatgaaaatcacgcgcgtttggtgttgacaaatgatgatccactagtggttgagtttctgaaatatgatcccttctggccccagaataatctagtgcttcctacaagtcaatga

SEQ ID NO: 69158 - DNA, 330 bp, Glycine max
  Peptide Sequence Number=SeqID_185936
atgctcctgaacgtcaatcactacgaagcgcctgttgcggaattggtcgaaatgaaccgcaacataactgtatttttaaacccagtgagtttaacagcgagtcctccttctggctattccgccgctgtttattattatagtttacaaaacttagtatgttcctccattttcaagagggttgccattagcccatcagtgtcgaccaaatcaccagcggtggctgaagaccattattctcacctctgcaagttgagaataatgaatttagaacatataaagctgcgaattgaaggcgagatggtctgtaaaggtaaaaacattggtcgataa

SEQ ID NO: 69159 - DNA, 306 bp, Glycine max
  Peptide Sequence Number=SeqID_185937
cattggggcaaggccaactactcagtatgatcctagacggttccattcgcttgatgcttggagccgttatacagataacatttttggaagtagcattttgccagagagaaaggttgagatataccacacagagtttgatgacttcaagacagagttggagaggtgtaatcttcacaaatgcctcaccaacttggctgatgggactattttatgcattcctaacccccaagggcattggatagaagactccaagaagattgggctagagatgcaagagacgacccttaggttctcacgagacttagg

SEQ ID NO: 69160 - DNA, 216 bp, Glycine max
  Peptide Sequence Number=SeqID_185938
atgtcacgaaactttacggattacgcaaccatcctctctttgacttttggaatgctacagaactttacggattgcgcaataatgcttcctttcgactcccgaaatgtcacagaacttcacagattgcctaacaatgggtgtcaagtacctcgaagcggttcaagcgaaggttgcatcccaccaaacagatggtccccggacgaaattagggtatga

SEQ ID NO: 69161 - DNA, 174 bp, Glycine max
  Peptide Sequence Number=SeqID_185939
atggcacagcaaacaaagaacaagctcaagaggttgctcaagaggttggcattaacagatccacttaaactgttacaagaacacaataaggttaagggaaacttcactaaggagaagaagcacagagttttcacgatgctcaagttaaatatgagataccctagccatgtttag

SEQ ID NO: 69162 - DNA, 306 bp, Glycine max
  Peptide Sequence Number=SeqID_185940
atgtcggtcaggaaagatgaccgattgaggtttaaagcaccaccggatgatgccaatcgaacatttcctaatagacattatccacataatattcagggatttaatagaaagtacaatagccgacatcgggaaaagattagccatcctaggacaaaaaattatgattctccgttactaatcaaaagaaatgctagccgacgccggtccggaaagatgaccgatcgaggtttggaaaagaagcatcaccggatgacgccgatcgaacaattcccaatagacatcatccaaataatattcagggattga

SEQ ID NO: 69163 - DNA, 486 bp, Glycine max
  Peptide Sequence Number=SeqID_185941
atggaagaaagttcagggtttcctgtgttatttggtggtgaaaattcaaaccctcctgatgatggtggcaaagacaagattctggggctgcaacttagtgcaagacttcaaaacaatggtctcaaagataagatatttctagggttggaacttattgcaagacttcaacaccgcaccagaggtttaagacatttaactaggatacatggtgtggatttgacgaacgaaactcaggatacatgccccaagagatctataaagaaagaaatatatgaagaggtgctgggaatttcttattccacggtgagtcaatcagagaaggttgtggcacatgatctgaaagagccacattctggtgcaataaagaccatgtcagctagcaggaagctgaacacaggagaaaaaactgtgctttcgtggatgattgaaactggaacaatactacaacatgagaaggttcatgcgaaaatgacacaacagtattaa

SEQ ID NO: 69164 - DNA, 366 bp, Glycine max
  Peptide Sequence Number=SeqID_185942
atggatggcaaccaatccccaacttatggatctcaagcacattctcaccttgataatacattggccatcgctgcatatttttgtttgttgcattcgattataatgaagatcgaatgctgggaatgtgaaatgtcattgaaatgtcaacgtttcttgcctattgattggcaaggaggaaaagattgtagaagagaaggagtcctagatgatcttgttgatatgtgtcgcaacgtacccttcggcaggagggcgacgcgagggctcacgggtgcgtcttccaagaaaggaaaatgcacggagtcgccaccaacatttattcgaggaaaacgtcggaaaaactggaaagacgtggtctacaaactttaa

SEQ ID NO: 69165 - DNA, 357 bp, Glycine max
  Peptide Sequence Number=SeqID_185943
atgtgctttgattttcttagaatccaatccttcacattagttttcaaatataattcaaaagatctggtgcagtggtggtttgggcgagcgtatctgatgaaagtggtggtttggacaaacaaatatggcgaatgggatgttggtggtggcccgggggtggttttggagagtcgatctggtgaagaggaggctagtggtgctgcggtggtggtttgggcgagcaaatctgatgaacaggaggctggtggtggtgtagtggtagtttacatgaacatatctgctaaatgggaggttggtggtggcacaatggtggttttggtgagtggatctaatgaagggagaagtgtcagagtgtaa

SEQ ID NO: 69166 - DNA, 471 bp, Glycine max
  Peptide Sequence Number=SeqID_185944
tacatatatgtatgggatagagggtgtcacaggttacgcttggggcgttgctgcacttgtgcacattgttggatctatgaacattttccatttgttggttccgctattcctgccgagaattttgatgatgggagaccgtgtgcatgtcgatggacctatgggaaggcactgcccatttccacatatcgcaggcgtctggatagactgacccttgacgtgactattttgccacatcctgctgtgtcttcgctctctgctgaagaaattgatgatagttggatgcagttcagtgagtacattgcacctgtagggaaattatgtgtagtgcttggccactgttcaccaaattacatggattggttttacatgatctcacacccattcatgagtccagcacagctaggggatcctcatagtgttccaccgattcggcaatatgaggactttgttgaagcaaatgtgtatcagtaa

SEQ ID NO: 69167 - DNA, 543 bp, Glycine max
  Peptide Sequence Number=SeqID_185945
atggaggcccacttggggcttcctgagggttctaaaagaaggcggtgccttctggttgaagcaaccctgctcgcttgggcgagctgggcagcaaccagctccctctttcttcctataaataggggaaaaagggcagagctaaaaggtttagcccatctgaccacacctttctggttttttcgacgttttcctcaaataaacgttggtggcgactccgcgcgccttcctcccttggaagatgcacccgtgagcctcacgtcgccctcccgccgaatgggtcccattgcatttaatcatgaggaatataatgggagccttcccactttgatcttgaggccacaatcatggacaaaggagaaaaaaacaagaagggtaaatagttcaacgacggtcaataacacacccgtcgttattgacctaacatttctacgacgtgcctttcaaccaccgacgttaacgtttcccaaaacaacgacgggtgtcatatacaccgacgttgaaatgcttaacaacaacaacaggtgtcatagacaccgacgttga

SEQ ID NO: 69168 - DNA, 570 bp, Glycine max
  Peptide Sequence Number=SeqID_185946
atgccatatcttgagggtgcaaatcctgcatcgtgtctagagaatagcttgatattgtctgaacttaattacaacaatgatgaggctagatcagaatttgaaaatctttttctatccatgacaggtacaggaaaaacatacatatggagaacattagcaagttcactgagggcaaaaaatcaaattgtgattatggttgcttctagcggcatagcttctttgttattgccaggaggcaagactgctcattccaaatttaagatacctgtgtcaattttcaaagactcaacatgcaatatacttcaaggaagtcagctagcagaattgttaaatcagacaaatctgataatttgggatgaagcacccatggcacacaaatttttctttgatgcacttgatcaaactttaagagacattattaaagaaaaaaaatcccaatcaaatttttggaggcaaagttattgtatttggtggagatttctgacaaattttgctagtcattccaagaggaagtcgttcagacattataaatgcaacaatcaattcatcatatctgcggccttgctgtga

SEQ ID NO: 69169 - DNA, 999 bp, Glycine max
  Peptide Sequence Number=SeqID_185947
atgtcgttggttgttgttgtgtcatttttgtttgtttcccagtttggtttagctctgttgttcggttggtttttgtttttgaagtttagttttgctgaggttgattgggagaagctaagtttttctttggttgacaattttgttttgcagtttagttttgctaagcttgatccggagaagctaagggtttgcgattataaagttatggcacgtgttgctgataaaattaaattgatagatggatcaagggaaactcttaagctttctgtaaggatcactgatctttggttcattgggattctcggaaagactgaacaagccgaaatggtggttgttgattctgatggagatgaaatccatgttgtttgcaaacaggatcaactgaagtctcgcaaggctgatttgaaagaaaatttgacttatgtgatgcataattttaaagttatcaagaatgatgggaaattcagagtttgtgatcatgaatataaattatattttattggagttactgttgttagcttatgtgatatggaacagttaccttttaggaaatttagatttgttgatttttctagtgtcattgctggtcattttaaaattggactcttggttgatgttattggcgtgattgatgaagtggtattccgatatgtgtcatccaaaaatacgagggttgttttgaatttaaaggatttgagtggacaggtgctatcctatacactctgggaaaattactgcttacagtttttgtcttatttgaatgatattgaagatgaaaggccaatcgttattctcttgactcatgctaggattaaggaagcgcagggatcatatctggcatcggtcagtaattctttcaaggcgtctaaactcatgatcaatgacctcgtgctggaaattcaagaatttagagagagccttttagatttagggatcgaggttagatcaattttggcgcctattggacaaaggagttcacaggtttcagggtcatcttaa

SEQ ID NO: 69170 - DNA, 276 bp, Glycine max
  Peptide Sequence Number=SeqID_185948
atggattgttatcctactgacaggataatacttcagaataatgatgacagtcaaattcgcacagagttttatgttccaaatcctgcgttccaaaaggaggaagatctagtggaggacaatctcgctttagaacaagacttggaggactacaatgctcaattgatggaagagttgttacacaaaaagcgatatccttattatcatccaatgtatggaagtcttacccgatcagaagtccaacaatacaacttgtcattatccactagatcagactaa

SEQ ID NO: 69171 - DNA, 375 bp, Glycine max
  Peptide Sequence Number=SeqID_185949
atgaagcgaaactgctacttggatcttcgttttcgcccttcatctgcttcatcaccccatgattctattaaaaacaaacgaagtttatttcttgcatttgtcgttagcatgagcaaaaaagttgttgccattccgcaaagtagacgccacatgcttgatgtcacagaacttcaggcaagagtgatactatggttggcaagtcaagaaagggaaggtaacacaggaccagcttcggccacgtcgctttcattgcaatctcaagcattattaatgcatgccccgcaaggttcttcagtaaagagatccctaaggaatttccttcagaagagaaagaaaaggtttcaaaagtcacacccccattgcttctcgcaatag

SEQ ID NO: 69172 - DNA, 222 bp, Glycine max
  Peptide Sequence Number=SeqID_185950
atgaagaataagaaggttgcagcagttggtgtctcgctaagtgagacatatgcgcttagtgagcaatatccgctaagcgagacatcagctcgcttagtaagtgaggagaatctgccatgcatgcacgcactcagcacgccatcagctcgcccagcaaaattggatagagcagggctagataactgtatgtctggacacggagtgcagggatttagtttttaa

SEQ ID NO: 69173 - DNA, 267 bp, Glycine max
  Peptide Sequence Number=SeqID_185951
atggacgcaccttcgtctaaagttgcacctactcaacagcatccacttttcattctcattgctcccaaggcaacagactatggccatcaagctctccctcttactaaggacgatgtatataatgttgggatgattatgatgcaatgtgggttgacaaatcaatggccaagctatcctccaggtctccacatccggcacaccgcctccatcaatttcaggcctgatcgcatagctccaaggttgccacccttggacctaagaaagtaa

SEQ ID NO: 69174 - DNA, 375 bp, Glycine max
  Peptide Sequence Number=SeqID_185952
atggatttcaaataccttagtgagtacgacactatggtagatatccttcccaatgctcttgttcttcatcacttcggtagcaaagcagttgaagagaatctggggcaccaacattttggggtcttcaaagaagtgatggatgccatacaacaggagatgggcattgatgacatagccaatgctttccagagagttgatgttgaagaaatgctcgacatgaactcttggttccttgtctttcattgtgacttcggtagcgagaatagtcataggtgtaggcctagtaatctgaacaagggaaccttcctcagatggagggagaggttagggtgcaaagaggtttctgagagagagagtgtgaagaggttgcataag

SEQ ID NO: 69175 - DNA, 318 bp, Glycine max
  Peptide Sequence Number=SeqID_185953
atggagagtgtattcgctcttatgtattgcgacggtgatatggttccatcatatgaagggataatgtttgaatgccctagtgatcctaaagtcataacaataaataaggtcatgtcgcttgttgccttaagaaaaataatttttgatgccaacaaaggttgtgctgaatacaattgtatggagctcaaacgtgacgatgatgtgggaaaaatgtttttcatctattcagaatttagtaccgaaggtccgattgagttgaatgcaatttttggccattctccagatgaaacaattgctctgatgagacaattgctctga

SEQ ID NO: 69176 - DNA, 813 bp, Glycine max
  Peptide Sequence Number=SeqID_185954
atgggagacaaatggtgcatagttggggactttaatccagtgaggactatggaggaaatgagagatcaagaacacacttcaagagtagacttgatagattcattgcgtcaagtgagtggattcaagggacataaaccattcaaggtcttgaattattgtatcttggagcaaggcttaagaagaaagcggaagacatgtggaactcatgatgtacaagggagagcaacctatgttctaaaagagaaattgaagctcttaaagaaggacttgaagaagtggaacttggaaaactttggaaatcttgagaaacaaagcaagggtattgggaacacaaattttttccataatatcataaattggagaagaaggaagaatgacattaaaggtcttcatattgaaggacattggatagaagatcctattaaggtcaagagaggtattttggaatttttcgataagaaatttcaacaaccctactttgaaataccaacacttgatggggttccattcaatcaaattggaaaggaagataatgttactctttgttggagatttagtgaaatagaagtcaaagaaatagtgcgggaatgtggtggagatattagtttgagacttgatggtataaattttaatttcatgaaaaagtgttggaacacattgaaaggggatgtgatgggaagaaacatgctagatagtgttctagtagcaagtgaggtgatggatgatgtgaagaggaggaaacaatcatatcctgttttcaaagttgattttgaaaaagcatatgattgtgtccgttggaatttcttattataa

SEQ ID NO: 69177 - DNA, 300 bp, Glycine max
  Peptide Sequence Number=SeqID_185955
atgggagaaaggtccaatgtctctgaatgttgggaggaagatgggttttgcaaagacgggagtttggtgacagtgaagctggaaattaaagggataagtgtgaacaattcggcgagtccagaggtgtggcaggaaacaaagctacacgaaaatggcaatgatgaagagataaaaggtgtggaaggtgagaaaaaggtggaatttgacatggaaaaaagggagagatggctaatgatgaccaagaagatgcatatcaacagagttagaatggggacaaagccttggttagcggaaatgtaa

SEQ ID NO: 69178 - DNA, 1530 bp, Glycine max
  Peptide Sequence Number=SeqID_185956
atggtgagatctacgcacttaaagtctaacctcgatcgacgggaagatgccattgccaaactcaccaccactcagttattgatgtccaccaaattggacgacctcttccagaagttggcggttatggagtccacccagcattccctggtctcttttgcggtgcatcccgcatctccttctctgcctattccaccatactggatgaaactcgaagttctacgattcgatgggtttgatcctattggctggctcttaaaaataaaccagttcttcgactatcatgccacaccgaaaaacgaatggttgatgattgcttcattttacatggatggctcgacgcttgcttgtcaaacccaagtagatgtaccctccacttgtaccacaaaggatgtaccctccaatgtgttaagacaaagttctcaggcggttaaacctttgaaactttgtgaatggggatacaaaagaattctcaggcgggagaagggagacacaaaagaattcaggcggttagtccttcgttcttttggaaaagggagaagagagacacaaaaagaattcaggcggttagtccttggtgaattctttttggcaaagggagaagagaatgaaaagatgaatagcacaagttttcaaggtttagaaaaccagaaaactttggaaagcttttggcacaaagaagaagaagaagttcaaagagattcaaggcttgaactagccatgtacagagagaaaaggctttgctttagctgcgatgacaagtttagtcgtggacaccgctgctctgccaagatattcctattaatagcttatgacgacaacatatcgtgggaggagattccgcctgatgacgcatttttggtagcgaaagagcatgatgaccagtctctagctcaaattagctttcatgccatatatggacacttggctccggagacactacgacttgtgagttctgtctctgataagaaggtactcatcctggttgatgggggtagtacacataacttcatccaggaacacttggtaaccactttggacctatacgtgcaatctactcagcccttgcacgtaatggttggaaacggtaatgagattgcttgcaaacttggtccttggtgttcaatggctcaagtccttgggtccagttttaacgaattatacagacttgactatgaagttcatgcaccaagggcgagtcatcaaactcaggggcaaacaccatatcgatatccacattttgaaaagcaagagatcgaggttcaggtcgaagcaatgttgcgcagtcagagtcccttttcatcactagctcttctggtcaagaagcgcgacaaatcatggtgtttctgcgtggattacagggcattgaacgccattacaattaaatattgctttcctatacccattattgatgagtttttggatgaactaggtggtgctcgttggtttaccaagcttgacttgctgcaggggtatcatgagatcctaatgcgtgaagaggatatgcacaagatagcattctgcacccattag

SEQ ID NO: 69179 - DNA, 1044 bp, Glycine max
  Peptide Sequence Number=SeqID_185957
atggagatagtacttgccgggaggttccttctctatactcactgttctattcgaaatgatgttcatcggtttgttggtcagtgccttgattgtcaacacaccaagtatgtcaccaagaaaccagctggcttattggaaccactgccccttcctactaggctgtgggaagatttatctctcgacttcattgtcagattgtcgttgtaccaaggaaacacgaccatcttggtggtcgttgacaagttctcgaaagtgattcatttgggacttcttccaactcaatactctatataccaagttgccaatcttttcctggatattgttgccaaacatcatgatacacctaagagcttgacttatcatcctcaatccgatggtcaaaccaaagttatgaatgatataattgagcagtacttgcgtgccttcgttcatcacaagccgtcaacatgggaaaccaccaatgatccttcagtatatcatggtctcttctgcagtggaagcagtcgatactttgctgtcatcatgggggcagtctttgatagcttgcacaggaaaatattaaaagctcaagctaagatgaaacactttgtggataacaatcgtagagaagtaagctttcaagaaggcgattgggttttggtcaaactccgcccttactatcaatcttcagtcactagaccaaaccccaccaagctcacaaaatgctactatggtcctttcaaggttctggaccgtatcggaacagtggctacaagctcctttttctcgaaggatctcatattcatcatgtcttccattggccccaaggatgcactttgcttacaagtgcttgttcaatgggcaggtctccatgttgactacacatcatgggaggattgggtctttttgaaggaagattatcaccttaaggacaaagtggttttcgatgggtctgggagtgatagaccaagcaagatgcaagaagcccagaatgagaggtccaagaggaagtcctcctcaatgtttccacgattacgcctagttattggtgttgctggcacttag

SEQ ID NO: 69180 - DNA, 177 bp, Glycine max
  Peptide Sequence Number=SeqID_185958
atggatgccatgaagaatgagatgaagtttatgcaagacaatgacgctttggatctcatcgaattgctagaaggtgtgaaaaatattggttgtaaatggatattgaaaaccaagaaggattcaaagggtatcaagatactaagagatcgctctcaaggtatcctaaggttgtcataa

SEQ ID NO: 69181 - DNA, 378 bp, Glycine max
  Peptide Sequence Number=SeqID_185959
atgacaagacaaaccacacactggcaagttaggtcactctcactaggtaaaatcatagggagaccagtcagggtcacgttgttttgtgagaatgctccaaccatgtgggatcgacataagcttaaagaagcactcaaactgggtgacccccaaggcctacactctgaagagtccatcagggatcttagctttaactcgtcgcccttaaagggtcttagcattaactcgtcacctttaaagggacttagcattaactcgttgcccttaaagggacttagcattaactcgtcgcccttaaagggtcttagcattaactcactgcccttaaagggacttggcattaactcgtctcccttaaagggtcttatagtcgtgtga

SEQ ID NO: 69182 - DNA, 213 bp, Glycine max
  Peptide Sequence Number=SeqID_185960
atgccaacgtcatcacgtcggctcgacggctcctcaccagaatcttacactctgtaccctgctgctgtcattctgctcccatggacaatgttcgcgatcatcacaggtgatcaacctagggcccaaaggagttccctaccaggtgacaagccccctcagtacaaagtacactctgccacagttattctatttcctgtgtcgtatgagctatga

SEQ ID NO: 69183 - DNA, 381 bp, Glycine max
  Peptide Sequence Number=SeqID_185961
atggcggtttccaaactcagaatgatgcaaagggttcctctcagtgtagggtttcaacggagaacaatggaggtttgtggtggctactggtggttgtgggtgatggagaaagagcttggaatgaagcgttactcacacgccagacgtcgtatcgaagatcgcaacggtcagatcgtggacaagtgtcctgtgaagcgacagaccaaatttcaagaagatccaatggttaatgaaggttgggcattgtttttaccgagacagcttcatgtagattccttgagaaacttcattaagaggcttcctcgtggcttctttgagaagcttttctcgagaggcttctttgagaagctagatccttatctacccatacctctctattaa

SEQ ID NO: 69184 - DNA, 357 bp, Glycine max
  Peptide Sequence Number=SeqID_185962
atggcttcaattggaagagcacctacagagaaagatcagaagcttaaggaggactttgggagtggtgtgcaagagcccgagagaaacaagcttgtattctttgaaggttgttcttataattttgatctggaggacttgttaagagcttcagctgaagtacttgggaagggaaattatggaacaacatacaaagccatcttggaggatggaacagcaatggttgtgaagaggaaaattgaaggtgaaaatgagggtatgtctacccctggaagtagaacagtaagacaacctagagttgtagttcagacaaccagtgacattgatatcctagatgatgggtatagatggagaagctag

SEQ ID NO: 69185 - DNA, 243 bp, Glycine max
  Peptide Sequence Number=SeqID_185963
atgatgaaaagtgagaaaatgggacttacagagaaaaaggaggaagacatggggcatggtgcagaaaagggaaagcaacattcaagaagagaacaaaaaggacacgggggtgagcgtgacgacggacacaaccagagtgtgacggcggagacggggtcagggatgatggcaatgatggcacttgtggtggacacggggtcaaggatgatggcagtgacggcacttgcggcgaacatggggtga

SEQ ID NO: 69186 - DNA, 279 bp, Glycine max
  Peptide Sequence Number=SeqID_185964
atgttgaagaacggtcgagaatcttcgcataattactcacggaaacgttacggaagcgcctcggcgttggattttcttcacggaaataattttactcagcaatttcgagagaataagaagtgctacgaaggccgaacccctttcttcttcactcctcctcctatttatagcaaaataggggaggagcttgccacccagctcgcccaggcgaacaaggttgcttcctccaaaagcaacagccttctggaggaagaatctggaaggcccaagtggacctga

SEQ ID NO: 69187 - DNA, 318 bp, Glycine max
  Peptide Sequence Number=SeqID_185965
atggagaaagatgcatcgcacgaagacagtaccactatcactttcagaagacatgtgagtccgcttagagatacgtgtagacatgtgatggtggattgtgacactatgatgtggaagcaaagctaccatgatgattcaccaagatgttttgatgatgccaaagttcaaagagttgtttcaagattagagaatcaagcattcaagattccactcaaagattcaagaatcaaaagaagaaatcaagaagcatcaagccatgtcaaagtaggtagtaaaaattatttttcaaaaacatcaaatagcacactttttgtttga

SEQ ID NO: 69188 - DNA, 1066 bp, Glycine max
  Peptide Sequence Number=SeqID_185966
atgctccaaccatatgggatcagcataggcttaaaggagcactcaaacccgatgacccccaaggcctacactccgaagagtccgtcagggcctctccctcctgattcaggctcgcgtgtcttccaacaacaacagcggcatctctaccggtcccctgagattcctccagtttttcctccgactgctctgatagagttcccaaacgtcagagagacggagaagggattgaaacctccacttaattctcggaattgggctgcaaacgtagtgctcaaatttcacgatgatccaacggtgaacgagtccgagatcgtcgttttactgagacagctgttgccaccgtcaccgtcgtcatctgttcattgtgtgcatggtgaaggtgcttgctcgcgtgcgtggtacgcgggtgctggtgcagggtgccgcgtcgcattcgcgtggtgccactgtagttcgcgtgttgttgttcctacttgcgctgctcaccccttttgcatgcgaaaatcgggttacttagacaaatcaggcatgttatttgttgtgagagagatcatcttgccatctgtgagagaattgaggcctttgggcattgtgaggtgcaaaccctcaaagttttgcaagttaggcactgtatcaaggggagaaatcccttatatttctgataagataccaagattcaatcatagtgctcaagcaagaaacggaaaggatattcagggaattccatgggagatgttgaacatatcaagggagaggtacaaattgacaaggttagagcaatataggaattttgaggacattcttacatcaggggatgttgtgggcaagcaaatggagaagggtggcaattactatgaattcttctatcatagaagaatggttaagcctactgtcgcaacctacccttcgacgggagggcgacgcgagactcaagggtccgtcttccaacaaaagaaacgcgcaggagtcgccaccaacgtttattcgaggaaaatgttagaaaaaccaaaagggggtctacgaattttaagaataaaggttcgggagttgtttacatgcggggaag

SEQ ID NO: 69189 - DNA, 558 bp, Glycine max
  Peptide Sequence Number=SeqID_185967
atgccccaccacaatctagcggactttgagccttgcctcggatatgccactgaatggcaagcagttggtggtatacccatgccaaacactttggaggaccctcagtttcgcccacaaccacacccctcacattccacagctattaaaagccctcatgctatggcggaaatgggaaagttagatcatctagaggaaaggctcagggccattgaaggaggtaaagattatgcctttgctaacctagaagagttgtttcgagtacctaatatcatcacccctcccaagttcaaggtgctggactttgacaagtacaaggggactacttgccccaagaaccatctaaagatgtattgtcggaagatgggggcatacacaaaagatgaggaattgctgatacattccttccaagaaagtcttactggggtagctgttacctggtacactaacttggaaccttcccgagttcattcttggaaggacctaatggttgccttcgttaggcagtgtcagtacaattctgatatggctccggataggatgcaactacagaacatgtga

SEQ ID NO: 69190 - DNA, 1041 bp, Glycine max
  Peptide Sequence Number=SeqID_185968
atggcctgtagaggagaatcgaactttgttaataaaatgcttatagaaaaacaaatcgaagatgatagaaaattggagaaggttgaagcaagtcttgcaaaagcaagagctttgataaaagaagccttgttattgagaaccaatgccaccgtgcttcaagatgacacaagtgattatattccagaaggagacatatacagaaatgcagttgctttccataggagttaccaattaatggagaaggtgtttaagatcttcgtatatgaagagggagagccccctctatttcattatggtccatgcaagaacatatattctatggaaggaatctttatcaactcattggaaatcaattctcaatttcggactcagaatccagatgaagcccatgtctattttctgccctttagtgttgtgatgatccttgagcacctcttccacccagttattcgtgacaaggccgtattggagagaactatcggtgattatgtgcacatcatatcccacaaatataaatattggaatagaagttatggagctgaccatttcatgctttcttgtcatgattggggaccaagagctacatggtatgttaaagaattgtattttatagcaatccgggtactatgcaatgcaaacatctctgagcatttcaatcccaagaaggatgcatcatttcctgaaatcaacttggtaaatggggagacaagaggtcttatcggtgggtaccctccatgtaaccgaacaattttggccttctttgcagggcaaatgcatggtagaattaggccagtgcttttccagcattgggagggcaaagacaaggatgtgctagtttatgagaaactcccagacggagttccataccatgagacaatgaagaagagcaagtattgcatttgtccaagtgggtttgaagtggcaagtccaagaattgttgaggcaatctatgcacaatgtgtgcctgtgataatatcacaacaatatgtgcttccttttagtgatgttctgaattgggactctttctcggttcagatttta

SEQ ID NO: 69191 - DNA, 366 bp, Glycine max
  Peptide Sequence Number=SeqID_185969
atgacttttacaaaatgtactcacacgctattaaagcaccaccaagcaagtcagagacccatcatggagtgtacgaaacgtgagcgtgtactaaagaatactaatgcggatttgcaaaaagtcaaaagggttgacttggacttagtcaacactgacaaagtgttgacatggcagtctaatcaccatcctaagtggcaggggtcagagcgaccagacccaacccacaattatgcaacaggattggaaaaccctgcttgcctcacgcaaaaaacggcacagccaaaggggaatcaccacggagggtggtgccccgcccctggcaccattagtgcaaggttcagcgacgcaaggccgccacagggatga

SEQ ID NO: 69192 - DNA, 318 bp, Glycine max
  misc_feature (28)..(28): n is a, c, g, or t
  Peptide Sequence Number=SeqID_185970
agatctttcttgatcagtgctgttgtgnttgtgtcctttggttaccgcaaagagcgtgatggctcttgggtaaaaaagggtgctcaaccaaatgatgatgaaggacaattaccggttgaaggggactcttctctccttcagagtattttggaaagatttgatggacttcaaacctatgttggtgaaaggtttgatgctttggaacaacaagtggacacgcgattcgacgaaatggactcaaggatcacaaaggttgaagaagatttcaccatcattcgtgactaccttaatttacctccaccaccactatcagtttag

SEQ ID NO: 69193 - DNA, 393 bp, Glycine max
  Peptide Sequence Number=SeqID_185971
atgtatcaacttcttgattctggatttattgggttgattttttcctgttacagtgaagatgtaaacaaggtaggaagaattcaagtaattgctttccagtcatctgatgggaagcataatcacatgtcaagacctgtacctctatctcctgtaaatagaagccctgttattgatattgattcatcaccaagttcctcagagaatgtatcaacaagacctggttacttcaaagcagagaatgctgagcaggacactggcgattcaagaagtgttgttgtcagtaagtttgtgagcagagaattctgtaggagactttgtgtctttgggaaactgcatgatggctgctattcaatattgtatttgactagtttaacaattggtgttttatcatag

SEQ ID NO: 69194 - DNA, 342 bp, Glycine max
  Peptide Sequence Number=SeqID_185972
atgtatactggttcggtcacttcccgtacctacgtccagtcctcaacttctgaacactcgagggatcccttttccatgtgttcaggaaactcacaattcaagagacaacagtctcttgatctcaataagtctttaaagaaaacacggcctctgtccccctccccctcactctccctctcgcacgaccttccccatccccaacgtctaatcaacaaagagatcttcagggttcttctacaaaaactcattctccaccctaaagatctcagcaccatctttattgcaagatctgtgcaagaccagatcttgagtacaagatccttgttcaagatcttgcattaa

SEQ ID NO: 69195 - DNA, 153 bp, Glycine max
  Peptide Sequence Number=SeqID_185973
atggctatttatagaaaaatccatctagggcagggaaaactcacccaggcgagctacttgcttagggctgaagctgaagaatacatgccaaggggattccagattggtggtgcaaagaggaaaagtgatagggcattggtcacccttaattag

SEQ ID NO: 69196 - DNA, 237 bp, Glycine max
  Peptide Sequence Number=SeqID_185974
atggtgatagtagtacggtggaatagtgatgatagtgttttaaaatccaaaccgaccaattcgaccacgacccgcaagtctggtcggtggcaacgacgacgacaacgacgatggaggcggcaaaatgatggcgatgatggtcatagtagcggtggaacgatggtggtggaggtgacgctagtgatggtagttgcaactggtggtggtggcaacgacaacaatgttgggttagaataa

SEQ ID NO: 69197 - DNA, 234 bp, Glycine max
  Peptide Sequence Number=SeqID_185975
atgaactcgctaagcgagcatgttatgctaaacgagttcatcaatactcattgtatgctagcattatctgaagaacttgctaagcgcacttaccgcgctaagcgagttcatcttttgaggatgaacacttatcctcttcctgaactacctatggaatcaagaaaaagagctagaatggaggacatcccttcgtcatccactcctgctccttcatcaataactggaggacaggac

SEQ ID NO: 69198 - DNA, 1551 bp, Glycine max
  Peptide Sequence Number=SeqID_185976
atgacctcggtggcgatgacggtggcgtcaatgttgttctctggtagctgccggagcctcgccatgcccgcggcggcgcgcgcagttcgcatctcgcgagcagcgctcgtcaataaccgtaacaagcaccctccaagttggtgctgtcggagttcacacaacagtaacactgcactcgccggtgaagctgaattcttaacaaccgacgccggtatcttaaacgccacctcttcttccgatagtttccggaagtatgaccggttgcttccatgtccatcgcacaaaactccaccgagaattgaacacttagttgtatcagaaggaggacctgtgttggaacatatttgcaaggctctggatcttcctcctttgtacgtttcagatctgattcaatttggagctgtgtactacgctcttgtttgtccccagcctcctccgaatgccaccgaagagcaaattagggtattcaaagaagtaacggaaccttcggtgttgcgtaaaagagcttccatcaaaggcaaaactgtgcgagaggcacagaaaactttccgcgtaactcacgtggatcaatttgttgagccagggacttatttgcgagtgcatgtgcacccgaaacgctctcctaggtgctatgagattgattggagatcaaggatcataactgtggcggaatcctacgtagttttggataaacctgctggtacatcagtaggtgggactactgacaacattgaagaaagttgtgcaacctttgcaactcgtgccttgggaatgacaacccctttgatgactacccatcaaattgataattgcactgaaggctgtgtggtattggctaggactaaagagtattgctccgtctttcatggcaaaatcagggagaaaaaggtgaagaagttctatcttgctcttgcagcttttcctttgccaactggaatcattacccactatatgcgtcctattgacatggctcctagacttatttctgaagattttatcaagggatggcatctgtgtcaacttgaggtcctggaatgcagaaaggttccctggccagctactgctatacaagacaagtattgtattgaagactgtgggtggccttctcaagattatgcatatgagtgcaaaatcaaccttcttactggtaaaacacatcagattcgagctcaatttgctgcctataaggcaccattaattggtgattctatgtatatgccagctgcaattgcgaatatgagtaatcctggacttaatccgtttggaaaatacaagaaagatttcagtagtgagagtgaaaaagaaacagcggttgtaaattggattgcacaacatggaaaagagccgagtgttgcaattggccttcaagcatatgcagatattcagaaggtggaagagtggtcacggatcactgtatgctggtttctccttctgtggcataggaatgcaatattttcttgctgtagaggggagggcaatgaaaatattgctggtttgaaaagagaaacccaaataaatggaaaagaagaggagcttcatatagggatttaa

SEQ ID NO: 69199 - DNA, 523 bp, Glycine max
  Peptide Sequence Number=SeqID_185977
tggagttagtcttaaggctgaatcccaatactttgctactgtaaatgatgacaatcctcgtttgtgtaaatggattgatagcaatctcgatgtgcaaactgatgatttcatatttactttggtaggtctgaagaagctagcttaccagaatgagcctttcatcatggcagagcaagctaatcgggtgttttatgttcaagatccttgtgatgaaaggcacatggttacaccaccaagctcccttcctcttgagtcaacatattcaccgtctatgtcaaagaggactacaaaagccacacaactcagatcattgtctgccaaactcgtggaggtggagagaccactagttcatgtggatcctaccactaggaaagctgatggttcctgcaacttagaaggatttgatttgggaggacattcagaacgcaaggaggacaacgatgacaaagtctatgagaagtacaaaattggcaaagagaagtggaaccaattttgtcaaagtcataaagacccttcatgggag

SEQ ID NO: 69200 - DNA, 520 bp, Glycine max
  Peptide Sequence Number=SeqID_185978
gccaagacaaccaggaaatgacatcgatgtttatctaagtcccttgattgaagacttgagaaagttatgggacaagggagttgatgtgtttgatgggaatagatatgagacattcaagttgcgtgcgatgatattttgtaccattaatgactttccagcatatgggaatttgaatggatacaacattaagggccatcatgcatgccctatctatgaagaagacataagctacgtacaagttcttgagcatgttgagaacatcaattctatatttggaaacacccaaaagaagctgacaagcaaaacttacatatggaagaagagattgatattctttgatcttgcatattggtccgatctagatgttagacattgtattgatgttatgcatgtggagaaatatatgtgtgatagttccattagcacacttcttaacattctaggcaagacaaaggatggtttgaatactcatcaagatctagctgagatggatatacatgaccagttacatccaaggtaa

SEQ ID NO: 69201 - DNA, 301 bp, Glycine max
  Peptide Sequence Number=SeqID_185979
gaatttgggttatgaagggtataaatatacttggtctaataaaagtaaatatcctgagacagtggaacaaagattagatagatatatggcaactgatattctgaaaaggaagaaaacaaagaggtacaagtttgagaaggtatggctaaatgatgtggaagcgtgtcaagcagacactaaaggatcttggtgcaaagacgaggagctggataagttgcttaaattggaagaggaagtgtggctgcaaagatcaagagacatttggttagaaggggagatagaaacacaaattcttccatag

SEQ ID NO: 69202 - DNA, 156 bp, Glycine max
  Peptide Sequence Number=SeqID_185980
atgaaccctaggctccttgctgttgcttcctcctctaagtgctctaaaatcatgtcgttgcgcttagcgccactgtcgtgcttagcacgagtatgtggatttgggcttggtgccaatgttgcgctgagcttggcaagaggcagacgactcgcttag

SEQ ID NO: 69203 - DNA, 888 bp, Glycine max
  Peptide Sequence Number=SeqID_185981
atgtcctccccttcagaggagtacatttcctcacctccagaggactacacgtcctcacctcaagaggactacacgtcctcacctccagaggactacacgtcctcaccttcaaaggactacacgtcctcaccttcagaggactacacgccctcgccttcagaggactacatgtcctcccctttagaggagtacatgtcctcaccttccaaggactacacgtcctcccctttagaggacttcacgttctcaccttcagaggagtacacgtcctcacctttagagctatacgccctcaccttcagagggctgcacgccctcgcctttagaggactacatgtcctccccttcagaggagtacatttcctcacctttcgaggaatacatgtccacgccttcagaggactacacgtgctcaccttcagaggactacacatcctcaccttcagagggctacacaccgtcacctttagaggactacacgtcctaaccttcagagggctacacgccctcaccttcagagaactacacgtccttgccttcagagggctacacgtccttgcctttagagagctacacgccctcaccttcagtggactacacgtgctcgccatcagaggactacacggcctcaccttcagagggctacacgccctcaccataaaaggactacacacccacccctttagagggctacacaccctcgcctttagaggtgtacacaccctcgccttcagagggctacacgtccttgccttcagagcgctagacgccctcaccttcagaggactacacgtcctccccttcagagggctacacgtccttgccttcagagggctacacgccctcgccttcagaggactacacgtccttcccttcagaggactacaa

SEQ ID NO: 69204 - DNA, 237 bp, Glycine max
  Peptide Sequence Number=SeqID_185982
atgtttatacggataaccacttgggtatttccgcccgtcaacgtgactcaaatgcttttcgtcttacagacagcaaaaaagaatgtttatacggataaccactcgggtatttccgcccgtcagcgtgactcaaatgtgagtatgacagatcttgtgagcgcggaagatgacgtaaatctccgcgtgtcaacgggcttgtcggccgcgattgacgaaggatgcagaagacgacattag

SEQ ID NO: 69205 - DNA, 297 bp, Glycine max
  Peptide Sequence Number=SeqID_185983
atggatgtctggtcatttgctgatgataaattcatgataagagttccatatccatttcaatggggacccctttctttcagtgctgatgttatttttgctattgttgctgcttctcttgttgcaattgtagagtcaacaggaacattcattgcagcatggagattaagcaaagcaacccctattccaccatctgtgcttggtcgtggtgttggctggctggtgatgacaaaaagctcaaagatcaagaatgagttcaagattgaatcaagtttcaagattcaagcttccaagaattaa

SEQ ID NO: 69206 - DNA, 249 bp, Glycine max
  Peptide Sequence Number=SeqID_185984
atggggaaggcaaaagaagcagcggtggtggcgggagccctagcattcacgtggctccttatagagctcgctttcaaacccttccttaccaaggcacgtgcttcgattgacaactctgacccgtcacgtgaccccgacgatgatgctcttcctaaaaccaccattaatgacgttcccaatgtcgctgattctaaacccgccggcgacgtacctaccgctgttgatactataaccaccgacccagtctga

SEQ ID NO: 69207 - DNA, 240 bp, Glycine max
  Peptide Sequence Number=SeqID_185985
atgatgatgagtgcacttggtcttctcacctttcttggagttttcaagaagggggcacgagaagcggaatcgacggagattggaagaaataagggcatgagaagcaaaatgtttctcaaccaatgtctagaggctagtgggaaagaaggattcaaacagatattcacatggccaaaaaaccacttagtgaagcactctcaccaaacaaggcatcatcataatcatcatcaaccttgttag

SEQ ID NO: 69208 - DNA, 338 bp, Glycine max
  Peptide Sequence Number=SeqID_185986
aattcgctatgcacaagcttcagtggctaagcgcgaggaagaatccagaagaagatgagctgtcaagtttgctaagcgcaccgcttcaggacatcaagtgcacgacttcagctcatccgctaagcgaaacaagcgcgctaagccaaaatccacttatgcgcgctaagcgatccagatctgcgctaagcacaaaagcacgaacaaggccacatcctagaggcaaaggagacatcctcaccacttgtgtttttgcagtctttcattttgttcttctctttgttggaaaggaggttttcagactatggaaagctaaatcctctgttggatcttccctggag

SEQ ID NO: 69209 - DNA, 366 bp, Glycine max
  Peptide Sequence Number=SeqID_185987
atgaaagcaaaaggcaaccaaaagtggcttgagggagcaagaaccgcaagccttcgggttgctcgcccagtaaaagaaactgcgaacacaaaggatactgggctgccttgcagcgacgttctctgcttgtttagcgccgggaaggggcaacgatcggtcggtcgtaaccctatccccacttgcatccgtccctatgtacctgtaagtaggaaacaaaaaatccaatggctaatcgtgtccggtcatcgtcttgcctcggttgatttccgcagtcggcttgtctcgacttctaaccgtgacctaagaaggccctgcccctgttaccacaaaatatgcatgtgtatgtgcatgtatgaatgttcctaa

SEQ ID NO: 69210 - DNA, 386 bp, Glycine max
  Peptide Sequence Number=SeqID_185988
atgccggagcactgcactcgtcaggttaccaccggcaagctggaggaggccgtcaaatccctctcccaggacaattccaccttgaacaacaaaatcaataccatccatgcttccctcaccgccaagatcgaagctctcttcgatcgattcgccaccatcaccgttaattctccgccacctccacccccaacaccactgcatgcgtcccctgctcctcaccgacaccatatgaaattggaagtaccacgctttgacagacatgatcccctcgtgtggatcttcaaaatatcacaatttttttattatcaaggcatacctgatcatgaaaggctcacggtcgcatccttctacatggaaggacccgcgctgtcttggtaccaatggat

SEQ ID NO: 69211 - DNA, 225 bp, Glycine max
  Peptide Sequence Number=SeqID_185989
atggaagctgattacaagctattgagcttagctcatcagtgggctaagcgcacatccaccactaagtgcagcttcaacgcgcttagtgcgatagaagaatctggcagggcatcatcatcaaggttgttcgctaagcgcgagatcagtgcgcgaagcgcagcagttgtctttagccaggctaagcacacaactggccctaagctcaaatccacttactcgcactaa

SEQ ID NO: 69212 - DNA, 315 bp, Glycine max
  Peptide Sequence Number=SeqID_185990
atgcctttgaaagctggggtgactcagggactatcaggcaaacagcgtgcggcattgccggggacctcccagcccgtagggtcactcttcagggtgaccgtcatggcgcagcccccttaccaccccgatatgcaaaatgcactgacaatgaagaagatcctgcagcagtggctggcgcgtctggcagccagcaaagccgccacccctgacgggcgcgaattcgaccccggtgagcatatcgatctgctgatcccgatcagccagctgtacggcgtggagtttcatccttccgtgtatcgctactatgaacgataa

SEQ ID NO: 69213 - DNA, 1062 bp, Glycine max
  Peptide Sequence Number=SeqID_185991
atggtcctgatgttcacgctggtggcgctgctggtatcgcttaccagccactgggtcagtcaggtcaccagcattggtcgcgacctggcgctgttgttcctggcgatagccgcactgacgttaatctccacgcgtatcgcccaacgcgtcacccggccgtttgtcgcgctgggtaaccgcctcaacgatgccagccagcgacgtagcggggtgctcgccgcgctgctggcgggcctggcaaccggtctgctgtggtcgccctgtgccgaaccggagctgggcgcgatcctcagcctggccgtcgtgggcgatcatccactgtcggatggcgtgttgctgctggcgtatggcagcggtgccgcgctgatgctggcgctgctctatttcgccggacgctcgctggtagcgcgactgcgtccggggctggcgatgagtgcgcggctgctacaggcggcgggcgagctgatgcttgcctcgttgggcgtgattgttaccggctcacagagccagctgcaggcagcgcccgcttttgccctgaagctggagcagcagctgagccagtggttgaccacgccggcacccaaagtgcgcctggagccggttagcctgccgcaagccagcagcgcgttgccgtcgctggaggggggcacggcgtggctgaacggggcgccggtgacgcctgccacgttaaagggcaaagtggtactggtcgatttctggacctgggattgcattaactgccagcatacgctgccatacgtgcgcgactgggccagtaagtatcaacgtgacggactggtcgttgtgggtgtgcatacgccggagtacccgtgggagcgcgatgaaaaggtgctgaagcgcgcgattacgcgctggcagctgccctacaccgtagtggcggataacaattacagcatctggaaccgttttggtaatcagtactggcccgcgcactacatctttgatgcacacggccaactgcgctacaccgcgtttggtgaaggcaactatgaagagcaggagagggtgattcagcagttgctgaaagaggcgcgtgcatga

SEQ ID NO: 69214 - DNA, 348 bp, Glycine max
  Peptide Sequence Number=SeqID_185992
atgttgctaagtagcaatgtcatctatatctgtgtaagagtggtcatgttggtgcgcatggtccgcactcttctctttgcagcggcacgggtgaaatcttgccccagtatgcatagtagctgtgtgatagcctccctctctggttgtgctcgcacagttggccctcctccaatatcagggggtggcccaggaaccgttaaaaggaaactactggcgagggcgtgtagccctctgaagttcaggacgtgtcgcctttcgaaggcgagggagtgtagtcctatgatggcaaggacgtgcaatcctctaaaggtgagggcatgcccccctttgaaaatggggaacatgtag

SEQ ID NO: 69215 - DNA, 3093 bp, Glycine max
  Peptide Sequence Number=SeqID_185993
tccttcaccgtcgacttctacgtgctccccattgccggagccaatgtcattctcggagtacaatggttaagatccttgggccctgtcttgactgattacactaaccttcgcatgcaattcttttatgatggcaggctcgtcgagctccaaggtgatcctgaggcccatcgtagcatgctctcttccccgcaattccggcgactctgccgccatcaacaaaacctttgtttccacatcacggtgcttcccgaggaacctgagcacaaaatccctgatgatattgacccagctgtgcatcacctcctccaccaattctctgctctctttcaggaccccaacaccctaccgccagctcgcgatactgatcacaacattcacctgcttccccaagctacaccagtgaatgtcagaccttataagtacccctattaccagaagcgcgaaatcgaaacgcaggtagaggccatgtttcaaaaggggatcattcaacccagcactagccctttctcttctctggtattgctggtgaagaagagtgacggtacatggcggttttgcgtggattaccgcgcgttgaatgctctcacgatcaaagaccgcttcccaattccgacgatcgatgaactgttggatgagctcgggggtgctcgttgcttctccaagctagacttattacagggataccatcagatacatatgcaaccgccagacatacccaagactgccttccgtacccaccacgtgcactttgaattcaaggtcatgccctttggcctttcatctccctcagtgatcacctccatcacttgcagaccactggagcttcactattctcagcgtctccctcagcgtctcccacagcttcactattctcacggaccactggagcttgaaagaattaatgacactgctgacgcattatccaggttgccggaaattgattcacaggcttgcctcatcctatctgtcccttgtctcaccttcatgactgaacttcattcgcaactccattctaattcaacatttcagcaacagatgaagaaggtccaagaccacccagaccaattccctgatttctcaattgctgacaaactcttactttataagggtcgcatttggttacccaaaggcttgcccataatcacaaccttgctccacgagtttcataccacacccataggtgaacacgctggaattgcgaagacaatagctcgcctcatgcacaatttttattggccggacctccaagatgacgtctcccacttcgtcaccaattgtgttgactaccaggtcacgaaatatgagaccaagaagtcaactggtctcctgtgtcctctccctgtgccaagccgaccctgggaagatttatctcttgattttattggtggtttacctccataccatggcaactcggtgctacttgtcgtagttgaccgtttctccaaaggcatacacttagatttggtggtcaaaattcacggtatcctgcgcagcctggtatcggatcgtgatcctctttttatcagtcatctatggcaggagttgtttcgatccagtggaacccaactccggatgagttccgcctatcaccctcagagtgataggcaaactgaagtcttgaaccgcgtaatagagcagtatttgcgggcattcgttcatcgaaagcccacgagctggggaaggctcctcccttggatagaatggtctcataacacttcttggatggccaacagaggaacctctccctatgaaattacctttggccgaaaaccattcaatattccggactatgttacaggctcctcaaaggtagctgcagtagaggacctgctctctaagcgcgaagctacatttcaaatcattaaaaagaagttagtgaaggcacaggagcgcatgaaacactatgctgaccaacatcgtcgcgacattcaatatgccataggtgactgggtcctcattaaactccggccataccgacaatcatcggcaaaagctgctcatgaagttggtgggaaacttgcacggcgttactatgggccattcaaaatcattgccaagatcggctctgttgcttatcgtctggaattgcctgaggggatgcgtgtacaccctgtctttcactgttcgaatctcaaacttttccgcggcgacccggagtccaccacaccaccgccattaccacctcactttcatgagaaccaccctctcatatcaccccttaccattctcgggtctcgcagagcttcctctgaccctcaaagtccttgggaagttttggtccaatggcaaggactctcccctgatgaaacttcctgggagaattggcagcagctatgtcgggatgttacaggaatagaagctgaaggtcattgtgcacatgaggaagaagagacacagggcatagcagaagtttatgaagatgaggaagaagaaacacagggcatagcagaagtaggaaaagcgggggtgcaagaagtatgctggcttcttactctctctcttgggcctgtgctggtctgctgtgttgctaacaacacccccttcatcgaaaacaaccttgtcctcaaggttgtgaagaacacgaatcgagtttccaatccagaattgcgaaggggtggacaacagggtgattatcggtggaatgcggtggcaaggaagctggcgaggttggaagagggccgtgatgaccctttaaaagggagacgtggaagacggggtggattcacgaatattccggcaagaggagtttataggccacgggtccaatacgctccaacgaacatacacccagtcgcccaccacgaaggaaacgtcacggcggtgcttatccgccgcgagcttcataagctcctaggctcgttgaagacggcgcgtcagctgagcgtgaatttgcacgcgagtggaaagcaacgaatcaacggcgtcgttggaggattgaccgcgaagatagttgactatcataggtggggccttaccgtagaccgcctcaaacgattgctgaatgtactgttcaagagtgcggttgagcacctccgtctgcccgtcggtctgcgggtggtaagcggtgctcattcggagcttggtgccgcttaa

SEQ ID NO: 69216 - DNA, 321 bp, Glycine max
  Peptide Sequence Number=SeqID_185994
atggggataacggtaagggctgacattaatgggcgcggtgttagggagaaggtgaatgtgatgttggatattgcggggaggtggcagtgtggagggttcaacaaagatggccgggtagtggcggaggacagaggcaattggaggtgggatggggtcggaggtgatgctcgtagaagaggggggcaggagatagtgaggggggtgcatctactcgaagggaccaaatccgcgccacataagggtaaatggaataaatcgagggtgaaggtgtggtcctggatcgaaagtgagagtgccaggaagcgtgccaaccttgattga

SEQ ID NO: 69217 - DNA, 1146 bp, Glycine max
  Peptide Sequence Number=SeqID_185995
atgcttgaatggcctcagccgacgtgccccacctcctttcgaggattcctgggtttgacggggttctaccgcaaattcgtcaagggatatgccgcaatcgcagcaccccttaactctctcttacgtaaggacagcttcctctggtcctctgaagctcaacacgcctttcaccaattgcaacaggctatgactcagacaccggtgctcgccaatcccaacttcctccttccttttacccttgaaaccgacgcatcaggcacgacaatgggtgcagttcttctgcaggaagcccacccgattgcatactatagcaaagttctctgccccaggttgcagcgagcctctgcttatgtgcgagagttacatgccatcacctccgccgtgcataaatggcgccattacttacttggtaactccttcataatccttacggaccacaaaagcttgaaagatcttatgtcacagacgatccaaacgcctgaacaacagacatatttgtcgaagcttttaggctttgattacactatcaagtacaagcccgacacagcaaacgtggtcgccgacgcgctctctcgtatcgttccggcagaggtcacgacccacagtatgtgcatctcctctagaacgttcgtgagcaccctacagcgcaccccgaactcacgacccaccagcagcttccttttcggcagggtcgcatttggattccctttgaaacaccattcacgcgttctttattggaagaattccactcttctcccctcgccggtcatccgggcgtggccaagaccctccaccgcctccgtcagaacttcgactggcctcaaattaaggccgacgtccgccactatgtcgcccaatgagccacatgtcaacagacgaagtacgaaacaaagaaaagcgccagtctcctccaacctcttcccatccccactcatccttcacactggtatcgcttcctttcccttgctgaatggtcgtataacacgtccctacattcagcaatcgtttgaggcggtctacggtaaggccccacctatgatagtcaactatcttcgcggtcaatcctccaacgacgccgttgattcgttgctttccactcgcgtgcaaattcacgctcagctgacgcgccgtcttcaacgagcctag

SEQ ID NO: 69218 - DNA, 1009 bp, Glycine max
  Peptide Sequence Number=SeqID_185996
atggctgattccagcaacgaccgcatcgaagcttccctcgaccgcctcgcctcacgcattgaagaccttcttcagcacgtcactccttatgcgtctccaccatttcctcctcgtagcctggttcctgcaaatttacaccgactgaagttagacgtgccaagatttgacggcactgattcgcttgggtggattttcaaaatcacccagttcttcgagtaccacggtaccccagaccacgaccgaatcacgattgcggccttttacatggagggaagggcccttgcttggttccaatggatgtcaagcaatggccaattcacctcttggccggttttcttgcaggcccttcaaagccgttttgccccttcccaatatgaggatccctcaggttctctattcaaattaacccaaagaagcacagttgcagattacttatctgagttcgagacgttggccaaccgggtgatcggtcttccggcgccttttctcttgagttgctttgtctctgggttagtgccggagatccgccgtgaggtcatggtcaatcaacctctgacggtggcccaagctgccggtctcgcaagactccacaaagagaagctttgcgacctctgccatgatttccacgaattggcctcccgccgcgagcgtggcctctgcttctcgtgtgatgagaagttccacaagggtcacaggtgcgcccctagggttcaccttctaattgcggatgaggatgaccctgtggagaccgcgggttctaatatagacccccaggacccgataccaagcccaattgatttacccaacccaccagcccatatcagtttgaactctctcgcgggtcatatcgcgcccgaaacgatccgcctcgtcggaaacattgtcggcaactccattctcgtgctcattgatggtgggagcacccacaatttcatccaagagcagcttgtagctcaattgggtcttccctgtcgcaccactacccctctacgggtcatggtgggtaatg

SEQ ID NO: 69219 - DNA, 213 bp, Glycine max
  Peptide Sequence Number=SeqID_185997
atgaagatgaatctaatggaaaggatccaaaagtccacttctagtgacaactcccaagggtggcttcatgtaactttactggcttctagagatatcatcctcttaggtaacaacattgtggcggtagggactaccagcgacaatgcctcaccaaaaaaggaaaactctaggttaggtttcactgttatcaagcgagtcggaaacctaacatga

SEQ ID NO: 69220 - DNA, 384 bp, Glycine max
  Peptide Sequence Number=SeqID_185998
atggtcattgaccaatccctcttttatgatttgacccaattgtctagtgacggtgtaccatttgaaggtgcactggatgatgattggaagtttgattttctgtgcatgatgcccgtcgagcgtgatggctctttggtaaaaaatggtgctcaaccaaatgatgatgaaagacacttaccggttgaaggagactcttctctccttcagagtattttggacaggtttgatggacttcaaacctatgttggtgagaggtttgactccttggaacgtcaagtggacacacgattcgaggagatgaactcaaggattgcaaaggttgaagaagatgtcaccatcattcgtgactaccttgatttacctccaccaccaccatcagtttag

SEQ ID NO: 69221 - DNA, 1332 bp, Glycine max
  Peptide Sequence Number=SeqID_185999
atgtggaggcaagtgaaagccacaagccaagatgagtcgatcggaagaaggaggaacatcaatcccgttcatgtcgccttcattgttgataagtacctctgcgacaataatttcttaagcacgcgttccatctttcacaacgaggcatcttctctctttgccacttcgtcaatcaaccagttgccgaagactttggaggagatgctgaatgagtatatatttttgaagaaacaaaatgtggtcctgaatcaagaaagagtcatggtgatggaagagaaaaacaggattcaaatactgttgcaaggcatgcagaatgccctgaacacttacaatgcttttcagaggtcaccctcactgaatgtcgcggggatgaatgcaaattttgcagtagttcctcaaccgagagtttataacaaaactcctcaaggtgtttctactattacaagtattgctgctgccatgcaaaacacatctaatacacagttgcttactagacctgtcaacaccaatgtggacactggaaacttctcaacacccatgattagtgtgtctgacaagaagagaaaagatactgaagcagtaaatgggcctatagttgcaaagaaacctcgtggtagaccacctggcaggaaaaatcaagtccaaggtgaaaacacatcaccacaatcaagtaatgctgtcaacaaccaagtagtttcttggccatcttcttctgcaactcaatcatcatctgggaactgtgcacccagcggatcactggttcaaggatccaatgctgtcaaaggctcattcaatcaccctccactttttgttccagacaattccccaattccaaagacacctacaacacaatcctctcagagtgatacatatgtatcccctactaaaatttatcctgctgcatcttgcaacggagaggctagtcctacttgttgcactatgaatccaaccaacaaagttatggttggccctgaaacacaaatggcttataaagagaacagtcattgcaattctcctatcgaagtagatacaggcaaatcaagtaagaaggatgacgtaaggagcaaactgaactttgatgcctctaatatgcctgagagcttggacaaatcattgtctaatgaggtttatacatctgagtctgacaaggaagttgacatatctgacattgatttttccaacttgatggattgctgcccattcctaggaatcacatccgaagatttttcttaccatccagttccaactcattccaaggataatgcttcaacgtcttctcatgaatgcaatgctaatcatttgacttaccatcaaactgcaaacaatcactga

SEQ ID NO: 69222 - DNA, 771 bp, Glycine max
  Peptide Sequence Number=SeqID_186000
atgattcacatgcttaggcaaggcatacaaaaggctgtggatgtttacaatacttttcagagtccaccttcacctaatgtcgagatgatgaacacaaattatgcagtggttcctcaatcaaggctttgtaatgaaactcctccaggtcaaaacacaatgttgccatcaagtaataccatcaataatcaagtaatttctcggcccccttctccaattcaatcatcatatgggaattttgcccccaacaaatcacgggctcaaggatctattgttacccaatgctcatatgtatcccatcctaagatttctccggttgcaacatgtaatggggaggctagtccctcttgttgcaatataattcaaaccaagagagttatggttagtcctacaaatcaaatgtcctatacagagagtagtcgtagcatttctcctgttaatactgattcagacatggcaagtaagaggaatcgtgtaagggataggctggatgcctctgataagcataaaagcttggacaaatctgatattgaatgttcagactgggagaaaatcttactcagtgatgtgttaggtaatcgagaaatgcattacgaagccatttttctgaccattcagcctcgactcatatccaggataatgcttcagatcctcatgaatgcaatgctaagtttgaacaactcctacagtagcactcaaaaagacatgaatatacaagattgcctccatatcttcagtattagtatcttgataggtctctttctgcagatgtga

SEQ ID NO: 69223 - DNA, 201 bp, Glycine max
  Peptide Sequence Number=SeqID_186001
gattcctttgaggagcaggcgtcacagggatcctttgtcccccatggacgtcaggatgttctcaccactactattggacatccagagcaccctagacatgtccgtgctgctggagccggtgtcaccatcaagaaatacttcggatcggctccacggatgtcccgcagctcttcctcattgtctcctgaagaattgcagtag

SEQ ID NO: 69224 - DNA, 1617 bp, Glycine max
  Peptide Sequence Number=SeqID_186002
atcgccgatgctgtacggtgcgtgttccgccagcgcacagcccagcgcgccaaaggcatcattcaggatcaaaaccgggccgcggatttcagtctcatccaactgctgcagcagatattcatccgccgcttcccacgcctgaagcgggttaacgtcgtccgtctccggaaaacgtttaagctgacttatctccagggctacccggagcacctgctttcccaggtccgcacgttaattgccgagcaaaaactgggggcagtgctggaaaaacgctaccccggcacgcacgatgtcgcgaccgataaagccctctggcagtatacgcaggatctgaaaaaaccgggtggcaagctgaaagcaaaggccgaaatccgcgtcgcgacggttttccgtaacgcgccggaagccttcctgcggatgatcgtggtgcacgagctggcacacctgaaagagaaagagcacgacaaagcgtttattccctgtgctgccacatggagccgcagtaccaccagctggagtttgatacccgccttcattggtacgaactggatcacgcgccagttcgtcgacgccgcccacgaaaccggcaaacttaagcttaccgcagtctattcccgcagccttgagcaggcgcagagttttgccaacgattacctcgttgagcatctcttcacttcgcttgatgacatggcgcaaagcgacgccattgacgcggtgtatatcgccagcccgaactccctgcacttcccgcaaacgaagctgttcctcagccataaaaagcatgtgatttgcgagaagccgctggcgtcaaatattgaggaagtggaagcgaccattgcgcttgcccgcgaaaaccaggtggtgctgttcgaagcgttcaaaaccgccagcctgccgaatttcctgctgctgcagcagtccctgccgaaaattggcaaagtgcgtaaagcctttatcaactactgccagtactcgtcgcgctatcagcgctatctggacggcgagaacccgaacacctttaacccggcgttctctaacggctcgattatggatatcggtttttactgcctggcctctgcaatcgcgctgtggggcgagccgcacggcgtcacggccacggccagcctgctggaaagcggtgtggatgcgcacggggtcgtggtgctggattacggcgatttcagcgtcacgctgcagcactctaaagtcagtgattctgtgctgccgagcgaaattcagggcgaagccgggtcgctggtgattgagaagatctccgagtgtcagaaagtgagctttgtgccgcgcggcggtaaagcgcaggagctgacgcagcctcagcatattaacactatgctctatgaggcagaggtcttcgcccgtctcgtggaagacaacgaagtgaatcacccgggcctcgcggtgagccgcaccacggcgaagctgcaaacggagatccgccgtcagaccggcgtggtgttcccggcagacggcgtgggcgcagaggctatcgcgggagtaacttcttcgccggtggatcgtcattacgatgcgtgcaaaatcgcatccggtcgccgggcaaccttcgtggttgtaagtgagaccttgccggaaggcgag

SEQ ID NO: 69225 - DNA, 177 bp, Glycine max
  Peptide Sequence Number=SeqID_186003
atggctgcctgctgccttaataaattatgggatgataaaatggttcaccggatttcatcataccttgcaattcaaagagtagttgctttgggaactttgtgtgccttggaattaaaagcagaaggcaataatgtcgagtataaatttatcaactttatcctttccccttttcaatag

SEQ ID NO: 69226 - DNA, 1232 bp, Glycine max
  Peptide Sequence Number=SeqID_186004
atgcttggggcagatcttttttattacaacaaagatgagatcaaacagattttaagagcaagcggaatgcttaatttaaaaaatattgcgctattgatcgttttgattgcgatatgtatcattccattatggatggccgtaaaatccgctttgaagtcgaaatatatcgggatcgcttttttaagccttggcctgattgctttttttgttcccagcaatatgtttcagtcaaaggaattaaaccagacaaataataccttcggccagacagcttcaaagagtaaatggaactatttctttacctccaataaagagaattttatcagcgatcacccggaaatcggagaaataattaatggggaagaaagctttgcagccgatgctgaaatgctcgacaagtcatttcctttctggagaaaagagaatactcccgattttttgggatcttatttcagcagatccgatgaggttccgaaccttgtatttatcgtgatggaaggttttggacatgcatacacctctcctaaaggttatgtcggaaactttacgccgtttctggattctttgtctaataaaagtttgtattgggagaattgccttagctctgcgggaaggacattcggagccttaccttcgcttacaggatcacttcctttcggaaaaaacggattcctggaaattgaaaagacaccggaaaattttaacctttttaatatactgaaagccaacggatttgaaacgggatttcactacggcggaaatttgttgtttgacggataccgaaacttcctcgagtacagtaaagtagatcatattgtagacattggatcgtatggaggggcttacaaaagactgccggcaaacaatggagacagttggggatatgaagaccaggccgttttcagaaagatgctggaaacccagaaattacagcaaaggccttattttaaaatgcttcttaccctttccacccataatccgtttctgattaataacaaagaatattatgaaaaactttataacgaaaggttgcaatccaatcttttaaatccggagcagaaaaaatgggcggcgggctttaaaaaccaattggttgctgtgcttaatgcagatgatgctttgaaaaacttctttgaaaactacagtaaacgtccggattttcaacgtacgatttttgttattacaggagatcatagtatgccggagatcacactggagtctaaaattgacag

SEQ ID NO: 69227 - DNA, 828 bp, Glycine max
  Peptide Sequence Number=SeqID_186005
acaccgagggcaggatgtcgagctcggcgttggccgggtccagcgcgacccagtcggcccaggcgccttgcaggaagtcgacgtagcgcgggctgtgcacgcgccggatcaggtccaggtcgggcgcggccggcgtctgcagcgtgccgatgccgcgctggcgcagggcgtccagcacgtactccagccgcgccggggtctcgtggcagggcacgagcctgccgcggaacatttcgtggcggccatcgtgtctgccgtggacggggttgtggaagatatgcacggcagttcgcgcaggatcgaatacaggtcgcgcgcttcggcgtagcgggggtatcccgcgctgacctcggcgacgccgtggcgatgcagcgccagccgggtgcgcggcacatggaagtattgcgtgacggccatggcgcgggtgtagccgcgggtccgcatgtaggcgctggcgtggcgggcggtggcccaggtgtctgcgccggcgctgtcggtgacgatgcggtcggcgggaacgccgcgtgcttccaggtaggcgcgcatggccgccgcctcgtcgcggcccgtcgggtcgatgccgccgctgacgaagatctcgcggcagcgggtggcggcatagcaatcgtaggcccggtccagccgcgccgccaggcgcgccgaggggctgccgtcggccgcgacggtgttgcccagcaccacggcgatgtcggcatcggcatcgtcggccagcaggccggccgccaccagcgcggccgcggccgccaacacgcaggtggccagcgcgatggccgtgcgcgcgatgatcgcggtcgcgccgcgatgtga

SEQ ID NO: 69228 - DNA, 645 bp, Glycine max
  Peptide Sequence Number=SeqID_186006
atggctgcaggtgcgctacccggcgggccgggcggacgcacccctgaagtgggtgcgctacgcggacctgaaaatcgacaaatatgcctacgcgccgcaacagcgcatgcccatgcgcggactgtcgttgtcggtgcgcggccacctgggcacgcagctctacgaagccggcggccgcttcacgctgcatgtgacgaaccttggcccggacgccgcgacactggcgtcgccgcgcatctggctgctgttcacggatgcgcaggggcgccgcaccttgcagcccttgtacccgcgcgcgccggtcacgctggcgccgccgcccaatccggccgacgccacgcaggcctcccccgcctatgccggcgacgcgcagcggcccgcgccatccgccgccgctgcgcgccacgttgccgactgggccgacgacccggtggtctggcgtccgggcgaagacggcaagccggcctaccaggtcaacgccggcaatggccgctatgtgcccttctttccggacctggcgccaggccgctatcgcctggccgtggcgctgaccgacccgggctcgctggcggaaccggtctattccaaccagatcgaggtcgacctgccgttccccaagcggccctgaacgccgattccgcatga

SEQ ID NO: 69229 - DNA, 165 bp, Glycine max
  Peptide Sequence Number=SeqID_186007
atgagcttgcttagcacatctcatccttcttccaaaattgtccatgcgcttagccatcagattgggcgcttagcgaatgatgcgcagtggcttagggagttcatgaaatctgcacttcaccaatcttgcctgttttacctaaaattgaagtggaatgatcattaa

SEQ ID NO: 69230 - DNA, 489 bp, Glycine max
  Peptide Sequence Number=SeqID_186008
atgtcgagggagccatgccccctgcaagcttggcgtagtaggcaaatagaaagaatgtggtcgtgtcaggagatagaccagatgcaatgcccatcactatcgatcaccgtcggtccttctacattccttggggattcacacctcgcgcgggaactggagtggtttgaagacttcaatttttatctgggtatggaagtgcctcatgatgctcaacaattcaaagcgaccctagtgaggtttgatgcgagaggagcaaaagcttcactgaaaatgttttgggtggttactggtggtcgtaggtggtggaggagaagtgttaaggttttggatgagcgtttggagagaatctcacttagtgagctcatctcgctaagcaaaattccacttttggctctaagtgtgatatctcgtgcggagcaaattacctcctcgggttggaattgccctttgtgtgtttgtctcgctaaacgagttgtccagagatgttaa

SEQ ID NO: 69231 - DNA, 200 bp, Glycine max
  Peptide Sequence Number=SeqID_186009
atggaactgtcgaaagtaaaaagaggggtcgtcgccgtcgtttgcgccgtgctcgtcgcctccgttcgcgctgtgctcgtcgtcgccgtgggtcgtcgctacaggctgcgtcctgtgtgcactgggttccggggtcgcacttttttgttggagcttggaggagggctgcgttctgattcaaccttgcgtgggaggggagg

SEQ ID NO: 69232 - DNA, 228 bp, Glycine max
  Peptide Sequence Number=SeqID_186010
atggccaaggagagaaaagatagtactgtcaaaatggttaatggattcaggaatcaaatgctgaatgctattaaaggcttctcaagatcacctcaaaatggattgttcataaattcatgttttgctcactgccaatctgagaggcaggatacatggtttgctgacaattctcctgtcattgggaacaagaatattcaccttgagaaaaattctaggacatttacgtaa

SEQ ID NO: 69233 - DNA, 363 bp, Glycine max
  Peptide Sequence Number=SeqID_186011
atggaccaattaaagcacctaagcatcccctcaggaatgcttagattctctaaccacgctagttacccacgtctgggccatccgacaagaaaaatcagcatgcaacaaggacaggcagatatcctcattgctaggttccctgaccctaactatggtgttaaaacgattcctttttgtgcttgctcgttgattccacacaagcctctaccatgccaaaacgaaggagacttagtatggatttcagaaaacaaagctagtaacagtgctctgggtcaaacacccacatcactacatgaaagagctgagagcatttcgggttttacaaaggaacgtcatttggaaattccaaccatgccaatgtga

SEQ ID NO: 69234 - DNA, 1159 bp, Glycine max
  Peptide Sequence Number=SeqID_186012
atgagccgtgataacagctcgcacaacgacggctatgcccagctgcatggcggtttccgcgcgcgtaaaaatcgcgatgcgctaaccgcgcgcgacaagctgcaatcctcgttacttgatcgtctgactgacaacgcgccggacaagcagagcgaagccagcaataccacgctgatttcccacagcacgctgcgccgccacgtgctgcgcgatctgcagtggctgtttaacaccatcaacaacgaagcccagcaggatctcagcgcctttggtgaagtgcagcgctcggtgtggaattttggcgtggcgccgctggccggacagaatatctccgacatcgaatggcaggatatgcagcgcaaaatgaccgatgccattctgcatttcgagccgcgcattctgccgcaggggctgcaggtacgctgcgtcagcgatctgaagtcgctcagcttgcacaacgtgttatcgattgagatcaaaggccgcctgtggttaatcatggacagcaaactgctcgactactacaaccgcgaactggcctatctgcgtgagctgggcgcggagttcgctgcgcgctatccgaaagtcgccgggcggctggggatgcgcggcatcgaagtcaccgatccttacgttgagcgcctgatggagggctttgctttcctcacgtcgcgcgtgcagctcaaaatggacgccgaattcccgcgcttttcgcagcggctgctggagatgattgcgccgtcttatctgtcacctacgccgtcgatggcgattgctcagctcacgccggacagccgcaaaaggcgacatcagcaatggcttccacgtgccgcgcggcaccatgatggagagccagcacctgaaaaaaagcggcgtaacctgcagctacaccacggcccacgatgtcacgctgcatccgctgcgcatcagcggcgtttcactcggcggcgtgccgggcgatctgccgctgggcgaactgaagctcagtggtcgcggtgccgccagcgcgctgcgcgtgcgtatcgcctgcgaaggcatctcgtcgctcagccagctgaatgtcgccgatttaatgctgtatctcagcggtccggacattcaggcgcagaaactgctggagctgctgatgcagcaccgcgtcggcatcgtgctgcaatcg

SEQ ID NO: 69235 - DNA, 871 bp, Glycine max
  Peptide Sequence Number=SeqID_186013
atggaaaaatgcctcatcttctttacgttcaaggaatcatttatgtcacgcattttagtgttaactgcccaccgcacccccgacgagtcgcgcatcaaccaggcgctgatcgaggccgtgcgcccgctgcctaacgtgaccgtgcacgaactgatccgcgcttacccggattaccgcatcgacgtggcgcgcgaacaggagctgctggaaagccacgatgcggtggtgatgatgttcccgtttttctggtacagctcgccggcgatcctgcgcgaatggcaggacgcggtattaacctatggtttcgcctacggcagcgagggcaccaaactgcacggcaagccgctgcagttggtggtgagcaccggcggcaacgcgcaggcctacacgccggcaggctacaaccgctatccggtgcaggatctgctgctgccgttccacgcgctggctaacctgaccggcatggattatctgccgccgcacctggtgcagggcgtgagcgacatgagcgatgagcagttggcgcaagcggccgccgggggcgcagcgctcgccgcgccctgcggggtcagtcttcgagcagccaccacaccgcttcgaacggccgcagcgtcagcgcttgcggctgatccgccgagtcgctgtagttgctcatcagcggacgccactgcgcggaggcttccacgccctccgccgcccaggccagcggttcgcggctcaggttggccaccaccagcaggcgctggccgttccagctgcgctgatagcaccacagcgccgggcgtaaaacaccgagtcgagatcggccagcgccgcgtcggcgttgatctgcgggtagttctcggcgcagccgatccacggcgtgccgatg

SEQ ID NO: 69236 - DNA, 216 bp, Glycine max
  Peptide Sequence Number=SeqID_186014
atgtcgctgccctttgacgtgcaccgcctgctgccggccttcctcgccgccgcgcaggcgcaaaatttctccgccgccgcccgccagctgggcgtcacgccggcggcggtcagcaaaaatatccgcgcgctggaagagaagctggcgctgcggctgtttcagcgcaacacccacaacgtgctgctgaccgacgagggcaaagcgctgctggcgcag

SEQ ID NO: 69237 - DNA, 288 bp, Glycine max
  Peptide Sequence Number=SeqID_186015
atgaagttgagcacaaatggaggaaacatccctgcgcaattgctggttcttgacagaaaaaattgggagcggtggcatattcaaatgaaggcgttgtttgaatttcaagacgtgatggaggtagtgaagaatggcgtagcggcggaaccagcagaacccactactgaggcagtgaggaatgcatacaaggatagcaagaagaaggatgcgaaggcaatattctttctgcatcagagtgtagatgatgcgaatttcaatctaatctcgaaggcgacctcagcgaagtag

SEQ ID NO: 69238 - DNA, 289 bp, Glycine max
  Peptide Sequence Number=SeqID_186016
atgacgatggaagagaatgagaagattgttgacttctttgcacgagtaaaggtagtcaccaatcagatggctacacaagtaacaagaattctggcgacagtaacagaggaagaagtggttttagaggaagaggtcttggtaggaacaatagaggaagaagtggctatgtttctagtagtggaagaggccagaataatgttgaaaataaacctgatcagtcgcagagaggcaggggcagaggctactatcgaggtggtagcaatggtagaggaagaggtggtaggaaaag

SEQ ID NO: 69239 - DNA, 159 bp, Glycine max
  Peptide Sequence Number=SeqID_186017
atgggttcgcaagattactcgcggcaattctaccatcactcgcaacatttggcgcgtgcagccggacccccactccctagtcagatggtgaatgacggtgccggtgcgtacgcgcttttgcaagtttcgctaaggttgtgtttaccacggatagggtaa

SEQ ID NO: 69240 - DNA, 403 bp, Glycine max
  Peptide Sequence Number=SeqID_186018
atgggttgtgctaattccaaaccaaagggatgccaacattgtcactgcaacaccccttattattcttcttctatggctagaagcttctcggtgcatgtacatcacccacctcaaaccaaaggagacagttaccatgttgtggcactgacatcaaccacactaggttctctggaccaggatgtaccccacaacaacaactaccatggcaatggtttaaggtttcccaatggcaaggtcattggtagtgacagtttcaggccccagaatcaggatcatgatgatgatgatgatgatgacgaggttgaggttgaggagaagaagaatgagccaaagacatggtctgaaatgattgaacaaatgttgccaaaagctatgatgaagtctccaatctcaacacctcctt

SEQ ID NO: 69241 - DNA, 796 bp, Glycine max
  Peptide Sequence Number=SeqID_186019
gcatgttgatgttgctgatgttgatccacccttaattcagaatggcaatgattcagccaaaccaatatcggtttcagattctgatgatgagcctcaagagaatcaagagagcatggacagaaaaaggttcttctctattgaggaagagatgatcagtgatgatgttgtttcttcattcaagaaatcgtcgcaagagaagcaagagggcatggatagaaaggggttctctgttggggaagagaagatcagtgatgatgatgatgttgttgtggatttgaagtcatgtgggaaggacaaggtggtgttgtatttcactagcttgcgtggcgtgagaaagacttatgaggattgctgccatgtgaggctaattctgaagggcttgggggtgagggtggatgagagggatgtgtcaatgcattcagggttcaaggaggagctcaaggagctattaggccatggatatggtaagggagggttaggattaccaagggtgtttgttgggaggaactacattggtggagctgaggaaattcagcaactgcatgaggaggggaaacttgagaaattgcttgattgttgtggaaagattgaagatggtattgatggcgatggactatgcgaggcatgtggggatgtgaggtttatgccttgtgaaacttgttatggaagttgtaaaatctactatgaaggtgatgaagaagaagattatgatggtgaggtggtcagattttgtttgtacagtgaggttttggtgtggttgatcatgttagagaagaagaaggagataaaagagtga

SEQ ID NO: 69242 - DNA, 762 bp, Glycine max
  Peptide Sequence Number=SeqID_186020
atgaggagtaagagatttacaaagctcctaaacatgttgcagctaatgatgttgcacttgaagatggtgtgtttggtgataaacctaaggacaaatcaatccttactaaatatgttgatcgtgtggcttgtaaactatgggatggattggccgtggaaagttgaagctagtagcacatggaaggaagttgagggatttgcccctccccccaataaggagatcatgcaagtggtgcaggattcaggattacttccattgactgaatgtagttatgaaaccgctgacaatggacttttatttgcttttactgagaggtggcatcatgagacaaacacctttcatttggcggtagaagagatgacaatcacacttgatgatgtgtcatcattgctgcatattcctatcattggtggtttttatagttatctgcacacgtctaaggaggtgaccattgcattgttgatggaacttttgttagtgaatcaggaggacacatttttggagactaaacagtgtagaaggggtaatgcttgcctatcttggttgcaaggcattcatgcaaataggtgtagggatgagcaatgggaccaaactgctagagcttacttgttggacttagtggcacttaatctagtccaaaaaaaattaattgcatcatgtggtatgccacccatgatatacctagctagttcacatgcacaagcgagaccatgtgtatatcttatgatccacaatggtcgctgtcaacaccaacaaacttaa

SEQ ID NO: 69243 - DNA, 426 bp, Glycine max
  Peptide Sequence Number=SeqID_186021
atgtcagatgaagtggatatggaggttgacatgaataatgacgttagaatagatgaagatattcataaagattacgaccaagagactggaaaaactgttgattgtagcaaagcattcataactacaaaggcatgggatcaaatcatggatgcatggggtagtagtgttaaagattgccctactcagtctgagtatgaagggcgtatcaagatgcttaaaattgtatgttcaccatggaagtactttgtcaaggttgagtctgcgcattggagcttaaagaggttcattcaaaatagcatggggaacttgtgtaaatgttgggatgccataaacaacttgatcagattgtatgctcttaatcatattgaagatgaattggatcgtgttaagtttgttggtgttgacagcgaccattgtggatcataa

SEQ ID NO: 69244 - DNA, 799 bp, Glycine max
  Peptide Sequence Number=SeqID_186022
gactacacgtcttcgcctttagtggactgcatgtcctcgactttagagggctacacgtccttgccttaagaggactgcacgtcctcgccttcagagggctacacgtcctcgccttaagaggactgcacatcctctgttttagtgggctgcacatccttgccttcagaaggctgcacatcctcgcctttatatggctgcacatcctcgccttcagatggctacatgtcctcgacttcaaaggactcgacgtcctcattgttaaaggactgtatgtcctcgccttcagagggttgcacaccctcgcatttagaggactgaacgtccttgcctttagaggactacaagtcctcgcccttagaaggccacacatcctcgccttcaaagggttgcttcatgccgtggccttcaacggactgcacgtccttggtttcagagggctgtacacccatgctttcagaggactgcacatcctcgcctttagaggactgcatgtcctcactttcagaggactccaagccctcaccatcagagggcagcacgtcctcgccttaagagggctacaccctttagccttcagaggactgcatgttctcaccttaagaggaccgcacgtcctcaccttcagagggcagcacgccttcgccttcagaggactgcacatcctcgcttccagaggacaacacgtcctctccctcagaggactgtacatcctcgccttcagaggactccacgtcttggcttttagaggattgcacgtcctcgccttaagagggctacacgtcctctccatcagaggact

SEQ ID NO: 69245 - DNA, 720 bp, Glycine max
  Peptide Sequence Number=SeqID_186023
atggaaaaaccgtcacggtttctggccaattccagtaccgcgcttgagcagttgcgcgggcttatcaaccagcatgagtcaacaccaggcactccgctgcccacggaacgtgagctgtcggaaacgctcggcgtaggacgccgcgaagtgcgtcgtgcgctggatgtgctggaagaagaggggcgcatctggcgtaagcagggcaaaggcacctttatcggtccttctgcccctgtcgaaccgctggcccttcagggattggttcagcaaaccaaccttctggaagtgatggaagctcgcctgcagctcgaacccggcttagcccggcttgcggcacttcgtgccaccagggaaaacctcgcgctgatgcagcgcatgctggaacgcattgataaggtcagcccggatgaccgcgatctcaacgaactgtgggacagcgcctttcaccgcgccattgcggaggccgcgggtaaccgcctgatgctcggcctgtttgatgccattgatgccgtcagacgtgaaccgggctggcagcacctgcgcgaattagcccgcacccccgaacgcgtcgacaattataacgaccaccatcacaagatcatgtctgcgattatccatcgccagccaaatgaggccgcggccgccatgcgcgaacacctgctcagcctgcaaaccgccctgatccatgcgatccaccttgaggacgacttcacgctatga

SEQ ID NO: 69246 - DNA, 499 bp, Glycine max
  Peptide Sequence Number=SeqID_186024
ggatgatcgcagtggtggtggaagtgatattgattgcggttgtgatacaaatggcggtgacaatatggtggtagcaaccaatggtagcgacattggtagtggtggtggtggtggtggtggtgatagaggtgtggttgtatcaatgtcaatgtgttggtgtgatggtggtggctttgacaatggtggtggtggttgtggtgacaatagtggtagttatgatgacattggtggtggttgtggtggcgatgtcagaggtggtattattggtagtggtggtggtgatagtaatagtgacattgatggcggtgatggtgatagcagtgtcggtgacgacgatgacttgacgttggtgttggtggtgataccaagtggtgacagtggttgtgacaacattggtaatagttgtggtggcgatgataatgataatgaaagtgacactaatgcaaccaattatagtagtgacaatgatgatgatgatgacagtatgtggtattggtga

SEQ ID NO: 69247 - DNA, 1077 bp, Glycine max
  Peptide Sequence Number=SeqID_186025
atggagtgtgcagtggcaatctcagttgacaacctaggtgaggctcataggatgttactagagctaacacaaatggcctcaccatacaaagcatcatgtgctgaacgtgttgttgcttactttgcaaaagccatgactagcagggtgatgaattcatggcttggagtgtgttcccctttggttgatcacaaaagcataaactcagcattccaagtgttcaacaacatttcccctttcatcaaatttgctcacttcacttccaaccaagcaattctagaagcagtgagtcattgtgacagcattcacatcattgacttggacatcatgcaagggcttcaatggccggcttttttccacatcttagccacaagaatggagggtaaaccaaaagtcacaatgacaggtttgggagcctcaatggaactccttgttgaaacaggaaaacaactcacaaactttgcaagaaggcttggcttgtcactgaagtttcaccccattgcaacaaagtttggggaagtaattgatgtgtccatgcttcatgtgaagcctggtgaggcagtggcagtgcactggctgcagcattcactgtatgatgcaactggaccagattggaaaacactgagactccttgaggagttggagccaagaatcatcaccttggtggagcaagatgtaaaccatggagggtctttcttggaccgttttgttgcctccttgcactactactccaccctctttgattcccttggagcatacttacacaatgatgattcaaaccggcaccgtgtggagcatggccttctctccagggagatcaacaatgtgttggccataggaggacctaagaggagtggtgaagacaattttaggcagtggagaagtgagcttgctaggcactgttttgtgaagcaggttccattgagtgacaattcaatggctcaagcacaattgatattgaacatgttttcacctgcttatgggtatagccttgcgcaagttgagggaactttaaggcttggatggaaggatacaagcttgtacacagcttctgcatggacctgctgtaattctagctag

SEQ ID NO: 69248 - DNA, 1104 bp, Glycine max
  Peptide Sequence Number=SeqID_186026
ttaattgtattaactactcatgatattctgcatttcaagttcctaacaatcccatcttgttctgtcaaaaaattccaggaacctgtgaagaccaggcatccacagcttcactatgagtcaaaactgtatatgcttcttcaaggaggaacggggattccccacctcaagtggtttggagttgagggagactacaatgtcatggttatcgaccttcttggaccaagtctggaagatttattcaactattgtgaccggaagttcacattgaagacagtgttaatgcttgctgatcaattgattaacagagttgaatatatgcattcaagaggtttccttcaccgtgacataaagccggacaattttctaatgggtctaggacgaaaagcaaaccaagtgtatgccattgactatggccttgcaaaaaaatatagggatcttcagactcataggcacataccatacagggaaaacaagaaccttacaggcacagcacgctatgcaagtgtcaacactcatcttggaattgaacaaagcagaagggatgatctggaatctcttggttatgtgctcatgtatttcttaaaaggaagtcttccctggcaaggactgagggctggcaccaaaaaacaaaaatatgacaaaatcagtgagacaaaggtgtcaacttccatagaggtgctctgcaaatcatatccctctgagtttgtgtcatacttccaatattgccgatcactgcaatttgaggacaagccagattattcgtatttaaagagacttttccgagacctatttattcgagaaggctaccagtttgattacatttttgactggactatgttaaaatatccacagatcagtggcagctccagagggcggcatggcactggcaaggcagctatgcatgcaggtccacatgtacaaaaagcagaaaagatctcagttgggaaagagattcgagagaaattctctggtgcagttgaagcgttctcccggaggaaccctgcaaatgctagtccttgtggtgatcacaccaaacacaggagttttgaggatgtaccagtgcaaaaggatttggtaatattattcaacaataagaatatatga

SEQ ID NO: 69249 - DNA, 1116 bp, Glycine max
  Peptide Sequence Number=SeqID_186027
atggcaaacagaaatagcttgagatgtatgacttcgtacagtcctcaagggcttatccatttgggtgtccatccttcaatcaagggggaagtgtgggagttcttgctaggttgctatgatcctaacagtacacttgaagaacggaatgagctcaagcaacgcaggagggggcagtatgatatgtggaaagctgaatgtcaaaagatggtcccagtcattggtagtggaaagtttattacaacacccctcattgatgatgaaggccagccaatagatccttctttggtaggcgtccagacttcagataagaaagttgtgcagtggatgcagttattacatcagattggtctggatgttcatcgaacagatcgagcacttgacttttatgagactgaagctaatcaagcaaaactcttccatgttctagcagtttatgcttggttggacaatgatattggttatgtacaaggaatgaatgatatttgctctcctttgattattcttgttgagaatgaagctgattgctactggtgctttgaccgtgcaatgcgaaggatgagagagaacttcaggagcagtgcaagttcaatgggggtccaatctcagctggctacactctcacagataatgaaaacagttgatccaaagcttcatcatcaccttgaggatttagatggaggagaatatctctttgcatttcgcatgcttatggttcttttccgaagagaattttcttttgcagatactttgtatctttgggagttgatgtgggccatggaatacaacccatacatcttcaccaaatatgaggatccagatcgtgcaaaaacaaaaggcccatcacctgcaacaaataacaaacatttgaagcaatacggaaaattcgagagaaaaaatgtgaagactgggcatactgaggaaaatagtgcactgtctgtttttcttgttgcaagtgttcttgagattaagaataggcggattttaaacgaggccaagggtgtggacgatgttgtcaagatcttgggcgacataacctcaaatcttgatgctaagaaagcacttaatgaagcactgaaaattcagaaaaaatacctaagcaaggccaagaaggcatga

SEQ ID NO: 69250 - DNA, 240 bp, Glycine max
  Peptide Sequence Number=SeqID_186028
atgatgagattgagggaaaatgggtcatcaaggaaggagttgaagcactccctgggcaagcctcccatcattgatgtcaccatcaatcaccatggatgtggggcctacttcgttggtgtcagagagatcactagtgatgacgatggttgtcggagagtggtagaggtgccttgggagactccgagagggagagtacatagaagaaggaaggaagacaactacaaccaagttaaagggtag

SEQ ID NO: 69251 - DNA, 1398 bp, Glycine max
  Peptide Sequence Number=SeqID_186029
atggtgaggggattgctcaacaagctcgtctctcgctccctctccgtcgccggaaaatggcagcacaaccaactccgccgcctcaacatccacgagtaccagggcgctgaattgatgagcaaacacggagttaatgttccgagaggcgtggctgtttcctctgttgaagaggtcagaaaggccatcaaggaccttttccctaatgaaaatgagttggtggttaagagtcaaattttagccggtggaagaggtttgggaactttcaaaagcggccttaagggaggagtgcacattgttaagactgaccaggttgaagacatagctgggaagatgcttgggcagatactagttaccaaacagactggtcctcagggaaaaatagttagcaaggtttacttgtgtgaaaagctgtcactagtaaatgagatgtactttgctataacactggatcgtacgagtgctggtccaattataattgcttgtagtaagggaggaaccagcattgaagacctagcagagaaatttccggacatgattataaaggtacctgttgatgtttttgaaggaattactgatgaagatgctgcaaaggttgttgatggtttggctctcaaagtggctgatagaaataagtcgattgaacaagtgaagaatttgtataaactttttgttgattgtgactgcacccttttggaaatcaatcccattgcggagacagctgataaccaattggtggctgctgatgctaagttgaattttgacgataatgctgcatatcgccagaaagagatatttgctctccgtgatacaacacaagaggaccctcgagaggtttgcctgattattaattgggttgggctatgtccaggtccaaaaattggcctcaccaatatattgggtgggttcatgttaataaacccagttcagtctgtcccacatacacctgtcagcctaactcatgtgactgctgcaaaggcagacttaaattatattgggttagatggagaaataggctgcatggtgaatggagcagggttagcaatggccacaatggatataattaaattgcatgggggtactcctgccaattttttggatgtaggtggcaatgcctctgaaggccaggtggttgaggcatttaaaatattgactgctgatgacaaagtgaaggcaattttggttaacatttttgggggtataatgaagtgtgatgttatagcaagtggaatagtgaatgctgcaaaagaggttgcactgaaagtacccgtagtagttcgtctggaaggcaccaatgttgatcatggaaaaagaattttgaaggaaagtggtatggcgttgataacggctgaagatttagatgatgctgctcagaaagcagtgaaagctgcttacaaatga

SEQ ID NO: 69252 - DNA, 787 bp, Glycine max
  Peptide Sequence Number=SeqID_186030
aaacaatcttagtggtgaaatcccctcgagtttggggttgctgaggaatctcaaggttcttgatctcagtgggaacaagttcgaacaatgtctccctcactcgcttggtaatctctcccaccttttgaagcttgacttgagcttcaatgggtttagttgccgaatccccgagagtctaagagggttgcaaagtttgcattttttggatttaagcttcaaccgattcggtaattttggggtgcctttattcttgagggagattcccacgttgaaggaagtgtacctgagtgggaattttctctctggggtgattccggaaatatgggaaaatcttgggggtgttgaaaaattaggtttttcagaaatgggtctggtagggaacatccctgcttcaatgggggttcatttgaaaaaacttacttatcttgggcttgacaacaataaactcgatgggcctgtgccttatgggcttttggagtatgctagtgagatcaatttggagaacaacaaattgagtgggagagtggaattctcaacaaccaaagtaggacaaaaggtgaagcttgcagggaacacaggactgtgtgtggacaacaacaaagttggttgtaagaggaggagtggtgatggtgtcttgggtcaacaactgaaggcctgcaagaaaactgatgttgttcctgatgatgctgtcgttttcagtggggcttcttctctgctgcgttttgattctctcgctggggtgttgtttgtcttcacgggatttcgttggtttggttattacgtgtag

SEQ ID NO: 69253 - DNA, 576 bp, Glycine max
  Peptide Sequence Number=SeqID_186031
tcaggtgatatgcgggattacctcatggttacctgcacctttcatcaaaccgggggcaaacgagcccgttgacgcgaagagactgacatcgtcttctacactctttgccatccagggacatcaagtcaggtggcaggcggagataccttatggtcatcggcgcctttcgtcaatcgaggggaacgacttcgacggtatcaggatgatgttggccgttcgggacgatcgagtgcgatggcgaagggaagtgtcgtggttgttctaccttgtcgttttcaagacgctgaagggtatgcaaatagcaatcaggcccacttgggccttccaggatgttccaacagaaggcagtgcctactggtggaagcaacccagctcgcctgggcggcaaccatctcctgatgagaatcctgaaattggccaaatacaggctaaaggcccaagtaatccttgtggcgtctatcctgacttatcttccttcaccggaagtagcgtttaccctgacttatcttccttcaccggaagtggcgtctaccgtgacttatcttccttcactggaagtggcatcatccagatccc

SEQ ID NO: 69254 - DNA, 942 bp, Glycine max
  Peptide Sequence Number=SeqID_186032
gcctttaagaaagagtttggcggtacggtggatgataagtacaacaacaccttctccagcgtgacgttttccggtggtcacgagcaggacatcctcggcgtgctgaacggccagttcgacggcgcggtgacctggacgtcgctgattggcgattacaacagtggctatacctcgggggcctttggtcgtctgattcgtatggatcacccggatctgatgaagcagatccgcatcatctggcagtcgccgctgattcctaacggcccgattctggtgagtaataacctgcccgctgacttcaaagcgaaagtggtggccgcgatcaaaaagctggataaagaagatcacagctgctttgttaaagcggtgggcggtgcccagcacatcggcgccgccagcgtcgcggattaccagaatatcatcgatatgaagcgcgacctgatgaagggtgctcgcggccctctcccggggggagagggggccgcacgagctaccggacaattccctcgccgctggcaggagagggggccgcacgtgctaccggacaattccctctcccgctggcgggagagggttagggtgagggcaatccctcgccatcaacaaaggatctctcccttgaccgatttcgaacactactaccaacgtattcgccgccagcaaaagcgcgacacgctgctgtggtcgctgctgctggtggcgctctatctcgcggccggcaacgtggcggaattcaacctggtcacggtctggcaatcgctgcctcacttctttgactacatcggcgcgacgctgccgggtgctgcacctgccgctgctgttcgcggacgtcaaaaccgagggttcgctggcttactggggctatcgcctgcactttcagctgccgctgatctgggaaaccctgcagctggcgctgtcctccaccctgattgcgggtactga

SEQ ID NO: 69255 - DNA, 150 bp, Glycine max
  Peptide Sequence Number=SeqID_186033
atgactttatttttcacacgacttcctatcgaatcaaagatcaaacgtggggtgggatatcgccagtcaagaacgaccttgaatggcaatctgaagggaagagacactaaaaatgggttttcctttgccgacagtcccttaccttgctga

SEQ ID NO: 69256 - DNA, 237 bp, Glycine max
  Peptide Sequence Number=SeqID_186034
atggtgaatgagtatgagattgttgtttttcttagacaggtttggtggtatgcgggaaaaagagagggttttgggaggagaatggaaaatgaaattgagaggaagatgaggcgtaaggagtatcgtcagtcaaaaactgacctaagatgtctctatttatatctagggtgcttggcacccatcattaggcaatttgtgaaattccgggacatgccggaaaacaaaagaaaatattga

SEQ ID NO: 69257 - DNA, 312 bp, Glycine max
  Peptide Sequence Number=SeqID_186035
atgaaatcttgggcttgcactagccagagatgtaatgaatccatatggcaatttaagcactcaacacagttcatggccagttctactagtaatttacaatttgcctccttggttgtgcatgaagcaaaaatacatgaagaaaatcctccccgcctggttgccctaggaagagtttatgagggatccaaaaccattcacaacatccctttgttgcttgatcaagtgaaggtcggtgttgaggaggttaaagatgcagatgctcccgttcctgtacccactaacaaggttaacttagtgggggcagacacttaa

SEQ ID NO: 69258 - DNA, 126 bp, Glycine max
  Peptide Sequence Number=SeqID_186036
atgacgacgatggcaatcttcaatggttgcgaggtaacgagcgcagggaagacaaagtcgcgaggagaaagagtttttgacgagcgcaggagaaaaacagggtttggggaattaatgaagcattag

SEQ ID NO: 69259 - DNA, 483 bp, Glycine max
  Peptide Sequence Number=SeqID_186037
atggaggtagcctcactagccgtagatgaagacattaatattgaagtcaatataataactgaagaaatcgatactgaaataaacaaaggaaagtctaatactaagccaacatctcaaatcaatcgaaaagtagaagcacaagatccatcgaaagaagttaataagagagatgaagtgaatcaaaagccaacctatgtaagtaaaccaatagttatgtcatgggagaagcttatagctctttttcacgagttcaaggactattttgcatgggattatgacgacaagtcaggattgagtcgagatctggtcgaacatagattgtcagttcaagaaggaaataaaactataaagcaagctcctcaaagatttgcacatgatattgatttgaagatcaaagaagaaattgagagacttttaaatgcaaatttcatttgtactatcatgtgcaacttatcaaaaagctatgaatttcatctttcataa

SEQ ID NO: 69260 - DNA, 231 bp, Glycine max
  Peptide Sequence Number=SeqID_186038
atgaaggagagtggtagaaaacaaggtaccatgtcgccatgtgcggcgtgcaagcttcttcgaaggagatgcacgccagattgcgcgtttgctccttattttccagctgatgaaccccagaagtttgatagtgttcacaaggttttcggggctagcaatgtaaacaaaatgttaaagagcactcctatgatgatgacaacaccttggcatatcttttgccaagttgcttag

SEQ ID NO: 69261 - DNA, 429 bp, Glycine max
  Peptide Sequence Number=SeqID_186039
atggtgtcgaggctgaaaaggaccccttgttcgtggaaatatggagttggaatagacctgagaggattcgaacctttctctggaagcttgctgctaatgacaaatgatgtgaggcatgctagacatttgactaatgatgtatcttatgggaggtgtgggggagatatagagaatatggatcatgttttcagattgtgtcccattgcatgccagagttgtttgatatctgttattccctgcttcaaagcaccaagtttttatattcaagttttatcctcatggttgcttaaaaatctggaagatgagtctgaggtggatgttgacgccattgccaatagcgttctgtgggtggcaaattttaccaacattcgtgctcctcttgcgaacagagatgtggttcatccagaattgtggtttcatccagaatga

SEQ ID NO: 69262 - DNA, 336 bp, Glycine max
  Peptide Sequence Number=SeqID_186040
atgagcggagtcaccaccaacgtttatttgaggaaaacgttagaaaaaccaaaaatacgaaggtctatggattttgaaaatgagggtttgggagttgcttacttgcagggaagagtattatgtcctgatgtccttcagcacaagcattcacgtattcaaggatcaacacataatatcaccaagtcaatcaatacacaagcgttatgcaacatatacactaagactcaatcctatatgcaatgtggtaccatgttagtgaaaaacctcgtcgggcgcctaggagtacatgacaagacaaaccacacactagcaagtcaggtcactctcactaggtaa

SEQ ID NO: 69263 - DNA, 228 bp, Glycine max
  Peptide Sequence Number=SeqID_186041
atgacaatgtgggtgtcgacggagcggtttctggcagatttcgggcgggaggagaaagagaacaacaatttcaggcaggaggatgacaaagagaagagttggaaaatgccattgtggctgccagtatctatttctaatggagaaagaaagcgtgagttgcaattccaattcatggaaaagttgcggctgctacacgtaggtttcctagtaggggtgaaggaattttga

SEQ ID NO: 69264 - DNA, 165 bp, Glycine max
  Peptide Sequence Number=SeqID_186042
atggcgaaggagagtgacggggctattagggcgtgggagtgtatgtttctgaaacaaggtcatggcaaacgtggaagggtgccaatgcaaacatgctacaacgataggtttttcatccaacgtcatcagtgtctttatcttaattacgattatgccaccgcctaa

SEQ ID NO: 69265 - DNA, 390 bp, Glycine max
  Peptide Sequence Number=SeqID_186043
attgacaaggccactatacttagtgaagcaatcactcatgtgaaaagacttaaagaacgtgtaagggagctagaagaacaacgtaagaagacaagggtagagtcagtgtcatttgttcatcagagatcccacattgcaactgtcaaaggcaccacctctggtgcaatgaactctgatgaatgctgtagaaccaacgaagcactccctacagtggaagcaagagtgtttaaaaaagatgtactcctccggattcactgcaagatacaaagtggcattttgatcaaaattttggaccatcttaatagtcttgatctctccacaatcagcaacagtgtaatgccatttggaagttcaactctagacatcagcattattgctcaggtacactag

SEQ ID NO: 69266 - DNA, 135 bp, Glycine max
  Peptide Sequence Number=SeqID_186044
acggacaagacttccatcctggccaatgctagcagctatgtgaaacaacttcagcaacgtgtgagagagctagagcaattgcaagaagttcaatccaacgttactagcaacgaaggcgccaccagctcttgcgaa

SEQ ID NO: 69267 - DNA, 177 bp, Glycine max
  Peptide Sequence Number=SeqID_186045
atgctcaaaatcctttcccagcttgaaaatgttaatctctctatagtcaatagcagcgtcttacgatttgggaaatccactctcgacatcaccattgttgctcagatgggtgagggatacaagatgacggtgggtgaactagtgaagaccctgagagtagcgatcttgactcattag

SEQ ID NO: 69268 - DNA, 987 bp, Glycine max
  Peptide Sequence Number=SeqID_186046
atggaggagccatgggaaaattggcatcttcacatggaaatggattgcgggaacgatttctcagggaagtgtcacggcactcacgatgacgagttcctcagagacatccttcttcagcaaccacctgcggctttctcgtccgaaagcgaaagcgatcactccttccgccctgtcgtccaaaacactaccatcaccaacgacggcgccgtcaaaagcaacagctctcaaatctcttccaaacgacctcgtcctttgtccactcccaggacttacattctgtccttcgacaactcaaccatgcttccggcctcacccgaaccccgcctccgctcttccaacaataattccccttggcctccggaaagcccaggcccagaacctagaaggcccattactggaggagctaagaagaccagaacctcttctcagaccatcgatcacataatggcggagagacgaaggagacaggacctcactgagaggttcatagcactctcagccaccattcccggcttgagcaagacggacaaggcctctgtacttcgagcagcaatcgattatttgaaacaacttcaagaaagggtacaggaactggagaaacaagacaaaaaaaggagtaaggagtcagtgatattcaacaagaaacccgacccaaatggaaacaacaatgaagacaccaccacctccactgaaacgaactgtagcatccttcctgagatggaagtaagagtgttggggaaggaggtgctcattgagatccactgtgagaaggagaatggtgttgagctaaaaatattggaccaccttgagaatcttcatctcagtgtcaccggtagcagtgtcttgccatttggaaattcttctctctgcattaccatcacagctcagatgggtgacgggtaccaaatgacaatgaatgatctagtgaaaaaccttagacaagtgctctcaaaatcacatttgctaagcgacagtgatccgtactag

SEQ ID NO: 69269 - DNA, 420 bp, Glycine max
  Peptide Sequence Number=SeqID_186047
atgaaagatctttttaagaggtggactgaacatcttgacagcacacgatcaagggtcagccacttaccaccggaaattcatgctggtaagagctactccatggaaaattatcagtgggagcaagagttacaaccctacaatcaatatgaagaagaaagaagttctaatttggataatttgttgatgcaattcaaggaaacaattgaatctactcaaagagcatttaaaagtctagaaattcaagttggtaagctagcaaaagaagtgactaaatttgtggccacaagggaagaaaactttgtagaggttgaagcttatgaggaaagccttgtagaagagcatgattcaagagaaaaagatgaagaaaaaagtgaggagaaagcacaacaatgggatgagtgctcacaagtagaaatttaa

SEQ ID NO: 69270 - DNA, 2187 bp, Glycine max
  Peptide Sequence Number=SeqID_186048
atggatccgcgtctttgtggtccccctaatgaaatccagttggggaatcagagatttgaaaatggtttctttgatcaaagtagggaatttggttacctgcagtccaatctagtaccaactgacacaccttcttcatcttcggtttggactcatgaggaaccttctccggaggattgtgaattttctgatggaattttgagttacatcagtcagatccttatggaagaagacatggaagataagacatgcatgcggcaagattctttggatcttcaaattgctgagagatcattctatgaggtgattggcgaaaagtacccttctacgcctttagggcatccaagttctgttgatccagatgatggtagtggggagcataatttatctgaaaactatggtacttgttcttacaatgatggtgacctcagtagcatttttactaacaattttttgcgacgaaatttgggggaacttcctaaccagaattttcgaggcaatagcatttcacagtcatcttatagctcttcaaacagtgtgaaaagtagtgtggaagggcctgtggactctccaagcagtattctccaggttcctgatctgaacagtgagactcaatccattttgctatttcagaagggtgttgaggaggctagcaagtttcttccaagtggaaatggactctttgctaatttggatgtggctaatttttcaaaactaaagcctcgagtggggagtgatgaattgcctgttaaggtggagaaggacgagggtgagtcttttcctgctggatccaaaataaggaagcaccatcacatggaagaggaggatgttgaagaaaatagaagcagcaagcaagctgcaattttctctgaacctacattgcgatcatccatgattgatataatcctgcttcatagtttaggggatggtaagaagcattttatggcccgccgtgaggctttgcaaaccaagaatgaccagatagtggtgtcaaatggtaaatcaaaggcttccaatggtggcaaggggcgtagtaagaaacaaaacgggaaaaaggaagtggtagatttgagaacacttttggttctttgtgcacaggctgttgcagcagatgactataaaagcgcgcatgagttgctaaaacggatcaggcagcactcaaacccttttggggatggaaatcagaggttggctcatatctttgctgatggccttgaagcccgcttggctggtactggtagccaaatttataaaggacttgttagcaaaagaacatcagctgctgattttctgaaggcttatcatctatatcttgctgcttgcccttttaggaagatgactgcttttatctctaatgttacaataaggaaatcttcagcaaattcaccaaggctccatattatagattttggtatcctttatggtttccagtggcctactttaattcagagactttcactagcaggaggagcacctaaacttcggattacaggaatagacttcccacaacctggtttcaggcctgctgagagaattgtagaaactggatgccgcttggcagcatatgctgaatcgtttaaggtggaatttgagtacaatgctatagcgaaaaaatgggaaacaattcaactcgaggaactcaagattgatagggacgagtaccttgttgtgacctgtttttatcgctgtaaaaatgtgctggatgaatctgtggttgtggacagtccaaggaataaattcctcagtttgataaggaaggtcaacccgaatatattcattcatggcattactaacggggcctttaatgcgcctttctttgttactcgattcagggaggcactgtttcactactcttcactctttgacatgcttgaaaccattgtgcctcgtgaggaatgggagaggatgctaattgagaaagagatatttggcagggaagcattgaatgtcatagcttgtgaaggctgtgagagagtagagaggccagagacatataggcagtggcaagcgcgaattctaagggctggatttttgcaacaaccttttgagcgtgagatagtaaagagggcaatagagaaagtaacgactagctaccacaaggattttgtaattgatgaagatagccaatggttgttgcaaggttggaaggggcgaatcatttatgccctttcttgttggaaacctgcatga

SEQ ID NO: 69271 - DNA, 1413 bp, Glycine max
  Peptide Sequence Number=SeqID_186049
atgggaatgtgcttactgaaccttgatgttgtccactttagcaacctatctggtcaggagcgagatagttactggaaaatgatgcaaaagtatgttggctctgatatcacatcaatggtgacacttccagttatcatttttgaaccaatgacaatgcttcagaaaatggctgagtacaatctcattggttgcaatatattttcacagcttatggagtactcttacctgttagatatggcggacaagactgaggatccatacatgagactagtatatgcttcatcattctttatatctgtctactatgcctatcaacgaacgtggaagccattcaatccaattcttggtgagacttatgaaatggttaaccatggtggcattacatttatatcagagcaggtcagtcatcaccctccaatgagtgctgggcatgctgaaactgaacatttcacttatgatgttacatcaaaattgaaaaccaaatttctcggcaactcagttgatgtatatcctgttggaagaacgcgtgttaccctcaaaagagatggtgtggtccttgatttggtgcctcctcctacaaaagttagcaacttgatttttggacgaacttggattgattcaccaggagagatgatcctgacaaatctgactacaggggacaaagtggtgctgtattttcaaccatgtggctggtttggagctggtagatatgaagtggatgggtacgtgtataattctgctgacgagcctaagatactgatgactggaaaatggaatgaggctatgaattatcaagtttgtgactcagagggagaaccacttccaggcactgagttgaaagagatttggagagttgctgataccccgaagaaggacaagttccagtacacgcattttgcacacaagattaacagctttgacactgctcccaagaagttgttggcatctgactctcgtctacgtcctgatagaatggcccttgagaagggtgacctatccacatctggttatgagaagagcagtttggaggagaggcaaagagctgagaagagaaaccgagaggccaagggccataagttcactcctagatggtttgatttaacagatgaagtaactcctaccccttggggtgacttggaagtttaccaatacaacggtaaatatacccaacattgtgctgccgttgatagttctgagtgcattgaagtgcctgacatcagaccagaattcaacccttggcaatatgataatttggatgctgaatacgcactcttaagtgacaagacaaaggaagacaccgaacccaatataataggacattctcttgggattggtgagggtgatttgagggcttttcatgacaatgaaagactagttcatccattgttggagattgggggtttggtgcactag

SEQ ID NO: 69272 - DNA, 1821 bp, Glycine max
  Peptide Sequence Number=SeqID_186050
atggtgttgcagaagaggttgaactatggttttaatggctatcaggtgcctgtcattcctagagcttcaaggtcagctagagggaggggcacaatcaagaagaaacccgacaacaatcagatacaggcttttgaaatgttggctagcgtagcgggcaactttttgcagaagaatgagagttctgatcctaaaaatgttgtgtttgtggaagatccttgctctttctgtggtactaacataaaggacaaatatgaggatgaaaggaggtcatttatgagggactcgtttgaccatggagcttgcagtgaaattgcctctgcctttgtcccaagtatgcaagggaaacatgacaaccatagaggcatgggggattcatcttttcttgacaatcatcttgaaggccaaggacaaaatgtccttgagagggaagatgaaaggatcaaaaggagaagtgtaaatgggaaaaccatccacattaaaggttgctccgatgggttaatagaaccatgccacaaagtatccaaacattgtagtttagctaataatgcggaaaaaccatcgttggagtgtcgcaagcatcttgattcttttcccaatggttttacttctaggaaattagttaatagagatgatgatgaaaacttagttaggtgcacacaactgaactccaagaataataatacatctggcgcaccacctgatatgccaaaattgaaggatgcaagtcctattatgagtgatgagaacaacagtagggacattttcgagtttgaaaatttacaacggatgtatccatttaagaagaggaaattcttcaatcagaattcatcttctacatctgatagggggtctcaatgtcaaggcatgtttgattcttctgacaccaccagggttaatggcacaaaccatgcaattgaagaatcgtcctctatagttggtcaacaagcacattctgggtccagggcttgtaatgtgaagctcagcataaaatcctttaaagtcccagagctttttattgatataccggaaactgcaaccattggttcattgaaaaggacagtaatggaggctgtgacaactatacttggagatgaattacatgtgggcatccttcttcagggaaagaaagttcgagatgatagcaaaactctaatccaaactgggatatctcaagatgacaaacgtcatagattgggatttatgttggagccaaggcatactccaatttctccaacttcatacaatgatgacccttgttttctaaccactagttcgcgaaaaaaattatccaggcaatcaacatctttaacattacaacaaggaacgtataatgtatccaaagaacgttctatgatcaaaattgaaagttgtgctaagggtgatcttaatatagtctcctctctggaagatacttcaactaacaataacatgtcaaagtgtcgtgctctagtggcagttcctgccattaacatggaggcattggcggtggttccattctggcgcaaatctggaaatcctgactttgcacaacgccgaatcaggaggccattctctgttctagaagtagaagcattggttcaggctgttgaaaaacttggaactggaaggtggcgtgatgtcaaacaacgtgcttttgatcacgcaaagcatcgaacttatgtggatttgaaggataagtggaagacactagtgcacactgctagaatctccccgcagcaaaggaggggagaacctgttcctcaggagcttctggatagggtcttagctgctcatgcctattggtctcaacaccagtgtaagcatcaacttaaaccactgtga

SEQ ID NO: 69273 - DNA, 261 bp, Glycine max
  Peptide Sequence Number=SeqID_186051
atgaagagtatgtccactcttgtgtattatgatggtgatatgattccatcatatgaagggatagtgtttgaattccccagtaatcctaaagtcatcacaataaaagcaaagcttcatggtgaatcaaaggtgattcaaaggtgttttgatgataacaatgatgatgacaaaggtgatgacaaaaagctcaaagatcaatcaaagaacaaattcaagagttcaagaatcaagaagaattcaagactcaagaagaaagtctag

SEQ ID NO: 69274 - DNA, 177 bp, Glycine max
  Peptide Sequence Number=SeqID_186052
atggctgccattgttttcatccacattgcatcattggtctctctttttgttgcaacaagtgcaagaatccctggagtttacaccggtggcccctggcagagtgctcatgccaccttctacggtggcagtgatgcttctggaacaatggctaatgtaaccataattgcgattgcataa

SEQ ID NO: 69275 - DNA, 363 bp, Glycine max
  Peptide Sequence Number=SeqID_186053
atggagcagcagaagctggcacaagcaatggtgggggcgggggagaaagaaaaacacagaagcagccatgggaccaatgcaaaccaaaacacaaaacaatacacaatagctaaagacaaaaaacaagaggaagaagattcactaacctcaaaggcgaaaccaccacagcaagaaaacgcaccatcaccaacaagaagaaaagccataaccagcaaccacggacaaccaaccaccacgcgcgaaaaagaggaagaagaagcagttcgaaagaagaagaggaagaagaaacagtgcggaaagtggataatgaatagtgacttgtacggacgagtcactatgcgttttttatatgaaaggatgtag

SEQ ID NO: 69276 - DNA, 747 bp, Glycine max
  Peptide Sequence Number=SeqID_186054
atggtgaactggctacggaacatgggggctctggatgtgaacaaagtggttcacagacaccagggttggcgcctcatcacttgcatgtggttacatggtggaatattccatctgttggcaaacatgtttggtcttctagtcattggaattcggcttgagaaggaatttgggttcgtagtattgcagtgcttattggactgctatttattatttctgaatttggaggtagcttgctttctgctcttttcattggggaaagagtctctgttggtgcttctagtgctcttttttgacttactgggaggcatgctttcagaactccttactaactggtctttgtatgagaaaaagctaggagctctcttcattgctatcaacctagcagtgggggttctcccacatgtggacaactttgcccatattggagggtttctttcaggatttcttgttggatttgtgttcttgatccgtccccaatttggatggattaagcaacgaaatgctcctcagccacattctccaacattaattaaatcaaaattcaacaaatatcagtgcatctcctggatcctagccctgatcctgctaatttttgggtttactactggcctgatttcacttctccggtgtgttgatgcaaatgattactgctcctggtgccattatctgtcctgtattccaacttcaagatggaactgcaatccgaaagcttcatcttctgttgtgttagtaaggaattgggagtga

SEQ ID NO: 69277 - DNA, 291 bp, Glycine max
  Peptide Sequence Number=SeqID_186055
atgctaaagctagacaaacagggatgggaggagaatgctctcgggcggaaaaaacaagtgaaagtgaggggagagatggtgtgggagagtgaagcatgtgtttgtgcacccaagaaggaacaaagcagggggagtgagggagcaaaggaaaaggggttagttgaggagggccctaaactgaaatgttacccatataggggaaggccaataattgttggaggagggtttgtgaaagggagattgtatgctcaaatggtgataaagagaataagggaaggacaaggtagatga

SEQ ID NO: 69278 - DNA, 147 bp, Glycine max
  Peptide Sequence Number=SeqID_186056
atggagattctctgggacggactgcactggatcatagctgctttatcgttttgtgaccttcttgctcgagagcttgatgaaggtagaactaggaatagagactattccaagaactacatagccttagggattctaatggaagaatag

SEQ ID NO: 69279 - DNA, 3210 bp, Glycine max
  Peptide Sequence Number=SeqID_186057
atggagcaagggagcacagacactcgtgtggatgcaaacccaagtctttccagtcacgaagaaatacaatctttggatttcgatactgagtgtgagaccaaaatgaccaactctgctggaaatggggcaggaggttcttcctatgttgaagaaggcgtgagaaaaaagcgcggcagaaaaagtaaaaaggagatgggaaagatgttagatgctaccgccatggaaggtggggtttccgagcagagacccagtagaaaaagaaagaaatatgatgaaatggctgaatttgaaatgtctggcactgagaaaaaatatggtcttaggggctgtaaacaagagatggagccaaaagccaacaggagaaaggccaagtgtgatgaagagggccccttaacgtgccatcaatgtaagagaaatgataaaggcagggttgtgaggtatcctcatttgaaagagaatgatattgctgagaaatgtcctgtgtgccgtggtaattgcaattgcaaagcatgcttgagctgtgatgaacttattaagcaaatgagggagtttgcaaaagctgacaaagaagagaaggttgaactctgtatgtatttgctgcaagtacttcttccatatttacggcagttggatgaagaacagttgattgagaatgagacagaagctaagatacaagggctctcagtctccaagctaaatttagctaaggcagattactctatggaggagcgtgtgtactgtgacaactgcaaaacatcaatatttgattaccatagaagctgcacaaaatgctcttttgacctttgtctcatctgttgccgtgagcttcgtggtgggcagcttgtaggtggtgcagatccaatagagttggagtttgtttggcaaggtcgtggttacttgcatgctgaaaaaaaagatgaagaggtaaaacaaaatgcatcagatgatgattgtaagcctgaggttcgtgaatggtcaagatctgggtggctggcacaaagtgatggtagcattccttgtccaaaagtcaatgatgaatgtaaccatggttttcttgaactgagaagcatattgggtcaacattttgtctctgagttagtgtgtaaagcaaaagaactagtgcaagcatacaagcttcaaaatgtagttaagaccgcagacaacttctgttcatgtttgaagcttgatagaaacacagatgttagctatagtaatatgaggaaggctgcttctcgagaagatttgactgacaactatttatactgtcctaaagctgtagatcttcagtacaaggatttaaggcattttcagtggcattgggaaaagggggagcctgtcattgtcagcaatgtgcttgaatgtacatctggtttaagctgggaaccacttgtcatgtggcgtgcattacgtcatgtaactaataccaagcgtggccaacatttggctgagaaaacaattgattgcttagattggactgagggggaaattaatatccaccaattttttactggctatacaaatggtcgtaaggattggcttgcttggccacagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtaaatgtgttgactcatattgctgaagtgaaactggattctgatcaacttactatcattgagaagttgaagcaaaagcacctcgagcaagagaaaagggagctacttggtgatgatcaggatggaggaactaatgttgacatgcttaataattcatcttctacaataaatgctttggacaagcaaagtagtgttgaagtcatggaacaagaaggtggattatgtgatgggaaagaagttgatcagtttcatcaaccgtctcgtagtaatgaggttgccattgctaatgaggatggtatttcatatggatcagagctcatagaggatgtccctaagttgcaggaatatctgaagaagcatttcagagagtttaggcatgtccattgctgtcctttaaagcagggtaaggctgcgtacaacatccctcccccataccttcgcatagcgaagagcctctgggcaatggggtacgaggttattcatcccatccatgaccagaccttctatctgactatggagcataagaggaagcttaaggaggagtatggaattgagccctggacttttattcagaagttaggagatgctgtttttattccagttggttgtcctcaccaagtcagaaatctgaagtcatgtatcaaggttgcaatggattttgtgtctcctgaaaatgttggggagtgctttcgtttgacggaggaatttcgcacacttccaattaatcacaggtctactgaggacaaattggagtgtaaaattgcttttgctaagcaaggtggaaatgggactggtggcaatgaggcaggagtatggggtttaagtggaggtagtaggataaactcaaagaacagttcaagagatgaagaacaagctagcatcggtgattttgttggtgatgacagggatggaaaaaggaaaagggtagaagggtttccaaacgttagagagaatgagaaggaattgaagtctccatttgtactgtcttcgtacgattcctttttctccctccatgaatattatctcgtaaattccaatggtgaagctttgggtttctgcgggaaaggaaaaggctatgatgcaaagtgtatttctctcagctctgacatgatttcaaaattcccgacggtgaaaaggcttggaattgagttgcaaacttggtgcttaaatttcacgatgatccaacgagatccaaaggatgagttgggtagttgctttggtccagcatacaagccaccatcttacaataacattagactgaagcttctgaagaaaaaagttgtgaggacagataagattttggaggagcataggactatttggaagaagactggatgtaccatcatgattgatggatggattgataggagcatagggaaatgtctttttgagatcaattga

SEQ ID NO: 69280 - DNA, 216 bp, Glycine max
  Peptide Sequence Number=SeqID_186058
atgggtattcagtctaccttaaggcatgtgattggaagtgttcaaattatgagctacttttgtcggcttgtcatgggtgaagaaaatgacaatatatgcaatggaagatgtgattggaaagttggagaaagcaaggctcttgattcaattatcgcttgtgaaattgaagattgttattcaatttacaggtccgggttaaccaagggtccagagtaa

SEQ ID NO: 69281 - DNA, 1884 bp, Glycine max
  Peptide Sequence Number=SeqID_186059
atggcacttagagactctgtgttgactatagagaccttaataagtagacaattaaggacaggttataaccaagtgagaatgaaggatagtgatatccataagactgcatttaagacacatggaggccactttgagtacttagtcatgccatttggcctaaccaatacaccaaccacattccaagaaagagttgagtatttaggccattttatcacaaaagatggtgtgtcaactgaccctgcaaaaatcatggctgtcaagaactggccaataccaacctccttgaaacaactgaggggatttttgggacttgcagggtactatagaaggtttgttcgagggtttggtgggattgcaaggcctttaaccaacatgttgaagaaaaataatttccactggtctgacgaagcaaaagtggcatttcaatccctcaaggatagtctgattcaatcaccagtattagcattacctgacttctctaaggtgtttgtggttgaggtggatgcttcaggaactgttagcagtagtctttgtagtccaaaagtggaggcattatctattgaatactcactttattatcagaacagaccacagaagcttgcagtatatactaagccaaaggttgacgacatccttccaacagaaatggctgatcttgacattcaaaaattgatccaagatttgcaaaccgatgcttcttcacataaacatcatacttggaaccataatgaactcagaaggaaagggagattggtagttgggaaggatctaactttatggactgatttgctacaatggatacatgctggtcctactagtggccactcgggtagggaagccacattgaagaggttgaaatcagttgtatattggagaggcatgaccaaggatgtcagaatttttgtgctcaactgtgaagtttgccagaaatgtaaatatgacaaatttgcctattcgggtttgctacaacccttaccaattccagagaggatatggcagcatatcaccatggattttattgaaggtctaccaaattccaaaggaaaacaagtgatctatgtggtagtggacatattaattgctcaatccttcttggacaatgtgttcaagttacatggttttccaaactctataaccagtgatagggaccctatctttgtcagccaattttggaaggatttgatggcctttcaaggggttcatttacaactctcttcaacttatcatccacaaacggatggccaatccgaggtggtgaatagatgcttagagacattcttgaggtgtatgtgttgtgatgttccccatgagcggtctaaatggcttccgctggcagaatggtggtacaataccaaccatcacatttccatacagtgcagtccttatgaggttatgtttggccagcctcctccaatttatcttccttatttgtcgagtgagtcaaaggtggaggtaattgatagaagtttgcagaaaagagaggaggcattaaagttagtaaaatttcacatgaagcgggctcaggagagaatgaagcaattagcagataagaagagaagtgacagatcgtatgagattggtgattttgtgtatgttaagctccatctatacaagcagatttcagtagcattcagacctaatgcaaagctagcacctaaatactttggaccatttcaaatcgaggataaaattggggctatagcttacaagctgaagttgccacaggggtctaaaatccatgatgtttttcatgtttcacagcttaaaaggcatgttggtgaagcaccagtttcaaatttccttcctacagattccgatggtgttatggtaggcaaagaacctgaactaattctggatagagcaaggttgtcacaaaggtcttag

SEQ ID NO: 69282 - DNA, 126 bp, Glycine max
  Peptide Sequence Number=SeqID_186060
atggctccacctaaagaaattgcgactgtcatttactacaacggtcacattgcagacaacccagttcagggatcggtgtacacatggtcagacacgttatatttaagcacaactactcaacaatga

SEQ ID NO: 69283 - DNA, 231 bp, Glycine max
  Peptide Sequence Number=SeqID_186061
atggagcttccatgggaagctaccatggggagtgatgttgacttgggtgcgcgacatggaatcaaagtcagcataggaaaggaatcgacatgggggcatctgtcgatggtgactgcaccgaagaagaaaatggggagcgttggctggcctcaaggcaatcaaagctggatgaggaaaggtcgacttccaccattggagggtggtagggaagggacagaagcacaagactaa

SEQ ID NO: 69284 - DNA, 198 bp, Glycine max
  Peptide Sequence Number=SeqID_186062
atggacaaggactgctgttttttaaaagtagtggtaatgattgatccaggtggtattgttcaccattttcaaaccatgaacaagtcaaacttactatcttcagaaactttacccaaggaagatgaaggtgcagatgatcaagatgcattggttgactctttagatgcgatgcctgacgaggaggaagatcctgaatag

SEQ ID NO: 69285 - DNA, 295 bp, Glycine max
  Peptide Sequence Number=SeqID_186063
atgcggtaccaagtccatgactgcaatagtatggcacaaccactcataactctaccaacctccgatgatgcctggcatagttctttgtatagcaatggtgagtgcaagatgctcaacaaccatgtcagcttcaatgcagctcccttacgtgcattttcaggagggacttcccctagcctccattgtttaaccaatgcagtgatcaatgctggatcaatcctgcactattcgattagggaaatatgttggaacccggtagatgataataatggtataatttatggttctgattcag

SEQ ID NO: 69286 - DNA, 1074 bp, Glycine max
  Peptide Sequence Number=SeqID_186064
atggaggagccatcggaaatcatcttcgacgacaacgtgcaaaatagcattgagggatcacttctagaagtgtcagcaggagtggccatgacgtcagctcaaatagcaggagctcatcagcctccatatccgtcgcttctcggagtgaggggtgggtttggttcagtttttaagggctggattgatgagcattcacttgctgctaccaaaccaggaataggcatgattgttgctgttaagaggcttaaccaagacgggttccagggtcacagagagtggttggctgaaatcaactatctcgggaaactacagcatcctaaccttgttaggttaataggatactgctttgaggatgagcatcggcttctgccattctcttggagtttgcgaatgaagatagcacttggggctgcaaagggccttgcttttcttcatagtacagaacctaaagtcatataccgtgactttaaaacttcaaatatcttactcgatacaaactacagtgccaaactttctgattttggcttggccagagatggtcctactggtgataaaagccatgtctctactagggtcatgggaacccatggatatgcagcaccagagtatttagcaacaggtcatctcactaccaagagtgatgtgtatagttttggagtagttcttttggaaatgatatcgggaagacgagctatagacaagaatcagccaactggagaacataaccttgttgattgggccaagccttacctatctaataaacgaagagttttccgtgtgatagatccccgtctcgaaggtcaatatttacagagtcgagctcaagccgcagctgcgcttgctattcaatgtctctccatagaggctaggtgcaggccgaatatggatgaggtggtaaaagcgttagagcagcttcaggaatcaaagaacatgcagagaaaaggcgctgatcataaacagcatcatgtacgcaattccggtcctggccgttccaacggtggcaatggtggttcagatgtccctagaaaggcttctgcttatcctagaccttctgcttctctcctccgcggttga

SEQ ID NO: 69287 - DNA, 702 bp, Glycine max
  Peptide Sequence Number=SeqID_186065
atgagagaggcgattgttgaagaatgtgagtgggcacgaattacttcctctaatctcaaatataagaggaaaaaaacatggcacgctaaccaagggtttgtttcagttagtttaagagtgtttttgtgtgatggtgacaacaatgataatgatggtaatgttagcaacaacgacgacgatagaaatatcagtgatggtctcaattgcagtagtggtgacgacggtggtggagatgacgttggtggtagcgatgcagatggtggtgacattgacaatgtagtggcgatagcaatgttggtggtgacagttaatggtggggatgttggtggtgataaaggtggtattattgataatgacaacaacattggtggtgacaatgataaaaatggtattagtggtggtggcggtggtggtagcaatgtcaattgtattagtgacaatattggtgacaacgatagtggtggtcatgtaatggtggtgataatgacgatagcggtgatagtgactagagcggttacaggtttcatgggtgtgggcttcatggggcaagcttaccgcatgcccatctctagcagtgataccaatggtgttagtggttgtggtggtggtaataatgctagtgacaatgatatcctaatgatagtggtgatgataatgtcgataacaatggtagtgataacaatacggtggtggtggtggtga

SEQ ID NO: 69288 - DNA, 3720 bp, Glycine max
  Peptide Sequence Number=SeqID_186066
atgcttactcttattattcagatagtaaaagaacgacgctttagtgggctaactactgctgaatgtttgaaaagagaactaatttataagttatccattggtgatgccactcatagtcatttggttaagtctcttcctcgtgatctctccaaatttgaacaacttcaagacatcttggatacagttgctgtttattccaatccatctggatttaatcagggtatgttttctttgcgatggtcattttggaaagaattggatttgtatcatccacgttggaattcaaaggatttacaagttgctgaagaaagatacttgcgcttctgcagtgtctctgcactaaccacccaattgccccagtggaccaaaattcatcctcctctaagggggatagccagagtagccacttgcaaagttgttctacatattatccgtgctgtgctattttatgctgttttcacttttaaatcatctgaatctcgtgctcctgacagcgttcttctacctgctctacatttactgtcattatcattagatatctgttttcaacagaaagaatctagtgagaatacatgccatgatgtgtcacatcttcccataattgccctctctggagaaataattgagagttcttttggtgaacaaagcttgttgtcacttcttgttttattgatggaaatgcacaggaaggaaaatgtcgacaactttgtggaagcaggtggttgtagtctatattctctgattgaaagcttactgaagaaatttgctgagattgacaacagatgcatgaccaagttgcaaaaacttgcccctgaagtagtcagccatatttctgaatgtgttccaactagagactcaagtgtctcatcgtcggcttctgatagtgagaaacgcaaggcgaaagctcgagagaggcaggctgcaataatggaaaaaatgagagcccaacagtctaaattcttggccagcattgattccactgttgatgatggttcacaacttggtcatgaaggtgacttagacactgagcaagatgtagaagaatccgattctaaacaagttgtttgctccctttgtcatgaccacaattcaaaacatcctatctcttttttgattcttcttcagaaatctaggctcgtgagttccgttgacaggggtcccccatcatgggcccaactttgccgatcagataaagatcggacacctatcatcaacaccaacgagatggatacattgcctattaactgtaattcagttagtttgggatcaacttcatcttcccacttaagtcaatttgttcagaatgctgcaaaagaattagcttcttgtgggaaacctggggaagttcttacttttctgcaatatgtcaagaataagttcccagctttgtcaaattttcagctcccagacacatattatcatgataaagaaaatacaccatatacttttgagactttagaacagggtatgtacttctccgtgcgtgatgaaatgcatgatcttctgctatcttcgaatttgttgaatgaggatgagaaagtttcaactgtgggagggaattcaaattttataatagacactggatctgtattgcttgggaaatatacagccgatcttgtgcaagagatgtcagaagtttcttctgtgtctgaaaatgcttctaatgagactgcttctgtagaatcaacatcacagcatccagcatatgatggatttggccctacagattgcgatggagttcatctttcttcctgtgggcatgcagtacatcaaggatgtcttgatcgatatttatcttcattaaaggaaagatctgtcagaagaattgtttttgaaggaggacatattgttgacccagatcagggagagtttctctgcccagtgtgccgcagacttgcaaattgtgtcttgccaactttacctggagaattacagaagcctttcaagcagtctaccatcttgagtactagttcaataaatactgcaccccccttagctgaattgagtgaattgacttattcacttcgtctccatctaggcttaaagcttctgcaatctgctgccaatgcagttgggaaggataaattcctaaatgctattcctttgcatcacattgatagaactagaacaaatcttgaaaagttcatatgggggctttctaaaatgtattccccttgcaaagaagaaaagctatcaagattttccagactaaaccactcaatgctgatgtgggacactctcaagtactctttgacatcaatggagattgctgcacggtgtggaaagacttcttttacaccaaactttgctcttagtgcattgtatgaagaactgaaatcttcaagtggctttatattatccctgatgctgaaacttgttcaaaagacacgaagtaataattctcttcatgttctacaaagatttagaggtgttcaactcttggcagaatcaatttgttctggggtttccctgaattacgcaaataatgacgagtctgggagaggtgatatgttaagtatcttaaagcaaattgaaatggacttgtcaaacaccaacattagcttttggagtcaggcttcagatcctgtactcctccatgaccctttctcaacattgatgtgggttcttttttgtctaccacacccatttttgtcatgtgaagaatccttgttatccctagtgcatgttttctatatagtagccgtaacccaggctataattttgtattatgagaaatctaaagataaaccatcaagggaatcagctctttcagattgcctgattaccgacatatataacgttatggatgagtctggatatgcccaacagtactttgtgtcaaattattttgaccccaatgttgatattaaaaacgctattcggaggtttacttttccttacttgagaagatgtgcgttgttgtggaagatactctattcttctatcccagcaccattctgtgatgaggaaaatatattggatagatcatggaatgccccaaaggacataatggactgggccaatattgagatatttgaggtcgctaaaattcaagagctcgagaaaatgttcaaaattccctctcttgatatggttctcaaggatgaactttcaagatctacagtctctatttggtgccatcatttttgcaaggaattcgacttgcgcagaattcaacaaaatatgcatgtaacacctgctgttccatttgagttaatgagattgcccaatgtttatcaggatcttttgcagaggtgtatcaaacagcgctgccctgaatgcaaatcagttcttgatgaccctgctttgtgcctactgtgtggtagattgtgctctccaagttggaaatcatgctgcagggaaagtggatgccaaactcatgctgtaacctgtggagctggtactggagtgtttctgttgattaagagaacaacaatcctactacagagatctgcacgtcaggccccctggccctctccttacttagatgcttttggtgaggaggattttgaaatgcatcgaggcaagccactttatctgaatgaggaacgctatgcagctttgacttatatggtcgcttctcatggtctggaccggagttccagggtccttggtcagaccactattggttccttcttcctggagtctgttaatgaaggagttaggttagctaggtgggctgggatagtagaagaaattgggcatattttgcctatataa

SEQ ID NO: 69289 - DNA, 390 bp, Glycine max
  Peptide Sequence Number=SeqID_186067
atgaggctagatcattatagagtgataaaaactaaatgcacaggtgatgcagcagttctcaaggaaattattgagcatgacagagtctacgacttccttgttgaatggggacaaaagggagagaggtctgcaaggaagaatgaacttactcatgttgctgttgctggaacaaatgaagagaataagcctgaatccactgatcttgatcaggaagagatagaaagggataagcatttgaggatgatgtttggacatggtagagtatcgaatgacctctactaccttgaagaatcaaatctgtctactatggttaagaacagtttaccacatacattcatgtctgattctatgttatccaacaaaaagaattttctttatcattgttggtaa

SEQ ID NO: 69290 - DNA, 234 bp, Glycine max
  Peptide Sequence Number=SeqID_186068
atgaaggttgacgcgcgcgtggtgtgggacgatgaggacaaggccatgcttggggctgtttgggcgagtgctttaatggcggttgggagtgaggaggggctgcagaacaagctctcggatctggtggagcatcccaacgtctccaatttcagttggaactactccattttctggcttctgggttggggagacgggtgctgcaggaaacccagcgaggaagaagaggaacactga

SEQ ID NO: 69291 - DNA, 372 bp, Glycine max
  Peptide Sequence Number=SeqID_186069
atgctaggtgcacccagcaatattgctggtgcacccagcaattcaatgaaaggtcaattttgcccttcagttaaaaaaataaaaagcattttttttcttcccggaagcattctctctttttctcactgtgtctctttcgcaaaaagcttcttctcttctctcttccccgacaagcttcttctccgcgagcttctccgacagcccttggacccatttgctttcgaggtaggtggccttcttcttagctttggttttgttatgcactacattaggacgaaacctagggtagaagacgagaggggagaagacgagaggacgccggaaaaaatggcggaaatcgctgacggaggagtcttccggaagaccccttag

SEQ ID NO: 69292 - DNA, 174 bp, Glycine max
  Peptide Sequence Number=SeqID_186070
atggtggaggttcacacatgggggcgtcaggacaatgttgacaagaacatagcggcacaacacaggtatagggaaggagagctaatggcaaggcacatacgggtggattctacatgttacgacaacgcgagattggacttgacaagatggctaggaggtcatcctgttccttga

SEQ ID NO: 69293 - DNA, 105 bp, Glycine max
  Peptide Sequence Number=SeqID_186071
atgggtgctcaaagctcaaagctttgtacgctgccagttaacaagttgattgtgctttatgtggttttcaagctttacgtggttctcaaagctcttttcctttaa

SEQ ID NO: 69294 - DNA, 681 bp, Glycine max
  Peptide Sequence Number=SeqID_186072
atgcacgaaacgtcgccgtttcttgcagaggtttcgtgtgcgaggaagggtctgaccctgacaatgaccctcaccttggaaactgagattagagcgttggggagtttcttgggagtgcaagatttgatggtgggttttggagtagcagccatagaagacagaaaaaaaaaggattactccaaaaagagactcaattttaggaagatatttatatttttaatagcaaaagatggtggtatctcatcgagggttcgaccaaccatcatccgatttggacacatcgatgatgatgatgacaaagaagttgatgatgcgatagtggttgaggagtcgcgagagaacaacaacgatgagtcagagtacaattacaatcatgttgtgtatcaagattcacaaaggtatgatagtgagaatctttcgcttgaagacttgtttgataatgatggattgactcaagatagttgttttgaggtcagctctaaagagaatagagaattcatgacaaatagaacagagtctttgagtgaggttgaaaatggagcatttggagagtctcaaaatgaagaagcaatgaaatcaagagtcaatgaaatccagaacgaaggggtggaagaagtaaagattgaagatctcaaatgtgttttcgatttgaatgaagtcccaattgaagggtgcaagtaa

SEQ ID NO: 69295 - DNA, 1614 bp, Glycine max
  Peptide Sequence Number=SeqID_186073
atgggggctgaggtggtggatttgaagaagtttattcattcttgggacttggattccttaaatttgtggtacctagttggaaccgaggaacaaccaggcttgatgccactggcaatgtccgcgatcctgtctatttgccagagcactggctgcacagcacagatttcatactacgaagtctacatggaccgatgctacgacctcttggaggtcaaagcaaaggagatttcagtttgggatgacaaagacgggcaaattcacctccggggactatctcaggtttctataaacacaatgtctgaatttcaagatgttttctcttgtggagttcagagacgcaaggttgcacatacaggcctcaatgatgtctctagtaggagccatggagtgcttgtgatatctgtgtccactccttctgctgatggcactggaactgttgtatgtggaaagttgaatctcatagacttggcaggtaatgaagacaacagaaggacatgtaatgaagggattcgtctccaagagagtgccaagataaaccagtccttgtttgcattgtcaaatgtgatatatgcattgaacaacaaaaaaccaagggtaccctaccgagaaagcaaattgacccgtatattgcaggactctctaggcggaacaagtcgtgcactgatggttgcttgcctgaatccaggagaataccaggaatctgttcatactgttagtttagctgctcgatcaaggcatgtttctaattttgtaccttctgctcataaacaagagaccccaaaagttaaagttgacatggaagcaaaattgagagcttggctagaatcaaaaggcaaaacaaagagttcacaaagacttggaccattaaattctccacttccgaaaaaaactcccagttccattgttacccctgctaagagatccattacctttaacagttcagtgaagaaggggggaagaactgctatcaacctagatgctcaacatactaatgaaagggcctttgctgtagcttttggaaatttactagatgttgaaggttcttttgattcatgcatggagaatgcgccatctggtgtcaaggaaaatgatgacaaagggactgagcatgatgccaataagcctgcatggaaatcatacaaaaatctacctgttgagtcattgagcaagggagtgaactcaattactattaagagtaaagatgcagcacaaagtcctttaagaaaagccctctcccccatcaacatcaatggtaatcagaaaccccttgaatcacaaacaccttttctggcaacctgctccactaataaagggccacaaaagaatgacactccacttggcaaattcagcacacgaagttctacactgaagaactgtctagttcaagaatacattgatttcttgaataatgcaagcagagaggaactacttgagttaaagggcataggagagaaaatggcagaatacataatagaccttagagaagaaagtcccctaaaatcgttaaatgacttggagaagattggcctctcttccaagcaggcccataacctgttcacaaaagctgcaaaaacactatttgaagataaagctgaagattcaatactcagttga

SEQ ID NO: 69296 - DNA, 138 bp, Glycine max
  Peptide Sequence Number=SeqID_186074
atgacaaaagttagtaatggttattgcaatgattattacttaagattctatgaaaaactatggaaatccaaatgggtggatgtaatggaagcaggacattgggcagatgtgacccgatttgagaatttaacaatctaa

SEQ ID NO: 69297 - DNA, 1809 bp, Glycine max
  Peptide Sequence Number=SeqID_186075
atgggtaaccgaatcggtaatctctgcctctgttcgtccggcgacgcctccgggaggttcgagaacagagcttccttcctctccaagcaactccagaattccctcggaaactccatctgctatgtgagatctgagacgtgccggttctccgacgatgacgtcaccctcttgactttccggtcggtctccggcgccactgtgagtgcaaacacatcggccacgccttcaacttcgctcgacgattcgcttcaacacagcgtcgttttggattcctctgcttcgtttgagagctctggctccttcacttccaccttagtgccttttcaaaatcaacacatgccccgtggattctctgtggaaggctccacggaaagagggttgtattcgggtcttcgtgatagtgtgatgaacggtgaagggtccattgagaaaggttcttctgaggtagcaataaagaaggggaagagaagtaaaagagatttgaaaaaggttttgagtagagcgtttttaagtattaggagaatatcaataaagaaaaatgataacgctaatgcgagagtaagttgcagtactagtttgagtgctgagatgagtttgcatggttctgagggtgataatgataataaatatttggatggtgatgagtgtgatgtgctaatggggtgtgagaatcttcattgggcacaagggaaagctggtgaggatcgtgtgcatattgtgatttgtgaggatcatggatgggtttttgtggggatttatgatggttttaatggccctgatgccactgattttcttctcaacaatttgttttatgctgtgaatgatgagctcaaggagatcttgtgtggtcacaacaagtttgaatccatggttatggattcagacactttggagttagatgagaatgtgtttttatcatgtaatggaaatggaggggctgatggtggttgttcttcaagtgaaaataaagaaaactatccaatagaaaatgaagagttaaatttggaatgtgcatcagaaggagaagagggaatgaatgggataaatagtgaaaaagtgggtttgagtcattcagatgtgttagaagctctttccgaggcattgaggaagactgaagatgcatttatgaagaccgttgatgagatgattggtcacaaccctgtgttggctatgatgggttcatgtgttttggtgatgttgatgaagggtcaagaagtttacttgatgaatgtaggagatagtcgtgcagcgttggccactcacactggggaatctcttcagctcaccatggaccatggcactcacgtgaaagaggaggtttacagaatcaggagggagcatcctgatgaccctttagcagtaaccaaaggccgggtgaagggtcacttgagtgtcacaagggcttttggggctgggttccttaagcagcctaagcaaaacaatgcagtgttagagactttcagggtcagctacataggggaatctccatacatcacatgttttccttcactccaccaccacaagctcagcacaaatgacaagttcctcatactgtcttcagatggactttaccaatacttcaccaatgaagaagctgctgccaaagtagagtcattcattaccatgtttccggatagagatcctgcacaacttctcattgaagaagcactaggtcgagcagcaaaaaaggctggtatggagttccatgagttgcttgatattccacacggggaacgccgcaattaccatgatgacatttctattgtcataatctccttagagggaaaaatatggcgttcattggtgtaa

SEQ ID NO: 69298 - DNA, 1588 bp, Glycine max
  Peptide Sequence Number=SeqID_186076
ccacccattctccaccgcgaccgctgccgccatcaccgccaacagcgtccccgccaccgccgccctcccctcttcgtccttcagaagtcagcccccaatctacccctggccccgccgcctcaccccccacaacctggcctccctcatctctcgccagcacgaccccgacctctccctccaaatctttcaccacgcccacccctccctctcccacgcgccccagcccctccacgcgctcttcctcaaactctcacgcgcccgtcgcttctaccacctcgaatccctcctcacgcacctccccaaccccccgccggagccccctctcaccacccttatccgcgcctacggcctcgccggaaaacccctctccgccctccgcatcttcctcaaattccaacccctcggcgtcaggtccctcaacgctctcctcaacgcgctcgtccagaacaaacgacaccgtttggcgcattccgtgtttaaaagttccaccgagaaattcaggcttgtgccgaacgttgttagctgcaacattctgctcaaggcgctgtgtaagaggaacgaggttgatgtcgctgttagggttttggatgaaatgagtttgatgggtttggttcccaatgtggttagttacagcactgtgttgggtgggtttgtgtttaagggtgatatggagagtgctatgagggtttttggtgagattttggataaagggtggatgcctgatgtaacctcttacactgttttgatgagtgggttttgtagattggggaagttggtggatgcaattaggatgatggatttgatggaagagaatagggttcaacctagtgaggttacttatggtgttatgattgaggcttattgtaaagggaggaagccaggggaggcggtgaatttgctcgaggatatggttgagaaggggcttgtgccgagttcagtgttgtgttgtaaggtggttgatttgttgtgtgaggaggggagtgtggagagggcttgcgaggtgtggaggggggtggtgaggaaggggtggagggtcggtggcgcggtggtgagtacgatcgtgcattggctttgcaaggaggggaaggtggtggaggcgaggggcgtgttggatgagctggagaaaggggaggttgcgagtttgatgacgtataacacgctgattgcggggatgtgcgagagaggacagctttgcgaggcggggaggctgtgggatgagatggtggagaagggccgtgttccgaatgcttttacttataatgtgttgatgaaagggttttgtaaggttggggatgtgaaggaggctatcagggtgctggaggagatggtggagagtggatgcttgcctaacaagtcgacattctcaatattggttgatgggatttctctttcaggaggaaagaaagaggaaattgacaaggtagttttgttggccatgacgactggagttgacggtgaatggtgggatcttttcttaaaacttgttgtgggtaatttagatggcaatgcttctgagcttgataggatattaacagagaatgcggttatttcttttgtagtctgcccaagactggaaatggatgactaa

SEQ ID NO: 69299 - DNA, 552 bp, Glycine max
  Peptide Sequence Number=SeqID_186077
atggtttcgacaaagggtgcatcgaagggttcaaccggggatatgtcaaagattcagggttatgatgaagttatattgttggtgtctttcgattcattgatgttgaggagtatccagggattttcggcctttttggatcaacttcgagaaagggttagtgataacattgaggttgcggtagcgactgatactggtcatccggtggaggtgccacaagcttgtcctacgactacaagaattaggttggtcactatagaactgatggttgaggtgggattatggctcaagttggcgcagataggaatgctttttgccttgctcgtcggaattggatacccccgacatccaacaactccattcccactccccctattatccaaacaccttgtccatgggatgctcttactgatattgctttgccgactgggaaggaatcaaggggaaaggacaaagacaagcataggcatcgaaagaggagtagttgcgaccactaaagtggctcaggggaaccatccgggcacaaggatggcggcttgcataacaagaagttga

SEQ ID NO: 69300 - DNA, 246 bp, Glycine max
  Peptide Sequence Number=SeqID_186078
atgggtggagtttgcgccggggagggcgtgagagtatggagtggagcatttggcaaataccaactggcaacaacaaaacgaagtgaaattcatattgtggcaagtggggctgcaaggaaaagaagagcagtaaatgcgctttactgcttctcggtcaaagtaccaatcaccaacggattcagcaatggtctgcttcagaggcaaggcaacaacagtggatcaaccacaatggattatatgtggtaa

SEQ ID NO: 69301 - DNA, 342 bp, Glycine max
  Peptide Sequence Number=SeqID_186079
atgttggtgtttgccaaaaaaatctcacttgaaatcgagctcaaaatcaaggaagcttatgagaagaagaaggttgtaaataatgcggcatttggggtggaaaaagatgatgatgaggtagaagcattggaagaaactaacaatataagggctggaaaaagacctgcagcagcaggttctaccgttgcatttgctgtcaagggagatacagggaatgatcatatggatttgcatacacttaaaagtccagaagcatcaaataaactcacaggtgcaatggctaaaagaaaaacagcatacaagatacttgtattaaagaagcaatcttgtattcttctatag

SEQ ID NO: 69302 - DNA, 471 bp, Glycine max
  Peptide Sequence Number=SeqID_186080
atgaaaggagattggaatgtttatagattcctgctttgtccattgcctgagatggatgtgacctggcattcacccaactctcctaaaacaaatgataagagctatgagacactaaataggggtgaagggggatttggtgcatgccaaaaagtcccacttgaaatcaaactcaaaatcaaggaagcttctgagaaaaataaggttgtaaatgatgtagcagttgggctggaaaaaggtgatgatgatgaggtagaagcattggaagaaatttactacgtaagggttggaaaaagatttgcttcaacagattctaaccttgctcctgctgccaagagaaataatgtgaaagaccatatggatttgcatatgcttaaaagttcagaagcatcaaacaaactcacaatggctaaaaggaaacaaacatacggtatgcttgtgttaaagaagaaagggctagaaccattcctatag

SEQ ID NO: 69303 - DNA, 304 bp, Glycine max
  Peptide Sequence Number=SeqID_186081
tttaaaggacggcctgaactggtacagggagaagttgcttgtcacgcctgagaaaacgcatgtgtgtgagctttttaatgtgtcgtcaactggtttgtgtaaattggcagacggtgatcctaaccacggggttggctactggaaaggtttccggaggagtgacgggggccagcagtggccagaaaacttatcaaaattttgccaccggggacagtgggtcctcacggttttcgaaatgcctctgtcagactctggattacatgttaaaaaagggaatggaccgaaatcatgtgcatggagctga

SEQ ID NO: 69304 - DNA, 294 bp, Glycine max
  Peptide Sequence Number=SeqID_186082
atggagaagcttattcctttttcaggaatattgagctctgaccctgctcagaacactggatgtgtgaatgtatgtagagaggaagtgggttgttcttcagaggctaggtcatatggaaaactattatggatgaactcttatcaactggcctgtctaaagcaaagcaggctttgctttcaggatgctctgctggaggattggcaactcttatacactgataatttccgacaagtacttccaaaggaagcaactgtcgagtgtcttgccgatgcaggattcttcctagatgagtag

SEQ ID NO: 69305 - DNA, 406 bp, Glycine max
  Peptide Sequence Number=SeqID_186083
atgaagcctaccactaaaaattttaatgttctccctattttcttggggtcattattctgtctctttttggcaggtttggatgctgaaagtgacgtctattgcttgcaaaccatcaagaaattggatcagtttaatcacttatctagctgggatttcaagagcaacactgaaggtgacatgtgtagatttagcggtgttgaatgctggaataacgtgaaagtaatcggtctcagtctttctaacaaggggctgaagggccagtttcctagttgcgttgaaaatttcgcatggttgcagactctgaacctctcacacaacgagctttctggatatatcctttctgatatctcaactagtcagttgacatatctgacctcactcgatctctcaaataacaatttctatg

SEQ ID NO: 69306 - DNA, 156 bp, Glycine max
  Peptide Sequence Number=SeqID_186084
atggggtacatgtgcattaagatttcgttttgtgtgatgtgtgtgttggggttggtgatcgtgggtgatgttgcctacgctcaagattcagcagaagactacgtgaatgcacacaatgcagcacgagcagagagagctatgctaatcaacgcaaag

SEQ ID NO: 69307 - DNA, 612 bp, Glycine max
  Peptide Sequence Number=SeqID_186085
atgtccatactgtccccacctgaagcttctctgttcataacaacgaaattgtttttgattgatggacatggggtgaagggttctgttgagaaggatgtctatgactttggaataatcctttttgaacttataacagggaaaagattaagttcaacgactgattcttctgacagtgttaatggtcagttgatgaactatatcagcaataacttgttcactgatcctgcagatttttatgataccattgacgaatctatcatagggaagggttttgacgataaaatccttggtctcctcaaagttgcatgtgactgtgttaaaggatctttaaagcaaaggccaaagatggttgatatgcacaaaactataagagccatgtgggaaggctataaaccttggtttgattctgaaaggctgaaactctctctgggttgttctgaccatataacatgcatcagcgaaatagaatgttccgcacttccgcttatcagacactttaggacaatgaatgtctgtttatttatatacaacactgtcaagttaaagctttgtaattttatgattcaaattgagcaaaataaggaatcatttaacgaggacgaggacttctaa

SEQ ID NO: 69308 - DNA, 846 bp, Glycine max
  Peptide Sequence Number=SeqID_186086
atggggtacatgtgcattaagatttcgttttgtgtgatgtgtgtgttggggttggtgatcgtgggtgatgttgcctacgctcaagattcagcagaagactacgtgaatgcacacaatgcagcacgagcagaggtgggttctcaatcaccaagacaaacagtgattgttccaagtttggcttgggatgatacggttgctgcttatgcagagagctatgctaatcaacgcaaaggtgactgccaactgatccactctggtggtgaatacggagagaatattgcaatgagcactggtgaactaagtggcacagatgcagtgaaaatgtgggttgatgagaaatccaactatgactatgattctaactcttgtgttggaggagagtgcctgcactacacacaggtcgtttgggctaactcggtgcgtcttggatgtgccaaagtgacatgtgataacggaggcactttcatcacttgcaactatgatccccctggcaactttgttgcaacttctgtcctagtatctttcatggtctactatgccccttggacagaattcaaaaagaggaggagtaacgctattcatcccttaatgaagaagcagaaccatcaaaagaacactagacaagaagctgaattgctaccactagccatgcaagagcaaggaagcaaagagagattgattcctagaatgagcttcaaggaattatgcaaggcaaccgattactttagcacagataacgttttagggataggaacgacagggattatgtacaaggcaaaggcacagaaacatagctccattggtaggattctgcatagaaaaaagagaaaggattttggtgtataa

SEQ ID NO: 69309 - DNA, 333 bp, Glycine max
  Peptide Sequence Number=SeqID_186087
atgaaagtaaaatattcaaagggaaaacgcagaacaaatgtacaagactcaggaaccaatggcgcttccaaaatcgcaaccaccactggcgcttccctattgcaggccaatttgcaacgctgcaacctaaacctagggctacgcgttcaccaagtcgccactactgctggcgcttccaaagccacctcagcaaaagggaaagcgctgctgggaatggtgcttccatggccacgtggctcgtccctgtcgaaggcgccatcagcactggcgccatgcatggccagctacatacaaaacaacaccccctgggaaatacctccaaaacagccctag

SEQ ID NO: 69310 - DNA, 4212 bp, Glycine max
  Peptide Sequence Number=SeqID_186088
atgacaggaccccacgacccaacttcaccaaatctggaaaccattctcacccgactcactgacactatgcaatctatgaacctcaagctcgatgaacttcttcatcgtcccgcctccgtttttcccccacagccagaaccccctcccatttcccctgttcctacgacacaacataaaatgaagttagaggttccccgttttgatggaacggaacctttaggatggatattcaaaatcaatcagtatttcgaatatcatggaactcctaagcgagagcgtcttaccatagcttcgttttatatggagggaagggcacttgcttggttccaatggatgtcaagcaatgcccagttcacctcgtggcctggattcctacaagccctgcagacgagatttgctccgtcacaatacgaagacccaaccggcattttatttaaattgacacagaaagggaccgtgagtcagtacctttcggaatttgaagacctcgcgaatagggttatcggattgccatccccattccttctgagctgtttcatctccggtctcacaccggagattcgcagagaagttcaagctcatcaaccgctcacccttgttcaagccgcgggacatgccaagcttcaggaagagaaattttccgacaaccgcaaccctccacgttctcgcgcaccacctccgcaacctaaccccattcgagttcttcctacttcagcagagccgcgaccaaccctaccacccttgctgccagctcctccgcgccctacaccgtcgttgatgaaacgtctcatgccggaagaactcacctcacgccgcgagcgtgggttgtgcttcacctgtgatgagcgttaccatcgcggccatcgttgcgccgctagggcttttcttttggtaactgaagaagaggaaccctcagactctaaaatagacccacctgacccaccacccgacccgcccgacgaacccgacccgtttcaagcccaaatcagcctcaattcattttcgggccacctggcacctgaggccttgcgtatggcaggaattttggccgaccatcgtgtggtgctgctcgttgacggcggcagcacccacaacttcgtgcagcccaccctggtgacccaattgggcctcccctgccgaagcatctcaccattgcgcgtgatggttggcaatggccaacacttggattgttctgcgatttgtgaaggagtttccattatcattcaagacgttaagttcaccttggacctacacgtcttgcccattgtaggcgctaacgtggtcttaggagtccagtggcttaagaccctgggcccaattctcacggattatgggtctttgaagatgcaattcttttatcaaaaccagttgatagaattaaaaggggacaccgcgattgactctagcttcctcactcaccatcaactccggcgactctgccggacacagactcaagcttcatattttcacatagcaatcatcacggacgaccctgaacccccacattctcaaaccttacccccagaaatccaagccttactcacacacttctccaaccttttccagagcccatcaggactaccccctaaccgtgtcaccgaccaccatatccatcttcttccccacaccagtcctgtaaatgtgcgcccctacagatatccccattaccagaagaaggagatagagcagcaggtcaatgatatgctacaaaagggacttatcaggccaagcacaagccccttctcatcaccagttctcctcgttcgtaagcaagatggttcgtggcgattttgcgttgattacagggctcttaacgccgtgacaatccgtgaccgattcccaattcctacaattgacgaattgctggatgaattgggaggagctcagtatttttccaagcttgatttactccaaggatatcaccaaatccgcatgcatgcctctgacatacctaagactgctttcagaacccaccatggacattacgaatttaaagtaatgccatttgggctctgcaatgcaccaagctcctttcaggccaccatgaatagcatattccggcagcatcttcgccactttatcatcgttttcttcgatgatattttggtgtatagcacctccttcgaagctcatcttcaccacttgactatcacattccaggtccttcttgataataattttgtactgaaactttcaaaatgttcctttgcgcagaaacaggttgagtaccttggtcgtgtcgtatctcacaagggggttgaaccagtagtctcgaagatcgaagctattcagcaatggccgacacccaaatcggcaaaagcagttaagagctttttgggacttgcggggttttacaggagatttattcgtaattatgccaccattgctgctccattagttcgactcacggctaaggattcttttgactggtctcctcaaacacaagaagcttttgatcagttgaagacagctctctctactgctcccgtcttagctctttcggacttcaccataccattcaccgtcgagactgatgcctctggtattggcatgggtgccgtgctcacccagaagggacaccctgtagcgtttttcagtaaacctttcacccccaagctcgccgtggcctccacttatgtccgtgagttagttgccatcaccaccgcggtcaaacgatggcgacaatacctgttgggtcaacgcttcatcattataacggaccatcgtagcctcaaggaattacttacccaagtaattcaaactcctgagcagcataaatacttggctcggcttttgggatatgactatgaaattcggaacgagcctgataaacatccctcattctcgatttcccaggaattaattttaacagggggacgaatctggcttcctagagaccttcccctcacggccacattacttcaggaataccacacgactccaacagggggtcacgccggaatcacaaagacattagctcgaatttcagagaacttcacttggaccggtctcagagaagatgtcaagcaatttgtggcaaattgcatggattgtcaggtcactaaatttcattgtcggcctgccggcgtatcacgaaaaaccacaattctcgtggtggtggaccgtttttcgaaggggattcatctgggaatgttaccaacgtctcacactgctcatatggtggcatccttgttcgtcgacatggtggttaaaatacatgggattcctcgaagcttggtttccgatagggaccccctctttatcagcaagttttggcaagagctgttcaaggctagcggcactcatttacgcatgagctctgcgtaccatccgcagagcgatggacaaacagaggtgctgaacaggatagtagagcagtatctcagagctttcgttcacaagaggccaaaccggtgggggaagcttttgccatggattgagtggtcccataacacatcgtggaatgccggtactgggacgactccttatgaggtcacatttgggaagaagcccttcaatttccctgagtacatcacgggaacttcaaacatagaagcagtggaacacttactcactgatcgagatgcgactttccaaacaattcgtaagaagctacttaaagctcaagagattatgaagaggcaagcagatagcaagagacgtgatgtccaatatcaaaagggaccacaaccaactgccggaaagctcgcgaagcgtttctatggacccttccaggtggaagaccgcattggcacagtagcttataaattgaagttaccagaatcagccaggattcaccctgtatttcattgctctaagcttaagccatttcgagggaacccagagcaacattcagaattgaatttgccccccacttttatccatgaccaaccagttgtacaccctttagctattttggattccaggaaaaatccggcaacaggaacttgggaggtgctgattcaatgggagggtctctctcctgatgagacttcatgggaggattgggaacagttacagcaagacttccaccttgaggacaaggtgcgtctacaagggccgaagagtgttatgaacaaagaagcttcaggtggggacagtatggacataacagcaaccacagagggtatactcacaaacaaagaggtgcaaaaggaaacaacattcaagagaaggatcaaaaagcccacctatttgaaggatttcgtctga

SEQ ID NO: 69311 - DNA, 444 bp, Glycine max
  Peptide Sequence Number=SeqID_186089
atgtccccagcaggttcaccaagatggagccctaccacagaacagctcatgatcttggaggaactgtacaggagtggcattagaactcctagtgcatctcaaattcagcaaattactacacacctttctttctatggcaggatagaaggaaagaatgtgttctactggtttcagaaccacaaggctagggatagacagaagctcagaaggaaactcaccaagcaactgcagctacagcagcaacaacaacaacagctccaactccaccatcattgcccaaaactcaatcaagatcatttcactaaccattttgttggtaactttggttatagcactcttcgttctactacccacgattttcccttttttaacccacctagcttgctttttcagggaggtgctgcgaacacatcgtcagaacaagcattgagttgcaaatggaat

SEQ ID NO: 69312 - DNA, 120 bp, Glycine max
  Peptide Sequence Number=SeqID_186090
atgaaatcttggaacaatgagttagagctacttgggtggtgtggtgcagtcttcactgattctggtagttgtgagaggaaagagatcaagagtcttgacaggtcgagtggtgcaacatga

SEQ ID NO: 69313 - DNA, 252 bp, Glycine max
  Peptide Sequence Number=SeqID_186091
atggaaaaagaagctaaaagaagagagaagaggtggtggttgtgcgtgaattgtgacggaggaagggagaagaaaggggatgtagggaagagaggagaaattgatgtccactcagtccccgctagcacagcccttgcaaccacaatgaacacactctataaccttctcctccctaaggttcttgggaactctgcaaacacaagtggtggcaaaattgtgattgcgtggctgcatacaccccaagcagcatag

SEQ ID NO: 69314 - DNA, 2595 bp, Glycine max
  Peptide Sequence Number=SeqID_186092
atgtcatcacaaaaaggaggcaaagatgaatcatcaacgtggattcttgagagcattgagattgatcccgttgtgggaaggcctaaaagggatgatgaagcaccccctaatggaagcacggtgcttaaatctcccaatgatgttgctgctgtgaacaacaacaacaacaacaacaacaacaacaacaatgtgaggagcagacttggcattcgggggagtaatggagggaggaaaatgatgaggactgaatcaggagcagccagagggattaagggtttacgttttcttgatagaacggtcacagggagggaaactgatgcatggaagtccattgagaagcgctttactcagaatgcagttgatggaaaactcacaaaagacaaatttggaacctgcatgggcatgggggcagaatcaaaggattttgctggggagctgtatgaggctttggcaaggagaaggaaagtctatgcagaaaatgggatatctttggatgaagctaaagtattctgggaggacatgaccaacaaagattttgaatctaggcttcaagtgttctttgacatgtgtgacaagaatggagatggtaagctatcagaagatgaggttaaggaggttatagtgttgagcgcctcagcaaataagctaggaaacctcaaaatgcatgctgatgggtatgcatctttgataatggaagagcttgaccctgatcataatggatatatagagatctggcagctagaaactctgctgaaggaaatggttagttctgaagaaggcaccaaaaaacttgatcaatgtagagccatgactttgagtaaagctatgataccgagcaagtataggacaccagtgagcaaatttctatctaaaaccacagaatttgctctcgataaatggaaaaaaatatgggttttcgcgctttggttggccataaacttggtgctttttatttggaaatttaagcaatacagggaaaagaaagcctttcaagtcatgggttactgtctctgctttgcaaagggtgctgctgagactctcaagttcaacatggctcttattgtcctaaccatgtgcagaagaacacttacaaaactaagaggatcatttctaagtcgaatcataccttttgatgacaatataaactttcacaagacgattgcggtagctgtggttatagggacttttattcatgtaatgatgcatatcacttgtgattttccaagattaatatcatgcccagaaaataagttcttttcgatatttggggatggttttaactatgagcagcctacttactacaccctagttaaaagcattcctggtttaactggaattcttatggtcttgattatggcttttaccttcactctagcgacacattatttcagaaaaagtgttgtcaagttgccttccccgttgcatcgattggctggtttcaatgcattttggtatgctcatcatttgcttattgtggtttacatactcctgatcatacatggctactttctatttctcaccaaggaatggaacaagaagacgacttggatgtaccttgtagttccactagcactctatgcttttgagagaattcacccgtttttcaggagtaaagatcaccgagtaagcatcattaaggcaataatatatacaggaaatgttctggcactatacatgaccaaaccccaaggattcaagtatgaaagtggaatgtatctttttgtcaagtgtccagatatatctacttttgaatggcatcctttctccatcacctctgcacctggagatgactacttgagtgttcatatacgaaccttgggagattggactacagagcttaaaaacacatttgcacaggtttgtgagcctcacaatgctcaaccaagaaagggaaaccttatgaggatggaaactagagcaccaaattcaacctataaccatccttcaaaatcaagaattagatatccaaagatcctcatcaaaggaccctacggagccccagcacaaagctataagaactatgatgttctctttctcataggtctcggaatcggtgccacaccaatgatcagtattctaaaagatatgttgaacaacatgaagtcagaaagccctaaagagggaacctatatgcaggactcagtccctagcagtaactcagatgatcaaattaagaaaggtcctgaaagagcatatttctattgggtaacaagagagcagtcatcatttgaatggtttaaaggtgtcatggatgatattgcagattatgactgcgataatatcatagaaatgcacaactatttgacaagtgtctacgaggaaggtgatgcaaggtccgcgcttattgccatgattcagaggctgcaacatgctaaaaatggagttgatgttgtttcagaaagccggattcgaacacattttgctagaccaaactggaaaaaagtcttcactgaattagcaaacgcgcatcaaagctctcggataggtgtattctactgtggaagtcctactcttacaaaaacactgaaggaactttgtcacgagttcagcctaaagtcatctacccgttttcagtttcacaaggagaacttctaa

SEQ ID NO: 69315 - DNA, 3762 bp, Glycine max
  Peptide Sequence Number=SeqID_186093
atggagctactgctacccgtgttgcacctaatccttcaagtgttgggttgcaacgcatggcttccaaaagtgatactgggatcccaaggtctattccggcgaattgcacctagtttagcaattgtgcgtaatgcaaaggcaactggttggagcttagcaggcataggaagcgaacccgacaatggtggaagggatggttgcgcggatggaggcgtcgttggcatgggaagcgaaggcagcatggccgacggaggtggcatgggctgcggagtcggcatgggtgacggaggtggcatggacggcagagtcggcatgggtgagggagttggcatgggcagcgaagtcagtaagggtgtggggcgcaattgtatgagtgcggaaaatggaggtggagttggcatggacggcggtggtggcagtggtgactgcacggaggaagaaggcaaggttggccaaggcggcctcaagatggtccttggtagcggaagaaaattcaaggtgccatggaagctccgtttggcgagtggtgtgggtggtggtagtggaagttggtatgacagccatggaagctccgtttggcgagtggtgtgggttgtggtagtggaagttggtatggcagccatccatggaagggagccatgggctctcaatgaaagcaccaaaatgttaggtgctgcatatgggaaaattggtttcgagggtccaacacctcttgaagaagaagaaaagaagaagaagcacttggaattcgaggaccaagctacctccaagagcaagaggaagaaaaggaattatgctattttctctattctagaagcgcaattacagacatgtatatataagctacggaggggacaagagcctgacaaacacgatccaatcctagtggtgcgcttcctttatgtacggacgctgcatgagcatggagctactgctacccgtgttgcacctaatccttcaagtaagaacgaaggcagttccttgcagcaggcaattggagcatcggctgaggcggagaccatggacacagacgctgctgctgcgatatggaaagaaattgaggcttcagagagttaccttgtttgttctatgtacgaagaagcggcacaattagcttcctctgttttggaacgcttgcgtcattcccatcatgatatcgatagagatgatatgttggaatcaagtgctatggtgctgcttcaggcattcaaccaacttccctccaagacaccacacattcttaatcaactcacactatacttcgtttcacccaaagctattccttcccgtcttcttcttactggagcttgttttcaaatagcacaaggttctgcactttccgttcaacaatttctccacgagtttctcaatggatggactcttgaacattcacaatattctgctgtcattaccgaggctgcaagtagagaccaaagccgccgcttcattcttcttccaattgttgaatatttgcaagttgttgagctctatgccgtcacgcttcttgcaacacttcaaaaaaatgttgatcttgcaatctcctgggttgagaatgcttcattgcctgaggaaaatcgacagtcacccacaaatagcaatgaagcttatcctttgaaagaacaaaatgtgtctgaaggattaccaaaagccttgaaaagtaatgaaaagtataggtccaaagaagctgttacaaaattgtctgaacgaatagaagcatgtttctggtgcttccgtggtatcaatttgaagattggcacttctaagtttgtcataactagtgggaagatcatgcttggcaatggccgtaaagagggctttggtagatttgtggcagcttgcgttttcctaccaagtaaatcctctggcagctgttcaaccactgtctgctacaacacgtcaagttgtccaccctccatctccaacccttgccttcttcacacccatcattccaaaccagcaggtacttctggagggcgtgcacgcggcaccattctttgggctgcttcagacacagaatctctcctcaaattcagagactcccttgaaaacaacaacgcgttgttgtcctcatggaatgcatccatccctccatgttcagatgatgatgcatcatcccactggcctcacgttcagtgttacaagggacacgtctggggtttgaagctggagagcatgaggctcaaaggtgtcattgacgtccagtccctcctggatttaccgtatctcagaaccataagcctcatgaacaatgacttcgacactgcatggcctgaaatcaacaaggttgtgggtttgaagaccattttcctttcaaacaacaagttctccggggagattccggctcaggcttttcagggcatgcaatggttgaagaagattcatttgtcaaacaaccagttcacaggtcctattccaacttccctcgcatccattcctaggcttatggagttgaggttggagggtaaccatttcaccggccccattcccaattttcaacatgcattcaaatcatttagcgtagccaataatcaattaaagggagaaataccagccagcctccataacatgccagcttcatctttctctggtaatgaaggggtatgtggaacaccgttaagtgcatgctcctcctccaaaaagaaatcaaccgtgatttttgttgtggctgtggttcttgttatttttggactgatagtgattggagcagtaatattgttagtcctgcgtcgtcgaagaagaaaacaagctgggccagaagtggcttctgcggaagaagcagggtcagataaaggaagtaggatgtggatgcatagtagctcctcgagccacggcaagagacgcttcaggttatcatttatgagggatgaaagagatgattttgattggcgggatctgctgaaatcctcagcaaggattttgcgcagcgatggttacagctcttcctgcaaggctgttctgttggatgggactgagattgtggtgaagaaattcacgcagatgaacaatgtagggagggacgagtttcgggagcacatgcgacggattggaagcttcaatcatcctaatctccttcctctcgtcgcctactactgcatagaggaggagagagtcttgattaccgactttgttcccaatggaagcttggctgctcgccttcacggatcccaacctgtaggacaagcaagcctggattggggaagccggttgaagatagtgaaaggcatagcaaaaggacttgagaatctgtacagtgagatgccaagcctaattgcggcacatgggaatctaaagtcctccaacgttcttttgagtgaatctttggagccactcctcacagactatgggttgttaccagtgataaaccaggacagtgctcctaagatgatgttcatctacaagtccccggagtatgtgcagcatggccgcatcacaaagaagactgatgtgtggagtcttgggatactcatcttggagattctcactggcaacttccctgataactttctacaagacaaaggaagtgatcaacagaatttggcaaattgggtgcattcacaagagtggactagtgagatgtttgataaggacatgatgatggagacaaacaataacaacagcgagggggagatgatcaagcttttgaagattgcattggcatgctgtgaatgggatgaggacaagagatgggacttaaaagaagctgtacaaagaattcatgaggtcaacgaggaggacgataatggccatgactcagatggcgaa

SEQ ID NO: 69316 - DNA, 3363 bp, Glycine max
  Peptide Sequence Number=SeqID_186094
atgaagacgacgcagcagcctgaagctcctcaaggcgatccctgtgaagagaagaagaagagcataaaccctgagctatggcaagcttgtgcagggcctttggttaaccttcctccctccggcacccacgtcatctacttccctcaaggtcacagcgaacaggttgctgcttctctcaacaaagatccccactctcaaatccccaactatcccaatctaccttccaagcttctctgtctcctccacaatctcactttgcttgctgatcccgaaactgatgaagtctacgctcagatcactcttcagccagtcccttcttttgacaaggatgctctcttgcgatctgatctcgccctcaagtcctccaagccacaacccgacttcttctgcaaacaactcaccgccagcgatactagcactcacggtggtttctccgtccctcgccgtgccgccgataagattttccctcctctcgattattctatgcaacctcctgctcaagaactcgtcgccagggatttgcacgacaccgtttggacattccgccacatttaccgtggacaaccaaaacgtcatttgcttaccactggatggagtctatttgttagtggaaagaggctcttggccggagactctgttttgtttattagagatgaaaagcagcatcttcttttgggtatcagacgagctaacaggcaacccaccaatatatcgtcatcagtgttgtcaagtgatagcatgcacattggaattcttgctgcagcggctcatgcagctgcaaataatagccccttcaccgtcttttataatcctaggactagtccctcagaatttgttattcctttagccaagtactacaagtcagtgtatagccaccagccatcacttggcatgcgtttccgaatgatgtttgaaactgaagactcaggaacaagaaggtgcctcacttttatgtccatctatatgaagtatatgggtacaattacaggtatcagtgatctggatcctgtgcgatggaaaaactctcaatggcgtaatttgcaggttggttgggatgagtcaaccgctggggaaaagcgtagcagggtctcactctgggaaattgaaccggtgactgctccatttttcatctgtccacctccattctttagatccaagagaccaagacaacctggaatgcctgatgatgaattgtctgattttgataacattttcaagcggacaatgccctggcttggtgatgatatgtgcatgaaggatccccaaggtctccctggccttagcctagctcaatggatgaacatgcagcaaaatcctgcactggctaactcacttcagccaaattatgcaccttccttatctggatctattttgcaaaatattcctggagctgatatttctcgccagctgggattttctgctccacaaatttctcagtcagacaatgtagccttaaatactcagaggcttcttcagactgctcaacaattggatcaccttcagaagctaccatctacttctagcacattgggaacagtcctgctgccacagcaacagttgggtgatatcactcaacaaccgaggcagaacttggcaaatcaaactatccctcagggtcaagttcagtcccaactcttgcatccccagaacatggtccaaaccaacaatattcttcagcagcagcaaccatccattcaaaaccatcaactacatagaagcctctctcagaacccatcacagcagcagacaactattggtcagaatcaaccgcaaaatttgatccagtcccctatgcctgatcatgttcaacaattacagatgtctgacaatcagattcagttgcagttgttacagaagcttcaacaacaaaaacaaacgctattggctcaacaaactgcattgcagcagcctactcaacttactcaaatccaggatcagcaaagacagcttttagataaaacacataacttgtctagagcactaacacctggtcaagtactggaaattcctcatattattcagaattcactgcccgaggctaattctatctcaaatcagatgacaaaggccaattgccagagcaatattcaattctctcagcagcccaagcttcagcagcagcaacaacctggcatggtttctgaaatgcctggccacatggcacttctccctactgctacaactaaccaactttctgctggtggcagtagtatagtgactggagcaggtggtgcagggcagtctgtaattacagatgatgttccatctcgctccacctcaccttctacaaataactgtaccaatgcacttccacaattgataaattcacgattcccgagaagcacaatggtaggggatgacatggcgcactctgctgccacaatcttgagttcaagtgccttggaaacttcgtcatcaaatgcaaacatgttaaaagatttacagccaaagtttgaagttaagccatctctgaatatttccaaaattcagaatcaaggccattttgctccacatacgtacttgaatggtaatgctgctcatacagattgtttggacacatcatcttctacaacgtcagtttgcctttctcagagtgacgctcatatgaatcagaatagcaatccattgtcttacaatcgacagtctatgttgtttagagacaataatcaagatggggaagttcaggcagatgctaggagcaatattccttatgccaataacattgatagccaaataggaatgccactgaatccagattcactcttaaccaaaggcacattaaggttggggaagtatttgtctaataatttctcttcagaaggcatgcttggaaattatgaaaataacagagatgctcagcaagaactttcgtcttcaatggtttcacagacatttggtgtccctgatatggccttcaattcaattgattccacaatagatgatagtaacttcttgaacagtggtccgtgggctccaccaccagcaccgccacctctgccaccagcacagtttcagcggatgaggacatataccaaggtatataaacgcggagctgtgggaaggtccatagacataacacgatattcaggttatgaggagcttaaaaaggatctagctcgtaggtttggcatagagggacagctggaggatcggcaaaggataggttggaaacttgtctatgtagatcatgagagtgatgttcttctagtgggagatgatccttgggaggagtttgtgaactgtgtccgctgtattaaaatactttctcctcaagaagtgcagcagatgagcttggacggagattttggcaatggtggccttcaaaatcaagcctgtagcagctctgacggtggcaatacttaa

SEQ ID NO: 69317 - DNA, 708 bp, Glycine max
  Peptide Sequence Number=SeqID_186095
atgtccgtgatcaggggaggcggtgaggtggtcgacaatgacaatccaggccttgatgtgggggaggtagccggaacggagcatgaagcggaggaaggaggcagcatagagcgtgtggttgaccttggtgacggagacaacgaggaggccgaggcaattggcgttgaggcagtgaagctagcgttcattgcggaggcgtgtgacgatggactgggcatgcgtgagagaatagagtgtgttatggtaagaaagctaaaaggccaagtgattgagacaggtggagttagggaggtgcatggagtgagagtaggtgagccaaacttcttcaattttacggtcatgaaggagggagagaagcttgtgatcgtaggttccaaggaggttcttgcagtggcgcgttggaagggagagagtgggggttatttattaagcaaaaaactcactgtttcattaaacgggcacaacacccttcccttttctcaaacgaatgccggcataacctccaccatttggaccttacttccggctactctagctaggttgttgttaggtgttgcgtatgggaaagctggtttcgagggtccaacacctcctgaagaagaagaagagaagaaaaaacacttggaattcgaggaccaagctacctccaagagcaagaggaagaaaaggaattcttctatattttctatgctggaagcgcaattatag

SEQ ID NO: 69318 - DNA, 2415 bp, Glycine max
  Peptide Sequence Number=SeqID_186096
atgtcgaggatgaattcagagaagaaactgggtgcaggacgtgtggtggctgtggcaattgagaataacaagacaagccaacacgctgccaaatgggcagtggataatcttcttcccaaagatcaatgtctcttactaatccatgttagacaaagagcatcttcggctccatcatcggatcatttgagcgaagctgtggccgacaaagaatctaaggaactttttgaatcatttcgagtcttctgcaatagaaaaagtatacaatgcaaagaagtgctgttggaggacatggatatatctaaggcattaatagacgccatttccacgaataccatcgagcttcttgtacttggggcgccatcaaggagtggccttgttagaagatttaggacaactgatgttccaagcactgtgtccaaaggggcaccacaattctgcacagtttatataatttctaaaggaaaaatctcaagcgtgagatctgctactgctccattggctcttaagaaagctgccattgccgctgcctcacctcgtaaccaattgcagccacaacaacaacaaccacacccgcagacaatgccaagtcctgaaagattttcagatcctcagctaccccgcaactacccaccacgacctacatcagagagggcagcgccacatgggagtcatggggcacgccccaccatgatggatgaagatgatatcatatcaccgttcacaagggctgggaaaacatacgagtcttcaaagcttctggattctgatatatcattcgtgagcagtggaaggccaagtgtggaccgaatgttcccaacaatgtatgaggatatggacagtgcgatgagtggaattgcccccggtaggttctcagactatgatggcagaagcagcttcgcttcctcctactcttcacaatcgcaaggcatggatgactgctactccttctcctcccaatcaaggttatccgactgcagcaccgatgatgtcgaattcgagatgaggaggctgaagctagaactcaagcagactatggagatgtacagctctgcctgcaaggaagccatgacagcaaagcagaaggcaatggagcttaaacgtttgaaagtggaagaacagaagaaactggaagagtcctcgtcgttatcgtcggggggtgaggctgctgcagcagcatcctccatggcactgatgatggagatggagaaggaaaagatcagagaagaagcactccaaaagatagcagcattggaagaacagaagagaatgagcctgcagatggagaggaagattaagcctgagaagaacgtgagcgtgagtagttttggacacgggacagccagctacagaaggtacagcattgaggaaatagaagaggcaacaaacatgttctcggagtctctcaagatcggggaaggagggactaatttgaagccggcacctcttccccccaggtgtgaactagattgcacccaggttgcaataaaggtgttgaagccagatgcagcacaaggacgagagcagtttcagcaggaggtggaagtgctgagttgcataaggcatccaaacatggttcttctgctgggtgcttgtccagagtatgggtgcctggtgtacgagtacatggccaatggaagtttggatgaatgccttttcccaagaggaaaatcacgtccacctctcccatggcagctaaggttccagatcgctgcagagatagccacgggtctcctttttcttcaccagaccaaaccagagccactcgtccaccgcgatttgaaacccggaaacattcttcttgaccgcaactacgtgagcaagatcagtgacgtgggcctggccaggctcgtccctccttcggttgcagacactgtcactcagtatcgcatgacttctactgctggaactttctgctacatcgacccggagtaccagcaaacgggtatgctcggaatcaaatctgacatatactctctcgggataatgcttcttcaattggtcacggccaagccaccgatgggtttgactcatcatgttggaaggtccattgagaagggaacttttgcggagatgcttgaccccgccattcaggactggccacttgaacaagccttgcatttcgccaagctttccctcggatgcgctgaaatgaggagaaaagatagacctgatcttggaaaagttgtgttgccggagctcaataagcttaggttatttgctgaacaaaacatgtcacctatgatgatgtttggacttagaagtactggtggaggtggtgctgcaggatatgttcccagaaacagtaactcttccatccattccggactttcttcttcaacccaaggcatgagtgaagtgtctggcttctctggatatgaaagccgctcaagcacatcatcactggggagaatatga

SEQ ID NO: 69319 - DNA, 438 bp, Glycine max
  Peptide Sequence Number=SeqID_186097
atggagaattattccatgttgttctctgtttccaattcctcaagctacccaattggagttggaagctctcaaattggttatagtggtcaaagctccaatgcgtttcttggtctaaggcctagtaatgaattagctagtgatgatcatgagaagagacaaggtggtggtgatggcaatatgttaatgtctcagatcagtggtggtagcattaatgtgagtgatgagttaggtggttcgggaaatagtaacaataataaaaagaaaggagagaaaaaggttagaaagcctagatatgcttttcaaacaaggagccaggttgatattcttgatgatggttaccgatggaggaagtatggccaaaaagctgttaaaaacaacaaatttccaagtttttatcttgtggcaatggcgcctgctaagtttgacttggaaaattga

SEQ ID NO: 69320 - DNA, 228 bp, Glycine max
  Peptide Sequence Number=SeqID_186098
atggcacccgcacaggacaggggcgggagtactctcccgctcctcgtctccgaaccttaccctgctccccgtccccgtcgtcgctcctcgtggggaggaagaacatacaacagaggaagaacaattcaaagttgcgaaacccagaaatgcacagtgcgactcgaagaagaaaaaggtgcaatgaaggcttccatgagttcacggctgaaacgaacaatgaagaagtga

SEQ ID NO: 69321 - DNA, 291 bp, Glycine max
  Peptide Sequence Number=SeqID_186099
atgattgaattatatttgacgttagttgttgacggaagtggtgttggaagacggaaagaaggggtcccaattccaaaggccatgtcccctaaactggtgagttgtaggtcccaatggtttgaccatcgactttcaaatgtcttcgagtccaaaattccaagtttcaatgagattgatgttttgaagaaacatatcaagcatgtggtggcaaaaagcgctcgggatgaagttcttcaaacaccaacaacaaagatgactctcgatttgaaagtcatgtattcatctcagtga

SEQ ID NO: 69322 - DNA, 252 bp, Glycine max
  Peptide Sequence Number=SeqID_186100
atggtcctagatgacacatcaaataaggtttatcatgatgatgatgatccaagaatttatgaagaggctatgcgaagcttggattgtaagaaatggcaagaagctatggaatctgaaatggaatcaatgaagatcaacaaattggttgtaaaagggtttacaagaaaaggattggagcaaatgggaaggtcgagacctattaagctcgcattgttgccaagggatatcatcaaacgaaggtataggttatga

SEQ ID NO: 69323 - DNA, 195 bp, Glycine max
  Peptide Sequence Number=SeqID_186101
atgcaaaacaaaagtttggtcctgtttgtggtgttttcacccggattactgttccagcttcctggcaaaggaaggcctgtggatttttgcaatttccaaacaagtggcgtctccgtctttgttcattcccttctcttctttggcttcatggctatcttcctcattgccattgatgttcacattggtagtggataa

SEQ ID NO: 69324 - DNA, 196 bp, Glycine max
  Peptide Sequence Number=SeqID_186102
atgagacgccaagtggacgccgaagaccaccagctaagggagacatcactggtggacaacgttggctacctcccaggattccccggcagcattcgcgtcgctgtttctgggcatgtccctgtccctcatgcttctcggggcggtcacgttcctcgttgggttgctgctgctgccttgggttactcttctggtgctg

SEQ ID NO: 69325 - DNA, 366 bp, Glycine max
  Peptide Sequence Number=SeqID_186103
atgaaagggagagataggctaaggaagcaagaagagagaaagaggctcacgtggaagatccctctgcaacgtgatggacccaagaatgaaacggcccaacacagacaaattggagacaagtgcagcaacatagaaaaccagcaccagaagagtaacccaaggcagcagcagcaacccaacgaggaacgtgaccgccccgagaagcatgagggacagggacatgcccagaaacagcgacgcgaatgctgccggggaatcctgggaggtagccaacgttgtccaccagtgatgtctcctagaatgcgacaaagacgaagaagcgcgagaagaagaacatgggtacgagtatacgaggtcaccggataa

SEQ ID NO: 69326 - DNA, 186 bp, Glycine max
  Peptide Sequence Number=SeqID_186104
atgcatatacttttcggtcgtccatcacttaagaacttcatagttaagcatgcttggcttggagtaattgtgggatgggcgacctttcaggaagtttcccagaaagcatgctggcttagacgactaagagacgatgcaatagctaatgcttcacatggttcatatcatacgcaacccatgatgtga

SEQ ID NO: 69327 - DNA, 462 bp, Glycine max
  Peptide Sequence Number=SeqID_186105
atggctcaagcaatggcatcaatgactagcttacatggttcatctcaggctatgttggaaggtagccttggctctgtacgcttgaatgtaggaagtggaagcagggtggcctcagtcacacatgtagggttcacagttaaagcacagcaacaacaagtgaatggtggtgaggtacaaagtagtcgtagggcaatgctttcacttgttgctactggtttggccactggctcttttgttcaagttgtgcttattgatgccaaacctatcaaagttggaccacctcccccaccttctggtagattacctggaacattgaactcagatgaaccaagacaccttaagctaccattgaaagataggttcttccttgaaccattgtctccaactgatgttgcacaaagggcaaaggaatcagccaaggaaattgttggtgttaagaagttgattgaaaagaaggcttag

SEQ ID NO: 69328 - DNA, 222 bp, Glycine max
  Peptide Sequence Number=SeqID_186106
atggtggaattacactggagttcaggagtagattatgtcattttgggtgactttaggaggagggtggcagactctcagaaaaactttgtcaatcggggttatggtagtcttaacttgaggtcgttccttcccctctttaaggatgtctttgacttcgatatctgccactgcaatcacaggcatagagccaaatcaaaaggagaggtggcaccaaaggtgtag

SEQ ID NO: 69329 - DNA, 276 bp, Glycine max
  Peptide Sequence Number=SeqID_186107
atggcgactgatgaagaaaggagaggacactctgattatcataactccattgaaatggatctttttaaaggctttatggaaaacatggatctcattggcattcctctactaggaaaactcttcttatggattaacctggacgggaaacaggacatcttgtaccacaaccttattctattcaaagatgaagtatgtaactggggctcgaaacccttcaggttcttcagttattggcttgagcatctagactttgtgaagttcattgttgaattatag

SEQ ID NO: 69330 - DNA, 444 bp, Glycine max
  Peptide Sequence Number=SeqID_186108
atgcttcattccatgctccagagcatccacagggagcagttcattatcatgcagagccttcagggcttgggcttgccatccattatgagcatgcatgaatttgatgcgcaggtggcctggccaggagcccagccttctccttctggagggggtggggcctccgcagcccaggggcctgctcctaaggagccagcaacagcaacaatagagggggaggatgagctcacccctcctaagcctttttattttgatgcagatgcgaacattgctcaagaggaggggacttccataaaccagatccatgagccatctcctgtacctatccctgaggagacccagccatctgcaccagtcacggagccaaagcagcctatccaggattcatcagcagctccagcactggatcttaatgaacatcagccacaggatgagcaggatgtttaa

SEQ ID NO: 69331 - DNA, 768 bp, Glycine max
  Peptide Sequence Number=SeqID_186109
atgtcgccggaaactccaccgactcctccaccgtcaccgccgtcgacagctgcaactcctcaatttcgggcagcgacaaccgcttcgccaccaccattgtccctcgcggcttccccagtgatcctcaattctccggagaactctgcgttccgactcgttctccgccgaggaggagctgaagacgctgcagctactctccggcgccgccgccgcgtccaccgccattggcgcgaaaccgcagacgccggagtcctcctcctccaccgacacgcttccgccgttcgcctccgacgacaccttgcgaaacgcaccgtttctccactcggaaacgcctctcccggggaaggcgcgcagcaagcgctcacgggcggcgccgggggactggtccacgcgcctgctccacctggtcgcgacggagcaggagaagctgccgcagctaaaggcggagccggcgaagaagagagaaggaacgaatgcggagtgttccggacgcaaatgcctgcactgcggtacggagaagacgccgcagtggagaacgggaccgatgggaccgaagacgctgtgcaacgcgtgcggcgtaaggttcaagtccgggaggctggtgccggagtaccgaccggcggcgagtccaacgttcatgtcaacgaagcattcgaattcgcatcggaaggttttggagctgaggcggcagaaggagctgcagcgacagcagcaccagcaattgatgagtcaaagttcaattttcggcgtatccaacggtggggatga

SEQ ID NO: 69332 - DNA, 201 bp, Glycine max
  Peptide Sequence Number=SeqID_186110
atggcatccctttttagcatcctctgcacggcttcgatcgttgtcttcttggctgtcaaatttgctgcggctagggaattcaaaatgggtggtgatttgggttggcatgaacatgccccaacgtcactgcattttataatcattgggatgcaaggaacaggttccaagttggtgactctttggttaagaaaaataaaataa

SEQ ID NO: 69333 - DNA, 627 bp, Glycine max
  Peptide Sequence Number=SeqID_186111
atggtgaatgagcagagaatacaagaggaggcaaaggtggcggcgttggagtgcagcggcacaatgagtggacccctcgtcggagctgccgcctccgccgggactcgccgacgccggagggcggaggctatgcaattggttctgagggcgttatgcatggcttcctctgttgttgcgatctcactcatggtcactgccaaggaatccagctctgtctccatttatggctttctcttacctcttcactccaagtggtctttctctgagtcatacgaatatcttgttggggtttctgctgctgtggcagctcattcgttgcttcaactactcatcggcatatcgagatttcttaggatgtcttctatgattccttccagaaatcatgcatggcttatttttgctggggatcaggcatttgcttatgcattgatgagtgctggatctgctgcatctggggtgaccaatctgaatcgcacaggaattagacacacagctctgcctgatttttgcaagcctttgcacaatttttgtgaccatgttgccatctcaatagccttcactttcactagctgttttttgctggctacatctgctgttcaggatgtaatatggctctcccagcactga

SEQ ID NO: 69334 - DNA, 312 bp, Glycine max
  Peptide Sequence Number=SeqID_186112
atggcgaacacttcttgtcccattgaactggagcctaggacactgaatcaagtgcagctcactcaagcaagggaagtagctgcaaaggtagttcaaaagttggaaccgtgtgaagcatcagcactgtttattgaggggctgatgcatccaatacaggaggtgatgcatatggatgaaaatggaagcctagctgagaagcttgttgattgcatgaagaaggctgagtccatccctgatgacaaagcttgccattgccaatgctcgtgcgctgctgaaaacccatttaaagaaccactttctgcaccgttttga

SEQ ID NO: 69335 - DNA, 789 bp, Glycine max
  Peptide Sequence Number=SeqID_186113
atgttgtgtcaactaagcgagtgtgcctcgcttagccagagtctttgtttttgtgttgtcacgtacaatgagttccgtcaggagctcgagcggaggcagtggcatagagccttgaccaggcagcttgacggtcacattgatgtggccctggtcaaggagttctatgcaaatctttatgattcagaagataaatcccccaggcagttccgagtgcgggggaagttgataaagtttgatgttgcctcctttaacaccttcctggagacccccgtggttttggagccaggggagcacctcaccacctactcgagatcacccagaccctcaggagctttcttccaagctctgagcaccctggaagctcctgagaaaggatttgactaccctggcgcagacttagagcgtgctctcatactccaacctcgcccccacctctcacacgtcccatctgaatatggacagggcaagatagcccagtccaactcctccaagctcaacttcctagccctcatcaccgccttatttatcgctagaggagtagttccagattctttgacatttgagtccttgagccccgccattaatttggcgtatatccggaagaattgctggaacccgggtgatccttcgatcatctttccggggacccgcaagacacaggttcgaggacctaaggcttcttcttctgcacctctagttccttcttcttcagctccaccacctctagctccagctccagtacccttcgacacctccgctcagagcgcagagattctagtaccgatgtag

SEQ ID NO: 69336 - DNA, 231 bp, Glycine max
  Peptide Sequence Number=SeqID_186114
atgggggttgcaaatagaaattttgaaattttgaattgggccttccagactgtttttcaaatttggattgcttctgaaggaagcaacccaaatcgcctgggtgaaaaaaattgtttccgtgaagaaaatccaagccgaggtgcttccgtaacgctttcgagatgtttccgtaagcaaatccgtgaaggttttccttcgttcttcatccgttcttcgttcttcaacgggtaa

SEQ ID NO: 69337 - DNA, 345 bp, Glycine max
  Peptide Sequence Number=SeqID_186115
atgttgctgggtgcacctagcatgtcccaagagaaaggcattgaaaccgatcaagcagaagtagaatttggcgctgagacaaaagggtcaaaagagtgggaagagaaaaagagggtgaaaataacatggaatgaacaaaattttaagaatcaaatcaagcctcgacaaaggcaagcaggtggttacattcggggtcttcaagggcccattttcaatatgctttcttcaaaaaataaatttttcgtcacgcctccatcgtcaccgtctatgccgtcattcgcgccactagcgatcgccaccttagttgtcatgttgttgttcatcggatttattgcgatggcatga

SEQ ID NO: 69338 - DNA, 837 bp, Glycine max
  Peptide Sequence Number=SeqID_186116
atggcgggggaagagaccaccgggaagaagagggtggtgacagaatccctaggatggctaacggaatcgtcgataatgccaaagaagcaccgagccatagctggcgttggcgcatcctcaatcctcgaattgaaggctgaactatacaagtctcaggaagattccaaaaaatcacgcgaattggccggccccgatgccgagtatcaacgcgccaagaacaaaatcgcccccaaagacaaattctccgtcaaaaaccgcggtgtcgatgcccgcgctcacaaaaaaacagtggtttttgtcccacagatttcacctttgggaggagaaaaaccaatgccttttgtaaagttcaggggtatcaaattgatcaaagttgaagttcaaggactaaaactaactttctctgaaacaatttttggtgtcagggacaagcttgagttgaaggcggtgagtgatggaacggcgagttatgcggcgctagagaggaaggctgagttgtatgagaagttggtgaatggagagttgtcggatgaggaggatcaagagaagtattgtgtggattttttccgcaagggaattgagcatgatgagttgccgccaccgccactgggccgtgatgtgttgctacaaaatgaagatggtcctgttaatgatgatgatgattcattgatgtttaacatgaagcctgttgggcctgggcgaacagctggagctgttgacaatgctgattataaacgcaatattagactagatagtttgggtggattcaatgtgaagctcttgagaattgagatgatactgggaattagaattaagggtgtgaaaatgaaaccatag

SEQ ID NO: 69339 - DNA, 465 bp, Glycine max
  Peptide Sequence Number=SeqID_186117
atgagaattcaagggactaaccgcctaagaactctttgtcctaacacattggagggtacatcctttgtggcacaagtagagggtacatctacttgggttgttatactgagaacaagagagggtacatttcttgtggatcagttcaagtggaaggtacatccacttggttgttcaaagagaacaagggagggtacatcccttgtggatctttggcttgtaaagtattttacaaggttgaaagaaatctcaagaaccgttggttgcttggggactggattagttgatgaagtcgttagctcaacactcgtacaagaggaaaggaagcaccaacttcccacttacttcaccagcagcatacttcatgatgtcgagaagcgctaccaaatgatagagaactatgtggaaagacgaactcccaagtatactcagggcctacttttgttcaccccatacaatgaccaatga

SEQ ID NO: 69340 - DNA, 345 bp, Glycine max
  Peptide Sequence Number=SeqID_186118
atgcagaaaggtcttcggaccagacaatatctgaacaatacagaattgtcaccaaaaaacaccgagactatttttagtctcacagttatcaagaactacgtaggtatgagttcctcatcacaaattaaggatacgttttgcgggcgagcgaaggcgaggctcacgggtgcgctttccaaaggaggaaagatgcgcggagtcgccaccaacgtttatttgtggaaaacgtcggaaaaactgaaggaaaccggtcaaaatgaaaattctaagttcgggagtcgtattctcggagaactggaggttgatgaaccttggttggggttatggctaccattgaattatcaa

SEQ ID NO: 69341 - DNA, 243 bp, Glycine max
  Peptide Sequence Number=SeqID_186119
atggcgaggtccggcgacggttacggtgtcggagtggacgagtcgtatagcgcgctgccgtggctgtacctgacgttcttgtcgatctggctcctctctgcttgctcttggactgtttacacctacaaaacgcaccattctcagttcataaacgaggtagtgttgttgatttgtgaagctgtggacacttgcttcggttccgttgatcaaagcattgcagctcatgctgtcctttctcttctg

SEQ ID NO: 69342 - DNA, 117 bp, Glycine max
  Peptide Sequence Number=SeqID_186120
atgcagttttggaacttgatggcaaagcaagacctcggtgaacttggttttaaggaaagtaatgtagaaactcctggagggaacattactgacagggttgataatcaagaacaatga

SEQ ID NO: 69343 - DNA, 426 bp, Glycine max
  Peptide Sequence Number=SeqID_186121
atgatgaacaatgatacattgggatataatgggcagagaggttcgaggaacctaggggaattagcaagtggtgactacctgacatttggtgcactcatttggcacgagaaactcataggtgtacacatgatgccagtagaacatccggatgcgatgcccactactatagactatactataacttgctacgttccatggtgtcgcaacctacccttcggcgggagggcgacgcggggctcatgggtgcgtcttccatgggaggaaaatgcgcggagtcaccaccaacatttattcgaggaaaacgttggaaaaaccggaaaggtatggtctacgaactttaagtgtgcaaagttcgggagttgttttttacgcacggggaaggaattagcaccccatgcgtccgtcacaagggacgacagcctttaa

SEQ ID NO: 69344 - DNA, 615 bp, Glycine max
  Peptide Sequence Number=SeqID_186122
atgttgtgtttaaacagggtttgtgaaaatacaaataatagggaaactgggttggccattcctgagaatttggattctgcattggctattcctaaggatttggagttggaagaagcagagaggaaggctcttggctctggttcaaccaaagctttgaaggaccatatgaagtcctctgcaactgatgataaaatgcaacagtggttccgtgaaggtcttgcagggccaatgtttagttctggcatatgcactgaagttttccagtttaatgtttctccaagtcctggagcaatagttcctgcaacatcagtagccaatgtttccaccgaaaactgtcagaatgctaccagtgtcaagaagaccaggaatagaagaacccttcatgagctcccagagccgcttaatgggtctagtctgaacataactaaagaacaagtgaaaaatttgcagaaagaccacctccatggtaacaagtcttctatggtggtttcagtctttgttgatcccagagaggctggtgatggtgatgttgatgttgatggcatgatgaggccgaggatgaaagctcagtttgtaatttcatctagtgttggttctataattatttttccttga

SEQ ID NO: 69345 - DNA, 855 bp, Glycine max
  Peptide Sequence Number=SeqID_186123
atggtagtttatgacgtccattgtcaagtaacctcaatggcctgctctttgtggatgtcatttggggtgtatgtaacaggggtgctatttcagacagctgcttttgtctcctttttgctcatttcccatggttactgtatcatgtgtgagcgtctttctttaaatgaacgccgttcaactgccgcacttgcatgtgtcttttacttgactctagttggttacaaggcttgtgtgccatacttctctgttcttctgctactaaattattttatatcattctacataatattccaccatatatcccaaaacctactagtgttgcgagaacaattgagcattatagaacatgaggatattcaagcaatgcatgatgctgtgtataagaagtacacaatgttcaagaaatttcagggtgcaatgcagatagtagctaccgcagaaactgtgatatacatgaacatcgatgactcttcagagaattactggcttcgtttattgctcagggaatgggcacaattctgcatctttgtgtacattggatggattttcaggtcacgagatttggcaccaaacttctctgttatgcctaccacaaagtgtaaaggcgagactctagtgcctcccatctacagtattgaaatggatgcagcaacatttaaagaatttagtagccatgaatggcacattggggtgccaacgtctacttcttatgatgaaagctccagagatgaagttttggcaatcattcagcatcctcgagcacagaggctaagaaagctcgatgctttttcgcacagggcagactgttttgttgtgtcagatctcaatacaaattcatctccatgcccaacataa

SEQ ID NO: 69346 - DNA, 369 bp, Glycine max
  Peptide Sequence Number=SeqID_186124
atgaagtcaggtgacatgcgggggtaccgtatggttatccgcacctttcgtcaaccagacgcaaacgagcctgttgacgcgcagagactaacatcgtcttctgcaccttctgtcatcctgactcgtgaagtgttacttttatcgtccagagacattcaagtccgacaacgcgcaagattcttctctgctaggcaaggacgatcgagttcgatagcttgtggaaacgtcatggttatcccgttttatcgctttcgaggcattgaagatggggtgcaaatagcaattttcaaattttcgaatttggaccttccagaacattttggaagcggggttgcttatggaggaagcaacccagctcgccttggctag

SEQ ID NO: 69347 - DNA, 1509 bp, Glycine max
  Peptide Sequence Number=SeqID_186125
atgaagcatccatatttggtgcagtggtttagagagactgaaatgccacgaatagcaggatattttattccacttctaaaaaagtggtctgtggaatatgcaggaagtgcagtggtgaaattgggcgccaggcgcatctgctgccccttatttgtattgtctctcgaagatgctttggtcaagctcatggatttctcactcaatcttgcacctgtggacaaattacactggttagcaactgaggcgggatttgaactgaatttcttgtcccattttggtgggaaggtttttcccagtgagaaaactgaggacctagagttttggatcggtttagcccataagaaactattgaaagctttctgtaaagaaagcatcacttcaaagaagcaaaattttcagcaaaagatacaagcagataatttggccacattgggactttttacatatcttggaaaaaggacaagaatatttttgtcggcaatgggcattaaggatcttgatggagtagttaagaacttcctcagttacttggaatgtggaattcttttcatatatccagaattttcctccattcgagtgtatcagtgtttcatggaggtggtaactgatgagataggatggcttgatttttatggttcatatgttcaaataaattgcaaggagaaaaggtctaaacataatgctcgccaggcagagaaagagataatttcttctgtagtttttactgtgtgctatgatgttttctctgggtttgcacacttcaatcgcacaactcaacaatcattggacacagcttcacgctcatacttgcttcgttgtgaatcactaaatactgtggatcatgcttcatttgacaaccatacatcatatatgggaagtataaatggacccaagttacctctggtgtttgaagtgcaacagatgtcacatgacttaactacagaaggatgtccaaagagtgatttccgaaacagttctatattcaaaaaatgttgggcttttagctcacgtattttgacaatgatgaaggctccaatttcagcaatcgcgaataagaaaacatacgaggaagatacctgtgtcaacaagtctaatcctcagcatgaaagttttatcaagagatacagcatcaagttggcatccacaagtgcagacctctggatgggtactgtgttgctcttcatagacattatggttgctttagaactacttgtaaggcaagtgcatggctgcaaggcttccgagagtcaaagaaagaaactacacagaaccatgactgacataattgtgctaattccagtgacaattttgatgctaattcctgtaacagctgtaggccatgcagctattctagcagctatcaagaagtatatgccattcttgatcccctcctctttttcttcagagcggttggatgttgtaaagctaataaagcaaactagaaagatgggttatcagttacattcggctcagtttgaccttgaagatcaaccagcaaccatttcttga

SEQ ID NO: 69348 - DNA, 789 bp, Glycine max
  Peptide Sequence Number=SeqID_186126
atggatgtcttcgacaacgatcacgaccatgacgaaccatttgttcgataccacagtaacgttaacagaacaatactgtacgtgtccatggtttccttcataacagtcttgtttctcgtcttcgcactctacctctacgcccggtgcgtcctaaggggccggtcccgcaaccgcgccgccattcgacgtctcaccatcgccgcgcttcacgtctctgacctcgacgcagccgccgccgcacaccgacacgccgaaccacccaacgcgggcctcgaccctgccatcatagcgtcgcttccaaccttcgcctccagaacgaaggttctagaaaatggtggtgatggtggcggaggaggggccaccgtggtggagtgtgctgtgtgcttgagtgctctagaaggtgaagaaaaggccaagttgcttcccaactgcaaccacttttttcacgtggattgcattgataagtggctgggttcccactccacatgtcctatttgtcgagccgaggtgaagccgcagcttcaaccacagcatcgtgagggtcctgtgggtctttctcttcacagtgcacgtacactgctcagtagggtggatggtgatgatgataataacaacaatgataacgaatcatcaaaaattaatgattctaattcacggttgagctcgtttaggaggattctcagtaggcaaagatcttcaagaagagtccaaccgtctggccacgatgatgaggatggtggtgttgatcaagatttggagagacatgatgaacatagaagggaggtatag

SEQ ID NO: 69349 - DNA, 1176 bp, Glycine max
  Peptide Sequence Number=SeqID_186127
atgggttttgttcgcatgaaagctgtttgtgtccttgaggccatccttagaaagaaggacgatgatcacttttcaccagtggaatcctacttcacggaaaataaagacgtggtgctgagatgttctgaatctccccaagcctctttaagggaaagggctatgaagtgttatgtggatctggagagcactaaggttcttggccttttaggtggaggccagccaaacagctctacagttaattcagagaagactgtgaaaacagagaatgctactgttgctgagttgcctgacttgatagacactggtgattcaaatgattaccatggaactgatgacactctaaagggtacaagtgatcaaaatatagcaaatttgacatcatcaactcctctggttgatgatttatttggagattttagtgcttctattggagctagtcaagaactaaaaaatgatgatccatttgctgatgtatcatttcacacaaatgagaacaaagaacatgcagatgatctcttttctggaatgactgttggtagcaataagcagggcgatcatgagagtcacaggcaggggaatataactgaacctcaactttttgacatttttgcttccaattctgaacaaggaaaccataaggagcctgttagtgatttaatggccggtctgtcaatggatgaaaatacctcaagtacgaagcagaagggaacgtctcctttcatgcaatctgaatctttattttcaggtttgaataaccatatccctgacaatacttcaggtggcatgttgagctctcagccaatggggtttaatgtaaatcctatgtttcccactggtcctatgccttataatatacagcctggtttcatgttgaaccaaccttattcttcccagcctctcaattacggtgccatgggaactcttttggctcaacagcaattcttggcaacaatggctaatttccaacaccttagtaatgtcaacatgcaagatgatggtgttgctcaaatggccggacctaatggaagatcacctttgccagacatatttcaaccaaattttcaaactcaaactcctagctcaatgatcaacacttcaaggaaagaagaaactaaagcatttgactttatctcggaccatatgtcatctgctcgtgattcaaggagaatgatttaa

SEQ ID NO: 69350 - DNA, 1146 bp, Glycine max
  Peptide Sequence Number=SeqID_186128
atgactacacccttggaacatgattacataggtttatcagaggctccatccatggaaaaaagctgtgacaagatatcctcttcggtttcctccaacctttcttctgaggatgagaacacttcatctctgaacttcaaggagacagagctgaggcttggcttgcccggttctgagtctcctgagaacaacaaattagggatctctctctttggcaaggatttgcagaataatggctattcttctgcttcttcaaccccttccaacaagaacctcaagaggggcttctctgatgccattagctcttcttcttcctcttctcggaaatggattttctcccagagtgatgcggcagcaactgaggctgatttggaaaatggttctaataatacctctgcacgatgcaacagagaggttgatatggttcctcactacgagaaaccagctcaggttgctgcaacaaatgaccatgctactgttcctgctccaaaagcacaagttgtgggatggccaccaattcgatcttttcgaaagaacacgatggcctataatttggcaaaatgcaacaacgaaactgaggagaaaccaggagtagcttgtctttatgttaaggtcagcatggatggtgctccgtatctcagaaaggttgatctgaaaacctacagcaactatattgaactttcttcaggtcttgagaaaatgttcagctgcttcaccattggtcaatgcaattctcgtgcacttcctgggaaagatggattaagtgagagtgcattcagggatattgttgatggctctgaatatgttcttacatatgtagataaagaaggagactggatgcttgtgggtgatgtcccttgggagatgttcactgagtcatgcaacaaactaaggataatgaaagggtccgaggcaatcgggctaggtgaaaagtggcaatatattgaatatgatactttttctttttacatcttaaatggaagattagctaacaatatgttatcaatttccttgcagctccaaggggtatggaaaaatgtaggagccaatactagtacagaacattctgctccgccactgggtcattcacccaagcatatatataaagaaggtctagaggagaatttcagcttaatcaaagaaaaataa

SEQ ID NO: 69351 - DNA, 501 bp, Glycine max
  Peptide Sequence Number=SeqID_186129
gatgatgaccagctaatgtggaggttcagtcacaatggaattgacacagtaagaagcgcaagtaataatatcatggaagcaatgctagacaatgaccatctcaaagtgcctggaaagtggaacattcaagcacctccaaaaatcaaacattttgtttggagactccttcgtggatgtcttccaacaatgcagaggcttgtgcaaaagggaattgattatgtcctccagaatgcggtttctgcagcaaccacattgagaatgattggcacctcaacatcaagctcgtccaaccagaaacctctttggactcctcctgcggctggcattatcaaatgtaacctcgatgcagccattttcaactactcccaatcttttggagtaggcatctgtatccgaggggagcatggcaaattcatccaatgcaaaatggaaacttttggtggcattccaaacctgccgaggctgaaggttggcctctttatcgagctctcaaatggatag

SEQ ID NO: 69352 - DNA, 234 bp, Glycine max
  Peptide Sequence Number=SeqID_186130
atggacatctgtcctataaacctccagaccaaaaagatccaacggttaacgaatacaggagggtgcttttaccgagacagctcaaacagcttccttgagaagctttctcttacttctacaactcctaaccctagtcccacaccaacttatgtttctgctcctacgagcaccctaatccattcaaccatgtcaaatcggcgccctccacacacaccacctagatttatctcctaa

SEQ ID NO: 69353 - DNA, 207 bp, Glycine max
  Peptide Sequence Number=SeqID_186131
atggtcatgtacttgacgatgcccacgtttcatatgttggatgttgtgtatgttcatggggggggtccagtgaccttgtcagatgtcccttgtgtgggaaactatagtgggaactcccttttggccgaggttgataaccgagggagcgggggagttatggtgcacgactgggtggcctcgacaaatactgcatggtttcctaagtga

SEQ ID NO: 69354 - DNA, 624 bp, Glycine max
  Peptide Sequence Number=SeqID_186132
atgcccacacagtccaccatacatgttttgctttcttacagagagagaatgagaggtgagaaaggaggggaaaggggaaggggggagtataagaacctaaacagagttaggaacgaacacagggaccatactagctattacttcacaaatttcccagagagccacaatgaggaagatttctggaagacttttatgagatggggtaaggtgagagacatgtttattgctccaaggaggaataggggggacaaaggagaaacatcaagaactacgaggaaactaagttgtgaaaggcaaatcttatgcacaatccattactatgcagagtataatattgaacttttacagaaaattttggtgggaagattgaagaaaccaaaggagatttacaacaataatgagatattacttatggaaggggtgtgttcactcaagatgagatatataggtgacaacctggttctgcttactgcgatggatcgagaagacattgtagacgtcattaagaaacctgaagaatggttgacagatttgtttgaaatcattggcccatgggacgtaaaggccactccggctaatcgcttgacatggctaagaatctctggagagcaaggagtgctttga

SEQ ID NO: 69355 - DNA, 444 bp, Glycine max
  Peptide Sequence Number=SeqID_186133
atgcataaggcattgcggtctggtgcacctctcccttaccctcagcttgtgactttatttcttcaacattttgaaattcctttggattctgagccttttgtgctagttaaacgctcctttgctattggtgctggtgcggtaacctcctttggctaccgtaaggacgtagatgggcagtggctgaagaaggacgcacaacctctgcaagacgagtgtactccctctcctccacctcaacgagatgattcctcggtcctcatgaatgaagttcttttggaattacgaggcctttgcacctatgttggtgaacgctttaattccttggatggtcgcatagatgccattgatgctcgctttgaaggaatggatacccgcatcactcagcttgaaaaggatgtgctttggctttttgatgttgccaaaggggggagaaacagggtttag

SEQ ID NO: 69356 - DNA, 933 bp, Glycine max
  Peptide Sequence Number=SeqID_186134
aaccaccacctactttgaaccaagccataaaacacacagagcacaatagaggaggaacaatcacaaggggcatgaggaccggtgtaggagatattgttcaagtagaaggagggcacattgttaggtccacaggtagaaaagatcgccacagcaaggtctacacttcgaaagggccacgcgatcgccgcgttagactctcagcacacacagccattgagttctatgatgttcaagacaggcttggctatgacaggccaagcaaggctgtggactggctcatcaagaaggcaaagacttccattgacaggcttgctgagcttcctccatggcatccacctactcatgaggaagaaaagcagaatgatgctgcaggatcaactccaaaggcaattggggccttcagttcaacccatgctgacactgaccccatcaattttcaaaccaacaactcctcagaagatcttggcctatccctccattgcttccaagaccaccctggcctcattcattggcaatcacaacagacaggtgcacatcaaacacctccttcaaatgaacaccaaatccgaaccctttttgctggctcaaccccaggtggctttgagaaccattatcaaagaagtgtgacttggaacaatgaagcaactaccactgatcatgtgaacaggttggggttcatactcaactcacagccatttataggccaaggttctacttcagcttatgctcaaagtggggggacccttcagtccagtttttcatttccaatgacttctccctctgagcttcacaggccccagccagtgaaccaaccttccatctttgacagcaggtttgtgtctgatggattagctgatttctgcattccagatagaattcaaggtgtggaagagaaccatggagttgcttccaataggccatcttcttccccta

SEQ ID NO: 69357 - DNA, 273 bp, Glycine max
  Peptide Sequence Number=SeqID_186135
atggtgtcctatgattggcagataaccatgtcctttaaaaactaccaaaagatctttaatttcttctctgacctgaccctgccacgctttgcagaagcatccacgagctttttcaataggccaaggtgttggcttttggggaccagcagcagtggcagaattgtcacaattcaaagcctgtggacagctgcaacagatgaaggactgcaggcaactatagttaagagcaacagcaagcaaagcaaagtgtgtctgcttaaagaaaacctatga

SEQ ID NO: 69358 - DNA, 198 bp, Glycine max
  Peptide Sequence Number=SeqID_186136
atgtgggacctgtttgccgtgtaccattgctacagtgcacagataagcatgcaatgccaagctagccccctttcaactttcaaacatgcacctccagagatcttatatgacatgtggatgtgtttgttccattttggctgctttattgcctcagatgccattgcggcccatgcatgcattctagctctaaaccaataa

SEQ ID NO: 69359 - DNA, 330 bp, Glycine max
  Peptide Sequence Number=SeqID_186137
atgaatgaatatgggaatagggttatgaagatgaataaggagaagcgagaagaacctgatgagagaggagggaaagagatttccatctggggaggagggtgtgggaagtgtgaatccaagcatcgtgtgaagggagagtcattgcgtggtggtgatggtgatgatgaatttggttgggttttgttgtgtgtccatgcaccgcttctttctctctctgtctctctgccactactactgtttagtttagagagagaaagggagattaggatgttctggtcattaggggtagcactgttgttgcattacattccaccatgtcacggaatctaa

SEQ ID NO: 69360 - DNA, 1101 bp, Glycine max
  Peptide Sequence Number=SeqID_186138
atggccttctctctgttccaaaaccccaccttccttaaacttaaacccccaaccatcgcgacgccgcgctggggctacgttcgggtgcggtgcggtggaccgcgttcccagcgtagcccattgatgaaaggccgaatcctgagcatcgaagcaatccaagccatccaaaccttaaaacgcctccaccgaaccaaccctccgaacctctcctccctcgtctccaacaccctcacgcgcctcatcaaatccgacctccttgctactctgcgggagctcctacgccagcagcactgcaccatcgccctccgcgccttctccaccctccgatccgaatacggcgccgacctctccctctacgccgagattatctctgccctcgccgccgccgccgccgccgccgaaatgaccgaccacgtggaccgtctcatcctcgacctcgaagctgaaaatgaagaaatcaagtgcgacgatcacaaggggcttgccagtttgatcaaggccgtcgttgctgctaggagcagagaatcaacggtcaggatttacgggctgatgaagaagagtggatatggttccgttaccgagcccgatgagtatgtggttaaggttttggttaatgggctcaagagtttcggggaagaggctcttgccagagaacttcaggatgaatacaaaattgcgcttgctatgttaaatttggctgttacatgttatgatttgacagagtcacaatgtagattagttgattgcttgtgttttgttgtgaactgcttgaaacctatagtgcatggttcaattgcgagatgctcaaaacgaatggaagtcatttggaaagttactgtgagccaaaagagtatactccctccaatattcagatctccatttcctggcagccacctctcctcaatgtgttcaaggttaatgtggatggatctcacagacagggtgggccaaacctcagcttgtgatggtctcatccgtgacttcaaagggaagttatcaaaggcttccattaaaattttgatcaaagtaatgtcctttggacagaattgtggggaatctatccgggttgttcatcaactctttgtctcgcgtgatttatga

SEQ ID NO: 69361 - DNA, 300 bp, Glycine max
  Peptide Sequence Number=SeqID_186139
atgacgaattatgtttttcctagtccttcgaacatggactacactccaccaattgtccaaccagatgatttcctgagcaatgtttttggaactgattgtggcatgccagcatcagctcgtgaatgcatgcatagcctgcagaacgaagtgggtaactttactccaccaagtttcaatttgatgtttagccaagatgttgaagtgaataatccatcattgcatgatataccatatcaatgcccgtgtcgaaatccaggacgtaataggaaacgcccttcatgtggaacaggacaccattga

SEQ ID NO: 69362 - DNA, 180 bp, Glycine max
  Peptide Sequence Number=SeqID_186140
atgtcaggccaaaaaaaagttataaaatttgaaataattgaactcaaaaccaacgaggacgagatgaaggtgctcattgagtctaactactggaaaaatattgggccaataaaaattttagctattttcagtaaacctgtaccgcaaatggaagacgagttgtccttgtcgcaaaattag

SEQ ID NO: 69363 - DNA, 300 bp, Glycine max
  Peptide Sequence Number=SeqID_186141
caaaataggggagaagcttgccacccagctcgcccaggcgagcaaggttgcttcctccagaagcaacaaccttctggaggaaggatctggaaggcccaagtggctttcgaagaagttacggaaactcacggatcacgcaaaaacacatcttttcgatttccgccacatcacggaacttcacggatcgcgcgagcctgcttccttttgatttctgacacgtctcgggacttcatttattgtgcaacaaaggacgccaagtatctcaaagcggctaaccaaaggttgcatgtcatcaagtaa

SEQ ID NO: 69364 - DNA, 177 bp, Glycine max
  Peptide Sequence Number=SeqID_186142
atgccacattgtttctcaatgccccacaaagaaaaccatgatcatgaggagtcaagcatctatagtagtcaagaggaggctacttcttctccttcctcaagtggaaatgagggtgaatccaagggtgatgagcatattgaaaaggtttacccttatgaagaaggtgatcttctaatg

SEQ ID NO: 69365 - DNA, 225 bp, Glycine max
  Peptide Sequence Number=SeqID_186143
atggcggtactcctaacacacttggagcttggtccttctttgtataagattcatctaggtccctatatggaaggagtttgtagacaaaggatcaagctgtatacaaaggatcaagctgaaagttttgatgatgccaaaggattacatgaatcatatgcttctcaaagatttactcaagacaaagcaattagagatattcaagatgataatcaagacagtctatag

SEQ ID NO: 69366 - DNA, 177 bp, Glycine max
  Peptide Sequence Number=SeqID_186144
atggccctctacgggtcgacgttagcttactcgaaccccctcaagcctctacttgtgtccgtccctaagtaccaaaaagttggtaacaacaatgtgtggcaaaccgtgaccgcgtcgtcgtcctaccttgattggtttctgcctttgaccttgtctcgacctctgaccattgcctaa

SEQ ID NO: 69367 - DNA, 300 bp, Glycine max
  Peptide Sequence Number=SeqID_186145
atgtacctggttgaacgatacatgaagatcttaaaagggtatacaaagaatctacaccatcctgaagcatccattgttgaaaggtacattatagaagaagctattgagttttgttcagagtacattgaaaaggcaaaacctattgggcttcccgagtctcggcatgatcaaagagtgggagatctgaagaagctaacttatcagaagagtcattcatcatggcaaaccaggctaaacaagtgttttatgttcaagatccttgtgatgaaaaatagtcaatggttctacacagaaaaatga

SEQ ID NO: 69368 - DNA, 235 bp, Glycine max
  Peptide Sequence Number=SeqID_186146
actgatcgagccaaggacatcaaggctcgggctgtgcatcaattaagtgtgactttcctgggtatgtgtctcggcatgggtgggtggtggggatgggagcgaggtcgagatggtggtggcggagcacatagaggaattgggatcacctattcttgttgctaccattttgcggtcgtaggagaatttttctcagccccacagtggacgccagatgttcctgctcagttccaacgag

SEQ ID NO: 69369 - DNA, 1830 bp, Glycine max
  Peptide Sequence Number=SeqID_186147
atggagaaggaactagaactttcttcagctcaatccagaatggattcccagcgcatttcccaaccccaaaggtgtggtaagggtggcctcgttaccatgcctttcatcatagcaaatgaagcacttgcgagggtggcaacgttggggcttctgcccaatatgatattgtatttgatgggaaactacaatcttcatttaggcaaagctaccaagatactcctcttatcagttgcaaccaccaatttcatgcctcttcccggagccttcattgctgattcttatctgggtcgcttcctcgctgttggtttaggttccttcatcacttttctgataaccatgtctcttaaggatgtgtttagggattcgatccctgaagatcatgttcatgtgtatagaaaagcaagcctttgtggggagagatcagtccctcaaaatttaactggctcaaagaagaatgggatgcccttgggaatgacactgttgtggctaacagccatgatcccacaggctcggcctcctccttgcaattctgaaactgaaagatgtgaatcagcaacacctggacaaatggcaatgttaatctcttcccttgctctcatgtccattggaaatggtggcctttcatgttccctagcctttggtgctgaccaggtgaatagaaaagataaccccaataaccaaagggccttggagatgttcttcagctggtactatgcttcgtcagcgatatcagtcataattgccttcactggaattgtatatatccaagatcatcttgggtggaaattgggttttggagttccagcagcacttatgttcttgaaacttcgattaccacataagatctcagatggaatgtatcatcgtaacaaggactctgatctagttgttccatctgataaactaaggtttctgaataaagcttgcttcattaaagactcagaaaaagatatagcctctgatgggtcagcctacaatcggtggagtctctgcacagttgatcaagtagaagaactaaaagctattattaaagttattcccctgtggtctacagggatcatgatgtatcttaacattggaggctcgtttggattgctgcaagctaaatcccttaaccgacatatcactccaaatttcgaagttccagctgggtctatgagtgtaatcatgatatttacaatatttatttggatagctctttatgatcgtgtcattattcctcttgcatcaaagcttagaggcaaaccggttaggatcagtgccaagagaagaatgggacttgggttgcttttctcttttctccacttggtaactgcagcaattgttgagactacaaggcgaaggagagcaattagtgagggacatattaacgacacacatgcagtgttgaatatgtctgcaatgtggctctttcctcaactttgcttgggtggcatagctgaagcattcaatgcaataggccaaaatgagttctattacaccgagtttcctaagactatgtcgagcattgcttcttccctttttggactaggaatggctgtgggatacgtgttatcttcattggtattcagtattgtggaaaaggttacttcaagagggggaaaagatggatgggtttcagataacattaacaagggtcgatttgacaagtactactggcttcttgccacaatgagtgctgttaatgtactgtattatctagtatgcagttgggcttatggacctacttctgatcaagaatcaaaggtaactgaagaaaatggttccaatgaggaagaattgccattaattcaatccaggactaagggtcagtttgataaggtatctcag

SEQ ID NO: 69370 - DNA, 706 bp, Glycine max
  Peptide Sequence Number=SeqID_186148
atggtaaacaccaagggagagaccagaaggataattatccttaactggtgttctagtcacatgttgtctatcttcatcttatactcattctttttcacttttagtttcaagcattgctcagcaacagatactataagtataaccattaacaacttcttgcaagatgggggaggggatactctagtttcaaaaggtgaaaattttgagctaggatttttcactcctaatggaagctctagtgggaaaagatatttgggaatatggtactacaagttgactccactaacagttgtgtgggttgctaaccgagacaaaccacttctagattcttgtggtgcttttggcatagcagaagatggaaatctaaaggttttagacaaaagtgggaaattctactggggcacaaaccttgaaggatcacattcacaacacagaatagttatgctaatggacaatgggaaccttgttgttagtgatgaagttgaagaccaaggaaaccatcaagtgaagattttgtggcagagttttgctaatccaacagacacatttctcccaggcatgaaaatggatgacaatttagcattaacttcatggagaagttatgaagatcctgcaccagggaacttctcttttgagcatgatcaaggggagaaccagtatataatatggaaaaggtccataaggtattggaaaagcagcgtttcag

SEQ ID NO: 69371 - DNA, 1964 bp, Glycine max
  Peptide Sequence Number=SeqID_186149
acacagaaaagggaaggttgggtgatagtggggatgtagtttgctggatttggtctgaggacttgaacaatcttgaagaagagtatgaggatgggtgtgacctgcatgttcgtgtcgcagtttctgatataggtggccttcataatgaaaatattaaatatgagggtcatggaatcattgtcaatcatggctcatgtatagattcttcttctgcagaatccactgggagaaattgtgggacctgtggtacaaacttcattccatatccccttagcacaggaccaagttgtggtgatcccatgtacttcagttttcactgcaatatctccactggtgagcttgactttgagactcctgggggcacatatcaagtgataagcataaacccagaagcacaaaaattcttgatccacagaaagaatgtacttaactgtgatcaaagttcaagggataagtttctgcctctcaacaagtcgtttccgtttcatcttaccagtaattgctatgctgatccaagcatttttagttctaatgctcccatgaaacatggagtagaaatagaattgagttgggagcaaccattagagcctatttgctcttcattgttggactgcaaggagtggccaaattcaacttgcaacacttccagtgatggcaagaagaggtgcctttgcaacacaaactttctttgggatggattgaagttaaattgtactctagaaggaaatcatagctatcaaccagaaaggcaactgtccttacctaagatcattgtaattactttaacaactgtgattggcttgattcttctctcaactactagcacatgtgtttacttgaggaaaaggagacaggccaaaccacaagatagcaggggatatgttcagaaaaactcagggattaacttgtatgacagtgagagatatgtaagagacttgattgaatccagtaggttcaaagaagatgatgcacaggccatagatattccatatttccatttggaaagcatacttgatgctactaataactttgcaaatacaaacaagcttggacaaggagggtttggtcctgtctacaagggaaagttccctggagggcaagaaatagcagtgaagagactttcaagttgttctggacaaggtttagaggagtttaaaaatgaggttgtgttgattgccaagcttcaacatagaaacctagttagacttttgggttactgtgtggaaggagatgaaaagatgctagtatatgaatatatgccaaatagaagcttggatgctttcatttttgactgggatgtgcgcttcaagattattttggggattgctcgagggctcctttatctacatgaagattctaggttgaggattattcatagggacttgaaaacaagcaacattctactagatgaagagaagaatcctaaaatctcagactttggcttagccaggatatttggaggaaaagagacagtagccaacacagaaagagtggttggaacttatgggtatatgtctccagaatatgcacttgatggacatttttcagtcaagtctgatgtctttagctttggtgttgttgtacttgagattattagtggaaaaaggaacacaggattttatcaagcagatcatgaattgagtcttctaggatatgcatggcttttgtggaaagaaggaaaggcgttggagttcatggaccagacactatgtcaaacatgcaatgcagatgaatgcttgaaatgtgtgattgtggggctcttgtgcttacaagaagatccaaatgaacgccccacaatgtcaaatgtagttttcatgcttggtagtgaattcaacactcttccaagtcctaaggaaccagcctttgttatcaggagatgcccttcgagtagagcatctacttcaagtaaattagaaaccttttcacgtaatgaattgacagtcactatagaacatggcaggtag

SEQ ID NO: 69372 - DNA, 102 bp, Glycine max
  Peptide Sequence Number=SeqID_186150
atggacatgagagcaaaggaagagattaacattgtcatttgcccagctgttgctggattcaggatagcttatttatctccatatatgtcacttatacgttga

SEQ ID NO: 69373 - DNA, 735 bp, Glycine max
  Peptide Sequence Number=SeqID_186151
atggtgtcagttaacattggaggctcgtttggattactgcaagctaaatccctcaacagacatatcacttcacactttgaaatcccagcgggttcttttgccgtagtcattgtgtttataatatttatatgggtggctctttatgatcgtgtcattattcctatagcatcaaagctcagaggcaaaccagttaggatcagtgccaagagaagaatgggaattgggttggttttctcttttctccacttggcaactgcagctattgtggagaatgaaaggcgaaggagagcaatcagggagggacatattaatgacacacatgcagtgttgaatatgtctgcaatgtggcttgttcctcaactttgcttgtcaggcatggctgaagcattcaatgctataggccaaaatgagttttattacactgagtttccaagaactatgtcaagtattgccgcttgcctttttggacttggaatggctgcaggaaatgtgttatctagtttaatattcagcattgtggaaaatgctacttcaagaggaggaaacgagggatgggttttagataatattaacaagggtcgttatgacagttgggcttatggacccacggttgatcaactattcaaggtgtctgacgaaaatagttcaaatgagaaagaattcactcaattgggcaatatgggccaggttgatgttagtgaaggaattggctcaaatgagaaaagagttaactag

SEQ ID NO: 69374 - DNA, 282 bp, Glycine max
  Peptide Sequence Number=SeqID_186152
atgcctgaggctcctagccagtacctttgcaacaagccaaatggaaaacttgatgatggtggtgctactaatactagcatcatcatcgagcacaacaataagaaagcactcaaatacattgaggatgttactagcaacgctgatgaaattcagaaaagggtccttgctgagatcctttcttgtagtgcacacgttgagtaccttcaacgccatggcttggaggggcgcacggatagagaaacattcaagaagatcatgcctgtggtgacctacgaggattaa

SEQ ID NO: 69375 - DNA, 411 bp, Glycine max
  Peptide Sequence Number=SeqID_186153
atggttgagaaagagatggaagatcccagtctagaagtgatccggaaatggataaaaggcctgtcagatgggacttatggtcaagagtttacttccaccacaagggttatccggctagtaaaggcacacaaaggtttcatcctttgtgacttgatcatacacagtggcttgttggatgaaaatggaaattggcatgtcagtgccatagcaacattagttgacatcattgcaagttttacctcctactccgttacctcgtgtctgcaggaagaggttgaagtggaggcaaaggttataagaaagaaggatgagttgatttctgtgattgtggaagtcaggaaaaagcataatggagaactggttgctcttggaaagctgtggatggtagctagaaagaatccaagaaagtaa

SEQ ID NO: 69376 - DNA, 1092 bp, Glycine max
  Peptide Sequence Number=SeqID_186154
atgaggacgtgtagtcctctgaagacgagtatgtgtagtcctctaaaggtgagtgcgtctagccctacgaaggcgaaggcgaggacgtgttgtcctctgaaggtgaggacatgtagtcctcagaaggtgagggcgtgtagccctacgaaggtgaaggtgaaggcgaggatgtgttgtcctctgaaggcgaggacgtgtagtcctctaaaggtgaggacgtgtagtcctctgaaggtgaggacgtgtagtcctctgaaggcgaggatgtgtagtcctccaaaggtgagggcgtgtagccctacgaaggtgaaggcgaggacgtgttgtcctctgaatgtgaggacatgtagtcctcagaaggtgagggcgtgtagccctatgaaggtgaaggcgaaggcgaggatgtgttgtcctctaaaggcgaggacgtgtagtcctttgaaggcgaggacgtgtagtcctctaaaggtgaggacgtgtagtcctctgaaggtgaggacgtgtagtcctctgaaggcgaggacgtgtagtcttctaaaggtgagggcgtctagccctttgaaggcgaaggcgaggacgtgttgtcctctgaatgtgaggacatgtagtcctcagaaggtgagggcgtgtagccctacgaaggtgaaggcgaaggcgaggatgtgttgtcctctgaaggtgaggacgtgtagtcctctgaaggcgaggatgtgtagtcctctaaaggtgaggacgtgtagttctctgaaggcgaggacgtgtagtcctctaaaggtgagggcgtctagccctacgaaggcgaaggggaggacgtgttgtcctctgaaggtgaggacatgtagtcctcggatggtgagggcgtgtagccctacgaaggtgaaggcgaaggcgaggacgtgttgtcctctgaaggtgaggacgtgtagtcttctgaaggtgaggacgtgtagtcctctaaaggtgaagacgtgtagtcctctaaagttgaggacgtgtagtcttctgaaggtgaggacgtgtagtcctctaaaggcgagggcgagcagccctttgaagacgagggtactagtacccaagggtccactcttatga

SEQ ID NO: 69377 - DNA, 450 bp, Glycine max
  Peptide Sequence Number=SeqID_186155
atgtctaccagtagtttctggaagtcattaatccgtgatgaaattcaatctggaaagactgacaaggacatctacaaaaagcttgaggacgaatttggagagactgtactctatacgcccaaatttgatatgcagacagcagctttgtggttattaccgctcctaattgcaggttcagctgcaggagtatgggcttacaacaggcataaacaaaagactaatgtccatatcatggctttaaaccttgttagaggtgttccattgaccccaaaagagaaggaaacaatgcttgatactcttacacctcctcattcacagggagctaggacacccttctggtggaggagatggcaagccttgtgggcaactaagttggctaaggcttcaatagacttcgaagatagtaatatagtacatgctaagaatgatctggaggatttcattgcttaa

SEQ ID NO: 69378 - DNA, 1560 bp, Glycine max
  Peptide Sequence Number=SeqID_186156
atggaggtggtcaaagcaattgccaagcacgaacctgcagctcctgaaagtgttgctatcagagctgatcagaagagttatagttacaagcaactcatcacatcggcacagaagatatctaatctcttgtgtggcagtgatgcacagacaggaaatctcggtggagctcgaataggaattgtagccaaaccttctgctgaatttgttgctggaatacttgggatttggcttagtggaggtgttgctgttccgcttgcaaccagctatccagaagtagagctcttgtatgtgattaataattcggttgagtctcacatatctaaggatgtatctgcaatactgagtactgaggatcatactgaaataatgcaaagcgtagccaataaaagctcttctcagttttttcatcttccacctgttctcaacaagtcttctgagaaaagcagagataaacattcacagaatgggggaattcatacagataaaattttgttggataagtttggaagatcaagtgaagatccagcactgattttgtacactagtgggacaacgggtaaacctaagggagttgttcatacacacagaagcatcatttcccaggttgagtttttgccaaaatttagtgtgagaggagtttggcagagatggcgtgagtcatatccaaccgatggttctaaggctgaagaggctataactgtgttcactggagttccaactatctatgcccgattgatacaaggttatcatgcaatggatcctgagctacaagctgcttcagtatctgctgcaaagaacttgcgtcttatgatgtgtgggtcctctgcacttccactgcctgttatgcaagaatgggaagccatcactgggcatcgcttattggaacgatatggcatgactgaatttgttatggcattgtcgaatccattgaaaggtgagcgcaagcctggaaccgttggcaaaccatttcctggtatacaggtcaagattattgcagatgaagagagtgtgaatggaaatactggaatgggtgagctttgcattaaaagcccttcattgtttaaagaatattggaaacttcctgaggtaacgaaggaatcatttactgatgatggattctttaagactggagatgcagttactacagatgaagatggatatttcatcattctaggacgtactaatgctgatataatcaaggctggtggatataagctgtctgcattagaaattgaatcggttataatagaggcaagtggctaccattttctcattgtggttcatccagctgtctcagaatgttgcgttttaggcctaccagacaaagactatggagagattgttagtgcaatcgttgtgccagaggccgatgttaaacgaaaacaagatcaagaatcaaagcctgttctaagcctagaagaattatccaactgggccaaagacaaaattgcaccttacaagattccaactcagctaatcgtgtgggataaactccctcgcaatgccatggggaaggtaaataaaaaagagctgaagaagctgcttgtttcagaacagtga

SEQ ID NO: 69379 - DNA, 1539 bp, Glycine max
  Peptide Sequence Number=SeqID_186157
atgccaaccatagaagaggagctagagcgaagatcattactctacagcctcctgatgccagtgatggagcaattcgtacctggcctagacaaaggcaaaggaatgtactttctgttcataaaatcagaagccaaaacccctggtggactcttagctcgtccagttttaacaagctactacaggagctcacacttcaagaacaaaacacattgttttgacccttacacaaactacactagccccattgagaccattctctgcctagactcttaccaaagcatgtactctcaaatgctctgtggactttcacaaaacgagcatgttctccgtgttggtgctgttttcgcctcaggtttcatccgtgcccttaagttcttggaaaagcattgggtgtgtttgtgccgtgacattagaaatggcaccattggccctgaaatcactgactcatccgttagagaagccatcatgagggtactcaaaccaaacccaaaacttgcggattttatagagggtgagtgcaagaaggggttgtggaaagggataattactaggttgtggcctaataccaagtacgttgatgttattgtgactggaaccatggctcagtatattcctatgttggattactatagcaatggtctccctcttgtttgcaccatgtatgcttcttctgagtgttattttggactcaacttgaaccctttgtgtgatcctagtgaggtgtcttatacccttgttcccaccatggcttactttgagttcttgccccttaataagacgaaggaacatgcgaattcaatttcttacaccgagcaggaacttttggttgatcttgtggatgtggagctggggcaagaatatgagcttgtggtcaccacttatgcagcttctaacaactatgccaccatgcacaaccaaacaggactttacaggtaccgggtcggcgacatcctccgtgtagcaggattcaagaacaatgctcctcaattcaatttcgtgtgccgaaagaacgtggttcttagcattgattccgacaagaccgatgaggttgagctacaaaacgctgtgaaaaatggagccaaccaccttacactattcggtgcatcactcacagaatacacaagctttgctgatacgtccactatccctggccactatgtactatactgggaaatcagcatgaacaagaacaacaacattgatcaaaatcaaaacccaattccaagttctgtttttgaggagtgttgctttgcagttgaagggtctctcaacagcgtgtatcgacaaggaagagtatcagagtccattgggccattggaaatcaagattgtggagaatggaacttttgataagcttatggactttgctcttagccagggtgcgtctataaatcagtacaagacacctcgttgtgtgaagtatgctcccattgttgagcttcttgactcgaaaactgtttccaattacttcagtccaaaatgtccactgtgggttcctggtcacaagaagtggtgcatgtaccctcttgacaacaaataa

SEQ ID NO: 69380 - DNA, 204 bp, Glycine max
  Peptide Sequence Number=SeqID_186158
atggcgtttgaaatgcagaggttgacagagagaaagagaatgatgccgattgaatcagaaaagttgagtaaaggaagtgttatcatggcagttgaggacgaagcacgtgtcattggacatgtggcagtatctgtgtctgtcatgtgcttcactgaaaaattgatttacatttgcttgctcatgaatcttcaacgggagttgtag

SEQ ID NO: 69381 - DNA, 1305 bp, Glycine max
  Peptide Sequence Number=SeqID_186159
atggtctgcaaccgcaatttcagcctcaacttcaaggattttgggctctcgcagagtgccacgtttgtttgcaatttcctgcgaagtcaaggattgcaacaaaaccacaacagtgactgcaaccacagtttaaaatcttattcttcagttcgtataccaaatgccaaacctagttggcggtgctctttgcgacatgtaattgtggcttctctttcttcattcttgtatggataccatattggagtagtcaatgaaaccttagagagcatttctatagatcttggctttagtgggaatacaatggctgagggtcttgtagtaagtatatgcttaggaggtgcttttattggatctctgttcagtggatggattgcagatggtgttgggcgtagaagaagtttccagttgtgtgctttacctatgataatcggggctggaatgagtgcaacagcaaaaactctgtggggcatgcttttgggaaggttatttgttggtactggaatgggacttggccctcctgttgcagctctttatgtgactgaggtctcacctccagctgtacgaggtgcttttggggccttaacccaaattgcaacatgtcttggactcatgggttctctctttattggaattccagccaaggaaatagttggctggcacttatctttctttgattttgttcagagaggaagaaccattgaagctgaagctgcatttgagaagctcttggggggagtacatgtgaaacctgcaatgactgaactgtcaaagtctgacagaggtgatggatctgattcagtaaaactttcagaattaatctacggccgctatttcagagggtctgtagttgcaatgattctgatggataaacttggaaggaaagtgcttctcctgggtagctttctgggcatggggttatcaatgggtctacaagtcattgctgcaagttcttttgcatctggatttggatcaatgtatctatctgttggtggcatgttactgtttgtgctgtcatttgctttcggcgctggtccagttccttctcttatcatgtctgaaatactacccggcaatatcagagcaaaggcaatggcaatttgcctggctgtgcattgggtgataaacttcttcgtgggtctattttttttgcgcttgctggagctaattggggcgcaactcctgtatagtatttttggttcatgttgtttgatagcggtggtttttgtgaagaaatatattctggaaacaaaagggaagtcacttcaggaaattgaaattgcacttcttgcacaagaagcaaactaa

SEQ ID NO: 69382 - DNA, 945 bp, Glycine max
  Peptide Sequence Number=SeqID_186160
atggcttccgttgttgcaagcttgccgccaccattgctgctccctgctagaaaatcacatatgggcaacttcccaagttcccctgtttctcttctttcagagaaaattttgattatgttgaaggctgcaacctcctatttcttgagcccttggccttgctgtctcaaggctacgagctctcagttagaagatgtttttctagctgctgtcattaatacagtgtggtttctttggatcagtagaaataacgcaagtttccgtaatggccatttctcccatgctcgtatcatatcagagattattggggctgtttcgctctcaggaaacttatccaagggggttatgaaaaactcaatttcagatttctctatgctcagggcctttcatatctctggccatctctccaaggctccccgtatcctccaaatctcttggcatcctcccttggcaggctggtgtaaatgttataccgaccgcactgccagggggtctctgggaattgcggcccgtggtggcatttatcgtgatttcagaggaagcttcatgggctgtttttccttatctttgggagacggagttgcttcctcgcttgtagctgagatcactggcactatggaggccattgaattgctttcgagaaaggatggaatcgcttgtgggagatggaatcgtgtttcttttgttgtgaaggcttctggagaaagttctgaatcttcaactacccttactgtttttaagtctgttcagaatatttgggatcaacctgaggaccgactgggacttattggtttgggatttgcagccgtagcagcgttttgggcatcaacaaatttgattgcggccattgacaaattgccacttttcccaactgtactggaattagttggaatattttactccgtgtggtttacttatcgctatctcatatttaagcctgaccggtaa

SEQ ID NO: 69383 - DNA, 201 bp, Glycine max
  Peptide Sequence Number=SeqID_186161
gatgtttacgaaggctatgaggcgattgcagaaaggttggagcgtgtgctcaaccttaggatggtcactgcaggcacagagttacatgatattatgcaagattgcctcacgatcgccaggggggtgccagtgcaaatggaagtgtcagggctcgacagagacggtgcacaaagcattgattattgtttttatgttttgtag

SEQ ID NO: 69384 - DNA, 855 bp, Glycine max
  Peptide Sequence Number=SeqID_186162
atgggagtcaacatgtccaacacaccacctcacaccaaagacttgttttcctcttcatctctctctcttagcttagctgggattttccggcatgctggggaggcggcggagacgtccggcatggaggtggcaggcggcaatgaggtccggcgagaggacactgttgagattagcagcgacaactcaggacccgtgagatccaggtcagaagaagattttgatggtgaaggtcttcatgaggatgacgacgacggcgatgacaagaacagaaagaagaagaagaggaagtatcacaggcacaccgctgaacagatcagagaaatggaagcgcttttcaaggaatcaccgcatcctgatgaaaagcagaggcaacaactcagcaaccaacttggccttgctccaaggcaagttaagttttggttccaaaatcgtcgaacccaaatcaaggcaatacaagagcgccatgaaaattcattgttgaagacagaattagacagacttagggaggaaaataaggccatgagagagaccataaacaaatcttgttgccccaattgtggcatggtaacggctaccatagatgcttccatgtccactgaagaaaaacaacttcttattgaaaatgccaaactcaaagccgaggtagagaagctccgaacagctttagggaaattctcaccaagaacaacgtctcctactacatcttctgctggccatcatgatgaggaagagaatagaagctctttggatttttacaatggaattttcgggctcgacaaatcaaggataatggatatagcaaaccgagcaacggaggagctcataaagatggcaaatatgggggaacccttatgg

SEQ ID NO: 69385 - DNA, 825 bp, Glycine max
  Peptide Sequence Number=SeqID_186163
aatcaatggaaggaaatgtttccatgcttaatatcaaaggctgcaactgttgatgttatatgcaatggggaaggttctaacaggaatggtgcagtgcaattgatgtttgctgagcttcaaatgctcactccaatggtgcccaccagagaagtgtatttcgtgaggtgcggcaaacagttaagtgatgaacagtgggctatagttgatgtctccatagacaaagtagaagacaacattgacgcatcccttgtgaaatgcagaaaacgcccatctggttgtattattgaggataagtcaaatggccattgcaaggtgatatgggtggagcacttggagtgccaaaagagcacaattcatacaatgtatcgaaccattgtcaatagtggtctagcttttggggcaaggcattggatagaaacactacaacttcaatgtgaacgtttggttttttacatggcaacgaatgttccaatgaaggattcaactggtgttgcgacgttggctgggaggaagagcatattgaagttggcacaaagaatgacatggagtttctgccatgcagttggtgcatcaagtttccatacatggaccaaggtcacaagtaaaacaggagaagacataaggattagctctaggaagaacttgaatgagcctggtgaacctcttggggttatcttgtgtgccgtttcttctgtgtggcttcctgtctctcctaatgtgctgtttgatttcttgagggatgaagctcgtcgaaatgaggtacagtacaagtgtacaactcttctgcatcctttttttaataaacctagggtattcttgggctga

SEQ ID NO: 69386 - DNA, 372 bp, Glycine max
  Peptide Sequence Number=SeqID_186164
atgtcaaaagtgttggctaacaggttaaaatctctgttggataaatgtatctcatcggaacagtctacctttttggagaatagatcagtcacaggcaatgctttgacgacgtttgaaaccatcatccaccatatgaaatgcaagcgcaaggggaagaaggatgaagtagctttaaaggtggatataagtaaagcttttgacaagatcaagtggagctatccaaaagggatcctaaggaagatggtcttttgtcaagataaatctagagaaagtgcatgcatgaaggatattctctttacctatgcgaggacctcaaggcaagaaatcaacttagccaaatatgaaatttactccgacaaccacacttcttag

SEQ ID NO: 69387 - DNA, 192 bp, Glycine max
  Peptide Sequence Number=SeqID_186165
atggcattccagatccttgccaatccttctccaacaaccaagttaacaatggagtctgtggaatcggtcaataatcttgtgtcttgtacattaagaaatattagaacaagtttgcagtgtgaagatggaggcgaaattcatggatggactttattttatatggaaaactcatccttgaattttgacctctga

SEQ ID NO: 69388 - DNA, 778 bp, Glycine max
  Peptide Sequence Number=SeqID_186166
actcctccaccctccgcctccacggtcgcaacctccaacccaactagcacgtccctgccggctccttccacaccctcaccctcaccctcgaacccctcaaagactcctccatcccccgactccaccggcctccaccacgatccacaccagatcgtatggcaccagcatcagtgtgtgcatcacaccggtcaaatgcagcgtctggaacgtgcgaacgtgcgtcggcatcaccgtgatcgccgtcctagggtttttcactccgaatagcgcccctactctttctgcactctctcgatatgcggtgcgccttcatcacctccccgagatccgaatgcggccacggccggattcggataccgtgccgcccgactaccacgagtcttgcggtgctcgccatcgccgtccgaggcttgttgagaaaaggaagaagacgaggcgcgagaagtggaagtcgagaaccaagctaatgagacagcagacgctggattaccagccagaaaatcgccgccagcaacttcactgcgtcgtcgccggacgaatccaactacgccaatcctctaaagttgttcgcccagcgcgagagtgcaaatgccctgatactactattatgtgtttggattttattttagaattgtatgtagttcgtagcagaatagatagaggtttaaatttgaagagaaaggttggagatggtgctgactttaggtttgaggatcacgaatgcgttgaaccagaaccccttcaagaggtgcaccgcatccagcacgacagcgagtag

SEQ ID NO: 69389 - DNA, 1617 bp, Glycine max
  Peptide Sequence Number=SeqID_186167
atggttaaagcaatggaacaagaacaggaaagtgtcaggtccagactattccatttcaaaggaatgtttgaaaatacagggaggcatacaaagagtttgagcattgagagtgccagcgcattagatccttctccttcggaagaagagccagtgtcatcaagaagtcaaggatcaaaacctctaaatgttctggataaggttcctaggccaaggataagcagggaggaaattgtagccaaagaagccaaagataagatggtgcaagaaatggaacagatgaaggagagatttgctaaactgctattgggggaggacatgtctggtggaggaaagggtgtttcttcagctttggcattgtcaaatgcattcacaaaccttgcagctgctgttttcggtgaacaaaagcggctggagccaatgccgccagaaagaaaagcaagatggagaaaagaaattgattggcttctatcggtcaccgattacgttgttgaaatggttcccgtgcaacaaaaaaacaaggatggctcaaccatggaggttatgacaacacgacaaagaactgatctccacatgaatatccctgctttacgaaagcttgatgcaatgcttattgatactctagataacttcaaagaccaaaatgagttctattatgtatcaaaagatgcagagaatgcagatagaaataatgataccaagtggtggttgcctacacccaaggttcccgtagagggtttatctgatgcagcaagaaggtttgtccagtatcagaaagattgtgtgaaccaagttcttaaagcagctatggccataaatgctcaaactctatcagaaatggagatccctgaaagctatattgaatccctacccaagaatggaagatcaagtctaggggacttgatctacaggagtatcacagatgattttttcgatcctgatcagctcctatcagccatggacatgtccaatgaacataaaatcgtagatctcaaggacagaattgaggcatccattgtgatttggagacggaagatgaaccaaaaagatagcagcaaatcagcttggggttctgctgtgagtgtggagaaaagagaaatctttgaagacagggcagaaaccatcttacttctcctaaagcgtcgttttcctgggacttcccaatccgcattggatataagcaaaatccaattcaacagggatgtggggcaagctgttcttgaaagctattcaagaatattggaaagtttggccttcacagtgctgtcaagaatagaagatgtactccatgctgatctgcaaactcaaaatccatcacaatcaggaagaaagagtctttcgagaaacccaattcccaagccagagaagtctccaactccaactcctaaaaaagaggtagacaagagtggctcagaagcaatgacactatcagatttcatgggttggaacaataatcaaggtgactcagatgctaagaaagaagcctttgcagattcagatgacttctacaaagacatcgataatggaaagccccagaaacttccaaacgtagtcacagacaagaaagtgtcctaccttgagacattgggaggtatgaggagtccaacatcacgccattaa

SEQ ID NO: 69390 - DNA, 894 bp, Glycine max
  Peptide Sequence Number=SeqID_186168
atggccatgaccgacgaatataatgctcttattgaaaataagacgtgggacttagtgccccgtccaactgatgctaatgttatccgaagtttgtggattttcaggcataaaaagaaagctgatggttcatttgaaaggtacaaggctcggctagtaggtaatggttcgaatcaacagactggtgtcgattgcggagaaacctttagtcccgtagttaaaccagcaactattcgaacggttctcagtattgctctttccaaatcatggggtcttcatcagttggatgtcaaaaatgctttcctacatggtaatctcaatgaaaccgtgtacatgtaccaacctgctggcttccgcgatccgcaataccctgattatgtatgcttgttgaagaagtctctctatggtcttaaacaagcacctcgtgcttggtaccaacgcttcactgattttgttgctaccttgggcttttctcatagtatatgtgataactcattattcacctaccacaatggcaatgacacggcctacatccttctttatgtagatgatatcattctcactgcatcctctgacactctacgccaatctatcatgtctaaactgagttccgaatttgctatgaaagatttgggtcctcttagttattttctaggtatctcagttaccaggcattccagtggtatgtttctctctcaacataaatatgctgaagaaatcattgagagagcttccatgtcctcctgcaaaccggtttcaactccagtggatacaaaagcaaaactcagtggaacctctggcaacccatatcatgatccatctgaatatagaagtcttgctggtgctttgcaataccttactttcacaagacctgatatttcttatgccgttcagcaa

SEQ ID NO: 69391 - DNA, 213 bp, Glycine max
  Peptide Sequence Number=SeqID_186169
atgtcagtcgaaaacaagctcaacatgtcagtgaagaatataggttactcctcttatgctctagtagttaacctactcctctcctgctttgctgctgttttcaagtccctcaatgattccatgtttgaaattaatgattcaaaaagtgtatcggagaatagatcgaaaaaatcaagatatgccggattgtatggtgaaagatggaaggcttaa

SEQ ID NO: 69392 - DNA, 1252 bp, Glycine max
  Peptide Sequence Number=SeqID_186170
atggctggctcgaatcctccctctccaccatcttctgttacacatcctgcactcacagtccccaacattaccaattttatcaaagttaagttagatatagaaaagagtcagtacaacacttggtcagaattgttcaaaatccatgcaagagcctaccaagttattgatcacattattccctcctctgctgatgatacacgtgatatatctctccaacaaacagaccccaagctttggtcacgccttgatgctgttgttctccaatggatctacggaactatttccgatgatttgctgaacacaatcattgaacgtgacacgacggcagaaatggcgtggaaccgcttgtttgaaatcttctttgataataagcattccagagcactctatctcgaacaagaattttcgcgagtgcagatggaacaattccctaatgcttcatcatactgtcaacatttgaaaacactatctgatcaattgtcaaatgttggtgcgccagtatcaaatgaaagattggtgttgcaacttatttctggactaacagatgcctatgccgccgtcggatcacagattcgacatggagaaactctcccgcccttctacaaagcccgttcaatgattgttttagaggaaacagcaaaggcgaaaaaggctgcaaccgttacagacaattctgcgtttctcgcttctcaagatgtcagcactgttaataattcttctcaacagaattataacaatacaccaaacagcaccaatcatggaggtcgtggcagcgacaatacagcctctaaccgcggtcgtggtagcaaccgtggtggccgtggtaatcgtggtaggggtcgcaacggaggtcgcaataatcggtcacaatattaccaatatccgcaacaacaacagtgggctgttccaccttgggctgcaccgtggcaaccatgggccacgccaccatgtccgtacccaactacgccaaattggcaacatcagtccactcctcgccagcaaggaattcttggaccaaagcctccacaagctcatatggcagccacatcagcaaataatgctcaaccatcatatgcatcaaccgacattcaagctgcgatgcatactctttctatggctcctcctgatgatcagtggtacatggataccggggccacctctcacatgactgcaaatggaggtaatctcacttcttattccaatatgagcaataatattatcgttggtagtggtcataatattccagttattg

SEQ ID NO: 69393 - DNA, 2736 bp, Glycine max
  Peptide Sequence Number=SeqID_186171
atggcgagagggagcagatcagtgactagcagcagcaaatggaggtactgcaacccctcctattacctgaagcgcccaaagcgtcttgctctgctcttcatcgttttcgttggcgtctctttcattgtctgggaccgtcaaactctcgtcagagagcaccagttggacgatttaaataacaaacaaggtggtacctctgggaagactgacttgagaaaagctaccaagaccagtaaagaggtcctagatgatccgattgatatcgagaggagggaaaaagtaaaagaagcaatgcttcatgcttggggatcttatgagaagtatgcatggggccaagatgaacttcagccacaatcaaagaatggtgtcaatagctttggaggtcttggagcaactttaatagattctcttgatacgctatatattatgggtctcaatgaacagtttcagaaagcacgagaatgggttgcaaactctttggattttaacaaggattatgaagcaagtgtttttgagacaaccataagtgcatatgatctttcaggggacaaagttttcctcaacaaagcaatagaaattgcagacagattattgcctgcatggaatacgcctacaggaattccttacaacatcattaatttgtcacatggacgagcacacaaccctagttggactgggggtgagagtatcttggcagattctggcactgaacaactggaattcattgttctatcccaaaggactggagacccgaagtatcagcagaaggtggaaaatgtaatagcccagctaaataaaacatttcctgatgatggattacttcccatctacattaatcctcatagtggggcagcaggctactctcccatcacatttggggccatgggtgatagagatatgtgggagaaatcaatgaaaggtctatcaagtttgattaggagatcaacaccatcttcatttgcttatatatgtgagaagaatggaggatctctaacagacaaaatggatgaactagcatgctttgctccagggatgattgctttgggatcatttggttacagtgctgatgatgattcacagaagtttctgtcacttgcagaagagcttgcttggacatgttataacttctaccaatcaactccaacaaaattggctggggagaactatttctttcattctgggcaggacatgagtgtgggtacatcatggaacatactgaggccagagacagttgagtccctcttttacctttggcgtctaactggcaacaaaacgtaccaagaatggggttggaatatatttcaagcttttgagaagaactcccggatagagtcaggctatgttggactgaaggatgttaatagtggagtcaaagacaacatgatgcaaagcttctttcttgcggagaccctgaagtatttttatcttctcttctcaccttcttctgtcatcccattagatgaatgggtattcaacacagaagcccaccctctgaggattgtgaccagacacgaagagggacttgttaagaatttaaatgagaagcaaaaacctttttctagaataggtggcaggaaggaaggaaggtcagcttgtaagatgtcagcatttcctcattgcgagggcttatcggtccctctccgtcgcattcctcaaaccagaccaccatccaccagctatcattccctcacattcactgttccttcttcacggcttcaatgctcatcatcgcaggctaagccagcaaccaacattgaattcaacgatcgccacagtcagcgagctgttaaaactgccttgtggtgtaactttcttgttttttcactcaagtttggagtatggttagcttcctctagtcatgttatgttagctgaagtcgtccactccgttgccgattttgcaaaccaggcgctacttgcttatggtttatctagctcgaggcgtgcaccagatgctattcatccctatggctattccaaggaaagatttgtttggtccttgatatctgctgttgggatcttttgtcttggttctggtgccaccgttgttaatggagtacagaacttgtggattgcacagccccctgagaatatgcagtatgcagctttggtgatatgcggttcattcatcattgaaggtgcttctcttattgttgccatacaagctgtcaagaaaggtgcagctgcggagggaatgaaattaagagactatatttggcgaggccatgatcctacatctgttgctgtgatgacggaggatggtgctgcagtcactggtcttgttattgctggggcatcattggttgcagtgaacgttactggaaatgccatttatgatcccataggttcaattgtagtcggcaacttacttggaatggtagctatatttcttatccagagaaaccggcatgctttgattggtagagctatggatgaccatgatatggagaaagtacttcagtttttgaaaaaagacccgtttcgtgaagctgctaagcagaaggatgatactgccctgatgaagattatgtcaaattacggtgaggaagtagttacagctttaggaagtgaagtagataggttagagaaggagatccagaatctcgttcctggtattcggcatgttgatattgaagcccacaatcctccaacagaggcgacctttatcacgagttctgaaggaaatacgaagttgagttacatgcctcgggttgagttgaccctggacagctcttga

SEQ ID NO: 69394 - DNA, 1737 bp, Glycine max
  Peptide Sequence Number=SeqID_186172
atgttcaacaacaatagcaagaagcgccgccatgctccgcccgcggcacccgacgccgtttttcgcatcgtgtgtccggccgcaaagacggaggacgtagcgactatcggcggcgacggagctaagattctggtggaggacttggtcagcgcggaggagcgcgtggttgttatcgtgggcgaggagtccgctgcgcaggttgcgttggttagggtttttgagagaacggtggatgaagaaactaagaattcgacagtgtcgtgtaaattggtggcccccagctatcaggttggctgtgtgctcggccgaggaggcaaaatcgtcgaaaagatccggcaagacactggggcccacattagggttttgcccaaagaccaacctcctcttcctcctcctcccggtgaagaattcattcagataacaggaaactttggcgcagtgaagaaagcggttctatccgtttcagcttgtttttatgataacaattctggtgcctttaagcctcttgatcatcattccagaggttgttattctgaaagtgctggacattcttctcataggatgtttttggaagaggacgttgtcttcaagctcttgtgtcaccatgaaaaagttggcagtcttattggcaaaggtggttctgtagtgcgggctctccagaacgaaactggtgcttctatccaaattgtggaggctggtcctgattcagacgagcgtgtcgttgtcatatctgcgcgagaggcatgtaacctttgtgtgatttttgtggctggggttcatcttcagattgtttactctacatcagagcaaaagcattctcctgcacaagaagctgtcatccgtgttcattgtcgacttacagagattggatttgaaccaagtgctgcagttgttgctaagcttcttgtgcgttcaccacaggtgggctgcctcttgggcaagggaggtcttgttatatctgaaatgcgaagggtcacaggtgctagtattcgcattttttcaaaggaacagattaaatacatttctcaaaatgaagaagttgtacaggttattgggagcttacaatctgtacaagatgctttgtttcacataaccagtagaattcgggaaaccattttcccaataaggactcctccaaattttagtgcaccaccacatttgccaccgtttccagaaatgccacctcctttatttaggccaagaaatcacttgatgtcctctggccaccctcctcctcctcaagttgggcaccctcatgaccattcaactgttccccccatgcctgttgaccatcagcagcatgcatttgtacatggtatgggacgtggtccaccaaacatggatcgagttccctatcctcgtggttatgaaggaccaaattctccaagatcatggaatcccctggcagttaacagaggaaattccggaggaacagctgatacttctagtttggcctcaagaaatgagaaccttggagagaatggaaacccattgcagaatccaaataacttgactattgagatcaccattcctcatatgtatttaactcacgtgtatggggagaacaatagcaacctaactcagattcgacagacgtctggtgcaaacgtggtggttcatgatccaaaacctggagctaccgagggtctggtgattgtgtctggagcaccagatcaaactcacgctgctcaaagcctaattcaagctttcattttatgtgggcagactatagcttga

SEQ ID NO: 69395 - DNA, 1029 bp, Glycine max
  Peptide Sequence Number=SeqID_186173
atgggtaatcacaaacccaatggagacgggcttatgatttatgacccaagagtggtctcatcttcatcgacggtcagaataaatcttggaagcaaaagacgaatcagaaccgtcgagtgtgagaagccccagggcacagagcaactacaaaaccctacttatctcactttacaatgttgtcaagcctgccgagaaaaccctagttcgcttgcagtcacacaagaggccaatcctattcatagctcgttgtttagatctgagaatatttcgtctgatttgattgttcgaatgacagagatgggtgaagaagtgaaggtagttgttccagaatcagtgttgaagaagcgcaagagggaggaggaatgggcgttggccaagaagcaagaactcgatgctgccaagaagaagagagccgagagccgcaaactcatctacaacagagctaagcagtacgctaaggagtacgatcaccaggagaaggaattgattcggttgaaacgcgaggccaagctgaaaggtggtttctatgtggatccagaggctaagctgttgtttattattcgcattcgtggtattaatgccatggaccccaaatcaaggaagatcctgcagttgttgcgattgagacagattttcaatggtgtatttctcaaagttaacaaagccacagtgaacatgctgcacagagttgagccgtatgtgacttatggatacccaaatctcaagagtgtgagagaacttatttacaagagagggtatggaaagctaatgaagcagaggactgctctaactgacaactctatcattgagcaggctctgggcaagtatggaatcatatccactgaagatctgatccatgagatcatcactgttggacctcactttaaggaggctaacaacttcctttggccatttaagctcaaggctcctttgggtggcttaaagaagaagagaaaccattatgttgagggaggtgatgctggaaaccgggagaattacatcaatgagctaatcaggagaatgaattga

SEQ ID NO: 69396 - DNA, 597 bp, Glycine max
  Peptide Sequence Number=SeqID_186174
atggaaaagaagcggaagaggaagcagcaggtgaagcgcgacggagagccaaagcccaaatcggttcgtgcgggttcaacccgaaccgacaatgtgaaagatccatttccatctcacgctcgacccaccccacaggaatgcgaagccgtgcgtgacactctcttagccctacacggcattcccccggaactcgccaagtaccgcaaactcccaccgtccgatgaaccggtccaactgcagccacccgaaccggttctcgacggtcttgtccgaaccgtcctctcgcagaacaccaccgaggccaattcccaaaaggctttcgcttccctcaaatcctcctttcccagttgggaacaagttctctgggccgagtccaaggacgtggagaatgccattcggtgcggaggtctagctccgactaaggcttcctgcattaagaacgtgttgcgttgtttgcgcgagagaagaggtgaattgtgtttggagtatttgcgggacttgtcagttgatgaagttaaggctgagctttctcttttcaaaggaattggtcccaaaacgctttgtcaaatattcagatatatggcaactgatgaatag

SEQ ID NO: 69397 - DNA, 1389 bp, Glycine max
  Peptide Sequence Number=SeqID_186175
atggaagagtctgagggtagtacaagtgggaatcacagttacagcagctgtggatcaccaatcagcaacatggctcaagactacctctttactattctcctcctcctccccatagatgcaatcctctccctatccatcacttgcaagagattcagggctctcacttcctcacacactctatggaaatctttgtgcaaaagggacttgggttccacttgtgttgactcactttccagtaacaaccagcatcgtcacttcccttggatgaggctctacaagcaagtctctcagatggattctgtttgctgtcataaactacttgtgtcagatttggatttccctgcagccagagcttctcactctctcaactttgtctccgactgtcttgtcttgtttggtggcggctgtgagggaggacgacatcttgatgacacgtgggtggcatacattggcaatgatttccggagaatgttgaaatggcagacagtccattcaggcattccaagtgggagatttgggcatacatgtgtggagatgggtgattatcttgttctctttggaggaatcaacgaccgtggcaaccgtaaaaacgatacatggttggggcatgtcatgttcaatgaaaacaacggtgtaacattttcatggaaaatgcttgatgtggggaatgttgcaccgccctctagaggggctcatgctgcatgttgtattgatgaaaagagaatgataatccatggaggtatagggcttaatggcctccgtttgggggacacatgggtcttggagatgtcagatagtcattgctttggtacgtggcatgagattgtggcacacccttcacctccaccacgttcaggacacacattgacatgcattgggagaagcaggacaatactatttggaggaagaggcttgggttatgaggtgcttgatgatgtttggttattggatacataccaaggttatcagagatgggtccaaatagtttatgatttacaaagcataccagctggtgtttcccttccaagagttggtcacacagctacattggttttgggaggcaggttgctaatttatggaggagaagactcatatagacaaaggaaagatgatttttgggtgttagatatcagtgccatcccttacccttgcatcactcagcaaatcacagtgagctcaaagaaagtgttgacaagaatgtggaaacggtggaaatcaagtggacatgcggcaaattctcgatcatttcaccgtgcctgtgcagaccgatcagggcgttatgtgtatgtatttggtggaatggtggatggttttcttcagcctgctgaaccttctggactcaggtttgatggggagctctttcttgtggagcttgtgcttcagctctag

SEQ ID NO: 69398 - DNA, 1455 bp, Glycine max
  Peptide Sequence Number=SeqID_186176
atgggttctagaatcccatctcataagcttagcaatggcctctacgtatcaggacggccggagcagcccaaagaaagaactccaacaatgacatcaacagccgtgccatataccggtggagacataaaaaagtctggagaattggggaagatgtttgatattcctgttgatggctctaaatctaggaaatctggaccaataacaggtgctccatcacggactggatcttttggaggagctggttcgcattctggacctatgcagcctaatgctgctgctcgagccacctatacttcaggtccaatgacttctggtggcatggctggttcgacttcaatgaagaaatcaaattctgggccactgaataagcatggggaacctgttaaaaagtcttctggtcctcagtctggtggagttacaccagttgggcgtcaaaattctggacctcttgctcccgttctacctacaacaggtctcattacatctgggcccatatcatctggcccactaaattcttctggggctcctcggaaagtgtctggtcctttggaagcgacgggttctatgaagcttcaaggttctgctgctgttcacaaccaagctgtgactgttcttagtcaaggtgatgattccttcagaaggaattttccgaaggcggtgttatggttattaattctgctttttgtgatgggtttcattgctggtggttttattcttggagcagtgcacaatgctattctccttattgtagttgtgattctttttggcttagttgctgcatctttcacttggaatacttattggggaagaagatctattatgggctttgttactcattatccagactctgagcttagaactgcaaaaaatgggcaattcgtgaaggtctctggggttgttacctgcggtaatgtgcctcttgagtcatctttccagaaagttcccagatgtgtatatacgtcaacaagtttatatgagtatcgaggatgggactcaaaagctgccaatcctgcacaccgtcggcttacttggggccttagattgctggaaaggcgcgtggttgacttctacatctcagatttccagtctggtttaagggcactggttaagactgggcatggagcaagagtgaccccttatgttgatgactcagttctcatcaatgtaaatccaaccaaagaagagctttcaccagagtttctccggtggttgggagagaggaatctttcaagtgatgaccgcatcatgcggctggaagaagggtacatcaaagaaggaagcacagtaagtgtaatgggagttgttcagaggaatgagaatgtgcttatgattgttcctccgccagatccaatcactactggttgccaatggaccaaatgcatttttccatctagtcttgagggtatagttttaagatgtgaagatgcatccaagaatgacgtgataccagtttaa

SEQ ID NO: 69399 - DNA, 1272 bp, Glycine max
  Peptide Sequence Number=SeqID_186177
atgagaacatccaaatttccatgtaggggattggattatcgtctattccttctgatttttgctgtatgtttggtgttgtatggaacagtttcaagattgaatgctccaaatgtttcttatgccacaatatctaagttacggcacttcaatcctaagcatgttatatcaaaaggaaaagggtaccctcctgtgcttgcatattggatacttggcagcaaaggagagagtaagaagatgttgaggctgctgaaggctttataccatccaagaaatcagtacctacttcagcttgatgatcgttcctctgagtctgaaagaatggatttagctatttcagttaaatccattaaggtgtttgaggaatatggaaacgtgaatgtcattgggaaaagttatgccatcaataggatgggatcttctgctctttctgctcctctgcatgctgctgctttgcttcttaaactaaacccagattgggactggttcatcaccttaagtgcttcagattatcctctcatgactcaggatgatatccttcatgctttcacatttttgccaagatatgtcaacttcattcattacactaacaagacagttcggaacgagcaacgagacattaatcaaattgtggtagaccaaagtttacactatgaaaagaatagtccacttttctttgctgtggagtcccgagataccccagatgcttttaagctatttcgaggttcaccctggatgattcttacaagatcctttatggagtactgtgttagaggatgggacaatttaccaagaaaacttctaatgttcttcagcaatgtggcttatcctctggaatcatatttccacacagtgctgtgtaactcccacgagttccagaataccactgtggacaataatctaatgtacagtctttgggacactgatccatctgaatcccaattacttgacatgtcacactatgatacaatgctggaaactggggctgcatttgcacacccatttggcgaagatgatgtggttctggagaaaattgatgatttgattcttaaccgatcatctagtgggttggttcaaggagagtggtgttcaaactcagaaataaacaagacaacaaaggtttcagaagctgaggaagagttctgctcgcaatctggcaatattgatgctgtaaaaccagggccatttggcatcaagcttaaaactctactagctgatattgagaacacaaggaaattcagaactagccagtgcaaatcctttgaaagttggtga

SEQ ID NO: 69400 - DNA, 858 bp, Glycine max
  Peptide Sequence Number=SeqID_186178
atggagaatgaaactacagaaacaagcacttcagggtgtggttctctgattcttgaaatgggtgccttatcaaaaatgactggtgaccccatatatgaatcagtagctttacgagctcttcgcaagctatggagtatgcagagcacattaaaattatttggaaccacgctggacgtgacaactgggcaatggattgaatattcttcaggaattggagctggggttgattccttctatgagtatctacttaaagcccatatcctttttgggaaggaggacttttggaaaatgtttcattctgcttatgttgctgtgcagaaatatttcagacatggtccttggtaccacgaagctgatatgaggacaggaagagcaacttattggcaacttacaagccttcaagcattttggcctggtctacaggctagtagctggactttgaatttttacctacttaaaattaggtatttgctggaccaccagatgcttcaccctactgaaaaatattacccattacgtcctgaattggctgagtcaacattctacttatatcaagccactaaagacccctggtatattgaagttggtgaatcaatagtcaattctcttaatttatacaccaaagttgaaggtgggtttgcaagcattaaggatgtgacaactatgcagttggaagatcatcagcatagtttttttcttgctgaaacgtgcaaatatttatatcttctatttgacgattcatttgtccatgagaacaattatgtatttaccaccgaaggtcatccccttccagtactaagcacttggcatgaagagcttccagaagcttatatcccaactaattggacttttgtgaag

SEQ ID NO: 69401 - DNA, 405 bp, Glycine max
  Peptide Sequence Number=SeqID_186179
atgggcaccggtcaagacctcctcgttcgccgaggagagtccgtacctcccaattttgagggtcccatttttgtgtgcacaaggaacgatgatcttgaatccgtgcttcaatctacaccttcttctagatggcgtgcagatttggtgttcttccagaacggaatgatggagccgtggcttgagagcaaaggtttggaagatgcaaaccaggtgttggcttattttgctgtctctaaaattggagaaagccctattgatggtaggactgataccaatcctgaaggactcactgctgcatatggcaagtgggcttctgttgtagctgctagattaaatgctggaggcctctcttgcaaggtttcttctttttactgtcatactactccctgccctggatttacataa

SEQ ID NO: 69402 - DNA, 990 bp, Glycine max
  Peptide Sequence Number=SeqID_186180
atgaggacccttatcaaaaatgctactatcgtaaatgaaggaaaaatctttgaaagcgatattttaattgaagacgatttaatttctaaaatacaaccccatatttctgatgaagcagatcagattattgacggctccggaaaatatcttttaccaggggtgattgatgatcaggtgcattttcgtgaaccggggttaactcataaaggagatattgaaagtgaatcgagagcagcaattgcaggtgggattaccagttttattgatcagccgaatactgtacctaacgctgtaacgcaggaattgttggcggataaatatgaaataggatcccaaaaagcatacgctaattacggatttatgatgggagggactaatgataatcttgaagaggtgcttaaaaccaatccgagaaatgttccgggaatcaagttattcttaggttcttctacagggaatatgctggttgataatcctgaaacccttgaaaatattttcagcaatacaaaaatgctgattgctgttcactgtgaagatgaagcaacgataagagcaaatacccagaaatacatagaacaatatggagaagatattcctgttaagtttcatcatctcatcagaagtggagaagcttgttataaatcttcctccaaagccatcgaattagcagaaaaaacaggagcgagactccatgttttccatctgtcaacagctatagagacagccttgttcagaaatgacattcctttaaaagataaaaagatcaccgcggaagtttgtgtacaccatttaacatttaccaacgatgattatgaaacaagaggaggtctaattaaatggaatccggcagtaaagactcagaaggacaaagacggactttgggaagctcttttagatggtagaattgatgtaattgctaccgatcatgctcctcatacctgggaagaaaaacaaaatgaatgggaaaatttctctggaaaaaatcgttga

SEQ ID NO: 69403 - DNA, 411 bp, Glycine max
  Peptide Sequence Number=SeqID_186181
atggcttccaagacagaaggtaagggcattgacattgccattgcctatggattagacaagaaggcttccaggagtggcgaaaagaatgtggttatcttcgacctcggtggtggaacttttgatgtctccctcctcaccatccaggaagctattttccaagtgaaggccactgctggggacactcatttgggaggtcaagattttgataacaggcaaggattactccccatttacatatacgattttctgtacactctccttcaatcccaaaaagaaattgaagaaaaatatattcaccaaggcaaaatgcaattgaaggagaagaaaccttacaaaaccttcacacggttagctgagaaatatgggcctatttatccatcagaactggtgctttcactgtcactgttgtaa

SEQ ID NO: 69404 - DNA, 309 bp, Glycine max
  Peptide Sequence Number=SeqID_186182
atggtcaaaaagcatattattatttcaaacgttcttggatccaacgcacagagctcctctacttcagctgttaattttaggaaaatatttgcatctgaactatttggactagcactgaagcaaagcgtgggaagcaatgtagaatccatttatgtggagaagcttggtggtagtttgtcaaaagatgacatacataagattctagtggaaggtgcaattgaggtgtcaggtggattggagagatttctttccaagcaagagcttagagatgaaaatacagatctaatttgcacttcggcgggaatgtag

SEQ ID NO: 69405 - DNA, 1334 bp, Glycine max
  Peptide Sequence Number=SeqID_186183
cagtcgagcagagagatgatcatcaacgtgaaggaatcgacggtggtgcggccggcggaggaggtggcgcggcgggtggtgtggaactccaacgtggacctggtggtccccaatttccacacgcccagtccaacggcacctccaactttttcgacggcaaggttctgaaggaggcactgagcaaggtgctggtgccgttctacccaatggctgggcggctccggcgagacgaagacggtcgcgtggagattgactgcgacggtcagggggtgctcttcgtcgaggccgacaccggcgccgtcatcgacgatttcggcgacttcgctcccacccttgagctccgccagctcatccccgccgtcgattattcacagggaatagaaacctatcccctgttggtgttacagtcaattgctagtttgccaccaccttccaggactgcagccaacggcgcgcaacacgttggtatgcaacatcatgtagcagatggagcctctggtttgcacttcatcaatacatggtcagatgtggctcgtggcttggatgtttccattccaccattcattgatcgtacaatacttcgtgctagagatccacctcgacctgtttttgatcacattgaatacaagcccccaccagccatgaagactcaacaacctactaaaccaggctcagactcggataatgcagcagcagcagcagcggtgtctattttcagactcacacgtgagcagctcaacacactgaaagccaagtctaaagaagatggcaacacaatcagctacagttcttatgagatgttggcgggtcacgtgtggagaagtgtatgcaaagcaagagcacttcctgatgatcaagaaaccaaattgtacattgcaactgatggaaggtcaaggttgcaacctcctcccccaccgggttactttggcaatgtgatattcacaaccacacctatagctgtggcaggtgatctcatgtcaaaaccaacatggtatgctgcaagcagaatccacaatgcattgttacgaatggacaacgattatttaaggtcagctcttgactatctagagctgcaacctgatctaaaagctctcgttcgcggggctcatactttcaagtgtccaaatcttggtatcactagctggactaggcttccaatccatgatgctgactttggttggggaaggcctatattcatgggacctggtggaattgcatacgagggcctgtctttcataattccaagctcaaccaatgatgggagcttatctgtggccatagctcttcagcccgaccatatgaaggtgtttaaggatttcttgtatgacatttga

SEQ ID NO: 69406 - DNA, 1020 bp, Glycine max
  Peptide Sequence Number=SeqID_186184
atggaaaagtacgagaagctggagaaggtgggagaaggaacatacgggaaagtgtacaaggctcgggagaaggcgagtgggagcctggtggctctgaagaagacgcgtctggagatggacgaggagggtgtccctcccaccgcactacgcgaggtgtctctccttcagcttctctcccaatccatctacatcgtccgcctcctctccgtcgaacacgtcgacaaggtccccaagtcccagaaatcctcctccaaccccctcaccaagcccatcctttaccttgttttcgagtatctcgacaccgatctcaagaagttcatcgattcccaccgcaagggccccaatcccaggcccctccctcctcccctcatccagagcttcctcttccagctctgcaagggcgtggctcactgccacagccacggtgtcctccaccgcgatctcaagccgcagaaccttctccttgaccagcacaagggtattcttaagatcgctgatctcggcctcggccgcgccttcaccgtccctctcaagagctacactcacgagatcgttactctctggtaccgtgcccccgaggttctccttggctctacccattactccactggggttgatatctggtctgttggctgcatctttgccgaaatggtgaggaggcaagctttgtttccgggggattctgagttccagcagctcattcacatattcaatagtcacatttcttatctgccttctcatactctgttgattcaactacggtgtttcctaatttttttatcattcaaggatgttgggactccaacagaggagaattggccaggagttacttctctgcgtgattggcatgtgtacccacgctgggaacctcagagcttggcaaagaatgtgccttccttaggacctgatggagtcgaccttctttcgaaaatgctcaagtataatccttctgagagaatatctgctaaggcagcacttgatcatccatactttgacagtcttgacaaatctcaattttag

SEQ ID NO: 69407 - DNA, 1446 bp, Glycine max
  Peptide Sequence Number=SeqID_186185
atggctatggcaccggcaatgttgccattctttctgtttctgtcccttctttctctgtgcctcctcatcaatgcaaacggagtgagttcctttgaagagaagaagatattcaacgtgcaaacgttgcagaagaaacaccaacttggtaaccagcaggcttgcctcctcccggaatcaagaaaggagaaaggtgctattatactggaaatgaaggacagaggacactgctcagagaagaaaattgattggaacagaaggcttcagaagcagttaatatcagatgatcttcgcgttcgttcaatgcaaaacagaattcgaagagtagtctccagccataatgtagaagcttcacaaacccaaataccactatcttctggtataaacttgcaaaccttaaactacatagtgacaatgggattgggtagtacgaatatgactgtgataattgacactggaagcgacttaacctgggtccaatgtgagccttgcatgtcatgttataatcaacaaggaccaatattcaaaccttctacctcctcttcctatcaatcagtttcatgcaattcatcaacctgccagtctcttcaatttgccacaggaaacacaggagcatgtggaagtaatccatcaacttgcaactatgtggttaactatggtgatggatcctacactaatggtgagctaggtgttgaacaacttagttttggaggtgtttcagtgagtgattttgtatttggttgtggtaggaacaacaaaggtctatttggaggagtctctggtcttatgggcttgggaagaagttacctctcattggtatctcaaaccaatgccacatttggaggagttttctcatactgcttaccaacgacagaatctggtgcttctgggtcattagttatgggtaatgagtcttcagttttcaagaacgttactcccatcacttacaccagaatgcttccaaatccacagctatccaacttctatattctcaatctcactggcatagatgttgatggcgtggctttgcaggttccaagctttggcaatggtggggttttgattgattccggcacagtgatcacaagactgccctcatctgtgtacaaggcattgaaggcattgttcttgaaacagttcacgggtttcccttcagcaccagggttttcaattttggatacttgtttcaatctcactgggtatgatgaagtgagcatacctaccataagtatgcattttgagggcaatgctgagctgaaggtggatgcaactggcacattctacgttgtgaaagaggatgcttcgcaagtttgcttggcgcttgcaagtctttctgatgcatatgacactgctattattgggaattatcagcaaaggaaccaaagggtaatatatgataccaaacagtccaaagtgggatttgctgaggagtcatgcagtttcgcttga

SEQ ID NO: 69408 - DNA, 1350 bp, Glycine max
  Peptide Sequence Number=SeqID_186186
atgggtaaaggtgatgttaaagccgtaattctgtctcgtgaaggtcccaaaaactccgcaggggagtccccacgtgcacagtacatgaccgtttcaactgtcatccgtatttctccttacttcgatatcggaaatcagagattccaccagacaactcgatcggaacaagtaagggcattggcattgacctcggcaccacctaccgctgctgccattgcctatggattagacaagaaggcttccaggagtggcgaaaagaatgtggttatcttcgacctcggtggtggaacttttgatgtctccctcctcaccatccaggaagctattttccaagtgaaggccactgctggggacactcatttgggaggtcaagattttgataacaggcaaggattactccccatttacatatacgattttctggagattgaggactgcatgcgagagagggctaagaggactctctcttccaccactcaaactaccatcgagattgactctctctacgaagctcaacatggacacgttcacgatgttgtccttgttggtggatccaccaggattccaaaagtgcaacaactgttgcaggatttcttcaatggcaaagagctttgcaagagcattaacccggatgaggctgtagcctatggggctgctgtgcaggctgcgattttgagcggtgaagggaacgagaaggttcaggacttgcttctgcttgatgtcactcctcttagcctcggcattgagactgcaggaggtgtgatgacagtgttgattccaaggaacacaaccattcccaccaagaaggaacagattttctcaacttatgctgataatcagccaggagtgctaattcaggtgtatgaaggcgagagggcaagcaccaaagacaacaatcttttagggaagtttgaactcacaggcatcccttcagcaccaagaggagttccacagatcaatgaggagattgagaagatggtccaggaggcggagaggtacaaggcagaggacgaggaggtgaagaagaaggtggacgccaagaactccttggagaacttggcgtacaacatgaggaatactgtgaaggatgacaagtttgcaggcaaaatgaacccttctgataaggagaagatagagaaggcggttgatgagaccattgagtggctagataggaacctactgactgaggttgaggaatttcaggacaaattgaaggagttggagggactttgcaacccaattatctcaaacatgtaccaaggaagtggtgcagatgacattcctaatggtgctggctatggaaaatcatccactggtggtgctgggcctaagattgaagaagttgactaa

SEQ ID NO: 69409 - DNA, 513 bp, Glycine max
  Peptide Sequence Number=SeqID_186187
atgcttgagcttgagaccttttcactgtctctgaagcagcatggacagaacaggtcacttattcttattctgtctccagaaaatagttatccccatgcttctcagttctcaattccatttacaagtattcaagccatatcaacctcagagttcaatatgaatttcacttcaaaaggtaaaggcctaatccagagcaatggaccagtacaagaacttcttgggaaattatatggaagcatagaagactcaataaggttgaacgacaaagttgaggaaactaaagacgggaacaaagaagaacgacttaatacaacaagaaaagcacaaggtggaggaagttcaagaggcacaggaagtagaggaaagacaggaagcggtggcactgctgatgttaatcgccggccacgtcaaagttctgcaccatcagagcctcttttttgggtctcaatatttaatccatgcgtaagcttggctttagtcatattgttttcccttccacttggtttgatgtaa

SEQ ID NO: 69410 - DNA, 2157 bp, Glycine max
  Peptide Sequence Number=SeqID_186188
atggtaggacccacctcacgagcttacgtgttcaaccctcccaccagatccctccaccatgcaactacaacgaagaaggttcatgaaccgggtcccacattttatccattcacatcacctgatgccacgtgcctcccagacggcacccaactacgccgtttcgcaccgcgagttacattcctaaatatgcccacaataggcgacaaaagaagcaccatatgtggagggcatatttgtcattcgggtctcaacttcacccggctgtcctgctttaaatacggcgtcgtttcttacgtggcacgtgacagcctgtcattgaagaaagagaagaaacattgcatcatggttcagctaatgaggtctgatacggataatcactgtctgaaaaaggtgaagttggaggttcaagatgaaatcccccctcttcacactcacaagcgacccaaattggaatctccccctaagcagtgtggtgcaagcgatgaatccatttcaatcccaccagcttcatacaatcccttggatgagccaagccctttgggtttgcgtctcaggaagagtccctcccttttggatttgattcagatgaggctctcgcaacaagaggaatccaaaaagaaagatcaaaaggcttcttcttcttcttctgttgctgctgctgctgctgctgctgctgattctaaacttaaggcctccaattttcctggaaccattttgaaaattgggaattgggagtataagtctagatatgaaggagacttggtggcgaagtgttactttgcgaagcataagctggtatgggaagtccttgatggttgtcttaagaataagattgaaatcccatggtctgatatcatggctatcaaggctaactaccctgatgatggaccaggtacgctcgaagtagtgcttgcaagaagacccttgttttttagggagatcaatccacagccgaggaagcataccttatggcaggcaacatcggactttactggtggacaagccggcataaacaggcgacattttctgcagtgtccacaaggattgctaggcaagcattttgagaagctcattcagtgtgatccccgtctcaactatctaagccagcaggcggatttggtgttggattctccgtattttgaacctggaacaacttcaattcacgaccacattgaatctagtgacggctttgatagaaaaagcgaagagcgatctggtatttttggattgcaggatgtggagtcaggatctgcagttcaatcatcttcctcaaaaagtgaacataaccttggtaaagctgttgaaaatgtttcccaagaaattacctcacctagctcagtgatgaacatccatgcaatgaaagatttcaggagtagaggagctgaaacattgaagtttcttagtaatttggaccagatcaaattgcctggacttcacccttctatgtcaatggacgatttggttagccacattggacattgcatttcagaacagatgggatctgacaatccaaatttcgctggtgacaaccagtatagcagatctattctggaagaatttactcagtacttgttcaatgactctcaacatgcaactacctccgatgaacagcgtaaggatccttctacagcagaagacatgaccaaaaatggcaatagtctgggagatgcaaatgccttgtcaagggtgaactcactatactcccttctgcagaatgcagaagacgcaatggccagaaatggcaatggtctgagagatgcagatgtgatgtcaagggtgaactcgctgtactgtcttctgcagaaggatccttatacagcagaagacacaaacacaatgacaagaaatggcaatggtcttgatgcagatgagggtggaaaagttggtgtgagtaactctaacatcactgaattgtcacaaccatgcaaaactaaagtgtctgatttggaagttcaagcggatgatgcttctggctgcaagcagggggggactggtatgtccaggaaggaatcagctggcgatttgcttcttaatcttccaagggtggcatctctgcctcagtttttgtttaacatgtccgaggattctgttaataaattttacttgcgtgggattcagaaatttacattgatgatgaatcccgacagacagacatga

SEQ ID NO: 69411 - DNA, 393 bp, Glycine max
  Peptide Sequence Number=SeqID_186189
atgtatcaaactacaagctacataaaatatttagaaggaaggtcctactacgccaacgcaacgcaaaacttaagagatggatatcccctcacgggaagcgcgtcgaaggggatgtgttatgttatgtgggccccgttttaccaagtcgtagaacgcgcttatgcatggaccccactgagtctccctaagcctcagatcatgttcttccttaatttcactcactcccacttcgttccgtgtcgtggtttcccttgcccctcaacacccagtgatggtggcgctgtcgctgttggggaaaatccgaatccaaaagtggtagtagatgacgagaaaagcccaaggcggagaagcatcccagacgcaaacaaactcggacaatggttagaaacatga

SEQ ID NO: 69412 - DNA, 213 bp, Glycine max
  Peptide Sequence Number=SeqID_186190
atgaggcggcgtgttgttattgggtggatgcagttggcggggttggagtccacgcattcgaaagcgttcgctctcacacccaatccctacccagacaactcccaacttctctcagtactctcatcaggatccggtaatgttcctcctcctcctctttcctctaactcatctcgatcaatgtttatcatgcatatgaaaccttcgttcttgtaa

SEQ ID NO: 69413 - DNA, 630 bp, Glycine max
  Peptide Sequence Number=SeqID_186191
atggagcttcaaaatcgtcaagcaacccaagtcttcatccgatcaaaaacagcaagctccctcagatctaagcagtccaaagggcacaacacaacagagaaagaaaagagtaagagtatgggaggctcatggtcatggcagctcacatgtgccctcttgctactcttctccgccgtagtcaccgccactgaccacattgtgggtgcgaatcgtggctggaaccctggctttaactacactctttgggccaacaaccacactttctatgttggcgatcttatctcattcaggtaccaaaagaaccaatacaatgtgtttgaggtgaaccaaactgggtatgacaactgcactacagaaggggcagtggggaattggagcagtgggaaggatttcataccccttaacaaggccaagagatattacttcatttgtggcaatggccaatgcttcagtggaatgaaggtttccgttgtggttcatcctcttcctcctcctcccacctctgcagttgctgctcaacattcatcgccaaagtctgcttctcctgtgctcttaaaacgaggatttcgctcactgttggtgtctactgtttcagcttgctttggaattgtttggatttatcacttgtag

SEQ ID NO: 69414 - DNA, 1178 bp, Glycine max
  Peptide Sequence Number=SeqID_186192
gtcaacctccatactcagtcagaagcagcttcttccaaagacatgggtgatttgagcatgtctttcagtttcactgaccttctttttaccaacaacaataacatgaacagggatgatgatccctttggacttgagtttgctaataacttcaagtcagcttcactgcctctctctccttcttcaatctacccttcttatgctgagttccctcctggttttgccccaaccacacagtcattgaattcacaccactttttttcttctcaaaatgttcctgcatcttacacaactgagccatcttctagcatgagcttcaacatgagaaacagttcaactatgggtcaacatggaaacaaggaggaagagagaaactactctgaccactctttccaaacaaaagcaaaccacgtgcctctctttcaatcttccacaagcatatttcaagtggagccacaaaagaaacaggacacaatgatattcaatgaagctgcaaagcaaacagatttctcatctgagaggacagaaacaaaatctgaatatccatccactcagggcttctcaacagcattagcctcaatcaaacatgaaatacaaagcaattctgctccaggatctgttcaatttaactccacttttgctcctaagtctattagggaacaaaggagatcagaagatggttacaattggaggaagtatggagagaaacaagtgaaaggaagcgaaaatccacgtagttattacaagtgcacgcacccgagttgcccaacaaagaagaaagttgagaggtctttggagggacatatcactgaaatagtatacaagggaagtcacaatcatcccaagccacatggtagaaaaaatggttctcaatcaattcatcaaacttcttcgccctgcaccaactcggggatttctgatcaatctgtgggagatgaagatctagagcaaacatcacagactagttattctggagggggtgatgatgaccttggaaatgaggccaaaagatggaagggggagaatgaaaatgatggctattcctattcttctgctgggagtagaactgttaaggaacctaaagttgtggttcaaaccacaagtgaaattgacatacttgatgatggatataggtggaggaaatatggacagaaagtagttaaaggaaacccaaacccaag

SEQ ID NO: 69415 - DNA, 1083 bp, Glycine max
  Peptide Sequence Number=SeqID_186193
atgggagaaatattcattcgattaccatttagatccacagtgaagtgcaagtgtgtgtgcaaacgttggttgggactaatttcaagtccttcttttccaacagaatttgtgtctagccagtactctcttttcaaggcctacttcaccttcctttccccccaccaacttatgttcggtttcttcccttcagatttgaactttaatgcgcaaatccacaaggttcctttgtctccagccatcctcataaaaggagacgtctgtggctattctaacggtttatttttgtgttgcagcaacagattcacaaggggttggggctactttgtgtatgatccctttaccaaggaatgtaatcacatacctccttttcctgatgcgcataaggaaacatgtttatacgctgttggcttcctttcccaaattaacgattttgaagaagaaggaaattctaatcgctgcttttgggtggtggttgtgagatcctctatgagaatgaaatatgagtttgaagtggaggttttttattcggggacaagaacatggagacaaatattgatgagttgtgtggatggttttgcttttgctcctcattggtttctcagttttgcatttgaagggtacctacatttcatgggaagcaggagtattcttgtgttggatcccattttcatgatttgtactaccattgattaccctgaaaatgctgatgctatgaatataatgagctttgggtaccttggatgctctggtgggactatgaggattgctgatattggcaataatgatttgagagtgtgggaactattgatccctggaaaatggcatttggtgcacaggaccaatctcaatctcatggaacatcttcccaccaggttctgcagtaattattgtaagcgcgtaggggggtttcatccctatgatggggacattgtttatttgcattcctatgttgatgggatttacgctataaacctggggactaacaaagttgtgcctatttctggttatgacaaatttgatattagtccctttcaattggagctctcttcaattccattggcagacaatgatgacaggagatag

SEQ ID NO: 69416 - DNA, 1965 bp, Glycine max
  Peptide Sequence Number=SeqID_186194
gggttaacagaatcatcggctcaaaacgttacaaacaatggttttccgttgggaggaagagtccacaatactacatcggatgatgagattgagactcacttaagaacaagacacaatgataccgtgtcggtggtgttgccgggcaatattcaaaacggtagcactgtagaagaaagagctagaactatgaatagtactgcatcaggaatagaaggcaaagtagaaagaggaacagatcggaacgtaactgctgagttgctgaatggtggagttaaggacctgcaagagagatcccaaaataatttcgctactgaaggaagatctgagaatatcacagcagcatatgctggctcgaaaaacgcttcactggcaagttcaacaaatgtgtcaaccacagaacctgttaatcttgatgacaatgacaaactgcttgggggattgttaacttctggatttgatgaagcatcatgcaaaagtaggatgcagtcccatttgtaccgcaaagcttctcctcataaaccttctccatatttgatatctaaactacgtaaatacgaagaaattcatagaaggtgcggaccaaatactagagattacgacaaaagcatgaaaaagattgtaagctccaagaacaatggtgctgctaccaaatgtaagtacattatctggaatactgccaatggtttggggaatcaaatgattagcatagctgcaacatttctttatgccatcctcactgatcgagtgctgcttgtaaaatttaataaagacaagcatggcctattttgcgagccatttctcaattcaacttggatattgccgcagaagtccccctttagttcttggaatgaacacaataccgaaacatatcagaccatgctagacaaggatagggctagcaattcaaagaagggtttaccatctgttctgtttattaatctacaattcagcttcgaaaaccctgagaaatattttcactgtgatcatagtcaagatcttctccggaagatccctatgttgattctgcggtctgatcaatactatgtcccatctatgttcatgaacccatttttcaacttggagattgccaacatgttcccagagagagacattattttccaccatttgggtcgctacctgtttcacccttccaacgatgcatgggaactaatcagcagttactatcaggcacacttggccagtgcaagtgaacggataggcttacagataagagtatttaatgctgctactactccaaagcaagcaatcatgaatctagttttaagctgcacattacagcaaaagatactgccagaagtggatttgaaaacttcagtgtcttctgctggaaaaaacatgactactgtaaaagcagttcttgtggcatctttacataaagagtacggggataatttacggagtatgtatctgaagaaaccaacagttagtggggaagtcatagaagtttatcagccaagtcatgaagggaagcaaaagtttaatgataatgggcataacctaaaagcatggacggatatgtatctgttaagtttatcagacgtgttggtgactacctctctctcaacatttggctacgttgctcaaggattgggaaatttaaagccatggcttctctacaggctagtcggtaaccatagcggcgattttccacgctgtgaacgggatttctcaacagagccttgctttcatatgcctcccaagcattactgcaacggagagcccatgaatgatatcgtttcttctttccccaatttgagggagtgcaaggatttaaggtttggtgtgaagctggcggccgttaacgggacagcctttggggtttacttggctcagaattatcaaatccctaacatcaggaagttagctgacactgccttgttacaggcaaagcaaattgaggaaaaatatcgtaagtctaagaagaagggtggtgatgatgattaa

SEQ ID NO: 69417 - DNA, 822 bp, Glycine max
  Peptide Sequence Number=SeqID_186195
atggtgatgggcatttcatctccatcttacaagctgaaattccttcgtcctcgccaacttgaacctctttctttgactccgccatcatcttcattcagagcgttggagttgaaagagaaggttcagcctctgatcccatggccggtgtctccctttacaaacctaaatcctacgaattccctctcttatgctcttcaagacggcaaaattcgcctcgaaatcgatttcccgcctttgcccagtaacatttcttcttataagggatcttcagatgagttcattgatgccaacgttcaacttgccttggctgttgtacaaaagctaaagaaagaaaccagaacgcagagccttcaaaaggaaatacacacttattttcatattgatggcattaccataggttccttagatgatgtctccctgctggacctatttaggccttccgggcttcccagccaaagatttgcagtaccgctttctttctcaattcactccatccgaatcagagagtattcaaaggtgatgcttaaacaagcagatggttcttatgcttgcatagcagaaagtgcaaactgcttcagccttggcgagcttcatactaatccattgactgatataggccaaagaggaattgttgagggtcttgggacttcaagaagaagagggaagttctctagaatttcttcgaagaggctacaaggtgttctcttgcaagcacgtggtgggaagaagattttgattcagaagtatcttatggatggcggagttgagttgtgcactgttagacgagactgttttactgcatccgcatgtagtggtcattga

SEQ ID NO: 69418 - DNA, 216 bp, Glycine max
  Peptide Sequence Number=SeqID_186196
atgaaattggtacagtctcatgtcttattgcaacacacgtgcacgtacttaaaagggaagggggctgacagtgctagacagcaaaatgcaaaaaaggaaaaggcaatgcctgcagctgcagagtccgtaaatatattggtggtaacttccctcatttcatctgttgctggaatcgctgaagacgttgatgatatcaagagatatgccacaacctga

SEQ ID NO: 69419 - DNA, 699 bp, Glycine max
  Peptide Sequence Number=SeqID_186197
atgactctggctatggctgtttggagtgctggtcttcacttcagtgctgctcgtagtagcttgagacctttggagaaaaccatttgcactgcccctttcttgaaggcgtcatctgggtttgctgctactaagccattctgcatccttaacacaacaagattgtcatattctggaactacaattatccctcgagcagcacctgttactgatgtgaaggatgggaatcaaggtgagactgataccattccaactcccgtagttataattgaccaagactctgatcccgatgctaccgtggtggagataacttttggtgatcggcttggggcacttcttgacacaatgaatgcattaaaaaacttaggtctcaatgttgttaaggcaaatgtctttctggattcatctggcaagcacaacaagttctccatcacaaaagctgatactggcagaaaagtggaagagccagagttgttagaggcaattcgtttaacaattataaataatcttattcagtaccacccgaaaccaagaggcagttctcagctaattagatttttcaaactgggtggtcaaggaatcaagttcccagttagcattgggagcagcttttggacttctgcctccaaaagagcagacaagttttgtcaagttaaaagatatcctattcctagctggtacctggaagtttcttctatataa

SEQ ID NO: 69420 - DNA, 1449 bp, Glycine max
  Peptide Sequence Number=SeqID_186198
atggaaatctttcaagccacagcggacaagatgaggatgagttccaaaagatttgcaacactctttgttgtattcttcatatcattttctgtttttctcattgtttcttcaatataccgaaactcaagttattatgctatttttgaggggttatccaaaggcagggaagccggagaatcagctcaaaacgttacaatcaatagatttccattggaaggaacagtccacaatacatcagaagagaacttagtgtcggagcatggcccgaaaaatgtttctttgactagttcaacaactgagtcaactccagatcttgaagacaaagacaaattgctaggtggacttttaaccactggatttgatgaagcatcatgcataagtaggatgcagtcccaattgtaccgcaaagcttctcctcataaaccttctccatatttgatatctaaactacgtaactatgaagatattcacagaaggtgcggacctaatagtagagcttacgacagaagcatgagaaagattgtacgctcaaagaacaaaggtgctgcagctacattgtgtaagtaccttatctggacacctgctaatggtttggggaatcaaatgattagcatggctgcaacatttctttatgctatgctcactgatcgagtgatgcttgtaaaatttgacaaagacaagcagggcctattttgcgagccgtttctcaattcaacttgggtattgcctgagaagtctcctttctggaatgaaaagcatatagaaacatatcagaccatgctagagaaggataggaataggactagcaattcaaaggatgatttaccatcagttctgtttattaatctacagcacaccctcagtgagcctgagaaattttttcactgtgaccatagtcaatatcttcttcgggaagttcctttgttgattttgcagtctgatcaatactttgtgccgtctctgttcatgaacccatttttcaaccaggaggttaccaaaatgtttccagagaaagacacagttttccaccgtttggggcgttacctttttcacccttcaaacgaggcatggaaactgatcagcgattactatcaggaacacttggccaaggcagataaacggataggcttacagattagagtatttagtcccgtttctactccacaacaaacagtcatggatctagttttaagctgcaccttgaagcataagatactgccacaagtggatttgcaaacttcagccggaaaaaatcatagtgtaaaggcagttcttgtggcatctttacatagagagtatggagataatttacggagtatgtatctgaagaaagcaacagttagtggggaagtcatagaagtttatcagccaagtcacgaagagcatcaaaagtttaatgataataagcataatctaaaagcttggatagacatggattggggaatttga

SEQ ID NO: 69421 - DNA, 1212 bp, Glycine max
  Peptide Sequence Number=SeqID_186199
atgtctctaaaaatagcagcagaaatttatccaaaatcaccatcagagacagtgaaggagcctttggtggtggtaaaggaatatgatgaagatagacacaaggtcgctgtagagagacttgagaggctttgtgaagttgggcagagtggaaagccttctcttgtcactgacctcatgggagaccccatatgccgtatccgtcactttcagttgcatgtcatgctggttgcagaatatggagaagaaggagaagttgttggggtgataagggtgtgtgtgaaaacagttaccagagggaattcggtttatataaaactggcctatatcttggggctcagagtctcccctcgacacaggagatttggcattggcacaaaactagttgaacatttagaagagtggtgcaagaaaaaaggggctaagtatgcatatatggcaactgattgtaccaatgagccatccgtgaatttgttcacaaaaaaatgtgggtattcaaagttcaggactctaaccatactagtgcaacctgtgcatgctcactacaagccaattagctccaatgttgctgtgcttcaccttccaccacgcttagccgggtccatatataaccatatgtttgccaattcagaattttaccctaaggacatagagttaattttgtcaaacaagctgaatttgggcactttcatggccatccccaagaagtacttgtctaggtgtgatccgaaaaggggcattctccctccaagctatgcaatattgagcgtgtggaacaccaaagatgtgttcaagttgcaagtgaagggtgtgtcaccattggcacatgcttgctgcgtaggtacaaggttgttggatgaatggatgccatggctaaggctaccttcatttcctgatgtttttaggccatttggggtttattttctctatggactacacatggagggaaagcgtggtgcgcaactaatgaagtccctatgtggattcgtgcacaacatggctagagatgatggtggttgtggggccattgtggctgagctgggccaaagggacccagttagagatgcagtcccacattggagcaagttctcgtgggcagaggacatgtggtgcattaagaatcttgaggacactaagaaggatatccaagaatctgattggttcacttctagatcctcttccccagtgatatttgttgatcctcgagatttttga

SEQ ID NO: 69422 - DNA, 270 bp, Glycine max
  Peptide Sequence Number=SeqID_186200
atggcccagatcgaaggtgatgctttcatttgcatgctgtatgtggagacagctgatcggcctggattactggttgatcttgtaaagattattactgacattaacattgctgttgaatcaggagaatttgacactgaggggctcttggctaaggcaaagtttcatgtcagctacaacggtaaagcaatcagcaagcctctccagcaggttcttgctaacagcttgagatatttcttgaggcgtccgacaactgaggaatctagtttttga

SEQ ID NO: 69423 - DNA, 285 bp, Glycine max
  Peptide Sequence Number=SeqID_186201
atgttagctaacttcaaaagggcgagccctggtgcagcgggtaaggttgcgtacaacatccctcccccataccttcgcatagcgaagagcctctgggcaatggggtacgaaaaaatgttagctaacttcaccctagagcttgcaatcccgactaggttggcaccccaaacactaaagatcccccagccactaaccaagaaattcattgcaaaagatgaagaaaatacagaagaccatggggggcatgaaccaaacccatgggagggaaatcaagagaatctatag

SEQ ID NO: 69424 - DNA, 222 bp, Glycine max
  Peptide Sequence Number=SeqID_186202
atgatgtttatagcagcaggactggaggctatcagattcggattattatgcgtgagcaaagtttcggggaaggctactgttattgctgcaataggtgtcgggtatacaaagaaatatgccgatgggggatatacaatctctggtatgcaggggtgcaagatcttatgcccaaatatgtttttgcagtgggggacattcataaggcctttcatgagtttttaa

SEQ ID NO: 69425 - DNA, 996 bp, Glycine max
  Peptide Sequence Number=SeqID_186203
atggattgttcatcatggattaacacttccttggatctcaacattaatccccgcagagttcatgaagaagttcccaaggaggtagaaagcgagcttttctctttgggaatgaccaagtttaacgtggaagaagagtctactagtgacttggaggaggaactgaagcgggtgactgcagaaaacaagaagttggccgaaatgctctcagtggtgtgtgagaactacaacactttgagaaaccatttgatggaatgcatgaggaaaaatggtgaaaaggaggtcagcccaacatcaaagaaaagaaagtctgaaagcagcaacaacaatagtaatttgatgggaactaacaatggaaactcagagagcagttctactgatgaagaatcttgcaagaaaccaagggaagaaatcatcaaagcaaaaatttcaagagtttatgtcaggactgaagcatctgatactagccttgtaagtctctttactagtactcaatctttggttcttggacatggcatagactatatagggattgttaaagatggataccaatggaggaaatatgggcaaaaggtgaccagagataacccttgtcctagagcatatttcaagtgctcttttgctcctagctgccctgtcaaaaagaaggtgcaaagaagtgtggatgatcaatctgttctggttgctacttatgaaggggagcacaatcatcctcagttttcttcccagatggaagcaacatcaggttctggccgtagtgtgacccttggttcagtgccctgtaccgcatctctcagcacttcaacaccaacacttgttacccttgacttgacaaaatctcagggaagcaacgattccaagagcacaaagcctaaaggagattcacctaaagtacctcaggttttggtggaacagatggctacttctttgaccacggatcctaattttagagcagcacttgttgctgccatctcaggaagattgttgcacaataattaa

SEQ ID NO: 69426 - DNA, 1107 bp, Glycine max
  Peptide Sequence Number=SeqID_186204
atgtcgggcccacccagagttcgatccatgaacgtggccgtcgccgatgccgacgcgcgcccggtgctcgtccccgccggcaacaaggtccgacccgtcgtcgaaggacggaagccggtgaagaaatcgtcgacggagacggagaaaaagccggtggcgcattcgccgcaatgcgtctccgttccggcggtggcgatttcgcggcagcaggagcaccaccaggcagtgctgaaaagcatgtcgtcgatgaacgcctcgttctcctccgacacgtcatcgacggattcctccactcacagcagcggcgcgtcgtcgagcgggaaggtgacgcgtcgggttagtgtggcgttgaggaagaagcaggttggtcctaagacggagaaggcgagttgtgacaatgtggctggttctgatgatgctgatttgagtgatagcttggagggcaagaaaagatgtgcttgggttacaccaaatacagaatttgaggttggtgttgacatgctggacaagggttgcagtacttcgccttcttgtataactcagccatgttatattgcttttcatgacgaagaatggggagttcctgttcatgatgacaggaaactgtttgagttgctcagcttctctggagccttggctgaactcacatggcctactattcttagcaaaaggcagttatttcgggaagtctttttggattttgatccaagtgctgtttctagaatgaatgagaaaaagatagctgcaccaggaagtcctgccaactcattgctatccgaactcaggttgcgatccataattgaaaatgcacgtcagatgtgtaaggtacctgtcaaatctccaaaggcagaattcataagtaaagacctcgtaaggagaggattcaggagtgtcggtccaacagtcatctatactttcatgcaagtggctggcctaacaaatgaccatattatcagttgcttcagattcaaggagtgtacctccaatgcagaagcaatgggcaaagagagctccctcaactccaaggtcaaagagaaagcaaacgaggaaccaacctcggtgggtctgttgctgtctgtgaacaaattgagcttcacctctaagtag

SEQ ID NO: 69427 - DNA, 264 bp, Glycine max
  Peptide Sequence Number=SeqID_186205
atgagcaagagcttgagagttgagataccatcaaacactaacaataacaatcgattattatatttaactaaagtagctaatttctcctcacataaacaaaaccctacaaaggaaggctttgataaaccgtggtgggcggaaatagctttgaaggtcgcagcttggattgggcaaaatcagaagacaaggcctatggtgatgatgggtcacaaacttctcgtcgtgggtgaagagtgggtgaagagtggaaagggatgctggtaa

SEQ ID NO: 69428 - DNA, 381 bp, Glycine max
  Peptide Sequence Number=SeqID_186206
atgggagatcgcttggaggatatgattcgtgaccttggacaaaagtcttttcagcaagcacacactcctatgcatgatacattgcaaactgattcaaagaaacctttgtattcggagtatcagaagattcttgcttccacgaatgactgcatattgtatagacatcaatttcaagaaatgtcaaaatgccctaggtgtggggtatcatggtacaaactcaaggatgatgaggagtgtagtagtgatgaaaacttaaacaagggccctccagtgaaggtgttgtggtatcttccaatcattccaaagtttaagcgtctatttgctaatggagatgacgcaaaagaccttacatggcatgcaaatgggagaaactgcgattga

SEQ ID NO: 69429 - DNA, 658 bp, Glycine max
  Peptide Sequence Number=SeqID_186207
atgggagggtgttgcagttgtcatgtttcatttgtaggcaaggtgcatgatgtggaatgtgaatgtaaccataataatgatgatggtgcatgtgaacatggtggggcaagggtcatgttaaaaggatcctctacgtttgtgtcaatgtacagccaaaagggttcaaaaggagttaatcaagatgcattaacagtttggcaggacttcactggaaaaaaggacatgattttttgtggggtgtttgatggtcatggtcctctaggacacaagttatcacagtgcatacgtgacaatctacccgcaaaactgtcagcatcaatcaaacagtcacaagaaaaagccatgaaacactatgacgctaatgctacaaatggtggcagtcatagtgatgactatgttgaggataaccaaaatatgtcctttccttcatgggagggaacctttatgaggtgcttcagtgaaatagatgaaaagcttgctaagaacattgacactgatggatttcgtggcggtagcacttctgtatctgtaatcaaacagggtgagcaagtaataattggcaatgtgggggattctcgtgcagttctttgcagaagagcacctgacaatcaccttattcctgttcaacttactgttgacttgactccagatattccaa

SEQ ID NO: 69430 - DNA, 402 bp, Glycine max
  Peptide Sequence Number=SeqID_186208
atgtctctaattgtatatgaaaggcttgagggctataattgcactatttttgcatatggacagaccgggacagggaagacatacacaatggaaggagttgcaagaaagaaggctattcataatgccaaattttcaagtaatgctagtgtcatcccaagagcagtgaaacagatttttgatatattggaagctcagaatgctaactataacatgaaagtaacatttctagagctttacgatgaggaaataacaaatcttttggcccctgaggagactttgaaatttaaagttgatacgtataggaaacctattgctttaatggaggatgagaagggggtgtttttgccaggggcttggaagaagagattgtttgcactgcaaatgaaatttacaagatattag

SEQ ID NO: 69431 - DNA, 351 bp, Glycine max
  Peptide Sequence Number=SeqID_186209
atgaattcctttttcttcttggatgaaaaagtggaagaagggtgggcactaagagcatctggatttttcttccatgcttgttatgcggtgctattaattgaaacaaaggatcaagaaggtcaatctcaagttctatcagcagctcttgagattgccgaggatgaaaatgttgaagtcgaccccaaatttcgtgctttagttgctgttggatcactgatgcttgaaggtcttgtcagaaaaacagcactggattttgatgttgtgaacattgcaaaagcagccaagggttctaaggaagccaagattgctgaagtcggatctgacattgagctgttaacaaagcagagctga

SEQ ID NO: 69432 - DNA, 480 bp, Glycine max
  Peptide Sequence Number=SeqID_186210
atgaaaaggggtgaaaaagagttgaaagaaagtgaaagaaatctctcgctcttgcgtccagtgtgtgttgtaacattacccacaaattcatcactctcacaccaccctggtatccctctctgtctatccatctctaacaagaacgacacatgccatgacagcgaggacaatgttgatgtcatctcgtcagagctcatgttggccgtcagcatctcgttggagcccaccatactatcgtcgacgtcaaccgctcctcgtgcactcgctagctcactctccaatcagatccaggaggccaagaaatggcgtgtttcgatgccccctttgggtttggttattgaactcagcgatcctaacacaaacgaagatgacgaccatgatttggacagtgcagtcgccaacgcagtgaacagtgcttcttcttcgatagagagttcatccaagaagcgaaggacgagcgaggctagagtcgccaactaa

SEQ ID NO: 69433 - DNA, 1266 bp, Glycine max
  Peptide Sequence Number=SeqID_186211
atggacaccacttcatcccctatgtccctccaaacccaaaaaacaaactttcaagaccttccagaagcttcccccaagccatacaagaagggtatagtggccaccctaatgggaggagctggttccttcaaagaagacaactattttgtgtcccttctgagatcctcagagaaaaaggcccttcaggagctaaaagaaaagctcaagtcttcatttgaggactctccctctgatgcctccatgtggggcattccgctccttggaggcgatgacaaagctgacgtcatcctcctcaagttcctcagagcaagggacttcaggattggtgatgcacaccacatgctcctgaagtgtttatcttggaggaaggagtttggtgctgacaccatcttggaagaggatttagggttcaataaggagcttgaaggggtggtggcatacatgcaagggtatgacaaagaaggccaccctgtgtgctacaatgcctatggggtgttcaaggacaaggaaatgtatgaaagggtctttggtgatgaggagaagctgaagaagttcctaaggtggagggttcaggttcttgagagaggcatcaaggtgcttcatttcaagcctggtggggtcaattccctcattcaggtcacagacctcaaggacatgccaaagagagagcttagggtggcgtccaaccagatcctctccttgttccaagacaactacccggaaatggtggctcgcaagattttcatcaacgtgccatggtacttcagcatgttgtattcaatgttcagcccgtttctgactcagagaaccaagagcaagtttgtgatctctaaggaaggaaatgctgctgagacactctacaaatttatgagacctgaagacattcctgtgcagtatggaggactgaatcggcccagtgacttgcagaatggtcccccaaaacctgtatctgagttcagaatcaaaggaggggagaaagtgaacatacaaatagaaggaattgaggctggtgcaactatcacatgggacattgtagtgggaggctgggacttggaatacagtgctgagtttgtgccaaatgctgagggaagctacaccatagcagtggagaagccaaggaaaatgggggcatcggaggaagcaatccacaactcattcacatcaaaagaatctggcaaaatggtgctctcagttgacaacactgcctcaaggaggaaaaaggttgctgcttatcgctatgttgtacgcaaaagcagcaccatttga

SEQ ID NO: 69434 - DNA, 2085 bp, Glycine max
  Peptide Sequence Number=SeqID_186212
atggcagactccactcgttcgaagtccaacctggattgcttggaagatgccatagccaaactcacagcctctcaatttaacctgtccatgagattggacgatatatgccaaaaggtcgcgactctagaaactcgacccctgtccctttcatcttcatccgctaatctttctactgccccttcatttatcatttctgatcgcatgaagctcgagataacccaatttttcgagtatcatgagacactggagccagattgcctcaccattgcttatttttacatggaaggattggcattagcttggttccaatggatgtctaggaatggccagctggcgtcatggcccattcctcgccaacaaaattgttggtcttccaacaccatttttgctcagttgtttcatcttgggattaagtcccgagattcgccgcgaaatataggtagcatagcccctcacgctgcgttatcagcccctcctcctttgcgaccattactgctagttcacacattggcgctgctacctactccacaaccatctccttctatccctttcaagaaattatcgtcgaaggaacttgcattacaccgtgaaaaaagtctgtgcttcaattgcaatgaaaagttcagtgggggtcatcgttgttcctccaagatgtttttgttcatcacggatgaagacgacaatcctatagatgaattaatccctcctgatgaacttggcgatactggggaaccagacgccatcagctctgctccggcattgcaattaccaaattttgaaattccattcactgtagaaacagatgcgtcaggagtagggattatggctcaagtcattcagacatcagaacaacaattttatctctctaggcttatgggttacgattacacaatcaagtatcgcacaggtaagacgaatacaattgcagatgccttatctcgtgttcctgatgattcgcagagttctctcttcatcgtgtccgttcctcatttcaatttcttagaacagttcaagacggacttgaccactcaccctgagtttgtggcccttcaattccacagtacaccaactggagggcacatgggaatcaaaaagactttagcacgcttgggggaaattttcatctggtttgacatgcgcactgatgttcgtcaatttttcttagcttgcttggattgtcaagctactaagtatgaagccaagaaaccagttgggctcctctgtccgttacctattccctcacgaccatgggaagacctttccctggatttcatagtgggtcttccttcgtatcacggagttgtttcgcttgagtggaacaaagttatggatgagttccgcttatcatccctaaatgaatggtcaaacagagaatggtgttacaacacctccatccattcggctataggcatctcaccatttgaagtatcttttgggcgtaaacctccaagcattccccagtatttgacgggtgattatcaagtgattacggtagacaacatcttgaatgaaagggaagcagtattcacaaagttgcataagaaactctccaaagcgcaggaaagaatgaaacttacggcagacatgcatcgacgggacgtcatgtttgaacctggagaatgggtcatgttggccaaacgtttttatgggccattccaaatcctctcacgcattggtaaagtcgcttacaagttgaaactccctgaagaatcacgaatccatctagtgtttcattgctccaaccttaaactttttcataactccactacagcaactcctctagctctaccttcgcaggacattgacaacaaccccgttatcatacctctggctattctgggaacgcattgggatttagtgcaggacgaaccacggttgcaagtgctggtgcaatggcaagtgttgcatccatatgacacaacttgggaagattgggccaatttgaaggaagctcaccaccttgaggacaaggtgttgcccgatggggtggaaaatggtaggcccaagattggtaatgcaaaaatcactcaaggcaggcccaagagaagaatcattgtgcccagtcacttgaaggattatgtttga

SEQ ID NO: 69435 - DNA, 279 bp, Glycine max
  Peptide Sequence Number=SeqID_186213
atgggggatatgctaggtgcacccagattttttgctggtgcacccagcaatttattgaaatgtcaattttgcccttcatttaaaaacataaaaagttttttccctctttcggaagcattctgtcttctcttccgcgaaaaagcttccttcctctcttctctcttccgcgaaagcaagcttccttggtggtcttcttctccgcgagacttctctgccttcatcttctccgcgaggcttctctcttccatttgcattcgaggtaggtggccttcttcttag

SEQ ID NO: 69436 - DNA, 329 bp, Glycine max
  Peptide Sequence Number=SeqID_186214
aaaatggaaatcttccggaagaagcttcttccggaaacattccggatgacgttcttctggaagtagttcctgagcacttccggaaatcacaaattcttcttccggaagaagtttcgccacttcactgtttgctgggtgccccagcaataatgctgggtgcacgtaacaactcccctcatattggaccaactaaaactctgattgagctagaaaattacactccccgtctttactctccatacgctatttgttcggggaatggaaggaaggatagcgagaagtatgctgagctggagggtgccgccagtttcacaggcgagacatgctga

SEQ ID NO: 69437 - DNA, 522 bp, Glycine max
  Peptide Sequence Number=SeqID_186215
atgaatgtgggactattggttgtttattggatttccaggacactaggggttggcctaggaagacagaaccctatgcactattcaagtggtgaaggacatgatggacagcctgtaagtggtagatcacttggatcttggagcaaacataaactcaccaattttcttgaccatgcatgtgatgtcaactttgaggcagaacaagaccagtattctgtgggtctaatacttggttctcagaattttgcagagaagcttgaaccaattgagattgtggcaaagcaagaagctgctcatggtgttgaggagttaactgcggggctgggcagatggaaacaaaccataactatgatcagaaaggtctatctttcttcgtgcctttgggtttttgatcttgaccatacttggatgaagaagacacaacaaatgcaagttgtgattcttgctgagtcgttccaagctaacgtagtttttcttcttggatcaatggatcacaacaaatggtgggaatcagttccatcatga

SEQ ID NO: 69438 - DNA, 144 bp, Glycine max
  Peptide Sequence Number=SeqID_186216
atggctaggaggttgttactagatccaacaattcatgaagagtttactcaattgaagtttggtcttttggcacttaaggaagtggggattatgtgtcatacctcggttgtcttagataaatgtcagtcgagggttgtatcgtag

SEQ ID NO: 69439 - DNA, 240 bp, Glycine max
  Peptide Sequence Number=SeqID_186217
atgggaaacacccagatgggaaagattgatgcttttcaggaagatggtatcggatggacataccacgttccgaagaaagcattcagaggggttgaaaatcttcatcatgcatgtatgatgaagaagatgcaaagtaaaaaagaatacccagtgggactgaaagatgtggagaagaggtttaagaaagtgaagaaagagagatgtggttactgttctgttgctgagtattttgtgaattaa

SEQ ID NO: 69440 - DNA, 756 bp, Glycine max
  Peptide Sequence Number=SeqID_186218
atggaggcctgtagattttacatgatagaaagtgcctttgctcttacggtggccttcctcataaatatttctgttatttctaatgtcttgggcaaatggagctcaaaactatttgcaattgctttacttgcctcaggtcaaagttctaccataacaggaacatatgcaggacaatacgtcatgcagggatttcttgatttgcgactgaagtcatggattcggaatctgctaactcgttgcttagccattgttcctagtttgattgttgcactcattggtggctctgctggagctggggagctcatcataattgcatcgatgatcttatcatttgagcttccttttgctttgattccactcctcaagttcactagcagcaaaatcaagatgggagaacatgtcaactcaatctcgatctcggctgttacttggatcattggttccctcatcatgggcataaatatatactatttattgactagctttgtcaaattgcttctgcatgtccacttaaaaattgttactaaggtgtttctcgggatattgggattttcgggtgtggcactatatatgggaggcattgcgtatctagtgtttcgcaaaaataaaaaaactacacacattttggcatttagaacattggaagaacaacaagtggcaaatgaacaaggtgatatatcaatttatagtctcccaagagaagacatagtaagcatgcaattgcctcaaaaaaggagtccagcagaaattgattga

SEQ ID NO: 69441 - DNA, 225 bp, Glycine max
  Peptide Sequence Number=SeqID_186219
atgcaggggacggaggaggggaggaaggggaagctggcgatgacggtggaggttttcgaggtggcgccggaggtggcggtggcggagtttactaagtctgccggagatacgttggagtatgttaagttctgtgaggagcaagtgaggccttccctcaaagacattgtttggagctggcaggtactagtactttctatgatccatcatggtcgtggtttaatttag

SEQ ID NO: 69442 - DNA, 264 bp, Glycine max
  Peptide Sequence Number=SeqID_186220
atgactgtgacaggttcatcatctgggcaacctcaattcattgccagcaccggtggtaaccggaacttctcgaatgcacccttgattgaaaactcagatactgatcaaattgttgtacctgatacaacaggctggaaaaacctatttgcatacgtgggacctggatttctagtttccattgcatatatcgacccgggaaactttgagacagatcttcaatcaggagcgcaatataaatatgagacaagaggtgtcttgaactag

SEQ ID NO: 69443 - DNA, 270 bp, Glycine max
  Peptide Sequence Number=SeqID_186221
atggcctcctatggtggtgattcaaacaacaattatctcagaagactacaggagaagccaattccatatattataagtattttggctcaaatcgcagtcaaattgttaacttgtatttatgtagcatttgcggcattggggaaatgttttgtggttcgctctgtagacaaccaaccaagaagccatgagaaaaccaaatcggctcaatccaattccgaggaacaattaatgactccggcgataaaagagccactttggcaaagaatttag

SEQ ID NO: 69444 - DNA, 273 bp, Glycine max
  Peptide Sequence Number=SeqID_186222
atggaatcaagcaatgtgaagaacaagtcaggtggaaaaagaaagatgtctagtgaggacacaagaagttacttcgcatggaacttggaaatggaacgtgtgctagctgatgtgcttagagatcaaagaaatttgggcaataaaggtgatggaaattggaaagcagtggcatacagtactgcagctcaaattttgtccaagcgttttggagttcacctcatggcagataatgttaagaatcgttttaagctttggagaacatggtatggaatt

SEQ ID NO: 69445 - DNA, 486 bp, Glycine max
  Peptide Sequence Number=SeqID_186223
atggatgagtttgatgcgcaggagcctgaaccagagcagccaacagtagaagcaacaaagggggaggatgagctcacccctcctgagcccttttattttgatgcaagtgtacacatggctcaagaggaggagacttccacagaccagatcccagagccatccccagcacctatacctgatgatgccataccatcttcaccaacatgtgagttagagaaacctacctctcaggatttaccagttgctcagccattagaagagaatgagcatgtgattggaattatgactgaaaatgttagtcagtttgttagattgattgtgaaggaatgcattgaccgtatcctggccatgtttgattgtgatagccatttagccaaaaagctgaccatgtgcttgaatgatttatcccttgcaaccagagagcatcatcacaggaagcgtggttcaaagcaaatttgtcccaagtttgggggagtaattatcaag

SEQ ID NO: 69446 - DNA, 1749 bp, Glycine max
  Peptide Sequence Number=SeqID_186224
atgtcagagggaaatgcagggaaaggaaagagaatcgccatcattggcgtctcaaccttattgttggtggctatggttgtggcggtcacaattggggtcaatctcaatgagaatggttccaacaatgatatagaggacaacaagaaaaatcatgttgcttcttccataaaagccgtccaaaccctttgtcatcccacaaattatgagaaagaatgcgaggaaagccttatagctggggctggaaataccacagatccaaaagaactcgtcaaaattttcttcaacatcaccattacaaaaattggtgataaactcaaagaaactaatattttgcatgagattgaggaggaacccagagccaagatggcacttgacacttgcaagcaactcatggatctttctattggggaattaacaaggtcacttgatggaataaatgagtttaacctcataaatgttgacaaaatcctcatgaatttaaaagtttggcttagtggtgcgattacataccaagatacttgcttggatgggtttgagaacaccactagtgatgctggcaaaaagatgaaggatttgttgacgataggcatgcatatgagcagcaatgcccttgccattgtaacagatttggctgacactgttaatgattggaatatcacaaaatcatttgggcgtcgcctccttcaagattctgagcttccgtcatgggttgatcaacatagactccttaatgaaaatgcaagtccattcaaacgcaagcctaatgttactgtagccatagatggtagtggagatttcaaaagcatcaatgaggcattgaagcaagtgcctgagaaaaaccgaaagccatttgtgatctacatcaaggaaggcgtttaccaagagtatgttgaagttacaaaaaaaatgacccatgtggtgtttattggtgaaggggggaaaaagacacgaatatctggtaacaaaaacttcatagatggaacgaacacttatagaactgccactgtcgctattcaaggagatcactttgtggccatcaatatggggtttgagaattctgctggacctcataagcatcaagcggtggcattgagagtccaagcagacaagtccatcttttacaattgctcaatggatgggtatcaagacacactttatgcacacaccatgcgtcaattctatagagattgcaccatttcaggtaccatcgactttgtgttcggtaatgcactagctgtttttcaaaattgcactttcgtggtccgaaagccactggagaaccaacaatgcattgtgactgcacaaggtagaaaagagatacaacaaccatcgggaatagtaatccaagggggatccattgtgtctgaccctgagttctactctgtgagatttgagaacaaggcttacctagctcgtccatggaagaattactccaggaccatcatcatggacacatacattgatgatttgattgacgctgatgggtatttgccatggcaaggactagagggtccttctggtatggatacttgcttctatgccgagtaccacaacattggccccggttcagacaaatccaagcgtgtgaaatgggctgggatttggaacctcaattcaaaagctgcacgttggttctcaccatctaagttttttcatggaactgattggattgaggttactggaattccttgctttcctggcgtgccgaaacaccataggcacaaaaagacaatacttaattggcaataa

SEQ ID NO: 69447 - DNA, 1890 bp, Glycine max
  Peptide Sequence Number=SeqID_186225
atggactacagctctgaagaagattctgatatcagtgaatctgagattgaagagtacgcagagaaaccatatgaacagttaagggctgggaaatacaaggttaaaaatttgaatggaactcttagatgtccttactgtgctgggaagaaaaaacaagaattcaaatataaggatttattgcaacatgcatcaggagttggtaagggttctgctaacagaagtgcacaacaaaaggcaaaccaccttgctctagcaaagtatttggagaccgacctagcctgtgaagcagagccaatccagcgcccagctctaccccaagctgtcaatcaacctttacatcaagaagatctttatgtttggccttggacaggtataattgttaacataaagggaaaatctatcgattctggatattggttgaaggaatttgctaaattcagaccaatagatttccgtatattcttgaaagatgatgacctcattgctggggctgtggtagacttcaacaacgactggaatggtttcatgaatgcaagtgactttgagaagtcatttgaagctgcacgtcatggtaagaaggattggaattcaaggaaattagaagctggctcaaacatttatggatgggttgcccgggaagatgattataattgtggagggccaataggggaatacctccgcaacaaaggaaggttgaggacagttacagatattgttcaagaggcatctgaaagcaggaatagtattgtgacaaacttgactaatgaaattgagattacaaacgaaaaccttgataaaatgcaatataagtttaatgaaaagaccatgtccttgagtaggatgcttgaggagaaagataagcttcacaatgcctttgaagaagaatcaaggaatatgcagcgtagagctcgtaatgaggtacggaggatcttggatgaacaagaaaagctgagtagtgaattggaggaaaaaaagcggaagcttgattcctggagtagagatctaaacaaacgtgaggccctaactgatcaagagaagaagaaacttgaagaggacaacaagaagaaagatctgaggaatgagtcactccaattggcttcaaaggaacaaaagatagccgatgagaatgtcttaaggcttgttgaagagcaaaagcgagagaaagaggaggcctataacaagatacttcagttggaaaaacagctagatgccaaacaaaagttggaaatggaaattgaagagttaaaagggaaattgcaagttatgaagcatcttggagatgaagatgatgcagctgttcagaataaaataaaagagatgaatgatgaattgcaagaaaaagtagataatttggaaaatatggaggccatgaatcaaaccctcattgtgaaggagcgtcagagtaatgatgaactgcaggaagctcgtaaagaattaataaaagggttagacgatatgctgaatgctcctagaactaaaattgggctcaagagaatgggagaacttgatcagaaggtttttgtgaataactgcaagaaaagatttcctcttgaagaagctgggaccaaaggtgtcgagctttgttctttgtggcaggaaaatgtgaagaattcagcttggcatccatttaaagtggtcacagttgatgataaagcagagaatattataaatgaggaagatgagaagttacgaagcctcaagcatgaatggggagatgagatatattcagctgttgttacagccttaaaagaaataaatgaatacaatgcaagcggtgggtatactgttgtggagctatggaacttcaaggataataggaaggctacattgaaagaagttatcaattatattatggaacatatcaaaccacttaagcgcaagagagcttag

SEQ ID NO: 69448 - DNA, 294 bp, Glycine max
  Peptide Sequence Number=SeqID_186226
atggtgagaggaaagactcagatgaggcgcatagagaacgccacaagcaggcaagtcaccttctcaaagcggcgtaatgggttgctgaagaaggcctttgaactttctgttctttgtgatgctgaggttgctctcatcattttctctccaagaggaaagctttatgaatttgcaagctccagtctcaatagtactcaagatcttcatcataatctcaaaagtgtaatgaagtacagtggggtatggataacacctgaggagcctaatttgaagtcttttcttttggggctttga

SEQ ID NO: 69449 - DNA, 717 bp, Glycine max
  Peptide Sequence Number=SeqID_186227
gagccttgtaggtcagctcaccttgcagcaatgaatgctgccaaagtgtctggctgcatcctttcttatgccgcaaatttggcattgccactatggccatcaaaggaggctgctagacagggcattatgagtatctggaactacgctgacatcattaaggtaagtgtggatgaaattcgactcttgactgaaggcgatgatccttatgatgacgtagtgatcatgaagaagctgcaccattacaatctcaagcttctgcttgtcaccgaaggagcacgaggctgtagagactacaccaaggttctgatccataacaaaatcttgcatgatctctattctgcttatgttcacaagcataatgctataataaatgctactgataggaacttggtattaagggggaggattctccaagtgcttggctgcttatcaattggtagcagagctggtttcctatgtcgtggccgttgtataccatcaattggagtatttaagtgcttggttctcctccagatagtggaagtaattgatacaactggagcagctgattcctttgtaggaggactttatattcatttatccaagagggatgagaaaagattgagggaggctctagattttgcaaatgcttgtgctgctttcacagtgacagggagaggagccataccttctctccccacaaaggatgctgttctcagaattctgttctcttactaa

SEQ ID NO: 69450 - DNA, 1818 bp, Glycine max
  Peptide Sequence Number=SeqID_186228
atggccatattacttgtcacattaactaattttacagtaatactcattaatgacagggaggtagttgaaatgtccgagggaaatgcagggaaaggaaagaaaatcgccatcattggtgtctcaaccttattgttggtggctatggttgtggcggtcacaattggggtcaatctcaatgagaatggttccaacaatgatatagaggacaacaagaaagatcatgttgcttcttccataaaagccgtccaaaccctttgtcatcccacaaattatgagaaagaatgcgaggaaagccttatagctggggctggaaataccacagatccaaaagaactcatcaaaattttcttcaacatcaccattacaaaaattggtgataaactcaaagaaactaatattttgcatgagattgaggaggaacccagagccaagatggcacttgacacttgcaagcaactcatggatctttctattggggaattaacaaggtcacttgatggaataaatgagtttaacctcataaatgttgacaaaatcctcatgaatttaaaagtttggcttagtggtgcggttacataccaagatacttgcttggatgggtttgagaacaccactagtgatgctggcaaaaagatgaaggatttgttgacgataggcatgcatatgagcagcaatgcccttgccattgtaacaggtttggctgacactgttaatgattggaatatcacaaaatcatttgggcgtcgcctccttcaagattctgagcttccgtcatgggttgatcaacatagactccttaatgaaaatgcaagtccattcaaacgcaagcctaatgttactgtagccatagatgatagtggagatttcaaaagcatcaatgaggcattgaagcaagtgcctgagaaaaaccgaaagccatttgtgatctacatcaaggagggcgtttaccaagagtatgttgaagttacaaaaaaaatgacccatgtggtgtttattggtgaaggggggaaaaagacacgaatatctggtaacaaaaacttcatagatggaacgaacacttatagaactgccactgtcgctattcaaggagatcactttgtggccatcaatatggggtttgagaattctgctggacctcataagcatcaagcggtggcattgagagtccaagcagacaagtccatcttttacaattgctcaatggatgggtatcaagacacactttatgcacacaccatgcgtcaattctatagagattgcaccatttcaggtaccatcgactttgtgttcggtaatgcactagctgtttttcaaaattgcactttcgtggtccgaaagccaatggagaaccaacaatgcattgtgactgcacaaggtagaaaagagatacaacaaccatctggaatagtaatccaagggggatccattgtgtctgatcctgaattctactcagtgagatttgagaacaaggcttacctagctcgtccatggaagaattactctaggaccattatcatggacacatacattgatgatttgattgacgcggatgggtatttgccatggcaaggactagagggtccttctggtatggatacttgcttctatgccgagtaccacaacattggccctggttcagacaaatccaagcgtgtgaaatgggctgggatttggaacctcaattcaaaagcagcacgttggttctcaccatctaagttttttcatggaactgattggattgaggttactggaattccttactttcctggcgtgccgaaacaccataggcacaaaaagacaatacttaattggcaataa

SEQ ID NO: 69451 - DNA, 156 bp, Glycine max
  Peptide Sequence Number=SeqID_186229
atggtgtgtgattctttggtcaagcacattgattatggtgtttcgttgataattaatgatggtggggagtggcggcaacaagcgaattgcggcaccaatgaagggctcctgaagcgcaaaaagaaaacacaacaagatgaagaagaagaaatgtag

SEQ ID NO: 69452 - DNA, 225 bp, Glycine max
  Peptide Sequence Number=SeqID_186230
atgactccagaacaagtcacgtacaacattatcatcattcaccctatgctagtgaatatattgatctcgatcaagcaacatcatcagttattgcatttcggtgttactccctcttatggaagaacggtaagcattgtggaaacaatgtcttccaagattattttgatgatgccaaagaatcaagagtcaaacaagtttcaagaatcaagatcaagattcaagtaa

SEQ ID NO: 69453 - DNA, 852 bp, Glycine max
  Peptide Sequence Number=SeqID_186231
atggctccgaggaagctttcctcgaagagatctaggaaggacgctgcggccgcagggactagtgctgctcccgagttcgatagccatcgtttcaggagcactgagcaccagcagcgtttcgaagccatcaagggatgttggacgtcactggtcactcccatggccaagtttgatctggatatagttctcgagttttatgccaatgcttggcctacagaggagggagtacgggacctccggtcatgggagtgcgaatacggtcagaggaggaaccgggccgatggatttgatgaggaggtcatcgctcagctgctatgcataccagacatggatgacgttgctgctcagcaacatcctgcccagcgatcacaacttcgacctccctctgccgaagtgtcagctggtgtatgccatcctgacatggatgagcgtccatgtatgccacctaccaggcaccctttagacccagataagtctaacagggccctgggttttccagcattgatcacgggtctctaccagtcgttcggggttcccgtcacacctagtaaggccccaaatgcaccgccgccacctcatcaagctgatccagctgggtcatttgacactgagcggtatttacggcatttggttcgccagcaggcggccaaccacaaggggcacgtgcagacccatgagtgcctctaccaactcagccttagtttgcagagccagggtttcgctccttttacgtgccctactcgagaacagttcagggcagaggttgcatggctcggagattggcccgaggcccaggcaggggaggcgcccgcagaggctcccgacgatggagaggaggccccacatggatga

SEQ ID NO: 69454 - DNA, 375 bp, Glycine max
  Peptide Sequence Number=SeqID_186232
atggctacaccaccctactcccctcctcctcttgagtcatcatcacctttgtcgtctatttcgaagaagacacgaaaagcaacacgattcagatcattagctactaaaccagttggtggggagagatcagtggttcatgtgaatcctaccactggtaaagtcgatggtccccacaaaaagaaattaagaacgtatttggggatcgtcgcccgtgataaggtggtggctgaatttgatattcctggagcatccgatctgaggacgaacaaaaaaatacttcagatcataggagagtggatgttcgaaagaaggatcccttggaagagcaggcctcatagggaagctttgacacccatggacgtgaagatttactga

SEQ ID NO: 69455 - DNA, 294 bp, Glycine max
  Peptide Sequence Number=SeqID_186233
atgactaacgctacggccagaaaagaggaagagcatacagagattgaaacacatcaagaaagcatttgtcaagttaccttaatccatcatcaattgaccaacgaagaggaaacgcctgaagtctctagtactccagaatatccctacttggctactgttggctatgttggagggaaagataaaggtaggttggaactcagcatagaggatcaaaagatctcttttgacctctttgaggccatgaaacacccagatataggtgatgcctattttgaagaagaagaggtggagtag

SEQ ID NO: 69456 - DNA, 339 bp, Glycine max
  Peptide Sequence Number=SeqID_186234
atgagcccttcgacaggcccaagtccatacccgccccacccatcaataaattacccaagcccgataagcccatcccctggcccatctccgagcccaagccgtccaatcaactgctggcgggctacctggcccacgagtttctcaccaaagggaccctattgggccagccggtggtgggacccacttccccggcgttgtgaaccccacccaactcgcccgtttcttgcacttgtgatgaatgatgatgatctaacacaaaacccactgggagagagagggagagagggacacgtggaacgatcctattcgctctctctcgttttgtctcggggagtgtaa

SEQ ID NO: 69457 - DNA, 1740 bp, Glycine max
  Peptide Sequence Number=SeqID_186235
atgaagtgcctacgctctgtggagtcgttgggaggagccgatgaagtgtttccttcatcatctggatctcttgcaagtgcaatcaaggacttttcagctagtgaaaattcttgcctggctgaacagttagataagaagccagacaccggcaacatagaagaagctgaatcatccttacgcgagagtggcgtcttgaactatgaggaagctagagctctgctaggaagatatgaatatcagaaaggaaatatagtagctgctttacatgtctttgagggaatagatataggtgttgtgactcctaagatcaaaattgccctttccagaagcagagaacgccgcaagagacattctcaaaaccatgctgaaccgcaaatgtctatacattctgttggcttactattggaagctgtcttcctgaaagcaaaatctttgcaggttcttgaaaggtttaaagaggctgcccaatcttgcaaagttattctggatatagtggagtcttcattgcctgaaggcatgcctgataactttggtgctgaatgtaaattgcaggagaccctcaataaggcagttgagctgcttccagaattatggaaacttgctgattgtccacgtgaagctattttgtcttatcgacgagcactccttcatcattggaatctcgatgcggagactatagcaaagattcagaaagaatttgctgtttttcttctatatagtggaggagaagcaacaccccctaatctccgttctcaaatggatggctcatttgtacctagaaacaacatagaagaggctatacttcttttaatgattttattaagaaaggtctctctaaatagaattgagtgggatccttcaattttagaccacctttcatttgctctgtctgtttcaggagatttgacagctttagccaatcaattggaagaattgcttcctgggaccatccatcgaagtgaaaggtactatgctctagctctttgttattatggaacaagtaaggacttggtagcactggatcttctcagaaagttgttgaggagtagagaggatcaacaccatgttcctggtttgttaatggcttctaagatttgttgtgagaactctactcttgcagaagaaggagtaagctttgcgtggcaagtgcttcagaacctggatggtagatgtaatcagctagaaaatcatgccaatttctttcttggtgtttcactttcagcacactcgaaattggccgtttctgattctgataggtttaagagacaatctgaggcacttcaagccctagaaactgctggaagaacgggaaacccctttgtactataccatctcagtttagaatatgcagaacaaaggaagctggatgctgcactttattatgcaaaatgctttctaaaactggaaggtggttctaatgttaaaggatggttattgttagcccggatattgtctgctctaaaacagtttttggatgctgaatctattatcaatactgctttggatcaaactggaaaatgggatcaaggtgatttgttgcgaacaaaagctaaacttcaaattgcacagggccagttaaggaatgcaattgagacatatacgcagttgcttgctgttcttcaaatccagagtaaaggttttggttctgggaagaagctatacaaggcatttcgtgaaaaagtagaaagcagaatgcatagagttcctcagaattttgcatgtgttgatgaagctttttga

SEQ ID NO: 69458 - DNA, 1224 bp, Glycine max
  Peptide Sequence Number=SeqID_186236
atgggttgctttttcggttgttttggttcctccaaacacagaaaccacaagcacaaggttcaacagccaaacagagctaatggtagtagcaatagcaagcaagagcaacatagtgtctctttggttcaggattgctccacaaatgctattaaccctataccacaactccaggataaaagtgaggagcaactaagtgtcagcagcagaaagaaagtgacatttgattccaatgtgaagacctatgagcctcttttggctgatgaagttgtggagaggaaaaatgaggaaggtgggaaggaggaagctttggcccaatcaaagtcatcttcctctgaagctagttctgtgacttcaacggggtcttaccctcccaatcataggtaccagaattgccgcaacagtgatgacgaagaggaagagattgattatggggacagtgatcttagtgatggagatgacgatgaagaatgcaatgaagtgagtgaggactttggagaagatgacatagtggcaagtactgctgctgatgatcatgtgtttgttgaagaggttgatgtgaagtccattgggtccaaccctaatgtcagagacagaagtgcttatgttcatcctgtgctgaatccagtggagaatctcactcagtggaaagttcttaaggctaagagaacaccaataaggcctcagaaagagaatgattttggggttggtgtaaaaggatcacctttcagcttgaattccaaaagcgacttgccaaagaagttgaaccgggagatacgagttgatgccagcctgtcaaattggttggtctcaccagaaactacacctgtttgcaaggctggctcagtggcttcctttgctggtagtacccctgataggatcacctcacaaggttcatattctgtgataagtcatgaagataggccaattttaggggcattgacattggaagagatcaaacaattttcggctacttcgtcttcacggaagtcaccaagtaggagtccagatgagatgcctattattggcactgttggaacctactggaatgttgcaggctctgctgaggaccctggctcagtctcttcctttaaaggaattccgaactcaacaagcaagtacagagaggataagagcgtgaattggcgctcaaccccttttgagacaagattagagaaagctttgaatagaggtgctgcttctgcttatgttcctcgtgtattttag

SEQ ID NO: 69459 - DNA, 948 bp, Glycine max
  Peptide Sequence Number=SeqID_186237
atggagggtgctaactggaagataacagaggaagaagcagggccatcctcttcttctgggattgcttcaaataaacaacaaaacccacctgaaacttttcatcatcaacatcataggaaggaggctgcagcagaagaagaagaaaccgaggaagaggaagaagacgatgttgatcatcataacaatagcacctttgttcctggtcctctcctttctctcaaggatcagatcgaaaaagacaaggaggatgagagcctaaggagatggaaagagaagctgttgggttgcatggaaagtgatttagatggtcagatacatcctgaagtgaaattccactccattggaataatctctgaggattttggtgaagtcattactcctttatctgtggatgaaagccaaaatggtcatattctgtttactctcaaggagggctctcattatcagcttaagctaaaattcagtgttctgcacaacattgtgtctggtttggcatactgcaacaatgtgtggaaaggagggcttcaagttgaccagagcaaaggaatgttgggtacctttgctccccaaaaagaaccatatgtacataccttaaaagaagacatcactccgtctggtgtgcttgcaaggggtgtatactctgctaagattaagtttgaagatgatgacggaaggtgtcacatggaactcaaatattcattagagataaagaagagggtgagtcctggtgcagcggtaaagttgtgccttggtgacttgttggtcatgggttcgaatccggaaacagcctccttgtctatgcaaggcaccgacattgacactgacatggatatcggacacaacacatgtggacatctgtcaaacacatcaaactcaactcagacgcggatgccggtgtcgcgtcgaacaccggacacggcaagagactggggtgttcgtgcttcatag

SEQ ID NO: 69460 - DNA, 2679 bp, Glycine max
  Peptide Sequence Number=SeqID_186238
atggccatgagtgcagccttaaacactggttctcactcccgaaatggatttcgttactcggacgaggaaaatggagatttcaatcaacagcagtggcaacataatgatgatcaagcattgtctgcggcaggaagcgttgctaatgaggattttgaagggccgaaagcatactacagcaatccaaggaaacgcaaagacgagagaagtttaacgagcaatgaccaaggagaagatgactacctattggccgagtcaaggcaacctttgtggcgcaaagttccaatatcttcaagcctaatcaacccttatcgcatagtcataatcatgcgtctcattatcctagttttcttcttccacttgcgcataacaactccagtgcatgatgcacttgccttatggataatctctgtagtctgtgaaatctggcttgcattgtcttggctagtagaccaaatccccaagtggttccctattactcgtgaaacttaccttgaacgtttgtccataagatttgagcgcgaaggggagccaaaccttctatcaccagttgatatctttgtgaccactgcagaccctttgaaggaaccacctattataactgcaaacacggttctgtcagtgttgtctgttgattatcctgttgtaaaagttagctgctatgtctcagatgacagtgcatctatgcttctctttgataccttgttagaaactgctgagtttgctagaatatgggttcccttttgtaataagtataacattgagccaagggcacctgagttttatttctctcagaaacttgattacttgaaagataaggtgcacccaacatttgttaaggatcgcagggcaatgaagagagagtatgaagaattcaaggtgaaaattaatgtattggttgcaaaggctcagaaaaaaccagaagaggggtgggtgatgcaagatggtaatccatggcctgggaacaacattgatgaccatccaggaatgattcaggtatgtctaggaagtgctggtgcactggacatagaaggcaaggaactgccaaggcttgtgtatgtttctcgggaaaaacgtcccggttatcaacaccacagtaaagctggtgcctcgaatgctctggttcgagtttctgctgtgcttagcaatgcaccttttgcattgaatttggattgtgaccaatacatcaataatagcaaggttcttagggaggctatgtgctttttaatggatccccaaattggaaagaagttctgttatgtccaatttccacgaaggtttgatggcattgattgcaatgacagatatgctaatcacaatactgtgttctttgatatcaacatgaaatgccttgacgggattcaaggccctatgtatgttggtactggatgtgtgttcaacaggcaggcattatatggccgtgagccaccttctgataaaaggccgaagatgaagagttgcagctggccttcatgctgcagctgttgttctggtgactctcagtcttcatctgatgatgacgagactgatcaagagcttgaggactttgatgaggatgaggaagaggaattacccttcatgtctctgaaaagtttagagaaacgatttggacaatcaccagttttcatttcttctgctttgatagaagatggtggacttccaaaaggaaccgatgctcaattactgattaaggaagcaattcatgttataagctgtgactacgaagagaaaactgaatggggaagagagcagattgggtggctttatggttcagtcacagaagacctcttaacagggtttaacatgcattgtagaggatggaaatcagtgtactgcatgccaaagaaagcagctttcaagggatctgctcctataaatctatcagaccgattacaccaagttctgaaatgggcttcaggttctactgagattttctttagtggttattgccctttgtggtatggttatggcggaaaactgaaatggctgcagagattggcctacactaattccgttgtctatccgttcacttccatccctttgttgatctactgtgcaattccagctgtttgtcttctgactggaaaattcatcatccccactctgtcaaaccttgctagcatttggttaatggccttatttatctccatcatcttaacctgtgtgctagagcttcgctggagtggggttagcattcaggactggtggcgcaacgagcaattttgggtcattgggggagtttctgcacacttttttgctgtatttcaaggtctccttaaagttggtggagtacacactaatttcaatgtgagagcaaaatcagcaaatgacactgcatttggacagctctatctcttcaagtggactactcttctcatcccaccaacgagtcttgtaatattaaatatggtgggaattgtggctggaatctctgatgccattaacaatggctatgactcatggggacctttctttgggaagcttttcttctccttgtgggtcattgtgcacttgtatcctttcctcaaaggcttaatgggaaggcaaaacagaacccctaccattgtagtcctctggtcaatacttctagccataattttctcaatgatttgggtgcgaattgatattttcttgcctaagcagacaggtccagcactcaaacagtgtgggataagatgctaa

SEQ ID NO: 69461 - DNA, 207 bp, Glycine max
  Peptide Sequence Number=SeqID_186239
atgggggagggatattgtacgcagtcttacccttgcatagacaaggaggctgtttccggattcgaacccatgaccaacaagtcaccaaggcacaactttaccgctgcaccaggactcacccttgttgatgcaagtacttttcagttatacgtgatatcaggcgtacaaatcacaaatgctgaattttgcatttccttagagctttga

SEQ ID NO: 69462 - DNA, 2901 bp, Glycine max
  Peptide Sequence Number=SeqID_186240
atggaatcttcgtcgactcctcctcctaagttccggttcagagaccactcagaaccggaatctcagaattcattggagccaagctccgatgttgtttctgcagcgtcaccgtctatcggtgatcctgatgcagaccttgaaattgaatccatgaccggaagaggcatcatgcatctgtgtgatgaacttcgggaactaaaggaagcagcaaatgaagatttacagaaaaacatatttagcaaatattccactttccttagaatactagaggaagtgataggagtggaaaatgagctcgtgcaactggaaaaccattttgtatctcataaaaggcaagtaaaggatcttatagatcgaatatatccaaagatattgtccatagacatagccttcgatgatcatgtcaatattgtcccatctcaccccaccgaattgaaagctcacattaatgaatgtttagagaatttggatattctcttatcagaaaacaagatggatgaagccctgaaccatctagaatctgcagatgaacattatcaaagccttcaatttcaagattgttcccatagagagatcatgctatatgaatctgcaatttctgagaaaaagtccatgctgatacaacaattatcacaaatagctgagaataaaagaacaccgggaccagaacttcaaagggcactagctagactttgcagacttggtgatactcaacttgctattaatctgttgcttaaacattaccatttgcgtgttgcgaatggaactgataatttgcagtgggcaaaatcatcttcaattgagatatacataagggaacttgcaaggtttgtgttctcaatggtttcacaagcggcaaggagctttgtgatgttgtgtggagaaacttctccttatgcctcagagcttatgttgtttgcatatgaagaaacaaaatcattcatcatttgttttgataaatacgtcaaaggcacctcagcaataagtggagggttgtcttctgccataaaagctgtcaagtttgctgtcatgtactgttctttgttagaaaatcagaaattggtgttgcggccatacttagtgaagcatctctttccatgcatggaagaggttttgaatacacatataaaccattttaagaaagtgattgttatcttctcagcgagcgatccttggattttggagaagtaccttgtttctggagtgtttgttggggctggatcttcaactttagccgttggagaacaacatgactattgcttgctaactaccagtggccggaaggttgtgacactattgcaggccattgtggaagatatttcttctttagtttcccttcatatggggagtttagtcattagtggaatcacaatcctcttcacagagtatattgtcatacttgaaaaagcccttacttatgaagcaagctcaacagaacaaggtagtccaagaataaagctagctgagtcactaccacaacaggtttctattttggccaatttgtcaactttagtgcagtttctctctatcatggtcaaagatatctttagcagcagtgatcacatagaatttcaagtattggaaaactattcaattgttcatcagcagcaaggacttgatgatttcctattgtttattgaagagggttccaataagttgagaaacgtgttctgccagcaattaattctcagagtattgtctacttaccacaggcatgaaatattttctgctagccattgcaatgaccagtttgatgctaacactgtccacgatccaatgccgtctggtatctttcaggttttatttctagaattaaagaaaatagaacaacttgaggaagaaaatgtgtttgaagtgaattggttgatgggattactgagagaattaatggagtcgatgtttatttgggtttccaacaacaaagagatccttgcaactacggaaaagaatgtgagctcacaaactgatgaagccaaacagtttattttggatgtgcaattcttggtggaaattggaatgtacggaggatatttctccagcgatcctttgctccttctaactctcatgaaatcaaccttcaattcagcaggactagaccctttcaaagatgtagatgatgattattgggctatagatgctgctactaaaacaattcaaaagctgttggagattgagaaaacaagtttgcatccaaaggagcctgtagttaccattaaagaggagtcacatgagcatgagaaccaaatcaatcaatcagcatatgaatgtaatttttccaaggaaaatgatataagttcttcagagaataacgtagtaaaacatgaactagatgaggttgcaaaacatgaactagaagttgccattgatgcaaagatggcttcactagacacggtatttagccccggagagggatctttagtgaagagagattatgttgatacagactcttcaaatttgagaccaccttctatcatgactttgcaattagaggatgctgattttgtagaggcaacggatacaaaaaatgatgaattgactccaacatcttccgtgggtgaggctttacaagctttggtaagagaaggtatgagatgcaaactaaacaatgacaactccatcaacatttggaaagatccatggcttcgaaattcagataagtgctatgttacatccccacctcctattggtcttgagcacatgactgttaactctcttatagatggtgagcgaaaatgtaggagactagacaatggtcaacaaattctcaacaatgaagatttacaagacattcagataagtgcatactgtgaaacaaaaactgggcgcttcttgaagctatcatatgggggatgcagtttcaattccatgattttatcagaagtggactgcaaaagcttttag

SEQ ID NO: 69463 - DNA, 730 bp, Glycine max
  Peptide Sequence Number=SeqID_186241
atggacagcaatacaaccaacaatagggacaatggaggaaccatcctacgaatcaattcaataaagaccagagggaaccatccacaaggccacaacaacaaagggcctagtctctacgatcatacaacgaagctggaagacactctagctcaatttatgccggtttcaaagtctaaccagaagagcacagagtctgccataaagaatctggaggaggaatgtaaagttgtcatgacaaggagcagaatggcaacccatgtggatgaaggaaaagctgagaagaagatggaggaacataaacaacagctggcagctaagccgacacttgaaccagtggatgattttgttgaacttgaagaagttaataaggaagctgaagaagaggatgttgacattcctctcattcttggccacccattcatgtctaccgcaagctacatagtagatatgggaaagaagatgttgtacttggcaccctttgttgcacaatacgtgaagtttcgtaacatgccgaagatcaaaaggaagcattgttacacagtccgtgagattccgatgttcctccagaaggcggttgcttctagaggaaccaacctggctcgcctgggcgagctgggtggcaagctccccccgtattttcctataaatagggggaggagtgaaggagaaaggggttcagccctgctgaaagattttcaaccgttcttcgtcgttcttcggtcttcaaccg

SEQ ID NO: 69464 - DNA, 318 bp, Glycine max
  Peptide Sequence Number=SeqID_186242
atgctattggaaacagaaacaagagagatcgaagcaagagttgtcttcaacgaaagagaaaaatatgatcttaactcgccaattaatccaaatctaaatgagaaagtcccaatgtggctttttgtgagatttgtaatcgggccaagcgaagacaagttgtgcatagagtggttgaatagtgtgtttcaatggaaaatgattctaactggccagccagtcaaatctcatccacaattaagcattgtcgatcttcttctttgtcttcgtcaatgtgctactgtcagcagcgatgatgagatgattgttgtcgttaggtga

SEQ ID NO: 69465 - DNA, 213 bp, Glycine max
  Peptide Sequence Number=SeqID_186243
atggctctaggtttcaaggaagtgactctggacacaccacttccagacatcaattacagcaatctagatcaatttcttggacaaattagaagacaatattttagtttcttgagaaagcagaggtttctggataccaaggcagattcatggagagagagagagagagggaaagagagaagtgggaaagatccaagaccaagagacttagattag

SEQ ID NO: 69466 - DNA, 459 bp, Glycine max
  Peptide Sequence Number=SeqID_186244
atggcttctcgtaaaaagaagtcaccagcttcagtgtcccagtcacgatatgacagatcaaaattcacatcacaagatgcttgggacagatatgcggacaatattctcggccagaaaatccttctgaaaaggaatgtgaagttgttctatgccaaatttcatgaatttagaagggaagttgggaggaggaactggcataaggagctcactaacttcttagagggaagcattgaagttgctattgttaaagaattttatgctaacctctatgaccctgaagacaaatcgcctaaagcttgcaactcatctatgtctctatgggaggggatttcagttgaatgcagacaacctgcctctgaagatcttgaggaagaatctgactactctggcccagacctagagtgttctatccttttcaaacttagccccgacatcccacacttctggcattactcttga

SEQ ID NO: 69467 - DNA, 1479 bp, Glycine max
  Peptide Sequence Number=SeqID_186245
atggaagcacatcctactttctccattgaaagatcaaagcaactcaataacatggggatgtctggagcactttcttcatccttgtcaatccttccaatacccccagaagagatgtttcccaagctgcctcaatcacaattggattttgtagaacaagagcttatgacaagaccttttactcattcaagttatttaaattccggtggagtagttgggcatattttttcgtcttcccctggatattcaactgatcttcatcactcatctctttcacctgatgaaaaacactctactaatgctcatttgatttcacaatcatcaactaacatcacccaatttccattatcatattcttcaaatactggaccaccaacttcagcaacaccaagccattattccaaagaaagcagtgtttcctggcatacagattccctgccaagctttctggattttcctgaaaatggctctattgataataatcgggtagaaagtagtgcctgccctataatggcatctgaggagtattctaagcaaaatgattggcaggagtgggctgagaggctaatcagtgatgatgacactttgactactaattggaatgaccttcttgctgacaacattcaagatcttgagccaaaggtgccattccaagtttcaaaaccactttcacagattccaggacatcaatcccaaggtcatcaacaacttcctgcttcatatggagagaattgcattggtgctgccctctcttcctcagcaaattttgctcctgctaagtcacgaatgcgttggacaccagaacttcatgaggcgtttgtggaggctgtcaaccaacttggggggagtgaaaaagctactccaaagggcgtgctgaagctcatgaaagttgaaggattaactatatatcatgttaaaagccatttgcagcatgcatttttactgaaacagatttggcttgaaatgaagaaatacaggacagctagatatagaccggagtcatctgaaggagttatggagaaaaaaacaagttccgttgaagagatggcatctctagatttgagaactggtattgagatcactgaagctctacgactacaaatggaggttcagaagcggttgcatgaacagcttgagattcaaagaaatctacagttgcgaatagaagaacaaggaaggtacctccagatgatgtttgagaagcaatgtaaacctggaaatgaaacgttcaaggcaccatcatctatcattgagactccatctggggggtcttcaaatgctacgaaagattcccttgccaaaaatgaaatggaagcatcacaagtgaaccatggcaggtcaggacctgatcaggttaagggcagtacgacatttgaggaaggctcattggaaaagtgcgggaagcctgattctcccaaaactgaacatgctattgctagtgaagatagtgctcaagccccgaagcgtcaaagaactgagtaa

SEQ ID NO: 69468 - DNA, 1002 bp, Glycine max
  Peptide Sequence Number=SeqID_186246
atggttaatcaattgacgaaaaacatggtgaagtctggtcaaatgttgttgacaatcaaagatcaaaaccagacaaatctgaataccatcaaaatcatatacaatgaacatcagagatattgtctccaagaaaagggtctaaggatggaaatacaacatctaataaagttgatagaacgcgaccaatatgtttactggtttagatggttggacaatgaagatgtcgttagagatataatgtggccacatccaaattccatcaaactcctgaattcattttcaatagtgttgatttatgatacaacttacaagacaaacaagtatcgtctttcgttgttggaaattgttggtatcacttcaacaagcatgactttcgttgttgcctttgcttatttaagttatgagagaacggataattttgaatgggctttaagtattgatagttctacttatgggtgcacacttagaattactcaccgtctaccatgtgcttatgagcttattgaatttatcagtgcatatggctacattctcttgaagaacattcatgtacattggaagatattatccattcgtagttcatacgacacaagtgactcttgggggaacttaactctgacacgtgagattgatgcattgtttaagaggttttcacaactagatgtgcctggtaaaatcatcttgaagactaaaataaaaacaaaggatgcaccaaagtctatgaaatctaccaagcacaaaccttcaatgtgggagcaagtcgatgaaataaatatgatggttagtaattcgggaactccaagtgtcactcgcaagggtgaacgtgacaacaagaagaaaaaaatggataattatgtggatgaattttccgatgaattgcaaaaatacattttgaacattgttgatatccaagcagatagaaattgttgttacatggtaattatatctgtgctaggctgggttaagagtcttggtctctcgtcttgtaagaatacattttga

SEQ ID NO: 69469 - DNA, 423 bp, Glycine max
  Peptide Sequence Number=SeqID_186247
atgggtgtcaagttcctcgaagcagtcaagcgaaggttgcatgccataaacaatggtccccggacgaaattaggccttatggttgatgaaggtagaaatcttggtggagggtttatgagattaacttctattaatgaatttttctcaaggaaaagttttctttcaggccttataagatatcttacagtggtagggcacttaggaggcacacaaaacaaaaagattgagaattcacggcagaacctgtgtctctttggggttcaagaggatcaatctgaggagcagaagctggttttgttggagaagaatttgaatcgatgcactaatgcgcggaaacatggtgattggaagagggtggttagggaatctgaggctgccattgctgttggagcatatttttcgcctcaagtagttttgaattga

SEQ ID NO: 69470 - DNA, 171 bp, Glycine max
  Peptide Sequence Number=SeqID_186248
atggcctttcaagtgaccacattccacctcgcttttgttgatgatacaagagagttcttaattactggaaggtacctccttccaaatgatcatttgaatgagctacagtggtgcatattctcttttctaacatggcatatgctttgtctgtctgttatgatccatttttaa

SEQ ID NO: 69471 - DNA, 204 bp, Glycine max
  Peptide Sequence Number=SeqID_186249
atggaggtatatgatgaaacaaaaatactggtatgcatactcaagctactgaagcaagaatctgttgacgggagtttggataagggaatgcatttcaaagcccgaagggaaagcccagtggcatacaccaaaaagtacaaaaattcacaaaaactccatgtaaggctgttagttagctcacacgctgccaaaggcaggaaatga

SEQ ID NO: 69472 - DNA, 2472 bp, Glycine max
  Peptide Sequence Number=SeqID_186250
atggcgccaacgccgagtcaaaaagaaagagcacttgcggcctgtcgtgctatgtcaagtcttggaattgatgattcgaaagtgaagtcggtgttaaagaaactcctcaaagtgtatgataaaaattgggaacttattgaggcagagaactatagagttttagcagatgctatatttgaggatgatgataatatggtgcccgaattgaaaaagaaaagccagacagctgatgtgcataacactggtcattctatgtcgtcttcttttcaaaacaaccaggaagcagagacagggtgtgaagaggctcagatgcatgttgaaacaccccaacctttgaaaaggttgcgtttacaaggccaggagagtcagcctttgcatcctccccctaacggttcccccagcccttcatcaaaaaaacttaaattagatgataatgcatctgggaagaagcctcaaaacaaaccagtgtcttctgatgggaatccagggattgcaactcgtccacttccaccacgagatggcattgttgataaggggaaacaacctgcatcactccctcttaatcacagaggaagaagacttccatctgaaagagtgccccaatctataccgtctagagaaccaacagttgaacctgggaggtttctattgccaaacaaccaaatgccccgtactcagacactggtcatacccaaggatgagcctattgatgaattgactgattacgagatgcccattgcagtgattccccctgaatcaagtgtaaggaactcgtcaattaagaatggtgtagctggaaaacatagtggtcatgttactgtgacatcatcacaaaacagagatggagttggagatgaagatgttattcccacctcaaagaaagaagcgacttgtaatgtagagatagcctcatcaactcttggagaggtaaaactttctttgagctacggctcagctcttcagggatcagattttcatatacctagtcgagatcaacttataaaagtgatggaggataaatgtctgcgatcatataaaatcactgacccaaatttctctgtcaagaatctgttgagagatatatgtgattgcatgttggaattcagaaatgactcaaatgatgactcacaagaaggttctgtgataagttccagtgttgatgtgtcaaaggaaccacgggcacctggcacactgagtgtggtaggaaataaagatttggacacgtcttctcacttttcaaacggatccatcaatgttaagtcttctgatgacttggtttctcccggaagtatccttcctctagcccacccgaatggtctgagtgatgctgtaccggtttccaagatggacagaacgaatgattttttgcaaagtaatgtcaaaaaggatctggaagatcctatgtctccaaattcacatagtttagtggttgttccacagcatcagcttacagctgatgatataaggtcttttcatgatgctaatgaccttacaaaaggagaagaaaatgttgaaattccatgggtgaacgaaactactaatgattttgcaccatcttttaactacataccccaaaaccttgtgttccaagaggcttatgttaacatttctctatcacgtgttggcagtgaggactgttgttcaacttgtatgggcaattgtgtcttgtcttcatcctgtgcttgtgcaaataaaactgggggtgaatttgcatacaatgctcaaggcctactgaaggaagaattcttggaagagtgtattgccatcagtcgcaatcctcagcaacatttattctattgcaaaaattgccctcttgaaagatctaaaagtgatggttgtttagaaccgtgtaagggacacttaaagaggaagtttattaaagaatgttggagcaaatgtggctgtgggaagcagtgtggcaatcgggttatccagcgaggaataacttgccatttgcaggtattttttacttcagaaggaaaaggatggggtcttcgcaccttagaggacctgccaaaaggtgcatttgtgtgcgagtttgttggagaaattttatccatgaaagagttgcatgagaggaacttgaaatgcactgaaaatgggaaatatacatgcccagttttactggatgctaattgggattcaggatatgtgaaggacgaagaagctctatgcttagatgcagcttcctttggcaacactgccaggtttatcaatcacagatgttctgatgcaaacttgattgaaatcccagtcgaagttgaggatcctggtcattattactatcattttgcctttttcacttccagaaaaatatcagcacaggaagagctaacatgggactatggcattgactttgatgaccacgatcatcctgtcaagctgttccagtgcagatgtggcagtaaattctgcaggaacatgaagagatatagcacaccacaagcccacaatgatagtcatgaaatatag

SEQ ID NO: 69473 - DNA, 987 bp, Glycine max
  Peptide Sequence Number=SeqID_186251
atgtcccttaacgacggcaacgattcaaagttgaacccttcttctctactgaattcattcaccaaattactatggggccaatcgctccctccccccggggctcctcgtcgccaccgtccgcaccgcctggaattccacgtggcaccgactcctccggccgctactcctctacgtgggcctggcgtgcccgtgggcccaccgcaccctcataatgcgcacgctgaaggggttagaagacgccgtgcccgtctcggttgcttcgccgggcctcgacgggtcgtggaagttcaaacgggccggtgggcccgacacggaacgttgaagcaaatttataggcttcggagaggagggtacgatggaagatctacagtgccaatgctgtgggataaggcttcaaaagacgttgtctgcaacgagagctacgatataattcacttgttcaattccgagttaaatagcgtagctcaaaaccctggcttggatctctcaccgcctcaattgaagaaacggattggggaatggaatcaaatcatatatccaaattccaaacgtcaacaacggggtttatatagtcaagaaggttatgataaagagttgaatgatttgtttagtacactggacaagttggaggttcacttggctaattccggatacttgtgtggagacacattgacccttgttgatatatgcctatttactactctggttaggtttgatcttgcgtataacgttctacttaattgcaccaagaagaagctgtgtgagtacaccaatctacatgcctacttgcgtgacatttatcagattccgaaggtggcggctacttgcaattttacagatattatggatggttactacaaaatcctatttcctctgaatccagggagcattagaccggtcatgccttctacttgtgagcatgaaagcctttgcaggcctcatgcaagggaatccctgtcatcagctacactagcatttgtaaaataa

SEQ ID NO: 69474 - DNA, 801 bp, Glycine max
  Peptide Sequence Number=SeqID_186252
atgacagatgcagataacatatacttggtttacaagggttgtgcagatcagaaactgcacgatccatctgggatatattcacagaacctcaaaaccctcttggattctctggtgtcgcaatctgaaaaaaaggcctttttcaccacaacttatggagaaggccagaatgtgatcatgggtctctaccaatgcagaggggacctctcgaacactgattgctacaactgcgtgagcaagattcctgacatgctcgaaaacttgtgtggcaaggtggtggctgcaagggttcagcttatagggtgctacctaaggtatgaaattgttgggttcaagcaagttcctgagactcaattgctttacaaggtttgtggggccaaggaagagagttataatgatggatttgaggagaggagggactctgtgtttggtatggtggaaagtggtgtaaagaatagtgggaacttgttttatagtgggagctatcagtctttctatgtgttgggtcagtgtgagggtgatttggccaaagatgattgcggggattgtgtcaaaagtgccgaggatcaggccaaagccgagtgtggtgactctatttcttcacaagtttatctgcacaagtgctttgttagctacagcttctattccaagggagggaccaatatttcatcttctccgggtaggtcactggacacgcagaggactgtggctcttgcagtgggagcttttgcagctttgggtttcttgattgtttgtttgttatttctcaagtcagtgttgaagaaaaaaagtgataagtattga

SEQ ID NO: 69475 - DNA, 207 bp, Glycine max
  Peptide Sequence Number=SeqID_186253
atggaagggagtaaaaaatacttatcaggaagaaggaagaaggaagctgctggaagagtgtttgctgaggtttggcgcaacacacccctcacatgcgtacttgcacccagtgcaacacctgcgccccaccctgtgtctatgctgaccaaattcatgtcacttgttagcttccgattgaattgtgtccctgtctttagcgcaatataa

SEQ ID NO: 69476 - DNA, 549 bp, Glycine max
  Peptide Sequence Number=SeqID_186254
atgtcacttgcagataacagacttggtttacaaggcttgttcaaattcgacccttctgggatatactcacagaacctccaaaccgttttagtttctctttggttacagtctgaacaaatgccgttcttcaccacaaccttaggggatggccagaatgtgataaactctaacaatgcaaaggggacctctcaaactccacttgccgcaactgtgagcaagattcttgacatgcttgaaaacttgtgtggcaaggtggtagctgcaattgcaactgccagggttcagcttatagggtgctaccttaggtatgaaattcttgagttcaagcaggaggctggcctgctggagctcgaggtcgttgagctgctgctcgcggtccatctcgacgatgagaggaacaacgaggacgaggaaggtggtgccggcgatccacgcggccttgccggtgctgcggaggagcttcttggcgacgaatgcggcgtcgccggcggcttccttgccgcgggtgacgatggaggagcgcgagatcttcgcgaggacggagcttga

SEQ ID NO: 69477 - DNA, 192 bp, Glycine max
  Peptide Sequence Number=SeqID_186255
atggcagcccaatgcacaagactcctatcattgtggggtctagtgtcagaggtacacagccttgcatctgtgaatgaagagactgcttctatcataaatccagagtattttaccttcaaattagctccttctaggacagctccctctagatttgcattgaattgtcatgcagatgagggggatataaactga

SEQ ID NO: 69478 - DNA, 228 bp, Glycine max
  Peptide Sequence Number=SeqID_186256
atgcctagaatttacaaagttgagaagagaggaagcattaaggaactatgggcactcaaatcaaccttccttccaattggtatcccgtccatatttaccttgacgaacagggaactcctgagctattcactctatatgttcgaagtggaggccatccaactacttgactgtttggaaagggacagcaacaccatagactacttgtttggatggcaaaccacttgttga

SEQ ID NO: 69479 - DNA, 2268 bp, Glycine max
  Peptide Sequence Number=SeqID_186257
atggggtacgaagttttttttaatctcactggggaaacccccggagagctggggaagctttcatcactggaatgcatgatcattggatacaataaatttgaaggagggattccagcagactttggaaatctcaccaagctgaagtatcttgatatagcagaaggcaatctaggtggtgaaattccagctgagttgggaaagctcaaaatgttgaatacagttttcttgtacaaaaacaaatttgaaggcaagattccatcagaaattggcaacttgacttcattggtgcagctggatctctcagacaacatgttatcaggaaatattccagctgaaataagtcggctgaagaatttacagcttctgaacttcatgcggaaccggttatcaggtcctgtgccttctggccttggggacttgcctcaactagaggtgcttgagctatggaacaattccttgtcagggccattgcctagaaaccttggcaagaattcaccattgcagtggttggatgtatcatccaacttactctctggtgagattccagaaactctttgcaccaagggcaatctcaccaagctcatacttttcaataatgctttcttgggtccaattccggcaagcctatcaacatgtccttcacttgttcgttttcgaattcagaacaattttcttaatggaacaattcctgtgggtcttggtaagcttgggaagcttcagaggttagaattggctaacaatagtctcactggtggaattcctgatgacattggttcttctacatccctttctttcattgatttttccagaaacaacctccactcttctcttccttcaaccattatttccattccaaatctgcaaactttaattgtctccaacaacaacttgagaggtgaaatccctgaccaattccaggattgtccctcacttggtgtccttgatctctcatcaaatcgattctccggaatcattccatctagcattgcatcatgtcagaaattggtaaacttgaacctacagaataaccaattgactggtggaatcccaaaagaattagcaagcatgcctacatgggccattcttgatcttgccaacaacactctgagtggtcatatgcccgaaagctttggtatgtctccagctctagaaacattcaatgtctcacacaacaagctagaaggtcctgtcccagaaaatggcatgctaagaacaataaacccaaatgatcttgtgggaaatgctggcttatgtggtggtgttctccctccatgtggccaaacctcagcatatccattaaggcatgggagctcacctgcaaagcacattcttgtaggatggatcattggagtatcatcaatactagccattggggttgcaactttggtagcaagatctttatacatgatgcggtacactgatggattgtgcttcccagaaagattttataagggtaggaaggtgttgccttggagattgatggccttccagaggcttgattttacaagtagtgacattttatcttgcatcaaggatacaaatatgattggcatgggagcaactggggttgtttacaaggctgagataccacaatcaagtacaattgtggcagtcaaaaagttgaggagatcaggatctgatattgaagtaggaagcagtgatgaccttgttggagaggtgaatcttttaaggaggctaaggcataggaacattgttagactactaggctttctttacaatgacgctgatgtgatgatagtttatgaatttatgcacaatggaaaccttggagatgccctgcatggtaaacaagctgggagattgcttgtagactgggtttcccgatataacatagctctaggaatagcacaaggacttgcttatcttcatcatgactgtcatccacctgttatccatcaagacatcaagtcaaataatatactgcttgatgcaaatcttgaggcaaggatagcagattttggattggccaagatgatgctctggaagaatgaaacagtctccatgattgctggatcctatggatacattgccccagaatacggatactccttgaaagtggatgaaaagattgacatttacagttatggagtggttctgttggagcttctcaccggaaagcggtcattagatcctgagtttggagaatctatagacatagtagggtggattagaaggaagatagacaacaaatctccggaagaagcattagaccccagtgtaggaaaccgcaagcatgttcaagaatag

SEQ ID NO: 69480 - DNA, 153 bp, Glycine max
  Peptide Sequence Number=SeqID_186258
atgggccccggcgggtgcagagaaacgcgagggactggaaccagagaagcggcacgcaaaccgaggcaggattttagcattcaaaaggtatgggtggacttcttctcacgtgaaattcgtgggtattgggtttttgggagctatgatgggtag

SEQ ID NO: 69481 - DNA, 525 bp, Glycine max
  Peptide Sequence Number=SeqID_186259
atggtgaaagggtacatcaataggtcagggctgaagcccctgtatgatgagcggtacatgaccgtgaataaaggcatgggctacatcagggtagagatcagaggtctattgagtgagtcaaatgtcttagctaacaaggcatattttttgtatttgctcgacaataccatatttgttgagaagagctcgatgcatgcatgggtatttgagcatttgtcgaccattcctgctagcgagaacgtgttggaaaatgactgcaagaagccatttgcggctaagtggttggcgttgagggataccaataaggttgttgggaccaatgtgttaatggatcagttagaccttaaaccttttgaggaccagacattgtactctggctacatcgtagttgggacattcatgtggtcatatctaccaaaaagggttttgaggcaatttgagtatgtacaaaggattcctttggacccacccaagcgtcctattgcatatgagaagtattgtgacacatgggccaagtgggattag

SEQ ID NO: 69482 - DNA, 1779 bp, Glycine max
  Peptide Sequence Number=SeqID_186260
atgagaaagcgccctgaccaaatggaaaaaggggcagcagcaaagaaccagaattcccgcctttgctgtttagcatccctttctgctttcttctggtttttgctcctttacttccattttgtggtactttcaggagatgataccaatgccaatagcagtagaaagaatagttataataatcatgttgatctagatcactcaaccctatcaacaacacctgtttctgttggttatgaacctcccccaatccatcaagtgcaagcctctcctagaaagattggcttacctgatcccgatgtgcggcggagtgatgctgacactgacacccctcgcgccgagaagattttcccttttatgagagcaatgagagcttctgaaaacaagagtgatccctgtggggggaggtacatttatgtgcatgaccttccctccaggtttaatgaggatatgttgaaggagtgcaaaagtttgagtctttggactaatatgtgtaagttcaccaccaatgctggccttggtccgccccttgagaatgctgaaggggtgttctctaatactggctggtatgctactaatcagtttgctgttgatgtgatatttggcaaccggatgaagcagtatgagtgcttgacaaatgattcctccattgctgctgcggtttttgtgcccttttatgctggatttgacatagcacgttatctttggggttataatatttcaatgagggatgctgcttctcttgatctggttcactggctcatgaagaggccagagtggagcacaatgaatggaagagaccattttcttgttgcgggaaggataacatgggatttcaggagactatctgaggaagaatcggattggggcaataagcttctgtttttaccagcagcaaagaatatgtcaatgcttgtggttgagtccagcccttggaatgcaaatgattttggaattccgtatcctacatacttccaccctgcaaaggatgctgatgtgttcatgtggcaagatagaatgaggcaactagataggaagtggcttttctcctttgctggtgctccccgtcctggcaaccccaaatcaatcaggggtcagttaattgatcaatgcagaaggtcaaatgtttgtaagctgttggaatgcgactttggcgaaagcaaatgtcattctcccagcagcataatgcagatgtttcaaagctcacttttctgcttgcaaccccagggtgattcgtacacgcgaagatctgcttttgattcaatgttggctggttgtatacctgttttcttccatcctggctcagcatatacacaatatacttggcatcttcccaagaattacactaagtattctgtcttcattccagaggatgatatccgcaagaggaatatcagtatagaggaaaggcttagtcagatacctcctgagcaggtgaagatcatgagagaagaggtcattagtctcattccaagactagtatatgctgatcctcgctccaaattagaaactcttaaagatgcatttgatgttgcggtgcaagcagtaattgacaaggttacaaatttgaggaaggatattattgaaggtcgcacagatgacaacttcattgaggagaacagttggaaatatgctttgttgcctgagggagagcatgaggtaggacctcatgaatgggatcctttcttctccaaaccaaaggatggtagtggagattccaatgattcatctgctgaagttgcaaaaaattcttggaagaatgagcgaagaaatcaatcatga

SEQ ID NO: 69483 - DNA, 255 bp, Glycine max
  Peptide Sequence Number=SeqID_186261
atgcgaatgcaaccacccaactatatagctcgaacacaaagaaaatgcattgctcagagagcatattgtcagaacacgggggaggtggtgacgacatcgcaacagaacgtagggagcaccttcgcgagtgacgacgtaagactaagggtgaggaccgtcatgagggagaggatcgtcgcaagggtgagagtgagagctctggtaaagggtttgggaggaacggtacaaactgaatgcaaaaagagaacgcagtga

SEQ ID NO: 69484 - DNA, 135 bp, Glycine max
  Peptide Sequence Number=SeqID_186262
atggcttgcaccaaaaaatctaaggcagcacgcgaaattgcaaatgggattgattcccttaaagagaagtcaaaacagggtagtctttggcttccaacaagtgcaccagatcgcacaagtagtataaaacggtaa

SEQ ID NO: 69485 - DNA, 306 bp, Glycine max
  Peptide Sequence Number=SeqID_186263
atgaattcgtattccataagaccatggacctctacaacaaggttgacggcgacaaaggatgcatgcggcgtgaggaggaggtgctcgcgtgacgatgaaggaggagcgaaggtacctcacacaacgatctgtggtgacctcacgcgaaggaggttggcggtgacctcacgtgaccagagggagggcaatggccatgaaggaggtggcggtgctgtagtgcagcggaggtggtgtagcggagttggtgaggaggaggtagggaaggattcatacagattgacaatccgtatgattcttatggattag

SEQ ID NO: 69486 - DNA, 4590 bp, Glycine max
  Peptide Sequence Number=SeqID_186264
atgggtgtcgcacgttttttccatgatgtcctaggattgcccgtgttggaacttgcgacaatctgcatgaacctgacttttgtacttttgtttctctttgttgtctcggtgaggcgtgttcttgtgtatgggggtggatttcgattcggtaaggatggaaacagcggcaatgctagcccaatttgcagtgtcattgatgaagaaacgcgtggtgttagaatcggtgtggggttcaagttgtcagtgttgtcttgtttctatgttctgtttgtgaatgttttggcgttgggatttgaagggggtgctttgatttggggtgaggctaatggggatgctgacgtggatttgtctcttcttgctgtccctgctgcacagggtttggcttggtttgtgttgagcttctcggccttgtattgcaagttcaaggtgtcagagaggttcccatttttgttgagagcttggtggtttttgtcctttgttatttgcttgtgtactttgtatgttgatgggagaggattttgggaggagggttctgaacatctatgttctcgtgctgttgcaaatgttgctgtcacaccagctcttgcatttttgtgtgtggttgcaattaggggtggtactggtataagggtttgtgggaactctgatcttcaagagccattgcttgttgatgaggaaccggggtgtctcaaggttactccttatagagatgctggactttttagtttggccactctttcttggctgaatccacttctttccattggtgctaagagaccgctcgagcttaaggatattccacttgttgcaccaagagatagagccaagactagttataaggttttgaattctaattgggagagattgaaggctgaaaatgagaatccctctaagcagccttcgttggcttgggcgattctcaagtcattctggaaggacgcagccctgaatgccatctttgctggtatgaatactttggtgtcatatgtaggtccatacatgataagttactttgtggattacttgggtggcaaggagactttcccccatgagggatatatccttgctggtattttctttgtggcaaagcttgtggagactgtgacaactaggcagtggtatctgggagtggacatcttgggtatgcatgttaggtctgctctaactgcaatggtatataggaagggacttagactgtcaagctcagccaagcagagtcacacaagtggggagattgtcaactacatggcagttgatgttcagagggtaggggactactcttggtaccttcatgacatgtggatgcttcctatgcagattgttcttgcccttttaattttgtataagaatgttggaattgcttctgttgcaacattgattgctacaatcatttccattgttgtcactgttcctgtggctagggtgcaagaagattatcaggacaaattgatggcagctaaggatgaaaggatgagaaagacatcagagtgtcttaggaatatgaggattctcaagctgcaagcttgggaggatcgatatcgattgaagttggaggaaatgcgtggagtagagttcaagtggctaaggaaagcactctattctcaggcttgcataactttcatgttctggagctcccctatatttgtttcagctgttacttttgctacttccatattgttggggggtcagttgacagcaggtggtgttctctctgctctagctactttcaggattctccaagaacctctgaggaattttcctgacttggtatcaaccatggctcagacaaaagtttctcttgatcgcatatctgctttcctgcaggatgaagaattgcaggaagatgcgactatcgtcttgccacctggcatttctaacacggccatagaaattatggatggtgtcttctgctgggactcttctttgccaaggcctactctatcgggaatacatgtgaaagtggaaagagggatgactgtggctgtttgtggcatggttggttccggtaaatcaagttttctttcttgcatccttggagagattcccaagctgtctggtgaagtaaaaatgtgtggttctgttgcatatgtctcccaatctgcttggatacagtcaggaaatatagaagaaaatatcctgtttggcaccccaatggacaaagcaaagtacaagaatgttcttcatgcttgctcattgaaaaaggacctagaacttttctcacatggagaccaaacaattattggtgacagaggtataaatttgagtggtggtcagaagcagcgggttcagcttgctcgagcactctaccaagatgctgatatttacctacttgatgatcccttcagtgcagttgatgcccacactggatcagaattatttagggagtatgtattgacagcactagcagataaaacagtcattttcgtgacccatcaagttgaatttcttcctgctgctgatatgataatgttcgggaagaaaccgagggcgagccctggtacagcggttcttaaagaaggccacatcatacaggcaggaaaatatgatgatcttttacaagccggaacagattttaaaactctagtttcagctcaccatgaagcaatagaggctatggatattcctaatcactcagaagattcagatgaaaatgtacccttggatgacactattatgaccagtaagacatccatttcttctgcaaatgatattgagagtttggctaaggaagttcaggagggatcatcagatcagaaagtaattaaggagaagaagaaagcaaaacgctcgagaaaaaaacagcttgttcaggaagaggagagggttagaggtagagtcagcatgaaggtgtacttgtcatacatggctgcagcatacaaaggtgtattgattccactcataatcattgcacaaacattatttcagttccttcagattgccagtaattggtggatggcttgggcaaatcctcaaactaagggagaccaacccaaagtaactcccacagttcttcttcttgtttacatggcccttgcttttggcagctcatggttcatctttgtaagggctgttctcgtggctacatttggtctagcagctgcacagaaactattttttaacatgcttagaagcatattccattcaccaatgtctttctttgactctacaccagctggaaggatcttgaatcgtgtttcaattgatcaaagtgttgtggatcttgatattccttttagacttggagggtttgcttcatcaacaatacaacttattggcattgttgctgtaatgacagatgttacatggcaagttttgctcctagtagtcccgttggctattatttgtttgtggatgcagaaatactacatggcttcctcaagggaattagtacgtatcgtgagcatccaaaaatctccaattatacatctttttggtgaatcaattgctggagcagccaccattagaggttttggacaagaaaaaaggttcatgaagaggaacctctatcttctggattgttttgcacgaccattcttctgtagtcttgcagctattgagtggctctgcctgcgcatggaattactttcaacctttgtttttgctttctgcctggtattacttgtcagccttccccatggaagtattgatcccagcatggctggacttgcagtaacatatggcctgaatttaaatgcacgtctatcacgatggatacttagcttttgcaaacttgaaaataaaatcatatccattgaaagaatttatcaatacagccaaattcctagtgaagcaccagcaattgttgaagattctcgtcctccatcctcatggcctgagaatgggacaatccaattaattgatctgaaggtacgttacaaggaaaatcttcccgtggtgcttcacggagtatcctgcacatttcctggtgggaagaagattggaatagttggtcgtactggcagtggcaaatctaccttgattcaagcattatttcgattggttgaaccggaggcagggagtatccttatagacaacattaatatttcatcaattggtcttcatgatcttagaagtcatttgagtatcataccacaagatccaaccttatttgaaggcaccattcgaggcaatcttgatcctcttgatgagcactctgataaagagatttgggaggcccttgataagtcacaacttggagatataatccgtgagacagagcgaaagcttgatatgccagtgctggagaatggagataattggagtgtaggacagtgtcaacttgtttctttgggtcgagctctgctgaagcaatcaaagatacttgtacttgatgaagcaacggcatcggttgatactgctactgataatcttatccagaagattattcgaagagagtttagagattgcactgtgtgcactattgcacatcgtattcctactgttattgacagtgatctagtgctggtactcagtgatggtcgagttgcagagtttgatagtccatctaggctgttagaggacaagtcatctatgtttctgaagttggtgacggagtattcatcgcggtcaagtggcataccagacttttaa

SEQ ID NO: 69487 - DNA, 276 bp, Glycine max
  Peptide Sequence Number=SeqID_186265
atggaaaaccatagatttataagcaagtctgattcagcaaaagccaggagcaacagaaagcgtattagacaacaaaaggtccatcttaatgttcaggatagtgtccatgcaagtgtcaatccagcttcatcccatactgaagatgattataaccaaccaaagtcaccaccgcatagtgtccatgcaattttcaatcgggcttcacacgatgctgaagatcattttggatatccaaactgtgaatcgtcccatcatgattcttcaatggacacagag

SEQ ID NO: 69488 - DNA, 428 bp, Glycine max
  Peptide Sequence Number=SeqID_186266
atggagactgtaatggttgctcactttcgttgttctagcactatcaaagtcccctatcatccagagacaagcaagtctgatgtcccatttgctatccggagacaatcaagtatgatggaacacgggcataaacatagtcgtctgcttcccttggcgaaagactcaatgaagcctccagcttgccggggcgagctgggcagcaacctcctcccctattttttctataaatggacattgggggctgaggagaagcgatccaacacctttggcaatcaaatttcacttaaaattagtgaggagaagaagaaagaaggggaaaatcaaggccaaggcgcttccataacgcttcatgatgtttccatgatcaattctgcaaacgttctttgtctttcttcgttgttcgccatccgttctttgatcttcaaccg

SEQ ID NO: 69489 - DNA, 1600 bp, Glycine max
  Peptide Sequence Number=SeqID_186267
ctagaggatcccccagaacttatcatcaacgaagtcaccggaggcagtcgttccgagctgcagggcaagctcgaggtgttcggcaacaaagccaacgtgatgatcgccaacccgaatggcatcacctgcaacggctgcggctttatcaacgcgccgggcgtgacgttaaccaccggcaaaccgcagttcgacaagcagggcgcgctggaggcgctggaggtgaaaaaaggcggcgtcaccatcggcggtaaagggctggacggcagcagcgccgactatgttgacatcatcagccgcgccaccgagctgaacggcaaaatcaacgcgcaaaacctgtcgctgacccagggcgctaaccgcatcagttttaaagacggcaccatcaagccgatcgctggcgaaggcgccaaaccagtgttggcggtggacaccaaggcactgggcggcatgtacgccaacaaaatccgcctggtggccaatgaggatggggtaggggtgaacctgaaagacctcaccagcaaacagcgggatattacgctgagcgttagcgggcggattgagttgggcaatacacaggcagcgacagacttgaacgccagcgccagggaaattcatatctcatcgggcgttaaggtgcgcggtgaacgtgacgtgacaatggctgccgatacgctcaataacaacggcaatgttacggcgcatcgcgatatgcgggtgtttgccgatacggtacgcaatgtggcactacgtgatggcgacaacaccgcattgcatagcaacaataatctctggattcagaaagacgctcaggggaataaagccaaacagatagaaaaccgctctgcacgcattcagaccaacagcggtgacttggttatacgcacggagaatttgaacaatgtcaggcaagaggttcaagccgtttggaaaaatactcccgctaactctaaagcgttcaataaatccttggtaggaagttattacgactcacggcaaggtgttgacgctattgtgctgctggagcctgaactgaaggactttggcatcggcagttggtttggcgaaatcaacctgtcgaaaggcgacaaggttaatgtggggaaagacgagtatcttctggtgaaatcgcaggcgccgggggtgataaattcaggcaacaacgcttatatcaacgcgacaacgttatggaacgatcagtcgaatatcagcgcggccaaagatctgatcctgacggggaacgattttaccgtaaagagcattcaactcggccagaaagatcggtactggcgtctgggaacgaacacgtttggcgttggggcgtttgcccgtgacgaagatgcgcctcccggagattgggatctgctgtatgtcacggaaaaagcgccttataccaagcagcaggaacttgtcgtctggcgagcaaaggggcagcaaaaatcatcgattaccgccggcaataatctcactgcggattttaaaaataagatagagatcagtacgccgacgcctcatgaaaatcagctgaatgaagtggtcacctccggcaggccagagtcgctaaaggcacggaatgttctgctgcatgccaaaaacatcgtcg

SEQ ID NO: 69490 - DNA, 156 bp, Glycine max
  Peptide Sequence Number=SeqID_186268
atgcgtgaaaagttccacagctacctaggcgtagtggcgcgagaaaaggttcccattatccacaataattggaaagacgtacctgaaacgctaaaggagattgtgtggaatgacattctaatcaaagttagagaccagaacaaatcatgtgtataa

SEQ ID NO: 69491 - DNA, 210 bp, Glycine max
  Peptide Sequence Number=SeqID_186269
gatgtggctgaagaagttgtgcagatacagaaggttatgggagctgatatagatgttacctttgattgtgctggttttgacaaaaccatgtctacagcactgagtgctactcagccaggtggcaaagtttgtctagtgggaatgggacattctgaaatgactgtcccactcaccccagctgcagcaagactatgtatgatgcacaaataa

SEQ ID NO: 69492 - DNA, 255 bp, Glycine max
  Peptide Sequence Number=SeqID_186270
atgttcagcccttctggtattaagaaatctctcgaaatttgtgagaaaaattgtttccgtgagaaaaatccaagccgaggtgcttccgtaacgcttctgagacgtttctgtaagcaatttcgtggagattcttcaccgttcttcatcgttctttgtcgttcttcggtcttcaaccgccttagtggtccctacttgttttgcgtacttttgttttcattacgtttgttttctgtacccccttttgtcgtgctttaa

SEQ ID NO: 69493 - DNA, 114 bp, Glycine max
  Peptide Sequence Number=SeqID_186271
atggggacccgggctgagaggaacgaggagaaggctacgtacatgcacttgatttgtgccatcgcccgaccgtcacctagtaccacatatgacgggtgccccataatccaataa

SEQ ID NO: 69494 - DNA, 189 bp, Glycine max
  Peptide Sequence Number=SeqID_186272
atggtgtttgtttctgaaggaggagtaggctttgtaacaccccaattgaatcacaccagaatcagaggtatgggactttgcaggtggtcttctgggaagtttctcagaaagtgtttgagtaaggataaaacatgcttaaaagtcttgtattggtttgtggggtcagtcattgagccaagaagcagttag

SEQ ID NO: 69495 - DNA, 444 bp, Glycine max
  Peptide Sequence Number=SeqID_186273
atggctatagggaaattgtctttgatagttattgcgttaagagcacgatggggtattgtatttgagatgcgttgtcttgaatgtgtgattaatcgtgaaggtgtagaattgttgggttacaagtgtgaggtgaagtcccacatcgggtctccttatatggtgactcgtggtccacaagtgtacccctcgaatctccccaacaattggtatcagagtcgatggttcaagttggtgactgactcagacgaacttccgctcgagggggagactaccatgtggaagagactcacacttgagggggagatgtgttgggttacaagtgtgaggtctccttatgtggtgactcgtggtccaaaggaatgtgatgactcattcctcatgtgttgtttgtgtttggatcctatgaagatctcgaaccttgtgttcatgggagaagatgactaa

SEQ ID NO: 69496 - DNA, 366 bp, Glycine max
  Peptide Sequence Number=SeqID_186274
atgcccaagctgggcacccccagaggacgattcacgctgaatcccgaaggggctccgtggaagattttgtggaaggacatcatcactctagcccaaacctggagtgtgctttcctacttcaacctcactcctacttcccacaccttcgacctcaacatggatcgagctctcttaatatatgtgattgtgatgaagatggacatggacataggcaacaagatttcactccagattactcaaatcgcccaatctaggccgaggcggatccaagctagagccacccaggatgcatcaccaccaccaccaccaccagtcagccctcctccagtcaccttatcttcgaccaaccagtcttcttctcagtag

SEQ ID NO: 69497 - DNA, 183 bp, Glycine max
  Peptide Sequence Number=SeqID_186275
atggcggtttccgaccatagagtgcttggaaagggtttggaacaaggtgggtacaacgaagagaatgtcaacaagagtagttcactttcaatgttccttcgagaaagaacatctgccacccggtgtccacgtgtccatgtccgtgtcgtgtccggtgtccgtatcgatgtcggtgcttcatag

SEQ ID NO: 69498 - DNA, 150 bp, Glycine max
  Peptide Sequence Number=SeqID_186276
atggaagagattcccttggatcaattggatgagagaatgtggggatacatgattttcatggagtgtctagctaagaagcgaaaatgcaaggaagatgtgttatatgtgacctttcatgccaccatgaaggcatatggcctgtcgagctag

SEQ ID NO: 69499 - DNA, 279 bp, Glycine max
  Peptide Sequence Number=SeqID_186277
atgaaggtgtaccatgataaaaaattgataaagaagacctctcaacctggtcaacaagttttgctattcaattcaaggctgaggctcttcctaggtaaactcaaatccaaatggtttggtcccttcataatccaagaaatgaagccttatggagcagtggagttgatggatcttgcgtcaagtgaccctgagagaagttggataatggcctcgaggaaacaccgaataggagccagtcagccacaaggggggattctacttgggattcctccctcttag

SEQ ID NO: 69500 - DNA, 2523 bp, Glycine max
  Peptide Sequence Number=SeqID_186278
atggcattcacttctgccctcacatccttgacaacattggtttgcctctgtatgttttgcgttaatgcaactacccacaaagaaattctgcaaacgggacaatcattgggaacttcagatacccttctttcttatggtggaaacttcgaattgggttttttctccaaagataactccaccaagtactacgtaggcatatggtataaaagggttccaaacgacaagattgtgtgggttgctaacagagactccccagttcaaacatcctcagcagttctgattattcaacccgatgggaactttatgatcatagatggacaaacgacataccgtgtgaacaaggcatcaaacaattttaacacctatgccacgcttttggattctggaaatttggtacttctgaacacctcgaatcgagcgattttgtggcagagttttgatgatcctactgataccctaatacctggaatgaatctaggatataattccggtaactttcggtcattgagatcatggacaagtgctgatgaccctgccccaggcgaattttctctcaattatggttctggcgcggccagcctaatcatctacaatggtactgatgtgttttggagggatgacaattacaatgatacttacaatggtatggaagactatttcacttggtcagtggataatgactctaggctggtactagaagtgtctggggagctcatcaaggagagttggtcggaggaagcaaagcgttgggtttctattcggtcatcaaagtgtggaaccgaaaattcgtgtggagttttttccatttgtaaccctcaagcacatgatccttgtgattgtctacatggtttccagccattgcatgctgattcttggaggaatgggaacacatctgctggctgtgtccggaaaatagaattgtcctgcagcaacagaagcagtaataatgttaaatccaatgatggattcttccagttcaataaagttcaattaccacaaacttctaatggatacatcaagctaaagattgatagagcaagagagtgtgaaagtgcttgctctagaaattgttcgtgcgttgcttatgcttattatttgaacagtagtatctgccagttgtggcatggtcaggtattgagtctaaagaacatctcaacatatttggacaattctgataataccaatccaattttttacctcagacttgatgcgtcagaattggttactgctgattcaaacccaacaaatgcaacagaactagcaactgattttcgcaagcatgaaaacttgctgaggaatctacttctgattgttatactgatcttacttctagcatttcttatattgggcctattagtttattggactagaaggcaaaggagaaaaggggaagatttgctacgttttcatgtaagcatgagcatgaaagtcgaagattctgagcttgctgaagcacacaggggtgcgaaagttaagaagaaggaagtcaaattgccattattcagttttggtatattattgaatggggatgaggttgctgtaaaaaggctatctcgaagatctggtcaaggatgggaagagctgagaaatgaagccttattaattgcaaaactccagcacaataatcttgttagacttctaggttgctgcattgatcgagatgaaaagatgttgatctatgaattgatgcctaataaaagcctggatgtttttctttttgatgcaacaaaaagaaggatgctagattggggaacacgagttaggataattgatgggattgcacaaggaatcctttatcttcaccaatattccaggtttcggatcattcatcgagatttaaaggctagcaacatattgttggacaccaacatgaatcctaaaatatcagattttggaatggcgagaatatttggtgataatgaacttcaagcaaatacaaaccgtatagttggaacatatggatacatgtcccctgaatatgctatggaaggccttttctccataaaatcagacgtgtttagctttggggtccttctgttggagattttaagtggcaagaagaatactggcttttatcaaacaaattccttcaatcttcttggatacgcttgggatctatggacaaacaattcgggaatggacctgatggatccagcactggatgatagtgatactactagtagtagtatgcatacagtgccaagatatgtgaacataggacttctctgtgttcaagaaagtccagcagatagaccaaccatgtctgatgttgtatcaatgattgggaacgatactgtggcccttccttctcctaaaccacctgcatttctaaatgtgagagaggtgattgcgatatttggggagatacagatcaaagttgtgaaaccagataatttcgttactctccttatgggttgtgctcaattgggagttctggagcaaggcaagtggaatcataattacatggatgaaaacagaattgtggtggatgctgtgtttggtactgccctaaatgtatgctaa

SEQ ID NO: 69501 - DNA, 1578 bp, Glycine max
  Peptide Sequence Number=SeqID_186279
atggcgacatgtggcaatcaacaatacacaacagttaaaaacacaaattttttttccctccccaaatccctaatccatgagcgcaatttcccaactttgaaaatcggagaagaaatggacagcgacatttcccagtgggtgacggagttcctactccgcagctccgtccccgattccctaatccaaaaaaccctagccgccctccctctctctaccgcctccccccgcctcaagaaaaccctcctcctccgcaccctccaaaccctcctccgcacagccacactctccgaaaccgcgctcgacatcctcgaactcctcgaacccagtgcccctgtctccgacgcgcaccgccgcgcgtactgcgcagtcgccgtggagtgcaccgtaaagtacctcgccgcgtgccccgaagacatcgatggcgagtacgccggagccgtgcggcggatctggcgcggccgcgtgtcggcgctgaaggcgcgctggagccggctggtctccggcgagctggcgcggtggcgcgacgtcgtcgaggacgcgttcggggattctagggctcgccagaggctggtggggttgaatagtcggagggacgcaatgaaagaggtgagggtgtttttgaaggaagcgtggggagcgatggggccttcgtttttggaaactgttgcggcgaaggagaagaataaggatgaaggtgctcgtgataatgatgataatgataatatatgtgatgatcatgatgatggtgcatgcatggaggatgtggcaatgcatggtgagaatcaggaaccattggaagagagtgttgatgcgaatcaggaagtgggtgggtttgacttatctcctcggagggataaagcaattccaaagcggaattctcagcttaaacacaaacactctgcatttcgtgcatctcataggggaaggggagttgaaatatctagtccgaaggaagtgaaggcaaccaaatcatggagcaaacatgatcctgtgcctagtgctgaagttaaaaaagttcgggaatccctaaaatcaagttctttggagttacgagcgttggttaaggatcctcttccccatgcattgcatatatctgatgttgtaagatccaaattggcaactagtgatacaaaaactgagccactgattgaaaaccaacatgaagatgtagaagtacaggatccagatgtttgtcagagtattgtaccttttcagcctaatgatgtcaatcttgggaagaagtcttttgttcattgtagtaatattcatcagccctacttgatggaacagaacataagtgctcgtacctttgagttgtttccttcttttttccagtgggaggattcagtagacaactcgccacaagcaagacagccaaggaggaggaaaaggaaatggagttcgttggaagaagaaacactaagggctggtgtaaaaatgtttggagaaggaaactgggcatcaatccgaagtttttacagtaacgtatttgaaaatagaagtggagtatgcaatctatgccccaaaatgctttgtcatgttgtcatatttctttctggacttgtacctgtaatataa

SEQ ID NO: 69502 - DNA, 201 bp, Glycine max
  Peptide Sequence Number=SeqID_186280
atgtggtaccatgtcagtgaaaccctggggcgcttaagagtacataacaagacacaccacatgatgggaatatcagacttaaaggagcactcaaaccaggtgacccccaaggcctacactccgaagagtctatcagggcctcttcctcctgattcaggtcgaacccctaaaatcattttagcacacaaacactgctcgtga

SEQ ID NO: 69503 - DNA, 3234 bp, Glycine max
  Peptide Sequence Number=SeqID_186281
atgggcaggaaaattgggtcatcctgcaatgcagctttctcttcaggccacaagattgctgacacggtcctcaaaccatcaccttggcactggccttttggttcatgtaaccaactgaatggaagttggtatcaagagtctggttcatttcccatggccactgagtctagttttgtgcaagcagccatcccacgctttgatggtcactatgaccattggagtatgctcatggaaaatttcttacgatcaaaagaatattggtcagttattgaatcagggattcaagaatcaccagtaggtgcagtcttgactgatgcccagaaaacaaagtttgaagctcgaaagctgaaggacctaaaagcaaaaaattacctctttcaggcaattgatcgtgcaatcttggaaactattctttgcaaagaaacttccaaggatatttgggaatccatgaagagaaaatatgaaggctctgtcaaagtgaagcgtgcacagcttcaagccttgaggagagattttgagacactggctatgaaggatggagaatctgtgaccaactattttgcaagaacaatggagattagtaacaagatgcggttccatggcgaaaagatgacagataaaatgcacagaagctgtaccacagaggagcaagcactgaaggcctctaccgctaccaatactcattcctccgatttcagaggaaggggaagggagagaggtagaggtaggggtagaggaaaaggagtatgtggaaacagagaagataacaagaatcccagagctaatactacaagcaaaggcagaggacaatactttaacagatccaagctagagtgctttgatgaagctaaaaataaagaagttgaaactctactgatggctattcaagaaggaggaaaaactgagtcagatatatggtatgtggatacgggttgcagtaaccacatgagtggattaatgggaaaaggtgatgtcaagataaaaaccaagaatggctttgtggaaacaatctcaaatgtgttgtatgctcctgatttaaaaagcaatttattaagcacgagtcaattacaagagaaaggttatgtcattgaaattcagaagggagcatgtgaaatttatgatcctgttagaggtgccattgcaattgttcaaatgagttcaaacagattgttcccattgaaaattgaaagtattcagacttgctttaagactgacatggaagatccatcatggttgtggcacttttgttatggtcacttgaattttagtggactaaagaccctgcaacagaaaaacatggtgacaggccttcctcaaattactattccttcccaagtttgtgaagaatgtgttgttggcaaacaacatcgatctcaatttcccaaaggaaagtcatggaaagcaaaagatgtcttggaactggaaaaatcagaagcgttttgtacatttaaaagcttcaaagcaagtgttgaaaatgaagcaaaaaagtctataaagactctttgcacagatcgaggtgtaaattggagcattcatgttttgaatagaagtccaacctttgctgttcaaaatatgacaccagaagaagcttggaaagggaggaggccagcggtagatcgttttagaatctttggatgcataacatatgcttatgtaccagaggtaaaaagaaagaaactggatgacaaggctgaaaaatgtgtcttccttggtgtaagtgagcctagtcaagtcatttacgacaacgatactgaacacgagcaaatatcagcaccttacatgctcgaaaacaccacaaattcaactcctatagcagctgtaacttcaccaacaaccactagcatcaataaagaagaagctcaatctcattcccgtgttagaagaaggccagtgtggatgaaagattacgaggtaactggaattcaaaatccaattactcactttgctttgtttgcagattgcaatcctacaacttttgagagtgttgtcaaagaagaaaaatggcccaaagccatgaacgatgagattgatgctattgaaagaaatgacacatgggagctgtttgatcttccaagaggacaaaaaacaattggtgtgaaatgggtctttaaaacaaagttgaatgagaatggtgaagttgacaagtacaaggctcgtttggttgctaagggatacaagcaacaatatgggactgattacacaaagtgttttccccagttgcaagacatgacacaattagattggtggtcgcgttggcagcacaacaatcctggcaaattttccagctcgatgtcaaatccgcattcttgcacggatacttggaagaatagggatgaagggaaaattctcatcgtttccttatatgttgatgaccttatttttactggaaattgtgatgccatgtttaaagaatttaagaagtctatgatggatgagtttgaaatgtctgatcttggaatgatgcattattttcttggcatagaagtggtacaatcaaatgctagtatttttatttcccaaaagaaatatgtggaagaaatcttggacagattccacatgcagaattgcaattctacaacaactccagtagcatttggttgcaagttgcacaaagatcatgaagggataaaggttgacaacacatttttcaaacaaattgttggcagtttgatatatctaactgcaacaagaccagacataatgtattatgtgagcttagttagcaggaagggtataacgtcaaatttgttgggatttactaatagtgattttgcaggagatcaagatgataggagaagcacttcgggttatgcattcatgtttggaaatggtgctattacatggtcctccaagaagcaaccgataatcaatttgtctagcacagaagctgaatttgttgctgcaactgcttgcgcttgtcaggcaatatggctaagaagaattttggaggaattgcagttcaaacaattagaagctacacaagtcttttgtgacaacaactcatctatcaaactctcgaaaaatccagtgctatatggaaggagcaagcatattgatgtgagatactatttcttgcgtgaactaacaaaggagaaaattgttgagcttattcactgcaaaagtgaagatcaagtagctgatttgtttacaaagcctctcaaattagcatcattccaaaaacttagagccttgcttggagtatgcacaatggaagaagccgtgcaagggacttga

SEQ ID NO: 69504 - DNA, 270 bp, Glycine max
  Peptide Sequence Number=SeqID_186282
atggagcaatcgttgggaacctcagacaccattctttctcgcagtgggaactttgaaccgggttacacttggtcattgagatcgtggacaagtgcagatgaccctgccctaggagctttttctctcagaagtggtgtggaagtgtactatagttatgtctcttgtccagttgttaatgactctaggctcgtactagaagtatctggggagctcaacttggagtactggtcagaggaagaaaagcattggatttctatcaagtcatcatag

SEQ ID NO: 69505 - DNA, 567 bp, Glycine max
  Peptide Sequence Number=SeqID_186283
atggcccctgtgctttattctgtacccgagacactatcaactgaggagcttgaggcattgagagcaccgcccaagagtgatgtaccaatcatcaccagaaatgagctccgtgatgctgatggttttgtctttggcttcccaacaagatttggaatgatggctgctcagtttcaagctttcctcgactcaatcggattactatgggacgaagaagatcaatttcttgaaggcaagcctgctggaatgttcttcagcaccggttgccaaggtggtggacaagaaactacagcgctcactgctatccctcagttggttaatcatggattgttgtttgttccaattttgtatacattgggtgctggaatcagtggaatgtttgagatcgaggaagtgaggggtgggagtccctttggttctggaacatatgctggtactgatggcaaaaggaacccaactgagattgagctgaggcaagcattccaccaagggaaatgtatagccgccatctcaaagaagcttaagcgagatcctcaaaattatctccataatattgctcgcagatggtga

SEQ ID NO: 69506 - DNA, 334 bp, Glycine max
  Peptide Sequence Number=SeqID_186284
atgaggacatacgatgtttttgtctgcttccgcgtcgaaacacgcaacgacttcaatggttttcttttcaaagctctgcgaaggaaaggcattgatgccttcaaagatgataaagatatcaggaaagttgcacacctctgcaactgcattcaaacatcaccaagacgtgttgtacctattttttatgatgttgatacatcacatgtgcgaaaccagagtggatgttatgagatagcctttgccaaatatgcagaaaggctcaaagaagataaagagaatacggatgaaatgcagagatggagagaagctcttacacgagtggccagtgtctctg

SEQ ID NO: 69507 - DNA, 222 bp, Glycine max
  Peptide Sequence Number=SeqID_186285
atgggaaatgagacactgtcgaggagagcaatgactctagggtttgaggaaatgaaacgaccgggtgatatgttggttctgaaggagtggagaaggggttttgttgttagggagtggatgcacaacatcgattttaataaaaccgatgaagactgcagccaactgttcttagctggtagttatatctaccagttgttcatcgcccaagttcaccacggataa

SEQ ID NO: 69508 - DNA, 420 bp, Glycine max
  Peptide Sequence Number=SeqID_186286
atgctcatgtgggatctgcatctgtgttggttggtgatattgatgatgcattggactctgaaaaatgtaacgttcttcacactattaactgattcaattgttgaagaactactctcacattttgttgaagaactactttctgcagagcatagggtgatgaagattggaccacacaaggaattgaaatttatctctaaggagaaaactgtatggcacaattcacacttagttgaagataaaaataggagaaaactgatttccagcgatctccttaactatggtttagaaagtgagtttcatattgggagtgtgttctctgctcaccttatctatggttcacaggtgaatggttcagtgatccacgcaccatcagatgcggcttcagtggcttttgagatccctctcctaacctatggttaa

SEQ ID NO: 69509 - DNA, 348 bp, Glycine max
  Peptide Sequence Number=SeqID_186287
atggagttgttctataggatatctcaccccttcatgagtctgacacagcctagggagtctcctagacatccacccatggtgcatgatgatacatttattgttccagatcttcctcaacagccagtcaacgcaacaactatgccagaaccgcctgcacctacagttgctgatgtagacatgcctcgacatacaatggacgcctgccaaaggatagcagaaaatttggaacacattatcaacatgaggatgatcactgctggaattgaagcatacactctgaccaagcactacctaagattagccaggggtgtcaccaagcaacaaaatgtttatgttcggtcaagatga

SEQ ID NO: 69510 - DNA, 633 bp, Glycine max
  Peptide Sequence Number=SeqID_186288
atgcagaagaagcccctcagcattgaaggccgacaacatctgcatgagcgagttacgaatcatgccggtgctgatacaaaggtttttccagccgaaccccatgatacatcaatgttgatgtcatatgttgatcatgtggtagctagagtttggacagaagaggaacgcattgagttaaagttggcctctcatgggaggaaggtagaaaaatttggaagacatgcacctgagattgaaggcatagttactactataggattaagttctctaattacatgttcgttgaacactggtgataggggacttttatctgctcttgtggagaggtggcacaaggaaactaatagttttcatctatcggtaggagaggtgactataacccttgatgatgtggcatccttgttacatcaacatattacaggtgccttccttacctttgatgctcttgatgtagaccaagtcgtggagttgttagttgagttgcttgacgtgagtacaaaagaagcaaaagatgagacatttcaatgcataggggcacatgttcacctatgttggatctacgagcatttccctacaattgcttccattgttgctgatgaggattatcatgagaggaaaccacatgcttcttga

SEQ ID NO: 69511 - DNA, 3723 bp, Glycine max
  Peptide Sequence Number=SeqID_186289
atggatgctattgcaagcgtggcatcaaacgtggctgcacctttgctgaagcatctcacttatgtgttgatgtacagtacttacctgaatcagctagaaaccgagattcagaggctgcagcatgaggagaaagaagtgaggcacactgttgaggctgcaaagaggagtggtgaggagattgaggacactgtgcttgactggtttgggagagtgcgtgcaacagttgaggaggggcaatcatttcttagcggcgaggatcgtgaaagaattggatgcttggacgtgtactcgaggtacacgaagagccagagggcaaaagacttggtggatcttgtgagggagatgagaaaggagactttcgaccgggtttcgtaccgatgtgccttgagatgcaacgttagtccttctgcaagggagtatgtggagttggaatctagaaaaatgatgttgaatgaaattatgaaggtgctgaaggatggtgatgttgacattgttggactttatgggatggctggtgtggggaagacagcattggtgaaggaattggcgtggcaggctgagatggatggcttgtttgatgctgtggtgatggcgaccgtgactaattctccggacgttggaatgattcgggccgagattgctgatggattgggattgaagttcgatgagctgacggagctggggcgggcaagtaggcttcgccagaggattaggcaggagcagaggattcttgtgatattggatgatgtgtgggggaagcttgagttgactcaagttggtgttccttttggtgagaacaagagaggctgcaaatgccagttgttggtcacatctagagatcttaatgtgttgaatactaactttgaggtggataaggcttataggcttgaggttctgtctgaggatgagagttgggagttgtttgaaaagaggggaggggattcggttaaggaaaccagcgttcaaccgatggcagaaaaagtagcaaaaagctgtgatggtttgccacttttgatagtgacagtggtggaggcgatgaagaaccaggatttgtatgcttggaaggatgcactagagcaggtaacaagttttgaacttgaagggtgtttttattctccggtgcgttctgctattgagctgagttatgagcatttggaaagtcatgaactcaaaacattcttcctccttttgggatccatgggaaatggttgtaccacaagagatttgttggtgtatggctggtgcctgggattgcacaagcatgttgatacattggcagatgggagaaacaggctttacaaattgatagacaacatgagagccgcctctttgtcacttgatgaagggaaaagagattcggttgtggcacttgacgtggttcgacatatagctgcttccatttcatccagggataaacctttctttactgtgccgagaaacaaggaattgaaagaatggcccagaatggatctacttaaaacttgtcatcatattttcttggactggtgtttcatccgcgaacttcctgagatgttggagtgtcccaagttgaagatactccaactaaattgtcaaggtaactatttgaaaatacctgacaatttctttgttcagatgcaagaactgaaggtgctgaatttaggaggtctaaattgtactccttcccttcctgcatctctcagtctcttgacaaacctccaagcattgaatctgtgtaaatgtatgttggaagacatagctattgtgggggaaatcacaagtttagagattctcaaccttgaaaaatctgagcttagagaactcccagcagaaatagaaggattaagtaatctacggttgctagatttgaccgattgctcaacactaggagtgattcctcgcaacttgatatcaagcttgacaagcttggaagagctctacatgggaaactgtaatgttcaagaggaggtcaagggaagcaaaagccaaagcattgattcatgtataagtgagttaaggcatttgaataaactaacaactttgaatgtgcagatagaagatacttcagattttccaagagactatcttggctttgggagactagaaagctacaagattttgattggggaaggatgggaatggtctggggtggagtctgggaattacgaaacttcaaaacttcttaagctcaatttaggtgctgatacaagcattctaatggattacggtataaagatgttgatggcaaaagctgaagatttgtatttggctgaactgaagggtgtcagggaagtactttacgaattgaatgatgaagggttttcgcgattgaagcatcttaacatcctaaactgtgctgaaatggagagcattattggttcaacagagtgggcttatggtgatcatgccttcccaaagttggaatcattgatccttcacaatctgattaacatggagagaatatgcagtgacccccttccagcacaggcctttaccaaactacaagttatcaaagtaaagggttgtgataggatggagtttcttttctcacattccatggttaaacacctttctgaacttgttgagattgagatttctgaatgcaaattcatgaccaatatcatagccgcacaaagacaaaaggatgctgatgctggacaaactgacaaaattaggctcatcaacttgcgttcccttactctagaatgcttaccttcccttgtcactctctctcctgagtcaagcattcaagctactgaaagtggcaatgatggatgtgaacggttgacacatattttctcatactctgtggctagaaaacttgtcaagcttgaacatctcttaattagttcgtgcaaatccgtggagcagatatttgtggcggatgaaaactcgggtcaccatcatcatttcagaatatctgctccaactgaactggttccgattttccccaacttggagacatttgtgatttctcacatggacaacttgaagtcaatatggcccgaccaactcactgaaaattccttctataaattgaaaaagatggaaatcacatcctgtaacaatctcttgaatgtgttcccatgtcatgtgctagacaaattacaaagcctggaatcactgaatttatggaactgtatggcactaaaagttgtatatgaaattgatggcataaacacagggcaagagggtagcagtcaaggagggctgaacattccactgagaactatgtctttgggaaatttaccaaagctaacgcatttgtggaataaggatcctcaaggaaatatccaattccgaaacctgtttacggttaaggctgctaaatgtcaaagtttaaaacatgtctttccactgtctgtggccaaagaccttgtgcatctccaattccttgagataagtgattgtggggtagaggaaattattgtaaatgaccaagtagggggaatcttaagggcatcaatccttagaaagatatatttgactcaggaaggagatcaggtgtactgggaaggtgatcttaatactactataagaaagcttttcgatagaggaagctgtgctttgaagaagcacccaatcaagaaggccatgcagaaggaagagaaactgaacatgaggactcaagttcaagtccaagaactgggatctgtattctcattggtagaaggttttttcagcaaggctgatcatgtaagtaatagatctactgaaaaatcagacgttgctgttgaaaagtaa

SEQ ID NO: 69512 - DNA, 207 bp, Glycine max
  Peptide Sequence Number=SeqID_186290
atggctcctgcatgtatcatcaatatcaccggaggtgcattttcgtggaatcccagcaagaagagccgcgtctggctcggaaccttcgacactgcggaggaggcagcgcgtgcctacgacgctgcagcacgagagtttcgtgaccctaaggccaagacaaacttccctctccctttggaaaatgttaagaacttgagccccagctag

SEQ ID NO: 69513 - DNA, 453 bp, Glycine max
  Peptide Sequence Number=SeqID_186291
atgtcacatcctatcagagcattgtatcccgacgtcattcagcacaagctcacatcatttcaccattttgtcgcccaacatcacatcacaacacaacacatctcattcattttcacaatattcacgtactcaaggatcaaaacacaatatcaccaagtcaatcaatccatatcgatcaatacacaagcgttaagcaacaaatacactaagactcaatcctatatgcaatgtgataccatgtcagtgaaaaatcatgtcgggcgcctaggagtacatgacaagacaaaccacacactgtcagggtcacgctgttttgagagaatgctccaaccatgtgggatcgacacaagcttaaaggagcactcaaacagggtgacccccaaggcctacactctgaagagtccgtcaaggtctctccctcttgattcatattcaacccaaaaaacattttag

SEQ ID NO: 69514 - DNA, 222 bp, Glycine max
  Peptide Sequence Number=SeqID_186292
atgggactcatgacaacgacgataacgggaggcagggataggtggagtgacataaagggagggatgaacggaggggattggtgcgcgatgcaaccggaggaaaaacgaagattgaaacagcagcacatgcaccctccaaacggcacggaaggaggagcacctccacaaagggtggcacacctccccaatgacgacagcgcgacggaggcactatggctatag

SEQ ID NO: 69515 - DNA, 105 bp, Glycine max
  Peptide Sequence Number=SeqID_186293
atggatgagggagatgaagttttagcagaaggggttgcattcaccctggaggctcactttgatcaacccgtcgttgtggatgagggtgaggaaggttgtaggtga

SEQ ID NO: 69516 - DNA, 513 bp, Glycine max
  Peptide Sequence Number=SeqID_186294
atgtcacattttagagttagtgatatcatagcaatgatatgggttgttacacaaggccaatattgccagaacctcaaaccgctattggattccctagtgttggtgtcaacacagaagggcttcgtcgcgactacacaaaacacattcacgggcacattccaatgtagaggggacctctccaacgccgaatgctacaactacgtcagcaagattccaaacatgttggggcacctttgtggtggcggcactggtgcagctgagcgagtgctacctatggtacgaggtggtcaggttcaaggtggtctcggctacatagcttctgtacaaggtgtgcggggctcgcaaagtggtcgacagtggagggttctagggagttaccagagcctctatgtgttggggcagtgcgagggtattttgggaaatgcggattgtggaggttgtatcaagagtgttatggaactggcttcatcttgctcgccgccactacacgaatctattccacattccgcctag

SEQ ID NO: 69517 - DNA, 348 bp, Glycine max
  Peptide Sequence Number=SeqID_186295
atggaactagaaaacgaaggcacaggtcctcaatgccgacaaaggaagcagtcaatggcgacgccaccaaagaagaaccaacaagaacacaaaggcgcagggactagaaaacgaatgaaaaacacgaatgcgcagagagggagaaggaaaggaagcgacgacgtacggaatgtgaacaacgacactacagagacaaatatgtctcgtgtggatgaggtgtatgatgctccttggaacctcatcgttgggatgcttaagcctttggaggaggttgggccagttacttgtaataaccagtatattagttggccatttcatgctgatatgaatttccatgttcatatttag

SEQ ID NO: 69518 - DNA, 615 bp, Glycine max
  Peptide Sequence Number=SeqID_186296
atggctggcattgttaggagtgttataggtggagctgcctatggattttttgcaccaatatttgctacttttgaagctgtagagggaggaaaagagaacaaacttttccactgttttattaatttcatattttatccttgggatggaacatggagcaccattagaacgaccttcaatattgtcaaggatgtgaaaaatgaatgttatgattcttatttctcgtttatgaatgatctgctacaaccgaacaggaaatattatgagatcaggctacgatatcttcttggtgctattgtggttgtgattcttgggatcattattggcatgcctgttatatcatttgttgccatatttaaaggcccttacatgctttttaaagggtggaagcgtttgtttcatgatctcataggttgtgaaggccctttcttggagacaatatgtgtgccttttgctgcccttgccattgttttgtggccattggctgttgttgggagagttttggcatctgcattagccagttttgtttttggtggatacggaggttttatcacttatcaggtcaatccttttacaagttttaagtctattgatactattgttactaatttattgtag

SEQ ID NO: 69519 - DNA, 282 bp, Glycine max
  Peptide Sequence Number=SeqID_186297
atggagaacaagaagtgcatttacagtactccatttggtattcaaaccactggcttgacgtcggtgctatcgacagtgcgacgagtgagtggaaatggaaaggaggtagaaagggaagtgcagagtgagggagatacgattaagtacgatggtggcggtggcggtgcgaatgataatggcatcggggcggagggtttggtcgagcaactaagcgatatgagtaaggtcctctgccatggtcagagctgctactcagttcggaaagagaaacagaaaccctag

SEQ ID NO: 69520 - DNA, 649 bp, Glycine max
  Peptide Sequence Number=SeqID_186298
atggctccaaaattcgaaccgggatcccaaattaaaatgggtgaaggaatgagtgaatggaggaaggagtggtcgcgctccgtgcccccgaccttggcggcgattgtgacgagggaaaatgagcagaggtccaagggaaggatgcgacaactaggggggatgacagcaatggtaggcggggacgacaccggtgtgggatgttgttgccttagtgcggggagtggaggtggagttggcgtgggcggcagagtcagcatgaacggcggcagtggcgtgggcggtggagtcgacatgggtgtgtgtgcgaggagtgccttcgcagaggaagaggatgggatggtagtggaagaggaaggtggcggaaagagcatggtcggagtaaagggagaggcagccataggaggcggtgatggcggaagaagaagggaagtagctgggtggtgcgggttgcgggcatcctccagccgatccgaagtagctgtgtatctcgtggattccgccattgaaggaagaagaagaagtaacgagagcagcaatcaacctcctaaggagaagaagaagacacagaaaagaagagtgcctggtgcctttgctgaacgatctcaccattcttcctttcttttggggtttgcttcctcctatacccctg

SEQ ID NO: 69521 - DNA, 297 bp, Glycine max
  Peptide Sequence Number=SeqID_186299
atggtggtggcagagaggaacgatgaagcagagaatagaggaaatgtggtcatatgcattcattgtggtggcaagggtcgtggtggtagtatgggttcgtggaggtggggtgccatggtggtggtaggttttcgtggtggaggcgaagttatggtgagggggtttgggtttgtggaggtgatggtatgggttcatgatggatgcgaggtggtggtgagtggtggtggtggggttttggataagtggtggcagttagatcaatcgatagagaaattagggtttgcgaatagcgcatga

SEQ ID NO: 69522 - DNA, 987 bp, Glycine max
  Peptide Sequence Number=SeqID_186300
atgagctttggccttactgaggacgaggctgagggtgatcaatatgaacttccaacctatgaatatcctcctttgaagtgtaatgtgatgcatgatggtatggatgccggtaatgatgacactgatatagagaaatatgcctttggtgaaactccaagtgaccgtttgaggaacttggaaaataggatttctcaaatggagaaaactcctacttacagccggatggatggggattttacaggaaaaaatattctagagaaagtgattgttggtcagtctccaagacggattaagcattctaggagattttccagtgactcagcatctttgagtgggataggaaaagaaataggtcccgagtctatgatggactctcccaagctcaatagtaactataggagagattatttctcagagtcagaggatccttccaatttcaagaaggtacacaatgcatcagatggtgacgatatgagcgacagaatttatacaattgactctgttcattgtggggcaccatataatggtttcacagattccaaagctggtggttttgaagattatgcaaccactcctagggagtcagggaatcatgctactgattttgaggatccctacataaagaagctttatatgaggcttcaggcccttgaggctgatagggaatcaatgaggcaggcaatcatttcaatgcgcacggataaagcacaggtggtgttactgaaggaaatagctcaacatctgtgcaaagagatgtcaccaaaaagaaaaatggcaaggaaactgtatttttctggcaactctaactcttcgtttgtttcaatttttaagtggatctcatcaattgttttctggagaaagagagctcatcaaagcaagtacatgtttgggctaccgcctgagagtgttggcttgctgatgctcctagacaagggaatgcatgcaaggccgtggagatgcgtttcgagtacacaagtgggggattaa

SEQ ID NO: 69523 - DNA, 235 bp, Glycine max
  Peptide Sequence Number=SeqID_186301
atggcgttagtgaggtgtataggtggcaattcagtgccacgtagattgtccaacatggcactgagttgcttcttcttcttctactctgaggctcagtcgctgctgcttgttcacttgatttgtccatgtctgcaagtggcagctgttgtgcattttctggtagtttcattcggcaatgccaccatggaagacgtgcagctattcgaactgcaagaacaaggaggaacccaggaag

SEQ ID NO: 69524 - DNA, 582 bp, Glycine max
  Peptide Sequence Number=SeqID_186302
atggataaggcttctataattggagacgcagtgtcatatgtgcatgaccttcaagctcaagctaggaagctgaaggcagatgttgcaggatttgaagcatccttattagtgtctgaaaattatcaaggatcaattaacaatcccaaaaatgtgcaagtgatggcccgtaatattagtcatccaaactgcaagaaaatcatgcaggtggacaagtttcaagtggaggaaagagggtacttagcaaaaatagtgtgcaataaagagaaggggttggaattgatagtgacgtcaaggctcatcaacgatagtgaggaagaggaggatgaccgagtagagaagtttgcttttattgttgctgtagcaagtgtagaaattacagcacgtttcactttctcacgaattgagtgcaaacacgtggcagatgctgttgccattggttgtggcgggatcgagatggaggagcttaggcgaagcggcattggcggcatggtggcaaagatgatggatgcctttaatccaatgaacaagagcgatgctggaggagtagttggaggagcgattcccagcgagaagaagaagtaa

SEQ ID NO: 69525 - DNA, 219 bp, Glycine max
  Peptide Sequence Number=SeqID_186303
atggttgggagtgtgataaagagtccagaaatatctggtcttgttcctactctacttaagggactttgtcatcctaaagagcatacaaaatattcccttaatattcttcttcaagtaaggcttttaatactgttttcagttgtggtatcacttgctaaacaatgggcatttgaagaaccttctgtggagacaataacaggtgaaaatgttttgacatag

SEQ ID NO: 69526 - DNA, 698 bp, Glycine max
  Peptide Sequence Number=SeqID_186304
gagaagacaaggatctagaccctaatacagtgctcaatgacccacccgacccgccagacaaagtggacttacctaacccaagcccaacccaaattagctttcactccttagcgggtcaccttgcactgaaaactttatggttgtcgggctcgttttccggtcgccaggtggtggtgctagtagacggtggaggcacctacaatttcattcaacaagagctggtgacgcaattgaatatgtcttgtcgtgatacaccatttcccttgtgggtcatggtaggaaacattcaacacctattatgcacaagcttgtgtgaagccactctcattgacatacagtcgatgcagtttgctgtcgatctccatgtcctccccatttctggtgcctatgtagtgttaggtgtccaatggcttaaatcattgggtccactactcacagattataacatcttgtgcatgcagttcttctatcagggacgcatggtggaactgaatggtgatcaggatgacactccgaacttcatcacactgtcacaattttggcgaatttcgcagacccaagctttaggactgtactaccacatcacacttctatcgaaggactcgcccaacccacaggaccttcacccagatattcagtccctcctgactaagttcgcacacttgtttcaccaacccagcaccttgtcatcgaagtag

SEQ ID NO: 69527 - DNA, 288 bp, Glycine max
  Peptide Sequence Number=SeqID_186305
atgggtccaaaatctatcctaaggctcatgagaatcttcttggagtcttctatccaatgcccttgggggcttgcacagttatggcccaatggttacatggacaatcatgggatcaaacatggaatttgcagggtgcatttggattttgggaggaggagagaaaaaagcaagctaaaaagggaaggcaagagaacaatttttttcctagcccttcctaaatggaatatggagaaactcatgtgcctaaccaaaatcaagcagttgaaccctattaaaaccccaagctaa

SEQ ID NO: 69528 - DNA, 1602 bp, Glycine max
  Peptide Sequence Number=SeqID_186306
atgggatcaaatcaaacacctctgctcaagaaaatgttctatcaagtcaaaatcaagagcttagaggtcactggtttacgagagttggggcagttgatgggtcaacttcaacgcaagccttccgcaaagcctatggatttccagctagtgcagactgtggaagagtttcaagaaatcctaggatgcccgctaggaggaaggaagccatatcttttctcagggttctatccctccatggccagagttgccaaagttgttaaaatctcggcacaagaattggaccgggtgaagcaaaatagaaatggagtagttggagtaccacaaaagcatttggaagagaaggcaaaggcccttgcaagtcaaggcgaatgggcttctttcattgacatcttagcacttttgatcttcagaattgtcctatttccgaacatggaagggttagtggacctagaggcaattgacacgttccttgcctttcaccatagcaaggaaggcccggtcgtcgctattttggccgatatgtacgacatcattgaaggagcattcgttaattggttccctcgctggaaggaaggaagaacaaagattctattctcatgcaaaggatttccaaatgttcctttgatgggaacaaggggttgtattaactataatcccgtcctcgctataagacagcttggctaccccatgagaggagcaccatcagaggaaagccccatgcctttcatcgcatggggttttagtgaccccaacgcaaggttacttcgaggagtccacaatgcatgggatgcgttgcgaaagaaggacaaagagcttaggggaagcagcaatgggatcaccggcggctatcgtaagtggctgaaagtccatgcacaagggttggattggctcccaaagctaagggctatgagagaaggagaggccgaagctccgaaagagagtgaggaggtacaagtcctaaaggcggagcttgagaaaacccaagcagtcaaggagaagttcaagtccatagccatcaaagttcgaaaggagtatgatgaactgaaagacatcaacatggccaccgccgaagccttggagcgagaaaccaagagggcccggaaggaagaacatggccgaaacaagatccgaggagctttatggggaagcaacagcgagcttaaactccaaaaagatgaaagagatcagtcgcgagtcgaaggcatgatcttgaaggatgagttgaaggcttgttttaggtgcaagaggagtttgtcccagcagttaagtgagacagaagaaaacatgttggccatcattgataagcacaaagaagagctaaacctagcggtagctcatgagcataggctaatggatgaatacgccaaggtatccgccaaaaaggaagcaaagggaagggtgatcgattcattgcacgaagaggcaatgatgtggatggataggttcactttcaccttgaatggaagtcaagagcttccccaactactagctaaggccaaagcaatggtggacgtctacacagccctcgaagaaattcacgggctcctcaactattgtcagcacatgattgacctaatggctcacataattaggagccgttaa

SEQ ID NO: 69529 - DNA, 213 bp, Glycine max
  Peptide Sequence Number=SeqID_186307
atgttgagcttcaggttaagcttttccaactacacgaaagtgcccaaccacgttatctggtgtaaaggggaacaaaaatcaaaagggtatttcactaaacctcacatcgtaaagaacttgctgagtcaggtcaagagtggtcatagaattgaagttgcttctgcggcgaagggtgtcttcaagacatcatcggagcttagccagaagagttga

SEQ ID NO: 69530 - DNA, 441 bp, Glycine max
  Peptide Sequence Number=SeqID_186308
atggtgaattatgcacatgttactatcacttcttttcttctcccatctactctgccactggctaccgttcaccaccatcaaagacaatttcaggcaacgaaaccagctccggtgaagttgcaacctttgcataacttcgctctccccctcttaaatggggtaagaacaacatcgatcattcgcaaccgactctccctcccccttaaaccgccaccactgcacgaagccgagcacgataacaccgacaactccgtccacaagccgtggaacctccgccttcgcaaaccgcactcctccccaaggccgccatcgaaatcggcaccggaccttcttcacccacaccacagcactagcaacaacaatgacaacaacaaccctgcactgaagtgtcagctccgcggacatgcagtgcacggattaagaggaggaaattctggataa

SEQ ID NO: 69531 - DNA, 771 bp, Glycine max
  Peptide Sequence Number=SeqID_186309
atggccccgaggaagcttctcgtgaagaggtccaggaaggacaccactggagagggctccagcactgccccgcatgttgacatggacttcgatcggcattggttccagagcgcaccgcttgtgacacccatggctaaattcgatccggagatagtcatggagttctatgctaatgcctggactaccgaggagggatgcgagtacagccaggggaggagtcaggcctctggctttgatgaggaggctatcacccaactgctatgcataccagggcaagatttcgctcagaccgccgcagggagacgggtgagtgtgcatatggctcagctgatctctaacgccatttatcaatttgcaggtattgcacccatgagacaccctgtggacccggagaagtccaacagggccctggggtttcccgctctaattacgagcctctgtcagttctacggaatgcccgtcgcctccagcaagaggaggaccaacagccagctgcagatttgccaccgccacctcaagaggatagaactcaaaatgcataggtgtatgtgtaatgtgactagccagcaggcggctaatcacagagggcaaaggcagctgaacgagacgttctatcattacaacctgcaccagcaaagtcaggaccccagtcctttcccttggcctactcctaaagagttcgaggccatggtgggctggcctagggacgagaccgagtttgagacgcaggcagggcccgcggggacctctagaggtggagatgaagcctag

SEQ ID NO: 69532 - DNA, 312 bp, Glycine max
  Peptide Sequence Number=SeqID_186310
atggacaagattgtcgactcaattcgtccaagaagagaggacaagggaccgagagactcattagagaggagttataattatcttgatgaaagcatctggagagggcatcgacagcctgattgtgagctccagcatgataatggatttggtaaccataccccatcaatcgagcgagcaatgaccaagaaaatactaccgccacttcttgacggtggtcgtaatcataaacaacttccggatgtatgccaaagctcggagcaattttggaggaaattgtttactgaagaaggctattggatggtttcttcgtga

SEQ ID NO: 69533 - DNA, 477 bp, Glycine max
  Peptide Sequence Number=SeqID_186311
atggtgaggcaagcgaatccattgacacacagagacaaacgtggtcgtctgcacccttcgtcgaagtctcaacgtctggtgactgagactactttagtctcaccttcgtcatccagagacgacaagtccgatgacatgcggagataccttacggttatccgcacctcagtcaaccagaggcaagcgagctcattgacatgcagagaccaacatggtcatctgcaccctttgtcaaagactcaacgtttgtcgactgagactactttagtctcaccttcgtcatctagagacgacaagtccaatgacaggtggagacaccttacagttgtccgcacctcagtcaaccagaggcaagcaagcctgttgacacatagagaccagcgtggtcgtctgcaccctttgtcgaagactcaacgtctatcgactaagactactttagtctcacttccttcatccagagacaagcaagtccgatga

SEQ ID NO: 69534 - DNA, 303 bp, Glycine max
  Peptide Sequence Number=SeqID_186312
atggagtaccagtcgcccccagcaagtgaggcaccacaacagcctggggatgatcagcagcaggctgcaggtgctccaccaccacctccagattctacctctgatcacctaccgagattggagtggtatatacgacatgaggttgaccagcaggcagccaaccataggggtcagtttgtggctgtagtagcatggccaggggattggcccgaggatcagacaggacctgtctgtggtcctggaggtgaggacgaggctgaggacgatcaggacatggtggggctgatagatttcctcctgtga

SEQ ID NO: 69535 - DNA, 267 bp, Glycine max
  Peptide Sequence Number=SeqID_186313
atggttattcagttcagtacttcccggggttcggggctagggctagggctagggctagggctagggctagtgctagggcttgatcagagaacaaaatggtgggagttgagagagagctcaagaacgaagacagtggctaggagagagaaagtattaacaacgcttgtgtttaacctaacttgtaaacattcattaggaaaaatggacggtgagatggagatcaacagaacattatacaatctccacaagatgggacactctccttaa

SEQ ID NO: 69536 - DNA, 372 bp, Glycine max
  Peptide Sequence Number=SeqID_186314
atggtgaagaacgacgaagaaacttccacggaatcaatcacggaaatgtctcggaagcattacggaagtgtctcggcttggatgttttccttccttcttctcctcactaattttaactcgcccaggcgagttgggttgcttccacctaaagcaatccctttttttggaatattccagatgggcccaggtgctagattacgcagtgctgaatttcgactcgaccgaccaatagctcaatcagcgaaacctgtcaaaagaaagagcataaaagacataaggtgcaacaacaaaagccttggtgccttgaaagcgataaaaatggataaccgtgacggtctctgcatgctatcagacttgatcgtctctggatag

SEQ ID NO: 69537 - DNA, 342 bp, Glycine max
  Peptide Sequence Number=SeqID_186315
atgtcagtcttacagacagcaaaaaagaatgtttatacggataaccactcgggtatctccgcccgtcaacgtgactcaaatgttagtatgacagatcttgtgagcgcggaagatgacgtaaatctccgcgtgtcaacgggcttgtcggccgtgattgacgaagggcgcagaagacgaccaaaaaagaatgtttatacggataaccactcgggtatttccgcccgtcagcgtgactcaaatgtcagtatgacagatcttgtgagcgtggaagatgacgtaaatcttcgcgtgtcaacgggcttgtcggccgcgattgacgaagggcgcagaagacgacgttag

SEQ ID NO: 69538 - DNA, 684 bp, Glycine max
  Peptide Sequence Number=SeqID_186316
atggcccagtccaactcctctaagcttggtttttcggcattgatttcagcattgtgcatagccagaggagtcatctcagattctctgactttcgagtctctcaatccagccattaatttggcatacattaagaagaactgctggaacctggacgatcccacgatcgaattttcagggatctgcaaggcacgggctagaggatctgagggtccatcttcggctactcctcctgctcctgcttcctctgcacctgctccttctctgactccagccccttttacttcagcaccaccatttcctcctgctcattctccagcaccagcttcctctgcttcatcatcatcattcgagtgccgatgctccaaggtggcctggccaggagtccagccttctcctttggggggaggtgaggcttccgcagcccaagagcctcagccaaagccagaggttgctcatgaggccactctagaggctactccacgtacctcaccagtcacttcacctattgtggaggtctctgagggtgaagaaggccccgtggatattgattatgtagcagatctacaggcggcacagagtacctgggatccttggccgacagcagcacaggagacaccacagccagcccaagatactccttcttcacctcatggcgagcctgcaccaactcaggatgattgttga

SEQ ID NO: 69539 - DNA, 891 bp, Glycine max
  Peptide Sequence Number=SeqID_186317
atgttgaatgatcaaacaccttccacaagccatggcacagagcaacaccacattgacagtgcagaaaacgaaccacaaatcagagaaatctacgccttaactccccccccaagaagagaaccaaactttgaaacacacacacacagccacagccacctctcatcttctgtgtccatagaaggtggttccagcgagaatttcagcatgagtagagaattcagtgctcttgttctagcaggctcaagcatcgaccacaacatcaccaccccaagtcaaatgagcttggacatgatgatgcatagcgatgaaggaggtgttaatagcaacaacactaacaataacaataactacaacaacttggggaggattgaagaggatgaggtgttgatgatggaggagactaaccctttggcaattgtggcggataacaaccctttggaggcggtttcgtcatcgccgccgcctccaagtcgtggtggagggactttttcttcttcttctgctacttcaggtggtggtgctgtgaatgagatgacagtgcagagagtgaggaaggaggaagttgaggcaaagatatcggcgtggcagaacgctaaggttgctaagatcaacaacaggttcaagagggaagatgctgttatcaatggctgggagaatgagcaggttcagaaagcatcttcatggatgaagaaagttgagaggaagctggaggagaaaagagcaagagcactggagaaaatgcaaaatgatgtagcaaaagcacatagaaaagctgaggagagaaaggcatcggcagaggctaaaaggggaactaaagtagccagggttctggagattgccaacctcatgagagcagttggaagagcacctaccaaaagatctttcttttaa

SEQ ID NO: 69540 - DNA, 223 bp, Glycine max
  Peptide Sequence Number=SeqID_186318
atggaaggtgtacaaggggatatacttggtgttgtgaggacagaaaaattgaagaaatctttgctacttggaagggcaagctttgagaagataaaatttcctaatgagaatgctctaatcatttgggatcggcacaggcttaaaggagcactcaaaccgagtgtatttacccccaaggcctacacttcaaagagtccgtcaggacctctccctcctgatttag

SEQ ID NO: 69541 - DNA, 528 bp, Glycine max
  Peptide Sequence Number=SeqID_186319
atggaatttcatgagaagtggcttagttggattcatctttgtctcaaaactgtccattacagtattactttaaatggtgattcagttgggtacatatctccttggagaggattaagacagggtgacccactgtcaccttatctttttattctttgtattaagggactctcatcacttccaaaatatcatgagaggagaggggttgatgaaggagaaacaaatactttcaagaacattttggattcttatgggcaagcatcatgccaaatgatcaatttccaaaaatctgaaaccttcttaagttcaaacactcccacaaaggccaaacacgaaatctcttcatcccttggaaggaagaaaaaaactatttttggatacctcacaaatagactctggaatcatatcaatcattggtcctctaacttcctctcaaaggctggtaaagaaattctcataaattcagttgctcaatccatacctacttattgcatgagtgttttttttcttaccctccactttacaagatga

SEQ ID NO: 69542 - DNA, 357 bp, Glycine max
  Peptide Sequence Number=SeqID_186320
atggatgtctattttgaagctcaagacactaacaaaagggttgttgtagcctttgcagataattctgggtttgtagataatagctgggagcttatatataatgttagagataaacatttgcttataaataaaagagaaatatctcttctcaagaagctcctttacgtgacaaaaaatggtaaccaaacagctcaaggatatatcaaatgcaacattgacgctgcaatttttcaagatattcatgcatttggtataggcatctgcataagagggggtcaagtccggtgcgatttcactaattgcacgatcgatgttatggggctatcacaagcccaggactcgcgttatcatatataa

SEQ ID NO: 69543 - DNA, 252 bp, Glycine max
  Peptide Sequence Number=SeqID_186321
atggtgaggagaaaaacaccttgtccaaagtgggtcaaggaggtgcaatgtcgtgaggaggagcagaatgggaggtgtagtgccacgaggaggaatagaatgggaggtgcaacgtcccgagaacgcggtagtggcatggtgggcactttgcaccgcaaggagttgagtcatagtgagaaagcgagagtgagagtcgcgaggaggagaatgggaggtgcagtgccacgaggaggaggaggtgcaacatcatga

SEQ ID NO: 69544 - DNA, 123 bp, Glycine max
  Peptide Sequence Number=SeqID_186322
atgacattatggcacatttgtatccttgagggggatgcaatgaaccaaataggaggagacatcgacagtggtttctgtgcccctgggaagaccatcaacatgagggacattgatggggattaa

SEQ ID NO: 69545 - DNA, 1014 bp, Glycine max
  Peptide Sequence Number=SeqID_186323
atggcgtttttgggactggctagaccgttctccataggaaaatatgcccataatggtgttgttgctcacgctgttgctgttggtgtctttgtctacctcagtcttccgctctgtgtcttcttctgtctgcttcatggttcctatgctgctcctcatggtatccttcaggtcttgctcctacttggtggggtagctaatgggtacctccaagttgaatgcttcctccagaattgtagtgtgattggtcgtcaagggctggtgcttgtctggcttgtgcctcttatccgacttgtgaaagtcgatcttggtgattccttctcgcttttcacgcttttgtccggattatctaatttcattcctgaatatggacatttcttctatctggatgtagcccttggcttggcgagaagcatggaatgcaatgctacctctgggttaagatttctcatctggacagctgttcacccaaatctgtccatgaattttctaagagactcatcatctgcttatcacagactagctaagaagctatctatggatctaggtgtgagtccaccataccaggaaggcatccagatgctcatttggatctatggttccatcacactgctcgaagttgagtggtttccaccccaagggtatgtcagcctccacaatgcgacaagtagtatgccatgttggacggcaaagtgtgagcggagtgctcttcgccctggtggtgtccgatacgagcctccaactaatcatggcacctttgttaagaggaaaagaggggagacctgcaaaacaaatgactctgatactcaagagtggagtgtaactgtagctccttatggtgtagctgcatgtggagcttgtaggacttggatcttcttcatcaatggattcctttgcttcttgaaggtcatggcagcagaatggagaaggaagaaagatgattggagacgccacttcaaggagaagataagtcaagaagaagctcactaccataggaagccatggacaagagcttga

SEQ ID NO: 69546 - DNA, 1022 bp, Glycine max
  Peptide Sequence Number=SeqID_186324
ataacaaacactttcgtgctgttacacttgagtatgagttctcccacacaaccatggaagccttttcaagtgtctttgcttactgtcaacatctcaagtcactgtcggatcaactcaagaacgtcgactttccggtcgataacagtaggttggttctgcaattggtgttcagtctcactgaaccctacaagagagtggccacacttatccgtcaaagtgatcccttgcctcaattttatcaagcacggtcgatacttgttctcgaagaattctgcctcaagaaggcggctcagacctcgtcctccgccatggtggctcgtgacttggacgaatctcaagaaatgtctgatcattcatcagcacgcctcacaaataatggtggaaaacagtattcaaaccgtggcaattctagaaagaatcgcaacaacactggtggttgtgataactcaggcgctggcaagggaggctttggtggcgggggtaaaagtggcggtggcaacaatcgtgggggtggacaacaacagccccagaacaacccctggcctgcaggacagcaatggccttggccatggatgcagtgggttgttcctccttgtccgtacccagctactccatgggtcaggcccaattatcagcaaactccacgccaacagcccggtattcttgggtctagacctcagcaggcatacacagccacaactcctactccaacaggcatcgaggctgcaatgcacaccctcgatattactcctccagatctgaattggtatatggacactggtgccacctctcatatgacgtccacctcaggtaatctcacgtcttattttaatatgagcaatcatcgtggtatcactattggtaatggtcaatcaattcctattcgtgcgatgcctctaatgaggtgtgagagtcggggcgcgctttatcctatcatcgagtccaccactccagccacttcttcctctacttttgctaccttagctcattctctttggcatgagcagttgggacacccggga

SEQ ID NO: 69547 - DNA, 103 bp, Glycine max
  Peptide Sequence Number=SeqID_186325
atcaaggagttgcggaaacaggtcgactgtagatcaaggtgctattgaagatgcagattttgcaatgtcgttgccgcacgcaaatggtggcacaatcaaataa

SEQ ID NO: 69548 - DNA, 156 bp, Glycine max
  Peptide Sequence Number=SeqID_186326
atggttctacccaatgagaaaagcataaaagtcgaagttgcagcaagaaatatgctagttgctcagggaaaaagtgaagcaaaagatatgagagtcattgttgaagagtttctttctaaagctcattacaagcagcttcacatgttcaacccatga

SEQ ID NO: 69549 - DNA, 258 bp, Glycine max
  Peptide Sequence Number=SeqID_186327
atgcaaccaaaggtggcttgggggagcaaaaaccgtgagtcccgggttgctcgcccaggcgagcttagcttgcccaagcgagctaacctgccatttttcttttggcgccatcatgagcatggccctctacgggccggcgttcgcttactcgaacccactccaggctgccttgcaacggcgttttccgcttgtccagagccgggaagggatgacgatctgtcggtcatgaccctagcctttatttgcatccgtccctaa

SEQ ID NO: 69550 - DNA, 321 bp, Glycine max
  Peptide Sequence Number=SeqID_186328
atgcaccttttgagaggtacccttgttgacgactggaagtttgattactctagtcatgatgcccgccgcatggtctgcattgaccaggcatatatgaccgacagactgcttgtcgggtcattgacatttgattgtcgcatcatgcactatatcattgttagaattttgatgcctcgttcttctaatctcgctcaagcctttgaggaggactcgattctgatgtgggctttcttgatcggtcgtctaatcggctgggcccatttgattcgttaccgcatgcataaggcattgcagtctagtgcacctctaccttacccttag

SEQ ID NO: 69551 - DNA, 279 bp, Glycine max
  Peptide Sequence Number=SeqID_186329
atggatgggcaatggttgaagaaggacgcgcaacctccgcaagacgaatgtactccctctcctccgcctcaacgagatgactcctcagccctcatgcatgaagttctttcgaagttacgaggcctccgcacctatgttggtgaacgctttgattccttggatggtcgtattgatgccattgatgctcactttgaaggaatggatacccgcatcactcagcttgaggaggatgtgagttatcttcgtcggtgcttcgaccttcctccaccatcttcatag

SEQ ID NO: 69552 - DNA, 462 bp, Glycine max
  Peptide Sequence Number=SeqID_186330
atggctaattctcttaatagccacttttttgtagtagtatttattctttctctcttggccttttctagcaatgcacaactatctcccaccttctatgccaaaacttgccccaatgttcaaaccatagtgagcagtgcaatgaggcaagctgttgctaaagaagccaggattggtgcctctattcttcgtttgttctttcatgattgctttgtaaatggctgtgatggatcaatcttattggacgacactgccaccttcactggcgagaaaaatgcaggacctaacagaaattcagcgaggggcttcgaagttattgataccattaaaaccaacgttgaagcttcttgcaatgccaccgtttcttgtgctgatatcctagcacttgccacaagagacggagttgtgctggtgagccaactatccataatttctttggcaaattcttcatctataacaaactga

SEQ ID NO: 69553 - DNA, 419 bp, Glycine max
  Peptide Sequence Number=SeqID_186331
actcatcttctccttgaagtggcatctcctctctctcttcctttctccattccgctgccattcatcttccaagaagcaaaggaatccattgatgaagaagatcctaggcctacaagctccaatggagcttgcatcacaaaccaagtatgtggaaaagtgacagcagatataaagcaaagatctaccttcttagtggaccaaggatggccattgtttgtgagtgaatttggtggagacttgagaggtaccaatgtgaatgacaatcgataccttaactgttttctggcactggtagctgagcttgacttggattgggcctattggactcttgttgatagttactactttagagaaggggttataggaatggaagagttttatggccttctcacttgggattggattcagattacaagagt

SEQ ID NO: 69554 - DNA, 183 bp, Glycine max
  Peptide Sequence Number=SeqID_186332
atggtagaggcttgtgtggaatcgacaagcaaggacaaaaaggaatcttcaagtgacgcgacgaggaatccgtggggggcactgtgcactgacctttcagggtctttggcactagcttttggtcacgttcatacgttggatgttgtgtatgatcgtggggggcactgtgcactgaccttctag

SEQ ID NO: 69555 - DNA, 438 bp, Glycine max
  Peptide Sequence Number=SeqID_186333
atgctaatgaggcaagccagtaaagatgtgatgctaggaagcattaatgttcctgctaagactcaactcttcttggcattggctgttgttcatcatgacagagaaatcctgggagatgatcataacttcaatccaatgagatttagtgagcctcgaaagcatttggccgcattctttcccatcggattagaccctagaatctgtgttgggcaaaatttggcaatgcttgaggcaaagattgctcttgctctgatcattcaaagttacaattttgtggtatctctaaactatatgcatgctcctatactatttgtcactttgcagccgcaatatggtgcacaaatcattttcaaggatttcatattgaagattgttgtcgtgtttttccttttctgcctgcgtgtaactttaaactctatatgtggggacgcattgtag

SEQ ID NO: 69556 - DNA, 279 bp, Glycine max
  Peptide Sequence Number=SeqID_186334
atgaaggcacttcagaaattagaagagcaaggaagtattttctcattcaagagtatgagacttttcggatacaacaaggagaaacaatttgagatggtcaaaagagcatgggatgagaatgcttctagtacttcaagtgattcaaacaatgaagaaaaggaaaatctctatcttatggcggatggtgatgttgaaagcataccaagcacttttgattctgaaattgatcttgatgaaaactatgataagcttttagatgccttcaatgaaatgcattaa

SEQ ID NO: 69557 - DNA, 249 bp, Glycine max
  Peptide Sequence Number=SeqID_186335
atgagtgaagaggatgacgtcattgaggttaacatcgacatcgaagatgtcggtgcaatcgaggaggtgctggcaggggcgtttgagggaaggatcataataggggttaaagttgtcaaggctgaggacgatggagaggctggaagggaaggagcgacatgcggacttggcaatacgcttctcctagtgggagccaccccaagaatcactgagggagcaacaacaaagggagacaaagggcgacgatga

SEQ ID NO: 69558 - DNA, 2493 bp, Glycine max
  Peptide Sequence Number=SeqID_186336
atggccaagcaaagtagtagagcccatttcatcagttgggaggtttgttacaaacctcagattgaagggtggattgagtcccgtcttggtaatctaatatgcagaagcatggctttggcggttcaatggctatggcccccctctgattatcttgttctctcgaaattcccatacatcttgtttgaacatacaaaagttgtggttgattggaactcaaattctaatcctgcgaggaaacttgtggttatcacatcaagtctactaagtgatgcacaccgaatacagacagcacactcagcatttcctgattcacctctggggccagatgcatatcatgaatatgaatccttactggttcaagattacgaagaactagttaagaaatcagggataaaacctggacaggcaaaacataactttgaagatggaggacgttcagagttttcttccagcggagagaatgttcttaatcttgaagctagttcaagtggaagagatttttacgagcacaatccattagactacattgaagatgcagtgctgaaattggttgtttctgttcatcattttcccatgattttatgtcccatttcaccacgagtatttgtcctacctgcagaagggttggtggctgaagcatacttatcagctgagcatgaagattccattagtcctggtttgccgcccttaagtactggcatgctctctgatgctgatgatgtgcctccaggggctactcttacagcacactttctctaccatttggctgccaagatggacttgaaaatggaaattttctcccttggtgatatatcaaaaactgtgggaaaaatattgacagacatgtcaagtctttatgatgtaggccgccgtaaacaatcagcagggctgttactcattgatcgtacacttgatcttctcactccttgctgtcatggggactcgcttgttgaccgtatgttttcttctttgccccgtagaaatagaacattttcccatggttcaggaagccaactcaaacttggttcttcctacctgcaacgtgctcctttagatgttcagataccccttgcaaagatcctgaatgaagaagattggcaaatagacaattttcggcttttagaaactgttgaagcttttttgtgtggttggaattctggtgattctgattctcaggttgaaggcttgattaacctaagccagaaaatccatgacaagcctagtcagtctgatgtagagatacttaccgggtcctttatctcctctgaaaatttccgtggaatgccattattggaggctattctagatagaaaaacaaaagatggggccctactgatcaagaaatggctacaagaatctctgcgcagggaaaatcttactgtgaatgtgaagtctcgtcctggtcttgttacaaagccagagttgcaagccatgatcaaagctttgtccaggagccaatcctctttgctaaggaacaaaggaattatccaattagcttcagccacattgttttcccttgatgaatcaaattatgctaaatgggatgcatttagcagcgcagagaaaattctgggtgttagttctggagaaacaagtcaaagtcttgccattcaaattggtgatctcatcaacaagagtgctctgctgggatcacatgtaaatgaagggaaaagggagatatcaaaggggttactttctttgcaagatgctttgttgttgatgatcattggatatatattggctggtgaaaattttccaacatctggttctgatgggccattttcttggcaagaggaacatttgttaaaagaagctgttgtagatgctcttcttgaaaatccatcagtagcaaatctcaagtttctagatggactacgggaagagcttgaaactaatgtaagcaagtacaaatcagaggaaacagctgaagaaccttcaaaactagatattgatgattttgatgatcagtggggtaaatggggtgatgaagatgttgatgatgacaacaaaaatgaaaaagtgtatggtgatgtgcaactgaagttggagttgcgagatagggtggataaatttttcaaatttcttcataagttatctggtttaaaaagaaagaatataccattaagggatggatcattgactacggaagctaattttgatgaggatagaaaaggattgctttataagttactaacaagggtgttgggcaagtacgatgtgcctgggttagaatatcattcttccactgtggggcgcttgtttaagagtgggtttggaagatttggccttggtcaggccaaaccaagtcttgcggatcaaaatgtcattttggtgtttgttattgggggcattaatggactcgaggtgcgtgaagctcatgaggcattggctgaaagtggaagacctgatatagagttgcttgttggtggaacaactcttctcacttccaatgacatgctcaacttactgttaggggactcaagttacatttga

SEQ ID NO: 69559 - DNA, 171 bp, Glycine max
  Peptide Sequence Number=SeqID_186337
atggaagacacacccgagttaaaagaagaagatttcaagtgctttggaggaaaattgatgcaaaaacttgaagaaaaagccttgaagaaaagagttgaagaagggacagctcgcttagtgcataagccaggaccaatgcgtctcctcgctcaacggcccgctcaggcttag

SEQ ID NO: 69560 - DNA, 342 bp, Glycine max
  Peptide Sequence Number=SeqID_186338
atggctacggttgatgttatcaaatcctgcatcggttccattagacagcaaaattcaacaatgggagagattggatgcatattggtgtatattggtgtccctggacatctagataaaactgtaccctccattagcgagaatttgcatctcaagaggcaagaagttttcaccgaactaatattgagattggaagagatatcagagcatattcaagacgctattgtttatttagatgctggatctacagaaagtttccaatttattggggcatatccagtacttcttgaacttggggcacgagctatttgcagtttggaaaacatgtgcgcacttgatgtgtaa

SEQ ID NO: 69561 - DNA, 177 bp, Glycine max
  Peptide Sequence Number=SeqID_186339
atgggtatggaggtggtgatagacacaaggaagtcaccaagcttgaaggactcaaagaaccctagtgattgggaaaacttgcaggatgagtatggcatgccaaggtcgtggtggatggagaagaataaagggatggcgaagaggggggatggggagtggtttggatccgctggatga

SEQ ID NO: 69562 - DNA, 312 bp, Glycine max
  Peptide Sequence Number=SeqID_186340
atgtgtatttttgaacaccatttttcacccaaagggtacaggaatgggataacaaattttaatccgttggatcggggacgagtacatgtatatgttggggagtcgggatcggggactggggggaaatactcgtccccgtcctgccccgttgccatgtctagatccaacatagatgacaatattgcacacaatgaaaggagtgaggataacgctaaagtcacaacgttggagagcaccgttgttgagggagagaaggattttatattcaaccatgttgatgctaataacaatgtcattgtcattcttgaatga

SEQ ID NO: 69563 - DNA, 186 bp, Glycine max
  Peptide Sequence Number=SeqID_186341
atgacgcttgcaccacgatgctgcccccctaacccacgcaccatgtctccagtatgtgcctactccttaggtgacacgtatggattccacttacttgacacgtctgactttttctgcaaaatgaaaagtttgtctaccttgctcctacgtatccttaggtgcgatgagaaattcaaacctacgtag

SEQ ID NO: 69564 - DNA, 966 bp, Glycine max
  Peptide Sequence Number=SeqID_186342
gtggagagcactactatagagaaggaagagcttgcaaagattgttgctgacctccaggcccagttgaaggagtcagagtccaaactggaagagtccgagctcagggcgtcaaagggtagggaggttagtaaagagcttgaagaagagttggatcttgacttaggtattttttacccaacaaaggacatgaaggacggtgaactacttcgtgaagaagaaatagttgctgcaaaggagtatgttgatgaggagcaagatgttttggccaatgtcttatcaatcatcttggtggtgcttcctttcactttgtggagcttctcccctaatgcttgtgaagaggtggaccttgggtttgatgagcctttggagatgcgagactcaccaagggcagaccttgggtttgacgagcctttggaatgtgagacacaccaagggtggaccttgggtttgacgagcctttggagaagcaagactccccaaggggcagaccttgggtttgacaagcctttggtgatgcaagactcaccaagggcagaccttgggtttcacaagcctttagagaagcgagactcaccaagggaggaccttgggttggacgagcctttggagaagcgagactcaccaagggcgaaccttgaatttgatgagcctttggagatgcgagactcaccaagggcagaccttggatttgatgaggctttggagatgcgagactcaccaagggtggaccttggggcagaacttgggtttgacaagcctttggtgatgcaagactcaccaagggagaaccttgggtttatcgagcctttggagaaacaagattcaccaaggacgtaccttcgatttgatgagcctttggaaaaatccatcaaggctcaccaagcggaccttgggtttgatgagcctttgaagaagcgagactcaccaagggtgaaccttgggtttaacgagcctttgtatggttga

SEQ ID NO: 69565 - DNA, 492 bp, Glycine max
  Peptide Sequence Number=SeqID_186343
atggcatctatgctatatgtaagtcagaaaggagtttcgttgattgttgtctggggctttaaggatgaccctattggctgccttcatctgaccattggtctgggggatggcataaggaagaccatatctgtatatgaggaacttgactgctcttggggcctttggcaagggtcccagtatgtccatcccccacatggcaaaaggccaagggtagctcaagctacaaaggttgtcaggaggggcacgcaccactttggttgcaagggagtgtccctcgatatggaggtcgtagattccttcatgaatctctcacgtgacattgtttgcttgttggctattgaggcatttcagcaagggtggggtcatccaatttggttcctccttctctcctgccatgacctcactggtttctatggtttgagcttggagtgtctcctggatgatcattttgagatgctcgatctttttagtgttggccagtttggagaatag

SEQ ID NO: 69566 - DNA, 150 bp, Glycine max
  Peptide Sequence Number=SeqID_186344
atgaagtttgggcttttgcggggagtgatttgggcaagaattgagttagatatggctggaagaaaaattggggggatgcgtcataatcgattacacaaatatggtaatcgattaccagagagcaacttttccagaaataactgcttgtaa

SEQ ID NO: 69567 - DNA, 762 bp, Glycine max
  Peptide Sequence Number=SeqID_186345
atggcagaaccatcgaaaaagcggaaaggaacctcgagtcggagtcagcggcattctgggtcacaggaagccccaattcctccctccattccctctggatcattattttcatcagaggaacagcgtacacggtacacaaacctcttttcctcttgttccattgtagacccaaaattcatagatatggagttcttctctaatgagaattttgaatgcttccaagcatttgaaaactccaatcttattccatttatgtctctgaaattacctgtctattctgaattagtcaaagctttttattctaatttagaaatccatgaaggtgcactgattgatgaatggaaattcgatttctctgtgcatgatgcccgccggttggtttgcaccaaccaagcggatatgaccggaagacttcttgccggttcattggcttttgaaagtcgcatcctccattaccttatagttcgcattttgcttcctagatcttcaaaccttgcccaagtttctgaagaagatctcactgtcatgtgggcctttcataaaggtttacaaattgattgggcacatcttgttagatatcgcatgcataaggcattgcgattgaatgccccattaccttatcctcaccttgttaccctctttcttcaacatttcaacatccctcttgattttgaaccttatgttccaatcaagagatcattccttataggcgcttcagtcatagcatcctttggttatattaaggagcatgatggctcatgg

SEQ ID NO: 69568 - DNA, 261 bp, Glycine max
  Peptide Sequence Number=SeqID_186346
atgccgatctccccctgtgaaagtatcggttggtctgtgccgtcccgacataaggatcgtgcccacaagacacccagtggacctggagaagtccaacaaggccctggggtctccagctttggttacgggcctctatcagtcctacagggtgcccgttccccccaacaagggatcgcgcctgcaagacacccagtggaccctgagaagtccaacagggtcctggggtttccagctctgattacgagcctctgtcaattttaa

SEQ ID NO: 69569 - DNA, 402 bp, Glycine max
  Peptide Sequence Number=SeqID_186347
aggatcccacccttcagaggactacacatcctcaccatcagagggctgcatgtcctcaccttcagagtgctgcacgcccttgccatcagaggactacacgtgctgaccatcagagggttgcacgtcctcaccttcaaaggactacacgtcctcaccattagagggttgcacatcctcacctacagaggactatacatcctcaccttcagaggactacacgtcctcgccatcagagggctatacgccctcaccttcagagggtcgcgtaccctcaccttcaaaggactgcacgtcctcacctttagaggactgcacgtcctcaccttcagaggactacacgtcctcaccatcagaggactggacgtccttacttttcagaaggctacacgctctcgcctttag

SEQ ID NO: 69570 - DNA, 2589 bp, Glycine max
  Peptide Sequence Number=SeqID_186348
atgatgtccaggtcgtatacgaatcttttagatttggcctccgggaatttcccggcaatgggggggagggagactagggagcggaggcggctgccgagggttatgagtgtcccggggtttatcactgaggtagatgatgatcaggcagttagtgtttcctctgataatccgtcgactgttactacagatagaatgatcattgtggctaaccagctaccgttgaaggcaaagcgaaaagaggacaacaaagggtggagtttcagttggaatgaggactcgttgcttttacagctcaaggatggacttccggatgacatggaggttctttatgttggttcgctacgtgttgacattgatccagctgaacaggatgacgtatcacagtatttattggataaattcaaatgtgtgccaacttttctacccgctgatgtcttggcaaaattttatgatggcttctgtaaacggcagttatggccactttttcattacatgctaccattttcaacagataaaagccaccgatttgatcgctctttatgggaagcttacgtgctggcaaacaagctattttttcagaaggtagttgaaataataaacccagaggatgattacatttggattcatgattatcatttgatggtgctaccaacttttataagaaggcgttttaacagggttaaaatgggatttttcctgcatagcccctttccatcgtcagagatatataggactcttccagtcagggaagagatactgaaagctttactaaactctgatatcatcggattccatacctttgactatgctcgtcatttcctttcctgttgcagtcgtatgttgggtctggagtatcagtcaaagaggggctatctaggattggagtactatggaaggacaatcagtattaagattatgcctgttgggattcacatgggtcggattgagtcagtcatgagaatggcagatgaggaatgcaaggtaaaggagctcaaacaacaattcgaaggaaaaaccatcttgcttggtattgatgatatggacattttcaaaggcataaatttgaagattttggctatggagcagatgctcagacaacatcccaaatggcaaggaagagctattctggtccagatagttaatcctgctagaggtaaagggatacatctggaggagatacatgctgaaatacaagaaagctgcaacaggatcaacagagtgtttgggagacctggttacgaacctattgtttttattgatagagcagttcctattgctgaaaaagttgcctatcacagcatggctgagtgtgttattgtcacagctgtaagggatggaatgaacctaactccttatgaatatattgcatgtagacagggaatatctggttctgaatcatgttccaatgtcagtgacccaaagaagagtatgctagtaatatcagaatttattgggtgttctccatcactaagtggggcaatccgtgttaatccatggaatgttgaagcaacttcagaggcaatgaatgaggccatctcaatgagtgatggagagaaacagttgcggcatgagaagcattaccggtatgtcagcactcatgatgtggcttattggtcacgtagtttcttgcaagacatggagcgggcttgcactgaccttctaaggaaaagatgttggggaataggtcttagctttggatttagagttgtggcacttgaccctaattttaaaaagctctcaattgatgcaatggtttcagcttacaagagggcaaagaatagggccattttgttggactatgatggtactgtgatgccacaaaactccattaataagagtccaagcaaggaggtcttgtctattttagaatcacttagtgcagaccccaaaaatgttgttttcattgttagtggacgggggaggaatagcttaagtgactggtttgattcctgtgaaaaacttggaattgctgcagaacatgggtacttcttgagatggtctcacggtggagaatgggaaaactgtggtaagagctccgactttggatggatgcagattgctgaacctgtaatgaaacaatatacagaggcgactgatggctcctcaattgaaagaaaagaaagtgctttggtctggcaataccgtgatgcagaccttggttttggatctgctcaggctaaggaaatgttagatcatctagaaagtgttctggccaatgagcctgttgctgtgaagagtggccagtttattgttgaagtaaaaccccaggatgtgagcaaaggcttggtcgccgagaagatattttcgtcaatgcacaggaagggcaaacaggccgactttgtgctgtgtgttggcgatgacagatcagatgaggacatgtttgagatagttagtagtgccatctcaaggaatattcttgcctccaatgcttctgtgtttgcttgcactgttggacaaaaaccaagcaaagcaaagtattatctggatgatacaactgaggtaacaagcatgttggaatctttggctgaagaatcagatgcttcaccctgcatagaagaaactggggattcctcttggaggccagtgtga

SEQ ID NO: 69571 - DNA, 231 bp, Glycine max
  Peptide Sequence Number=SeqID_186349
atgacgcataacttactggttacgcacgcagtattgtcacacatttcaaggtggtctccaaagtcggctcaaagtgttacaacttacgatatggagagtggtgagcttaatttcaactttcaagcagggacaacgctacttgttgtaggtcaactagaagcaaaggcaatatttcttgaggtggagcaggaagcaccatggaatgatcttcatacaccacacccaacttaa

SEQ ID NO: 69572 - DNA, 156 bp, Glycine max
  Peptide Sequence Number=SeqID_186350
atgaccacggaaaacctgtggttttggaatgtgttagagaagcagagaggagggttgccggaagtcaattcatataaagcacttgaaaatattacttgcatgtcgttgattaggttgaaactggttcaaatctctaaagtaaagtctcggttttag

SEQ ID NO: 69573 - DNA, 639 bp, Glycine max
  Peptide Sequence Number=SeqID_186351
atgggtggaagcataaaaatgatagaagaatcgctgaagctggcatttggagacaactctgagttcatcaaggataaaagaatagctgcagtgcaggctttatctgggactggtgcatgtcgactttttgctgcatttcaacagagatttcatcctaatacccaaatctatataccagtgcctacctgggccaaaaattacagccaccataacatttggagagatgctggagtgcctatgaagacattccgttactatcaccctgagtctagaggattggatttttcaggactgatggatgacataaagaatgctccagatggttccttctttctgcttcatgcttgtgctcataatcctactggagtagatccttcagaagaacaatggagagagatctcttcccagataaaggctaagggtcatttccctttctttgacatggcatatcaaggttttgctagtggtgatccagagagagatgcaaaagccataaagatttttcttgaggatggtcatttaataggacttgctcagtcatatgcaaaaaatatgggactgtatggccagcgagcaggaagcctgagactcttcagtggcatttcttgtggttggggagtggcatatgttggaccttga

SEQ ID NO: 69574 - DNA, 375 bp, Glycine max
  Peptide Sequence Number=SeqID_186352
atgaagaagttgtggcaacagattgaaattggacttacattgatagtatctttacaggttatggcagaccgcatcatcggaatgaggactacactacgagaaaacttagaaaagaaggggtctactttgccatggcagcatataactaatcagattggtatgttctgctacagtggattgacacctgaacaggttgatcgtatgacaaacgagtttcatatttacatgacccgtaacggtcgtatcagtatggctggtcttaatacgggcaacgttggatatgttgctgacgctatccatgagcaacatctagcatttcatcatcaatatgttaggaggacagggcagtctagtggcggacctattctcaaatga

SEQ ID NO: 69575 - DNA, 185 bp, Glycine max
  Peptide Sequence Number=SeqID_186353
gctcgctaagctcaattccacaaattttccaagcagataaggatttgcacttagcgcggcaaggcgcgcttcgcgcgacttctcaactggacaacactggcttagcaagcaggctcgctaagccaaattccaaaaatttgaaaaacaaagagatacttgcgcttagcatgacagggcatgcttag

SEQ ID NO: 69576 - DNA, 348 bp, Glycine max
  Peptide Sequence Number=SeqID_186354
atgtatgaaaaggggatggataagtctgaggacgtggctactaatgagagggtcaatgttgaggcctcacacaatgataagttgaacctgttactcagaggaaacgactttagtctctttcacctccgttgttgtcgtaatgatgcctgcatgaaaccaaattgggttttcttagctaaggagaaaccccaaccgagtggagagaggccaagcactaggaatacatttgaggttgtcctacaacaagtgtcgatgaggaataatgatttccttaacgattatttgactgagtctgagaagcataacttgagtatattagaaaaacttccccggaggttgtcagcctaa

SEQ ID NO: 69577 - DNA, 546 bp, Glycine max
  Peptide Sequence Number=SeqID_186355
atgacattggcttggcatggggacaaaatggccagtgtgtggcatatgatgttggggtggatacctggcatgtcaaatagctgccacatgaattggcagatccacatcgaatacatcatcttggtcacccagacttgcttcgtaaacggtcagggttcatattggagacccttcatccacgcgaatgacttgactgctaccaccaggttaaagtatgtctatggagctgccttgatcaatgaagaccttggacaccatgcaattggcgatcacgatgaagaagactatggggttgttttggttgatagggttgatgcccttgaagtctctgtcgatgaatgttatgggagggagacttcttgggaatggtttgtcaacacaattgatgttgatatcttggataacatggagatgacactgttgggattggcaagactatcctccattggaaaatttgcctgcaatggtgttgattacacctcaaatttgttgggcgagctcattttcttgttcttgcagaggtcattgctcgtgtcttgttggtga

SEQ ID NO: 69578 - DNA, 285 bp, Glycine max
  Peptide Sequence Number=SeqID_186356
atgcttgacaagggtgtcaaagttgtcgatggaccttggagggagtcctccataccatgtcaatgctgctcctttgaggaatgttgggaaaacccgacaaaagattgcgtcatcattggtgtagagatttgccactataggttgagtggcttccaacctaagggcaggtcagcctccatgactctgcttgtgtacattcatgcattgtgcagagagagtgcttgtcaccctggaggcgtctcacccgagcctccatctggtcgtggtcagcctttagctttatga

SEQ ID NO: 69579 - DNA, 432 bp, Glycine max
  Peptide Sequence Number=SeqID_186357
atgccactaagggcaagcagttggtggtgtacccctgccaaacactttggagggccctcagtttcacccacaaccacaacccttgcattttatgagttgtgcctagtgcctgacatcgtcatccctccgaagttcaaggtgtcggacttcaataagtacaaggggactacttgccccaagaatcacctgaagtatcagtataattctgatatggctccagataggatgcagctacagaacatctcaagtagcacccccaatgacagagaaggagatgataacaatgatagtggacacattaccagtgttcctgatgcaatcctacccccaagggcattggatagaagactccaagaagattgtgcaagagatgcaagagaaggccctagggttctcatgagccttaggatagatttctggcccatgggctaa

SEQ ID NO: 69580 - DNA, 847 bp, Glycine max
  Peptide Sequence Number=SeqID_186358
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcacatcctagagctcactcccataggagagaaaaggaaagaaaacctcaagaggctaacattaacctctcatacttccatgggaagaacaatatagaggcttatttagattgggaaatgaaggttcctttggctaccctttgcttccaaggtgcccttaggaagagttacatcccctcctactatgaaagggagcttatggacaagctccaaaggcttagacaagggagtatgagtgttgaagagaaggaggaaagaacaagcattgctaggttccttagtggacttaatatggaagtgagggacaaggttgagctgcttccttatagggacctagatgacctagtccaactttgcataagggtagagcaacaacttaaaagaagacctacttcaaaatattatggctctcactcttatccaaagaaagaccaaggtcgaggaatcttaggggctgcaccttctaagcccaaaaatgataaggagaagacaatagaaaggcaacctcctaaggcta

SEQ ID NO: 69581 - DNA, 237 bp, Glycine max
  Peptide Sequence Number=SeqID_186359
atggtggcgactccggacatctttcctcctttggaaagcgcacccgtgaacctcgccctcgctcacccgcgtaaaagggcacgttgcgacacatacggatgctctatacacatgacgagagatgcatcaaaatttactcatatatctcccaagaatagtggacatgtgacttatggtgacaacaacaaagcaaagataatgattcatggttatggcataagagaactgcccatataa

SEQ ID NO: 69582 - DNA, 567 bp, Glycine max
  Peptide Sequence Number=SeqID_186360
atgacccgaaggctacttgccggttcattggctcttgaaagccgcatccttctttatctaattgttcatatcctacttcctagatcttcaaaccttgcacagcgacaaattgattgggcacatctagtttggtatcgcatgcataaggcattgcgattaaatgctcctttgccctatcctcacttagttactttgttccttcaacattttaacatccatcttgattctgaaccttatgttccaatcaagagatctttcttgatcggtgctgttgtggttgcctcctttgcttaccacaaagagcgtgatagctcttgggtaaaaaagggtgctcaaccaaatgatgatgaaggacacttaccggttgaaggagactcttctctccatcagagtattttggacaggtttgatggacttcaaacctatattggtgagaggtttgactccttggaacgtcaagtggacacacgattcgaggagatgaactcaaggattgcaaaggttgaagaagatgtcaccatcattcgcaactgctttgatttacctccaccaccaccatcagtttag

SEQ ID NO: 69583 - DNA, 264 bp, Glycine max
  Peptide Sequence Number=SeqID_186361
atggaaacggaaacttcatccttcacactctccgataaaaatctcaacataattcaacaagatgaccaaccatcatctatggatgatgaaagacaaatcaaaaccctaacaagagaacaagatctctggcttgtttctacggttcctattaaggagtcttcaaatttgttatgcctaatgtctctaaggcacattaaaattgctgcatctatacccatatctattaagggcttgatggctacttgtacacatcctatgatgtaa

SEQ ID NO: 69584 - DNA, 1536 bp, Glycine max
  Peptide Sequence Number=SeqID_186362
atgtgggagtggatcatcgatccgtcgctctgggcaggattagtcacgctaatcgttcttgagctggtgctgggtattgataacctggttttcatcgccatcctggtggagaagctgccgccgacgctgcgcgaccgcgcgcgggtgttcggcctgctgctggcgttggtatcacggctggtgctgctggcgtcgctgtcgtggctggttacgctgacccaaccgctgttcaccctcttccagcacagcttcagcgcacgcgacctgatgctgctgggcggcggtatctttctgttgtttaaagccaccaccgaactgaacgcccggctggagggcagcgacgaggaatcgggtcaaaataacagcggtgctaaattctggccggtggtggcgcaaatcgtggtgctggacgccatcttttcactcgatgccgtcattaccgccgtcggtatggtcaacgacctgccggtgatgatgatcgccgtgaccatcgccatcctgttaatgctgctggccagcaagccgctgacgcgcttcgttaacggccatccgaccattgtgattctctgcctgagctttctgctgatgatcggctttagtctggtggcagagggtttcggcttcgtcatccccaaaggctatctgtacgcggccattggcttctcgattgtgattgagatctttaaccagctggcgctgtttaatcgccgccgttttcttaccgccggacggccgctgcgccagcgcaccgccgaagccgtgctgcgcattctgcgcggtgaagcgcagcgcgccgatctggatgccgacacggcatcgctgctgagcgataaccagggcgcagcgctgtttaaccgtcaggagcggcgcatgataatgcgcgtgctgggtctgggtcagcgccagatcaacagcatcatgacgtcacgccatgacgtcgagcacatcgatctgagcgaagacccgcagtcgatcatggataaactcgaccgcaaccagcatacgcgcctgctgatcaccgaacagggacgcgagccgctgggcgtggtgcatgtgatcgatctgctgcatcagtcgctgcacagtaaatcgctggatttgcgtgcgcttattcgccagccgctggtgtttcccgagcgcgtcaccctgctgcaggcgctggagcagtttcgccatgcgcgcacccattttgcctttgtggtggatgagtttggttcggtagaaggcgtggtgacgctgagcgacgtgatggagaccatcgccggcaacctgcccaatgaaggggaagaaattgatgcccgttacgatattcagcccgcagagcatggcggctggatcgccaacggccatatgccgctggaagatttagcgctatacgtggcgctgccgctcgacgagaggcgcaattaccatacgctggcgggattgctgatggatagcctgcagcacgtgccggccgaagggtgggcattcatgcgcaccggcatcgggtttattgccgcggtgcatacttctggctatccagccactgattga

SEQ ID NO: 69585 - DNA, 365 bp, Glycine max
  Peptide Sequence Number=SeqID_186363
atttgtcacataactatctaactggaaaaattccaaccagcacgcagttacagagttttaatgcctcgagttatgaagataatcttgatctttgtggaccgcctcttgagaaattgtgtattgataaggggctagcacaagaaccaaatgttgaagttccagaggatgaatattcacttttcagtcgtgaattttacatgagtatgacatttggatttgttataagcttttgggtggtgtttggctcaatcttattcaagcgttcttggagacatgcctatttcaagttcttgaaaaatctatcagacaatatttatgtcaaggtcgcagtatttgctaataaaatatcaaaggtgcatgactga

SEQ ID NO: 69586 - DNA, 753 bp, Glycine max
  Peptide Sequence Number=SeqID_186364
atgtctcttagagaacgtctcagttctatcaccaaaggcacctcctcgatttccacttatctactgttaatttgcaatattgttgatgagttggctctcattggccatccgattgacgaccttgaaatggtcattcatactctgaatggtctaggacccatatttcgagagttcactgcctccatccgcactcgtgattcaccaatttccttcaatgaattatatgataaattggtggattttgagatgtatttacaacgtgaagaacgcctctcaaccaacatccccgtcactgccaatgttgttcaacatcatcaacatgatcaaggtcgtgggtacttttcccatggtcgtcaacacaaccatcatgtttcctctagcaacaagaaatcaaccaatctaatcacctatcaatattgtgaaaagcctggtcactccacaaagcattgctataagattcatggctatccaaaaaagccacgccaaccaactgctaatgttgtgcaaacaacttcatctcactcacctccaccttcatctcactcacctccatcctcatggctctttgactcaggtgcatctcatcacatcactaatgatctaacaaacttgactctcaaggatgactaccatggatatgacaatcttcaagttgcaaatggtaatcaacttcttattactcacattggctccaccactattcccactaatggttctcctttaaagctttcagatattctttatgttccaaat

SEQ ID NO: 69587 - DNA, 171 bp, Glycine max
  Peptide Sequence Number=SeqID_186365
atggcaatttcaggatacacattaatcccagtgaaggctattactcgttccattacatgttgggctgtgaaagctcaaatcaataggctatggaaaacagttgagcatgctaatggaaatgcaattaggaggtttaatgttaagagcaagttgattttgttatttgtttaa

SEQ ID NO: 69588 - DNA, 297 bp, Glycine max
  Peptide Sequence Number=SeqID_186366
atgatgacaacagacattaccaagctcaactcaatgttccacttattcccagaaagagaaaatgctgaaggtagatgtcttagagatgttgttaacaatcctattgcatatacggtaaatcaaatttgtcatgacaagcaagtgctaaggatgtttcattcaaaggagttcttaattgtggcacaggagttagctgcaaagacaattgcacaaagatcatcaattgaaaatactaagatgatcacaggtgtgaaggtattggcggaagcagaaataatgcaccctaagctacactaa

SEQ ID NO: 69589 - DNA, 237 bp, Glycine max
  Peptide Sequence Number=SeqID_186367
atgaaccaggcaattgaaatatttaccaagaaagtgcaggaagcaaaactggtgttgctgaaacatggttcaatctttaaagcagaaacattgattcatgagtttcctctgcatttcaaaacctcatgtgctttttccattaacagtggaaaaaccatggataatgtgtcaaaaatcaagacagagtttggctttgaagatgaaaatcgtccgcctcatgcggcacggcagagctga

SEQ ID NO: 69590 - DNA, 531 bp, Glycine max
  Peptide Sequence Number=SeqID_186368
atgtcgcgctatgcgcgttcatcgtggctgttgaagcaaaacgatgcagacactaagcacgcctgtgcgctaagcgtcaatagtatactgagatactcagagaagttcaggaaaagaaaggcaccctctacacctacccaagacagatttgatagatccagattcacttcccaagaggctttggagagatacactgacattgtggtgcctcgtaagcttttaccagaaaggaatgtggtagtctactatacagagtttgatgagttcaaggaagaactcgagatacaccattgggatgaggagttaactaactttctggacgataacattgatgttgccattgtaaaagaattctatgcaaacctctatgaccccgaggacaaatcacctaagcaggtgagggtgagagttcatttgattaagtttgatgaggatactcttaactcatttttgaagacccctgttgttgtggaagagggggaaaaaatttgtgcttcctctagatttgcactcctgaggcttgatccttag

SEQ ID NO: 69591 - DNA, 360 bp, Glycine max
  Peptide Sequence Number=SeqID_186369
atggagcatatcagtatccatgtggcccaactcatttcagatgttattcatcagtttgttggtactaaacctcttaggcacccagtggacccagaaaagtccaacaaggcattggagcaggatcaacaacctcagtcagcagcagatgccccacccccacgtcagccgccatccttggagtccatctcagcacacatgcagaggatggagttgcagatgcacacgtacatgcgccatttggctgaccagcaggcagcaaatcataggggccagatgcagttgaatgataacttctgcccctatacattacaccagcatcgccaggaccctagcctttacccttggcctactcctgagtag

SEQ ID NO: 69592 - DNA, 579 bp, Glycine max
  Peptide Sequence Number=SeqID_186370
atgaatttgaaggataaaaggtttgggagttgtttacgtgaggggaagctttggtttcacttggttactttcaaaatcattaaaagaggacttgcaaagaaattaagggtggagattgcacaacagcttgcccaggcgagctgcttgcttcctccagaagtaaccttgctcgcccaagcgagctcagctcgcccaggcgagctagttacttcagccttaagctttctagtgggcccaggggctaaaaaatgccccaaaagtgacccttttgccattcttttgggaagtaaagataaagacactaatttcattccagcgatctcgccatccgacagaccaatagtggaagccccagcagcgaaacctgtcaaaagaaggattataaaaggcatcagggcggaagacattgacagtcttcgcaagacaatagactttgatagccttgtaagagtaaagaaagcagatgaccatgattgtctccgcatgatgacagactttgatagtcttgaaaatgtaaagaaagcagatgaccatgattgtctccacaagccaacggacttggtagtcttgaaaatataa

SEQ ID NO: 69593 - DNA, 642 bp, Glycine max
  Peptide Sequence Number=SeqID_186371
atgtctcaggtagtggccactcgatccattcactcctccctcacgcgccccacctcaggatctgcacaccacagggcccaaacgttgttgaagcctccaacttttgcttccaaattgttcggagcacaaaggaacaacccctccaaagtttgctcccgaagttgcctcgtcaatgcgaggaaatctgcacccgctaaagttgttcccgtgtcacccgaggatgattcaaagattgaggaagagttgcagcacttgcgtggtatgcagcaacttggcgacacttctgttggaatgtggtcaaaacccacgtttaggaggaagacaaaggttgtttgcaccattggtccttctaccaacaccagggaaatgatttggaagctggctgaggctgggatgaatgttgcccgattgaatatgtctcacggagaccatgcttctcatcagaaaattattgatttgggtcctgaggttaggagtggggatttgccacaaccaatcaatttaacaactgggcaggaattcacttttaccatccggaggggtgttggaactgcagattgtgttagtgtgaactatgacgatttcgtcaatgatgtggatgtgggagacatgcttcttgttgatggtatggcaaccaactga

SEQ ID NO: 69594 - DNA, 564 bp, Glycine max
  Peptide Sequence Number=SeqID_186372
atgccttctgatattgttcatagtgttcttgatggttataatggaattgtgatggcttatggtcaaactagaataggtaaaacttttactcttggacaattgggggaggaagatacctctgatcgtggtatcatggtttgttccatggaggacatcttagctgacatatctctaggaattgattttgtcactgtctcatatctgcagctttacatggaggctctccaggactttcttaatccagcaaatgataatattcctatcgtggaagatccaaaaactggtgatgtgtctttgtcgggagatacttcagtggaaatcaaggaccaaccaagttttttagagctgctaagagtaggggaaactcatcgaattgctgccaacacaaagttgaatactgaatcttctcatagtcacgctatactaacggtacatgttaagaggtttgttgtggactgtgaagatgttgtttctactaaaaataatgatgcctctcacttgactaaaccttcaaaaccaatttttcgaaagagcaagttggaaagagcaagttggttgtggtag

SEQ ID NO: 69595 - DNA, 1866 bp, Glycine max
  Peptide Sequence Number=SeqID_186373
atggatggttctaaggcagtaattaagggaaatcctaattcttctcacaatgtgctgcttaaagcacaaaatgtcacccggggtcctaccaaaagaactgtgtgggatcatccaaggttgccttcaacagaggataagatattggagctgcttcacggatttgtgaatcagtttctttctgggggatacaatgttttgatgcgatccattcgtgaagatattgaaaaggaacatccctcaattcaaaaaagtgatgttgttgttttctttcaagtggctgaatttgtcacttcatttcagtgttacaagtattcagcttctaagaccacggagggaggggacacatttgagacttttagtcataaagatgcagatacctcagatttcagtggtcaaatatgtggtccaattgcagcatccttgaatgagtcaatgtttcaattggttatttcaaagtggcggcatgcctatgatggtctaaaggaaacaaatgactatcagtttctatctgcagccggttctcttttgaaaaacatgattcgcatgctggatttgattcttaaattgttgcctgaagactcaaaggaacctcaaacagctcgcatacttttgtacaagttattttatgatcagactgaggaagggatgactcagttcctattgaatttgattaaaacctttgacacccacaaacaacccaaaaggtatccaattgttgtcatatatttagtggaaatcattcacaaggttgtaaagctgatggataatcttcagtctcgaggagcattgagggtgtctagaaaatcaaggaaagtgaaaaaaaaaataattccagaagggacagaatcaggggacaaactggctggagatcattctttcattcaaaatgaaactggcatctcaactgtcaatcaatcagcagaaaatcagccactgcaggaaggcctaccaaatgcaaattccactggggaagatgttatccctgatgataatgaacatgaaaatcatgttgaggaagttgggaactcccaagttgggttagaaccaatgggagccacaaattctgaacatgttaatgaggatatgttggatggtactaaggatttttctgaagatgagcaactacatgcatataatgaagttgatttcaaggtttcaacgctggtctctgcctttgcaaatcataatatcattcagaaattatgttggttgctcaagttttacaagagcaattccctggctacaaaccattacataataagcatgctgcggagaataagtgatgaccttgaactccatcctatgctttaccagttgtcgctgctcacaactttttatgacatcctggttgaacaaaagtcatgtccctgcaaggactatgcaggtatagttgattttctgacttgtttggtcagaaagatgctaaagaaaatgaaaaagcaacccctcttgtttgtggaactccttttctggaagactcggagggaatgccattacatcaatgctgaatatttgttgagcgagcttggtcatttgaagaaagaaagtgccaattggaataacactcagggagatgaagaaattggttcatccccagcaaaggtgtggacacgcagaagcatagctgatgcacttggtgaggatgaagccgatgttgtgattactcatgactcaggatatcaaaaagacaagcttgatgatgttattaaaggctttgcacctacctctggcagtaacagtgacaaagatgatcataatggggagcaattgatggaagatgaatctcaaattgctccaaggagaaggaagaaacttgttcttgatggtgatttggaaagacaaatcaaagatctccatgagaagtag

SEQ ID NO: 69596 - DNA, 300 bp, Glycine max
  Peptide Sequence Number=SeqID_186374
atgacgacgttagtctctgtgtgctatcatgctttgggtctgatggatagcaaaagaatgcttataccgataaccactcagagattgatggtgcgtggtagacgacgtaaatctctgcgtgtcaacgggctcggaccccgattgacaaagggtgcagaagacgatgtgcggataaccataaggtacccccgcatgtcatcggactcgctgtctctagatgacaaaggtgtagatgacgacattgactgtgcggagaaattacttgtgtatttccgcacgtcacctgacctcagggtcaag

SEQ ID NO: 69597 - DNA, 816 bp, Glycine max
  Peptide Sequence Number=SeqID_186375
atggctgagacggatggagcaggtgtggatagtggtgggaaggaggcgagtagtatttttaagttggagtggggaggtcataactgtcattcgtggtgtggaaccctggacagttccttggacagcaaagaccattgttcagtttcatctcatctagaagagcaaactaagttgggttctgcaggatcttggatagttccatttttagcatacacagcagggtttagaaaggaatctcttacatacagagggcaagcattgtgcagcctcttgactgatgttgctgaaggcgtggttggaatagcaattcttcgccattgtcttgcaaagtttcaacctctttcatctgattggttcaaatttgaagtcaaggggaagtggcagtttgatgttggtttaggctgcctcatgttcccccttatcaatcagctatcacaaatgaacctaaatttgctgcctgttcttcaatatactccagttaccatctcaagtgtagagcaatccattgttgcgcgagaccctgtggcaatggccctctatgcagtggtagtctcggtttgtgccccaatatgggaggagattgttttccgtggtttccttcttccatctttaaccaagtacatgcctgtatggagtgcaatattagttagctcaatagcttttgccttggcacattttaacattcagagaatgctaccacttgtatttcttggcatggtgatgggtactgtctttgtacggtctaggaacctctttccatcaatgttgttgcatagtttgtggaatgcttttgtatttctggatctcatgaaataa

SEQ ID NO: 69598 - DNA, 837 bp, Glycine max
  Peptide Sequence Number=SeqID_186376
atggaaacttcccagcctctttctattgaaagcttctcatacagttggttagtgaacctaaggccatcatcactagaaagcctagaaagctccctaagaacctcccttgatgcatctgatgaagcttccttcattgagatggacccaagaatgccaccctctaaaagattcttcaagaactcacaggactccaaatttgacttcccaatttcacagtcccctctcactcttgtccatgcagacgaactcttttccaatggctatctcatgccactctttgttgagtcattgcaaatggaagaatatgagtcctcagactccaacacaagcctggtctcatcatcttcacatgcaccaacgagtgaggctcctacaggcccttctagatgcctttccttaaaaaggtgcagaacattgtcaaggagagtgtttcagaagtatctgaatttcttgaggcctttgtgtagaaagctgagggttcataagtctagtactgaagctgttgctaaaagaggtgaggctgtgaagaataggagatactattcagacactacttcaccgcgaactagtgtagccttttctgctgatgattggcgctactcttgtgattctgaaagctcaatatacgaagcagttctccattgcaaaagatccattgatttttggagttctaacatttcaacgctttgtttatggcaggagaatgagttaaggaatctgcaaaaggggaaggagaagatgaagataaatgagaagggattaaagtcgatccactgtcactgtaaaaccttttatactatgagggaaaaaagtatggaactttgttgttatagctaa

SEQ ID NO: 69599 - DNA, 462 bp, Glycine max
  Peptide Sequence Number=SeqID_186377
atgtattgtcagccatcaaacattcttattgatgccaacttccaagcaaagctttcagattttgggttgtccagggttatggaccttggtcaatcctatgtgagctctgaagtaagaggaacgtttggttatattgatcctgaatataggacaaatcaccatgtaaaagcctcaggagatgtctacagctttggaatagtgttattgcaacttctatcaggacaaagggtacttaacattgatttccagagaccaatgtctctgggtaaaatggccagagatgttgttagaggcggtgatatgtcagaatttgctgatcctaaactcaaaagagagtactctgttgaagcatttgacatcgtattaaagctagctttgtcttgcatagggctcaagcagcaaaggccatctatagagcaagtgttgtatagcctagaaaaggcactcgatatctctttataa

SEQ ID NO: 69600 - DNA, 545 bp, Glycine max
  Peptide Sequence Number=SeqID_186378
gcgacaaggacaacgtcgatgacactgtatgcaaaaagtacgacactagcaaggaaaaatggacccaattttgtcagagccgtagagacccttcgtgggagggtgtgctaaagaaggcacagaccattcagaaactaaacattttccttcacgtgttgtcttgtgggggttatgaatttctagaaaacaagttgatggaggagaagaaaagcaaacaattggaggaagctactaaatctggaagcattgacaccatcattgatcctccatctcccattagacgacacgtgaagtggaagatggcctgcaccaagaaaacttgccaaatgatgtctgaggcagcaaagaaaattgctgataagattgtaaattcctttgttgcccatggacgtcaagatgtactgactgctgccattgggcaaccagaacaccctggtcgtgtttgtgctgctggagccggtgtgacaatcaaacaatactttggacaactccaaggacctcttgcacatctttgtccatggttcccgaaaacctggagtacctga

SEQ ID NO: 69601 - DNA, 279 bp, Glycine max
  Peptide Sequence Number=SeqID_186379
atggaggatgcacgaacagcgctaggaatcaattcgtggggctccggactcgatggtggaggatgcatgaacagtgctaggcaatcaattcattgggctccagactcaatgatggaggatgcacgaacagcgctagcaatcaattcgtggggctccagactcgatggtggaggatgcacgaacagcgctaggaaatcaattcgtggggctccggactcgatggtggatgatgcacaaacagagctagggaatcaattcatggggctccagactcaataa

SEQ ID NO: 69602 - DNA, 447 bp, Glycine max
  Peptide Sequence Number=SeqID_186380
atggaatcgagagctccaagtgggccatttttgcctgcccccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 69603 - DNA, 123 bp, Glycine max
  Peptide Sequence Number=SeqID_186381
atggcagcttcaacctaccttgacctagatgagaaaggtatcaggctaatcgtaaggaaaagcacaagtgggacatgccacctattagaaagctctcttgtatcttggaattgcaagaagcag

SEQ ID NO: 69604 - DNA, 348 bp, Glycine max
  Peptide Sequence Number=SeqID_186382
atgatcgtggagaagtttcttcagaaggtggcctggcccagagtcgagccttctcctttgggagggggtaaggcctctgcagcccaggagcctcaacaggaacagaaggaagacattttagaggcctcagagcccagtccacctgagcctttcatttttgagatcgatctagtagcagctaccccacaggtgacaccagagccttccactgcaatgttggacttgtcttcctctcagacagagccatctgcaccagtgccagacctgccacttccacaggattcatcagcaggcactcctgcactggacctgaatgagcatgccatggattctacacaggatcattga

SEQ ID NO: 69605 - DNA, 291 bp, Glycine max
  Peptide Sequence Number=SeqID_186383
atgaaattgctattggaagcagaaaatgaaattgcagaaaacgaattttattgctacgtgaatagtgcgcatgaaaagtcctcagccccaaagcttacaaatctattgtttgctcagctcaccatttgggctcagcgcgcatccatcgctaagtacagcttcggcgtgcttaacgcgacagaagaatctggcagagcatcaatttcaaggctgcagctaagcataatggttgtctttagccaggctcagcacaggactggcgctaagctcaaatccactaattcgcgctaa

SEQ ID NO: 69606 - DNA, 402 bp, Glycine max
  Peptide Sequence Number=SeqID_186384
atgttgcatccccttcaacttcacagggaaaagttgaactcaatgaacttgctcctgtatatgtctccaatcgcggtcctagttttgttgcctgcagcacttatcatggagcctaatgtcgtagatgtcatattgacgcttgcaaaggaccataaatctgtgtggctacttcttttcctaaactcagtcacagcatatgcagctaacttaacaaacttcttggtgactaaacataccagtgctctcacactccaggtgttaggcaatgcgaaaggtgctgtagctgttgtaatctcaatactcctattcagaaaccctgtcactgttcttggcatgggtggctatacaattaccgtgatgggagtggctgcatatggagaaacaaaaaggaggtttagatga

SEQ ID NO: 69607 - DNA, 3081 bp, Glycine max
  Peptide Sequence Number=SeqID_186385
atggcagttgatcagggtgtgtttaagagaaagagattagactcaaatgtaactccttctccaatttacctcacaaagttgaacttgaggaaaaaattcgaattgctctctacgttcaaaaggcagcattacaatttattgatgctgatctggttttcttatgcagctggtaatcgagttgagtacaaactatcaagtgaggcaagagattctggttttggtattcatccagatgagattgcatctattgttcgtggtcatgataacaagaccttaaatgatattggtggagttgaatccattgcaaggaaattgttagtttcggttgatggaggtgtcagcgaagagagtataaatagcagacaacagatttatggattcaatcgttataccgaaaaaccttctagatcgttcctgatgtttgtgtgggatgcattgcaggacttaactctaatcattctcatggtttgtgctgtagtttctatagttatagggattgccactgaagggtggccaaagggaacttatgatggtgtgggaatcatactcagtatattcttggttgtcgttgttacagctgtcagtgattacaagcagtccctgcagttcagagatttggacaaagagaagaaaaagatatttgttcaggtcaatagagatgggaaaagacagaagatctcaatttatgatatagtagttggtgatgttgttcatttgtcaactggggatcaagttccagctgatgggatttttttatcaggatactctttgcttattgatgaatcaagtttgtcaggtgagagcgaacctgtaaatataactgaagaaaaaccttttcttctctcaggaaccaaagtgcaggatggtcaggggaagatgttagttacaactgttggcatgaggactgaatggggaaaattgatggagactctaaacgagggaggagaggatgaaaccccattgcaggttaaattaaatggagtagctactattattggtaaaattggtttgacatttgccattctgacatttgtagtgttgacagttaggtttgtggtcgaaaaagcgcttcatggtgactttgctagttggtcttcagatgatgcaaagaagttactggacttctttgctattgctgtaaccataatagttgttgcagttcctgaaggattaccactggctgtgacactcagtcttgcttttgcaatgaaaaaactaatgaatgacaaggcacttgtaaggcatctttctgcttgtgagactatgggttcagctagttgcatttgcacagataagacagggacattgaccactaacaaaatggtggttactaaagcatggatatgcgaaaaagccatgcagataaaaggtactgagagtgcaaacgaactgaaaacatgtacatctgaaggagttataaacatccttttgcaggctatatttcaaaacacttctgctgaagtagttaaggatgataaaaatggaaaggacacaatattgggaaccccaacagaatcagcattattggaatttggatgccttttgagtgctgattttgatgcgtatgcacagcgtagagagtataagatactcaaagttgagccattcaattcagtccgaaagaaaatgtccgtgcttgtgggtcttcctaatggaggagtccgagctttctgcaaaggtgcatcagaaataatattaaaaatgtgtgacaaaactattgattgcaatggggaagttgttgatcttcctgaagacggggcaaataatgtctctgatgttataaatgcctttgcctctgaagctttgagaactatttgtttggccttcaaagagataaatgaaacccatgaacccaacagcattcctgatagtggctatactctaatagccttagtaggaatcaaggatcctgtacgccctggggttaaggaagctgttcaaacttgtatggctgctggaataactatccgcatggttactggtgataacataaatacagctaaagctatagctaaagaatgtggtttacttaccgagggtggtctagccatagaaggtccagatttccgtgacttgtctcctgagcaaatgaaggatgtcataccaagaatccaggtgatggcacgatccttaccgctcgacaagcataagttagttaccaatttgaggaaaatgttcggtgaggttgttgctgttactggcgatggaactaatgatgcccctgcactgcgtgaggcagacattggacttgcaatgggcatagcaggaactgaggtcgctaaagaaaatgctgatgtcattataatggatgataacttcacgactattgtcaatgttgtcaaatggggacgtgcagtatatataaacattcaaaaatttgtgcagtttcaattgacagttaatgttgttgctctggttatcaacttcatttctgcatgcatcactgcaacatgggtgatagtcttccttctttcaggatctgctccactcacagctgttcagttgctttgggtcaacttgatcatggacactcttggggcattagccctggctactgaacctcctaacgatggacttttgaaaagacccccagttgcaagaggagcaaactttatcaccaaacctatgtggaggaatatcataggtcaaagcatatatcaattaattatccttgggattctaaattttgatgggaagaggctgctcggacttggtggttcagattcaacaaaaatactcaacacgttgatattcaactcctttgtattttgccaggtgtttaatgagataaacagcagagatattgacaagataaacatattcagaggcatgtttgacagctggatatttatggcgataattttcgccaccgctgcatttcaagtggtgatagttgaattccttggaacgtttgccagcactgtgcctctaaactggcaattctggttactaagtgtggtaatcggagcatttagcatgcctatagctgctatcctcaagtgcatcccagttgaaagagatgctagtaagcagcaccgtgatggttatgaggcactgccatctggtccggagctggcataa

SEQ ID NO: 69608 - DNA, 357 bp, Glycine max
  Peptide Sequence Number=SeqID_186386
atggtttggcttcaggtattcacttatttaaagtcatttggcttaagggtcatacagatcaaattgatccataagaagcatacggatcaacttgatcgtatgcttcttacttcatcttacaaaagcacaaacgaagcagaaacggaaacgacacccatggggagaagaggcttacctcgacggtcgacggtggggcagcccaatgcacgtcctcaatgccgacaaaacacggacgagaagaagctccaaagcacaatgaacacggcaacgcacaacgaagggaagaagaagaagaatagcggtgtaggggctgagctacagtcacgaatgcgtgagaaatggaggttgggtgcataa

SEQ ID NO: 69609 - DNA, 354 bp, Glycine max
  Peptide Sequence Number=SeqID_186387
atgtcccttagcctttcctctaaagatcaaaattttctctttcttccatggcaggaggtagtctccccaccgagaaatgtaagggttgcatcgggcgatgttgaggggccccagtcgcaacctacccttttgcaggcgagcgaggcgaagctcacgggtgcgtcttccaaaggagaaaaatgcgcagagtcgccaccaacgtttatttgtggaaaatgtcggaaaaaccgaaggaaaccggtcatgaagaatattccagattcgagagttgtatttatgtttgaggaaggtcgacaaaagcggggctcttgctcctacataccctccatcgaagaggaaatcaaacctacgtag

SEQ ID NO: 69610 - DNA, 459 bp, Glycine max
  Peptide Sequence Number=SeqID_186388
atgaagagatttccatcttcccttcagtggtctttgattctgggatgtcgtgaaatagattcccttgaatcagctggatgggggaatgtggatatgagatgttggccgcctacacctctgttatacaacttggaaatgcttcttctgcaagccccagcacaatcaacccacataaccaccgatagcgggatactgagccaaatgctgagccagaaactagtccctacaaaggagtacaaccccatcaaacggggctttcgggcactagcatacttcgtgcaggacaattggaaacgcctatgggtcatagccctgtggctttccatttgcgctggtcttttgatttggaagttcatccaatacaagcacggaaggaaacataactgcaggggcagaggtcgaaatagcaaaccaggggtacgggagaaagcaaagcccaaaagaaaagaagaatggtga

SEQ ID NO: 69611 - DNA, 138 bp, Glycine max
  Peptide Sequence Number=SeqID_186389
atggttggactttatttgccgaaaccagtattcactcatggccaattatatgttgcattgtcaagggtcaactcagcaaaaggattaaaaattctcatccatgatgatgagcagaaaagcatgaattccaccaccaat

SEQ ID NO: 69612 - DNA, 2589 bp, Glycine max
  Peptide Sequence Number=SeqID_186390
atgaacacactcctacgcttcaaaaaaggagtcagagatccttcaggcatgctctcctcatggctcccaaaattagattgttgtcgatggacaggagtcaagtgtgataatatcactggcagagttacacagcttaatctcccatgtcacacaactcaacctgaagttgttgcttatcaagagaaagacgacaaatcacactgcctaacaggtgaattcagccttaccttgctggaactagaatttttgagctacttggatttcagcaacaatgacttcaagtctatccaatacagttcaatgggtaaccacaaatgtgatgacttgtcaagaggtaaccttccccatctgtgtggaaactccaccaacctccattatcttgatttgtcacataattatgatctgcttgtctataatctccattgggtttcccgtctttcctcattgaaatatcttaaccttggaggtgttcgccttcccaaggaaattgattggcttcaatcagtcaccatgctcccttctcttttagagttgaccttggagaattgtcaacttgaaaacatctatccatttcttcagtatgctaattttacttcacttcaagttttaaatctagctggcaatgattttgtatctgagttgcctagttggttattcaatcttagttgtgacatctctcatatcgaccttagccaaaatcgcataaatagccaactccctgaaagatttccaaattttagaagtattcaaaccttgtttttatctgataattatctcaaaggacctattccaaattggcttggacaacttgaagaactaaaagaacttgatctttctcataattctttttctggtccaatcccagaaggcttgggaaatctatcatccttgattaatttgatacttgagtcaaatgagttgaagggaaatcttccagacaatctcgggcatctcttcaacttggaaacacttgcagtttcaaaaaattccttgactggaattgtgtctgaaagaaatttacgttcattaacaaatttgaagagcttttccatgggttcaccttctctggtctatgattttgatcctgaatgggtccctccttttcaacttgtaagtatttcattgggctatgtgagagacaaacttccggcatggctattcacacagagttctctaactgatctaaagattttagactcaactgcttcatttgaacctcttgacaagttttggaactttgctactcaacttgaatatttcgttttggtaaacagcacaatcaatggagacatatcaaatgtgttgctaagctcaaaattggtttggttagattccaataatttaagaggtggcatgcctcgtatatcaccagaagtgcgtgttttgcgtatatataataactcattgtctggatctatttctcctctcttgtgtgacagcatgaaaaataaaagcaatttagtgcatttggacatgggttataaccatttaacgggagaactcacagattgttggaatgattggaaatcgttggttcatattgatttaggttacaacaacctaacaggcaagattcctcactcaatgggctccttgtctaatcttcgttttctgtatctggaaagcaacaagttctttggagaggtacctttttcactaaataactgcaagaatctttggatacttgatcttggtcacaataatctttctggagttataccaaactggttgggtcagagtgtgagaggtcttaaattgagatccaatcaattcagtggcaacattcccacacagctatgccaacttggttccttaatggtgatggattttgcaagcaatagattatcaggaccaatacctaattgcttacataacttcacagccatgctttttagtaatgcttcaacttataaagttggctttactgttcaatcaccagatttctcggtaagcattgcatgtggtataaggatgtttataaaaggcaaagaattaaatcgtgtttatttgatgaatgacattgatctctcgaataacaacttgtctggaagtgtgcctttggagatttatatgctgactggattacaatccttgaatttgtcccataatcaattaatgggaacaataccacaagagataggcaacttgaaacaattggaggccattgatctctcaagaaatcaattctcgggagaaattcctgtgtccttgtctgccttgcattacctttcagtcttgaatttgtcgttcaacaatttaatgggcaaaatcccatcagggacccaacttggttcaacagaccttagctatattggcaattctgacctctgtggacctccgcttacaaagatatgcccacaagatgaaaaatctcacaatattacaaaacccgtgagagaagaagatgatgatgatgataaatctgaagtatattcctggttctacatgggcatgggaattggatttgctgtgggattttggggagtttttggcaccattttgctcaacaggagatgtagacttgtttattttagatttctgcaccgagtgtgcgactttgtgattcgaaagatgatctccatctactga

SEQ ID NO: 69613 - DNA, 513 bp, Glycine max
  Peptide Sequence Number=SeqID_186391
atgctcactggactacagtccttgaatttgtcccataatcaattactgggaacaataccacaagagataggcaacttgaaacaattggaggccattgatctctcaagaaatcaattctcgggagaaattccagagtccatggctgtcttgcattatctttcggtcttgaatctgtcattaaacaattttgtgggggaaatcccaacagggacccaacttggttccacaaaccttagctatatcggcaatcctcacctctgtggagctccacttacaaagatatgcccacaagacgaaaagtccaacaacacaaaacatgcaggagaagaagatgatgatgataaatctgaactatactcctggttctatatgggcctgggaattggatttgccgtgggatttttgggagttttgggcgccattttcttcaaccggagatgcaggcatgcttattttcgatttctgcaccgaatgtatgactttgtgatccaaaagatgaactccatctattga

SEQ ID NO: 69614 - DNA, 840 bp, Glycine max
  Peptide Sequence Number=SeqID_186392
atggcggaggaaccggagagcaccgtcaccaacggcgccgccgacgaatcgctgctcgataagatcaccgagaagcttcacggccacgattcttcgtcctcttcatcttccgactccgactccgactccgaaaaaaccgttacttcctccgttaaggataagattcaatgtgggaatgttgtggatggctgcataggtgaaaattgggatgttaagtcaagaattgaagagttgtttgatgaggtgtcattgaatggagaattgtatgcgattgtgagtgctgctgatgtgttattgtggaggaacaagaaaatttctgctggcatgcttggcggagccactgctgtttgggttctttttgagttgcttgagtatcaccttcttactctggtgtgtcacattttgatactgttgctcgcagttctgttcttgtggtccaatgcccatactttcatccacaaatctccacctcgcattccggaatttcatcttccagaggagccattcctgcaagttgcgtctgcattgagaattgaagtcaaccggggatttgctgttttgcatagtattggctctggaagggacttgaagaaattcctagtggttattgctagcgtatggattctgtcaattgtggggaactggtgcaatttcttgaccctgttctacataacttttatcttgttgcacacggttcctgtgctatatgagaagtacgatgataagatagatccacttgcagagaaggcagttattgagattaaaaagcagtatgctgtgtttgatgctaaggtcttgagtaagatcccattgggtccattgaaagccaagttatcttag

SEQ ID NO: 69615 - DNA, 1608 bp, Glycine max
  Peptide Sequence Number=SeqID_186393
atgccatcttccatacgtgctatgacaacaaatgaggtgagcaaattacacaatgaattgaatgagaaaatatcagaaataaaacgtctgcaattggagttgactagacgagaagatgaagaagcaggtgattctgtggatagcttcaaaagactaattgaaactttggagaaggaaaacactactcttaagttggaaaaagatgaacttgaggttgccctcaaatcaagtaggatggctagtaaaatgtcacctgatgattctcagattcagatcaaggttccaagcagtaacagtgatgtgagccaaaacttgaaagcaatatttactttacaggagcagttaccagatccttccaaaagttttccagggaacgaagacttggaaagatccttacataagctaagtaaagaattgaaggaaacgcaaaatgagaggaacaaagcagtacaagaattgacccgtcttaaacagcatttgttagaaaaggaatctgaagagtcagaaaaaatggatgaggatatcaaaatcattgaagaactacgtgatagcaataattatctaagggctcaaatagcacatcttgaaagaactctgaaacaggcaactgcaagtcaggagaaactgaagatggcaaacgacaatgaaattctgaagtccagggaaatcattgatgacctcaacaagaagcttacaaactgtatgagcacaatagatgctaagaatactgaacttgtaaatctacagacagctcttggacaatattatgctgaaattgaagctaaggaacatttagaaggagatttggctcgtgcaaaggaagaaacatctaagctttctcaactgttgaaagatgcagactgcagagcaaatgtattgatcagtgaaaaagaagaaattttagcaaagctttctcaatctgagaaggtacaatcggaatggagaagtagagtaagcaagcttgaagaagacaattccagattgaggcgagctcttgagcagagtatgacacggttaaatagaatgtcagtggattctgattttcttgttgacaggcgcattgtgataaaattactgatcacttatttccagagaaaccacagcaaagaggttttggatctaatggttcgcatgctgggattctctaccgaggacaaacaaagaataggtgttgctcaacaaggtccaggaaaaggtgttgtccgtggtgttcttgggtttcctggccgcctagttggaggtatcttgggaggaagtggttcaactgaatcagctgcaaatgtaggagtagataaccagtcctttgcagatctgtgggttgattttcttctcaaggaaacagaagaaagagagaagaaggagtcagaaggaagagataaatccatcgatgagtcacatgataaaagttttgatattaattcttctccaccacattccaatcagaggtttagcactggagcatcaattaactcacccactaatcaaaacatcagttctcaccctcgtggatactttcagcattccgaacaaattggttcagagttctcaacagttccccttacatcatcagatagtaaaactactagttcaagacttcctagatactaa

SEQ ID NO: 69616 - DNA, 693 bp, Glycine max
  Peptide Sequence Number=SeqID_186394
atgtgggacacaatcgccaacttcaaggagaacttgaacaaaatagccctcgacgttcactacgccgatgaagacgacgtcgttttccctcccgacgtccacaccgccgccgtctccgatcgccgcaattctcacagctccgcgcattccaaatcgcttcctatgtcgccggctgcctccaacggaacatccgatcacccctactctcctgagatagaacaatataaagcagaaatcaagagacttcaagcatccgaggcagaaattaaagcactatctgttaattatgcagctctattaaaagaaaaagagaatttcgaggctacaagtccagcatctgcaaatggtgcttacacagtcaagggaagtaatgaccaatcaccaaatccactgcataggttcacaactcaaatgaaaaatcgttatgctacaaacaatggaaccacatctactttggaatctgatgctagtcaaagtaagatggtatctaaacattcaaacttacgagtaaaggacaaggagcaagcagatatggtagagggaaaaagtagtcccacagccacagcagcagtacaacatactcatgagatacgaaaaatgaagttggaactagagcaagaacgcaaaaagttggcaaatattcagctaaaattccagggtaattattctgcatttagaatatctagattgtaa

SEQ ID NO: 69617 - DNA, 1143 bp, Glycine max
  Peptide Sequence Number=SeqID_186395
atgggttcattgggtgcatcaagtggaagagagctattgcttcacatgaatggtggcacgggaaaaaggagttatgccaacaactcttcgttccaaaaaaaattaatgcttaaagccaaaccaatgcttgaagaaactataacaagactgtatcgtgattcttctccaaactgcatgaaagtagcagatttaggttgctctgtaggaccaaacacacttcttgtgacatcaaatattattgatattgttgataccacatgcacccgcttgaatcgtgaaccacccatattccaattttttctcaatgatttatttggaaatgatttcaataccatcttcaagtcacttcctgatttctatacaagattgcaaggagataagggaaatgaatttggttcatgctttattaatgccacccctggatccttccatgggaggctctttcctagtaattccataaacttttttcattctgccaacagtctacactggctctctcaggatccgttatcagggttgactaaggagacaaaatcacttaacaagggcaactgtcacatagttagcacaagcccttcagaggtgtacaaagcttactttaagcagtttcaagaaggttttaaatcatttctaaaatcgcgttcggaggaacttgtgcctggaggagcaatggtcttagtgttaccttgcacttgcaaaaatgaaactctttcaaaaagcctttgggaagtaataagcctaacactgaatgacatgctctcggagggtttgattgaagaagcaaaattggactcttttaacataccaacgtatgagcctacaattgaggaaattaggcatttgattaaggaagaagagtcattgtttcttcaaagattagaggttttcaccgtgcctagggatgagggtgtaagtgaatgtggtgatgatttctttcttgatggaaatataagagctgaattcatagccacatacacaagagctgcaatggagcctctcttatctgcaaagtttgaggcacaagttataaatgaattgtttatcaggtttcgaaagaaacttgtgcaaataatgaaggtggagaaatttgagactgctaatttgatgatatccatgacaaaaattgctcgaagaagtgtttaa

SEQ ID NO: 69618 - DNA, 1188 bp, Glycine max
  Peptide Sequence Number=SeqID_186396
atggattcattcagtgcaacaacggaaagacagctattgcttcacatgaatggtggcaagggagaaaggagttatgcaaacaacagcttgctacaaaaaaaactaatgcttaaagccaaacccatacttgaagaaactataatgaaactgtatcatgattcttctccaagctgcatgaaagtggcagatttaggttgctctgtaggaccaaattcacttcttgtgatatcaaatattattaacattgtcgataccacatgcaccatcttgaattgtgaaccacccacattccaattttatctcaatgatttatttggaaacgatttcaataccatcttcaagtcacttcctgatttccatacaagattggtagaagataaaggacacaagtttggttcatgctttattaatgcaacccctggatccttctatgggaggctctttcccagtaattccatagacctatttcattcctccaacagtctacactggctttctcaggatccattattggggttgactaaggaggcagaatcgctttacaagggccattgtcacatagttagcacaagccctccagaggtatacaaagcttaccttaagcagtttcaacaagattttaaattgtttctgaaatcacgttcagaggaacttgtgcctggaggagcaatgctcttggtggttctcggcaatcatgaaactccaagaagaaccggttgggaattaattagtctaatactcaatgacatgttcttggagggtttgattgaagaagaaaaattgaactcctttaacataccagtgtatgaacctacagttgaagaaattaggcatgttattcaagaagaagggtcattctttgttcaacgactagagattttaatcttgccttgggttgaaggcataaatgaagctggtgatgattcttttcttgatggaaatataaaagccggattaatggccaagcacgtaagagcagcaatggagcctctcctttccacaaagtttggtgaagaagttataaatgaagtattcatcagaaacattcgtgtattgccacgaagtcataataatataaaagtttgtttctctttcatgttctggctttgtgccttctttgataagactagaaccgatttgttcatgcgccacaaagtgttcatgcaatgcacttcagatgtgaagtga

SEQ ID NO: 69619 - DNA, 1131 bp, Glycine max
  Peptide Sequence Number=SeqID_186397
atgggttcattgggtacatcaaatggaagagagctattgcttcacatgaatggtggcaagggagaaaggagttatgcaaacaactcctcattccaaaaaaaattaatgcttaaagccaaatcaatacttgaagaaaccataaccacactgtaccgtgattcttctccaaactgcatgaaagtggcagacttaggatgctctgtaggaccaaatacatttcttgtgacatcaaatattatcgacattgttgataccacaactacccttttgaattgtgaacaacccaccttccaattttatctcaatgatttatatggaaacgattttaataccatcttcaagtcacttcctgatttctatacaagattggaagaagataagggacacaagtttggttcatgctttattaatgctacccctggatccttccatgggaggctctttcccagtaattccataaacttatttcattctgccaacagtctacactggctctctcaggatccattatctgggttgactgaggaggagaaatcacttaacaagggcaattgtcacctagttagcacaagcccttcagaggtatacaaagcttactttaagcagtttcaagaaggttttaaatcatttctaaaatcacgttcggaggaacttgtgcctggaggagcaatggtcttggtgttaccttgcacttgcaaaaatgaaactctttcaaaaagcctttgggaagtaataagccttacactgaatgacatgctctcggagggtttgattgaagaagcaaaattggactcttttaacataccaacatatgagcctacaattgaggaaatcaggcatttgattaaggaagaagagtcattgtttcttcaaagattagaggttttcacggtgcctagggatgagggtgtaagtgaatgtggtgatgatgtttttcttgatggaaatataagagctgaattcatagccacatacacaagagctgcaatggagcctctcttatctgcaaagtttgacgcacaagttatagatgaattatttatccggtttcagaagaaacttgtgcaaataatgaaggtggagaaatttgagactgctaatttgatgatatccctgacaaaaattgcttga

SEQ ID NO: 69620 - DNA, 189 bp, Glycine max
  Peptide Sequence Number=SeqID_186398
atggttaccgaatcggggatgaggactttactgagagtggtacctgaggatatgtcgcgagggtcaggagaccttggggacgtcaggtggggtgctattgcccaaaaccaagcttggccaatcccgacccaacccgggcatagtcagccagtgagaacctgtgccgtacctcagcaggcgagctcctag

SEQ ID NO: 69621 - DNA, 258 bp, Glycine max
  Peptide Sequence Number=SeqID_186399
gacgcaccagcacaagccgcagaagaccattctccatcaccacctcctcagagagatgattcttcatctcttatgcacaacattcttgacagattggatggactccacaccttcttcggtgagcgctttgactcattggacaactgcattgatgccattgatgcacggtttgcaggaatggatacacgcatcactcagcttgaggaggatatgagttatgttcgtcagtgctttgaccttccaccaccatcctcatag

SEQ ID NO: 69622 - DNA, 657 bp, Glycine max
  Peptide Sequence Number=SeqID_186400
atggcttgggatctctggagttcgtcctatgcccaagttgcgagtggtagtaattactggtcacagcatcctgaatgtgacttctactttgggtgtggccgtgatttcatagaggaggatgccttgaatgtggaatcctgtgttcgggttttaagaattttgatcaccaaggcagataccgagattgaggaacttgaaagggatctcttgttgcttcagaatgaattggcctgcaccgagcatgaaaagtggcctgatatatgctgtgctgctctcactgagagaatcagccggcttgatgtggcggttagcactttgaagaatgattatgctgatgatgcagagatgcagccactgttagataaagaacctgctgagacacttaatgaaatacttgcccagtctctggatatgaatatgttgagtccaattgtgaatgttactggacatgcactagacaaggattctagcacttttgattctaatataatcattaaggaggaagaaaaagaactccatggaacctctgaaagctcggaacttcttttggagcttcatgaaaagagatcagataatcctgaaaagattgaggtagagaaagctctgttgtatgttttcaatttaaatgcacttattttctattcctgcatgtcttaa

SEQ ID NO: 69623 - DNA, 294 bp, Glycine max
  Peptide Sequence Number=SeqID_186401
atgaccaagcaagaagctaattggtctccatacgataacaacggaggatcatgtgttgcaattgctggagcagattactgcgtcatcgccgcggatacgaggatgtccaccggttacaatatcctcactcgcgattactccaaaatctcccaactggcggagaagtgtgttatggcttcttctggttttcaagctgatgtcaaagctttgcagaaggttttgtctgctaggcatttggtgagtcaaaaacttgaaacagcagtagtgattgtgaattcttttggggttgcttag

SEQ ID NO: 69624 - DNA, 1899 bp, Glycine max
  Peptide Sequence Number=SeqID_186402
atgcctattgtagagaggctcattttgtatcttcctagattacattacagctttaatgttgatttgcctgaaaaatctcttgttagaagtcctgatttaggagctatcatctctgatgagacgaaattatcagaaacatttgataatgaagttactggtaatgaagaagtcagaaaaagccaactcattaatacagatattggtcaaatgttggatttgttttccaccaaagatgatggaaacattccaagtgaagtcaagaaagaaaatgaatttgtcaaagaaaatgatgttagcttagatgattttagacctgcaattggtgtcaaggggaggaaagagtatcctcattccaggttagctacttcacaacaacgaaaaaggggacctgatcactctcattggatgaaattatcagaaacatctgataataaagttgctggaaatgaagaagttggaagaaaccaactcatcaatacagatataggtcaaatcttggatttgttttctgccaaagacaatgaaaatattccaagtgaagtcaagaaagaaagtgagtttgtcaaagaaaaagatgttagctcagatgattttagacctgcaattggcgtcaaggggaggaaagagtatcctcattccagattagctacttcacaacaacaaaaaagtggacctgaatctcctgatcactctgattggatgaaattatcagaaacatctgataaagtttctggaaatgaagttgaaagaagtcaactcattgatacagatataggtcaaatattggatttgttttctgccaaagacaatgaaaatattccaaatgaagccaagaaagaaaatgaatttgtcaaagaagatgttagctcagatgattttagacctgcaactgacatcaaggggaggaaaaagtatcctaattccagattagctacttcacaacggaaaagtaggaattccaatttagacaaaaaggtatgtgattttgctccagaaactgcacagagagcctacaagaaacaatccaaggttgctccagatgaagatttgaactctgtggatttacctttacaagttgtttatcctcaaacattttgtagtgctgatactgaattttgctcctttaaaggaagtaatggtaataattctggactagtgttcaacattgaaaataccactcccttattaatgctgaaaattctgcattggtttctgctagggattcaaaccaagagtacactgaatactgatttacagatgatagatgaagatgaagaggaacaagaagcacaagaccttaagtcccaaattacttctgaattcagaaaattgaacatgagtttcccttcaaagctaaaagctcgggaaaagcagaaactggaactagaggcattttcttccagagaaccatatgacagttgtacagaagttattccaagtacacccataattgtatcaaccaagaggcagcgaagatcgaaaccctgtactgatgttgccattttaaatgagcccatgaaccggaagattattactagaagagcagtgcaacccgacaagcatgaaactgaaggtcgtgctcttgttccttatgatagcaacttctctgaattacaaaagagaagaaaagctttaaagttgccaatcactgtggacatggaaacaaattcagacagggtttctatggacagcagaagccagttagttcttcatagtagcaacttgcattccttggtggattcccatgacggggcctcatctttgctgcctggtgacttgaatagcttgtcattgattgatttgagggccatggcaaaggaccacaaagtaaaacagtactataagcttcgaaaaggagctttggttgaacaattagctaagcagctcagtagctgctga

SEQ ID NO: 69625 - DNA, 819 bp, Glycine max
  Peptide Sequence Number=SeqID_186403
atggccctccccaccaatctcaagttcttctgtgtgtttctcctagtgcttattctctattcctcatccttccttgcatcagctgttgatcctaaggctgaagatgaagaatttaccttcgctgaaggaagtatcaaagggccaaagaattgggggcagatcaacccaaaatggaaagtatgtggagatggaaaactacaatctcccattgatctctctgaccaaatggctcaagagcttcctcaattgggtaaacttgacaaagtttataaaccagctcctgttgtcctaataaataggggtcatgacatcatgctgcaatggaacggggatgcaggccagcttaacataaatggaactttctacaatctgatgcaatgtcattggcatacaccttcagagcacacgttgaatggaacaaagtttgacttggaactgcatgcagtccataaaacctctaaaggagagattgctgttattggaatctggtataaaattggccattcagatcccttgctttcaaagctgctcaatgacataaaatcaattaaggacaagaagatagacgtaggagtaatcaacccaggagacatcatgtttgaaacaaaagagtactacagatatgttggttctcttacaactccaccatgcactgaaggtgttgtttggacaatagtgaaggaggtgaggacagtctcaaccgagcaattgaatgccttgaaaggagctgtccatcatggagaggaaaatgcaaggccaacacaagaacttggtggaagacaagttttgttatataaagatgtgaattgggaattgtga

SEQ ID NO: 69626 - DNA, 3291 bp, Glycine max
  Peptide Sequence Number=SeqID_186404
atggatcacagaccgaaatccaaggagtcactctcttactccactctcttcaatctcgagtctttgatgaactttcaacttccagaacaagataatgattttgattattacggaaatagtagtcaggatgagagcagagacagccaaggtgtggggattgcaaatcacagtaatgggaatgtgcatgaaaaggaggtgaatttgttcaagaagaggaggtggtctctaaacagtgacaacgaggagaagagcagtttttacgggacacacatgacggaggagcgatatcgatcaatgctgggagagcatattcagaaatacaagaggaggtttaagggtaccttgaatagtcctgcccaaaatcaggctgctgttccacttgtgaaaagcaacacgggattaaaagctcacaagtcagggaatgagcgcaggggaggaggattacatgtggcggagagtacatcggaatggatgaatgattctggttctcaaaaacctggaaactaccgcaatgcagatttctcgccgcaatatggcactgataggattatgtatgaacctgcatctttggatatcggggatggaatcatttacaagatccctccagtctatgataagttggctggagctctaaacctcccaagctgctcagatatccatgttgaggatttatacttaaagggtactttggatttgggctccttggctgaaatgatggctgctgataaaagatttgggaacagaaaccgagcaggcatgggagaagcaataccacaatttgaatcactgcaggcacgactgaaggtcatgtcagcttctaattcggctcgtaagttcagtctgaaaatgtctgatgttgatttgaattcctccattccggagggggcagcgggaagcataaggcgatctattttgtctgagggtggagtattgcaggtttattatgtgaaggttttggagaaaggtgacacctatgagctttgtcacattggactgcttcagatcattgaaagaagcctacctaagaagcaaaaggtgaagaaagaccctgctttgatagagaaggaggaaatggaaagatgtggaaaagtttgggcaaatattgtcagaatgaaagttagtagatcccttaaatggacaaggactgccagtatgcgcacccgtaaactagctagagacatgttactgttctggaaacgaatagacaaggagatgacagaagtgaggaagagggaggaaaaagaagctgctgaagctttgaggcgtgaacaggagcttcgagaggcaaagagacagcagcaaaggcttaattttcttatacaacaaactgagctgtacagtcactttatgcagaacaagtcaaacttactatcttcagaaactttacccaaggaagatgaagatgcagatgatcaagatgcactgatcgactcttcagatgctgtgcccgatgaggaggaagatcctgaagaggctgaattgaagaaggaagctttgaaggctgcacaagaagcagtttctaagcagaaaatgttgacaagtgcttttgacactgaatgcttgaggctgcgccaagctggtgaaactgattcacttccaccagatgttgctggagcgagtaatattgatttgcaaacgccctccaccatgccagtggcatccacagttcggacacctgaattatttaaaggtgttcttaaagaatatcagctaaaaggtcttcagtggctcgttaattgttatgagcagggtttaaatggtattctagcggatgagatgggacttggaaagaccattcaagccatggcttttttggcccatttagctgaggtagctattcatccacatgttttggaaaaaaatatatggggaccttttctggttgttgcacctgcttctgtattaaataattggaatgaggaacttgagcgcttctgccctgaactgaaaagacttccatattggggtgggctttcagagcggacagtacttaggaaaagtattaacccaaaggatctttatcgtagggaagctaaatttcacattctcatcacaagctaccagctattagtatccgatgagaagtattttcgtcgcgtgaaatggcagtatatggttttagatgaagcccaggcaatcaaaagtgcaaccagtataagatggaagacactcctcagttttaattgtcggaatcgcctactgctgactggtacacccattcagaataatatggctgagttatgggctcttcttcacttcatcatgccaactttatttgacagccatgagcagtttaatgagtggttttctaaaggaattgagaaccatgcagaacatgggggtactttaaatgagcaccaacttaatcgattgcattcaattctaaagcctttcatgctgcggcgtgttaaaaaggatgtgatttctgagcttactacaaaaactgaggttactgtgcattgtaagctgagttctcggcagcaggctttctatcaagcaattaagaacaagatatctcttgctgagttgtttgatagtaatcgtgggcagctcaacgagaagagaattctgaatttaatgaacatcgttattcaactaaggaaggtttgcaaccatccagagttgttcgaaaggagtgagggaagcacgtacctttactttggagagattccgaattcccttccacctcctccatttggggagatggaggatgtatattattccggtggtcacaaccccatatcatatgagtttttatggtctgaaaatgggtccattgtaaacggccgttataaagaggatttttcaatgataccaaaacttgtctatcaagaaattatacaaagttctgaaactctcagttcagctgttggtcgtggtgtctccagagaatcttttcataaacattttaatatttttagaccggaaaatgtttatcggtctgtcttctcagaagatatgtgcagtaaaagtggaaattttggttttacccatatgatgaatttgtctccacatgaagtgacatttctagctactggttcttttatggagcgactattattttctatgatgagatgggaacaaaaattcattgatgaagctgtagactttctaatggagaccatagatgatgatccagaatgtagttaccttgagaaagaaaaagtgagagcagttacgcgaatgttattggtgccatcaagatctgagacccagtttcttcaaaaaaaatggcaaactggacccagccatgctccttttgaggccttggttgtcccccatcaagatagg

SEQ ID NO: 69627 - DNA, 168 bp, Glycine max
  Peptide Sequence Number=SeqID_186405
atgaagaagaagaagcgtaaccgtaaaaggaaaaagaggaacagagtggtgcgcaggataaggccagggaaagtgacgtttacactaacgtgcgctaccctgtatgtttcgattttgacggttgaatttgccgtgtatagacggcgagaagaaacggaaggggaatga

SEQ ID NO: 69628 - DNA, 243 bp, Glycine max
  Peptide Sequence Number=SeqID_186406
atgtaccctctcttgttctcagttacaacaacccaagtagatgtaccctctacttgtaccacaaaggatgtacactccaatgtgttaaaacaaagttctcaggcaattagtcctttgaaactttgtgaaggggaaacaaaagatatctcaagcgggagaagagatacacaaaaagaattcaggcggttagtccttggcgaattctttttggcaaagggagaagagaatgaaaaagaagagtag

SEQ ID NO: 69629 - DNA, 204 bp, Glycine max
  Peptide Sequence Number=SeqID_186407
atgtcttctcacagaagttgtttggtatttttttcgtttgcatggcaacagaatctatgctatgttgcacttgattatgaagctgagctattgaaagatacaaaagcatcatttgaagctgctggagaaggatggtttaccctttcaaaagggaggtttcagacagcagagatcctattccagccacatcttgccggagtgtga

SEQ ID NO: 69630 - DNA, 294 bp, Glycine max
  Peptide Sequence Number=SeqID_186408
atgaagatcaagaaaagaacaaaagaaaggaaagaaggattctcgatcaaagatcgaaaggaagtgaaaaggggaaaagaagcaactctcgatcaacgaaaggaagagaatagaaagtctccaaagccagattgccactcagaatcattcttgactggcaatattccaccccacatgaacaaagaggaaaaaaccgaaacacccagcttcctctccaaaaacgctgacctcgagaaaatcctattgattagccccatgtttcccctgcgtgtttgtttgaaagctagaagttga

SEQ ID NO: 69631 - DNA, 315 bp, Glycine max
  Peptide Sequence Number=SeqID_186409
atgaaacaggccaaatacagtctaaaggcccaagtggagaaggacgaaggcccaagtggagaaggacaaagcccccgagtggagaaggatgaaggcccaagtaatccttgtggcgtctacccagacttatcttccttaaccggaagtggcgtctacccagacttatcttccttcactggaagtggcgtctaccctgacttatcttccttcactggaagtggcgtcatccaaaacctccgtagcctgtatcaaacgatccactcctactgttcacatcagtctattaggaaatgttcgatcgacgtcacaaggtga

SEQ ID NO: 69632 - DNA, 315 bp, Glycine max
  Peptide Sequence Number=SeqID_186410
gctcataagaaccctagggccttctcttggatctctggtccaatcttcttggagtcttctatccaatgtccttggggggtaggattgcatcgagacttcaacataaaggaggcaatggtgatgatcaatgtagctcttttatgcaccaaagtctctccagcactcaggccaaccatgtcgtcagtggtaagcatgcgtgaaggtagaacgattattcaagaagtggtgtcagacacaagagaggcttatgcacttttaaccgatacgggttcttctggtggggaaattagaaagttagagaacctagagaggtga

SEQ ID NO: 69633 - DNA, 216 bp, Glycine max
  Peptide Sequence Number=SeqID_186411
atggatgagaagtcctggagtaaaggttggactgtggtaggaaacatggaaagttcaaggttggttttgggtaaagggtatgggaccaagcttggaggagtggtaaatctgtccatcgacaggtcgaacacttccagcaatgacaacgatggtttgaggtcgacgatgccggtggaacgaaggtggtctgaggttgacggtgccgttggagtttga

SEQ ID NO: 69634 - DNA, 300 bp, Glycine max
  Peptide Sequence Number=SeqID_186412
atgtcccttgaagaacttattggaaccttaaagaataagagtgggtccagatggaagatctcattcaagaaagtgttcaaggagaagaaagacaaagaaaagagactcatcatatgccatgagtgtaagaagcttggacacttcaagtcagagtgcctaaaattggagaagtccaaggaaaagtacaaggacatgaaaagtctcataggcacttgggatctggatgacaccacctttgatgaagaagcaaaagaggaagctaacctatgttcaatggctaatacaacttttaaagaatga

SEQ ID NO: 69635 - DNA, 144 bp, Glycine max
  Peptide Sequence Number=SeqID_186413
atggttgaccttgatattggaaactatgaacatttcttggacctcaaattaactcgtgacaataatatcacaactgggaaaatatatcaggttgttccacacgttattgatgccatccaagaatggatagagtgtgtggcatag

SEQ ID NO: 69636 - DNA, 132 bp, Glycine max
  Peptide Sequence Number=SeqID_186414
atagaggaaaccaaggatgctgatagaaatggtccaaaaggaattatcagcgctgttaggatatccattgttgttggatggggttacattctaggcattacctttgcagtcactgacatcgtttaccagtga

SEQ ID NO: 69637 - DNA, 171 bp, Glycine max
  Peptide Sequence Number=SeqID_186415
atgttctggtcttcagtgagggaggcagaggcgacaacaaaggaggctgaggcggaggttgggagcaacgaaaggatcattgcagtcacatgggatggagtgagttcttacttggggaccatatttgagcttgaagtaggctttgaggtcccaagcaaagaagaagagtag

SEQ ID NO: 69638 - DNA, 4707 bp, Glycine max
  Peptide Sequence Number=SeqID_186416
atgaaatacacagagaaatttatcccaattcttatctcaggaggtaccttgtcctcgaaacaaggagttgagcatcctctgcttctatcaactggtccgacctgccgtgccatggccgaccatggtactcgcaagaccaccacggataggcttgaggacgccatctctcgcctttccatccaccattcttctcttctcgacaagcacactgacctcgccgataaatacatggacctttccggcaaggtcgacgccatcctcgcccagctccaccaacttaattccaaccactcccccaacccttccccttccagcgctagtacccagccctctcaccgcagtcccgtcaagctggacatcccacgcttcgatggccgcgacccgcttggctggatattcaagatatcccagctctttgactatcagaacactccggaagaggagcgcatcactgtcgcctccttctacctcgacggcgccgcccttagctggtaccagtggatgttccgcaacggattcatcacttcctggtccgggttcttgcaggctttggagtcccgttttgctcccacccactacgacgatccgaagggggccctcttcaagctctctcagcgaggcacggtcaatgagtacctcaccgagttcgagcgcctggccaaccgcgttattggccttcctccacctttcttgctgagctgtttcatctccgggttgtcaccggagatccgtcgggaggttctcgcccttcaaccaatctccttgccccaggctacgtccctcgccaagcttcaggaggataagctccgcgaccgccgttttccctcacggccttacccttccccttcccacatttcctccgccccccacgctcccacacccccccttcgccctaaacccccttttatccaacgtacccccgacgaaattgccctccgccgtgaaaaggggctttgctacaattgcgatgagaagtggaattcttcccatcgctgcaaaggccgtgtcctcctcttcatcgcggacccctcccaccccgaacccgaacccacacacacaccctccttcgaacccaccaccttcgacccctccctgcctgacctacccacatacgaccccaccacccttactcctgccccgtcccttgacccatcttcttcccacattagccttcatgctctctcaggccttccttcccacgacacctttcgcctttttggaaccatacaccaccaccgtctcaccattcttatcgatagtgggagtacccacaatttcctccagcctcgccttgcccatttccttcatcttcccacccaaaccactacccctttacatgtcttggtcggcaacggctctgttttggactgcactcagctctgccccgacgtccctctcaccctccaagaccaccctttcaccgtcacctttcatcttcttcccattagcggcgcagacgcggttttaggtattgagtggctcaagcaacttgggcccgtcactactgattacacctcctttattatgcacttcactcatctgggcctccccaccacacttcatgctgacgctgctattgggcctgagaccatttctgcccctcaattcaaacgcttacttcaaaccggctccacctcagctctctatcacctctgccttttacccgtaaacccacccgacccgccttcgaccccgtcatcccccatccctgccattgaagctttactgtccaaattccagcctctcttcgacccaccttcccttcttccccctccccgccaagtgacccaccgtatcaacctctttccatccactgccccggtgaacgtccgcccctaccgctaccctcactttcagaaggctgagattgagcggcaggtctcggagctcctcacggcgggccttatccgcccaagcacaagcccgtactcctcccccgtccttctggtcaagaagaaggatgcatcctggcgcatgtgcgtggattatcgcgccctgaattccgtcaccattcgcgatcgttttccgatcccgaccattgacgaattacttgacgagcttggccatgcttcctggttttccaagctcgaccttcgtcagggatttcatcaaatcctcatgcacgaaccagacattgagaagactgcattccgaacgcatcacgggcactacgagtaccgcgtcatgcccttcggcttgtgcaacgcgccttccaccttccaggccgcgatgaacaccctgctcgcccccttcctgcgccgttttgccacagtcttctttgatgatattttggtctacagcgactcattatcatctcatctccaccacctcgagcttgtctttcaggcattgttgcaacaacaattcttccttaagcgcaccaaatgcttgattgcccagcgccaattggagtacctcgggcacctcgtctccgctaagggagtcgaacctgaaccatccaagctccaggctatcgtgaactggccatctccaacatcggctaaggacctccgggcctttctcggtctcaccgggttctaccgcaaattcatcaagaactatgcggcgattgcggctcctctcactgcactcctgtgcaaagatgcctttgcttggtccccaacctctcaggccgcctttgaccacttgaaaactgttatgacccaggcccctgtcttggccctgcccgattttacggttccctttgtcgtagaaacagacgcgtccggcaccgccatgggcgccgttctgatgcaatcaggccatcccattgccttcttcagcaagcagttcggacctcgccttttacatgcctcaacatatgtcagggagctccatgcgattgtcacggcagtccgcaaatggcggcagtacctgcttggccattcgttcaccattttaacagatcacaagagtcttagagaactcatgtctcaggtgatccaaactcctgagcaacattactatttgtccaagcttctcggcttcgattactcaattcaatacaaacctggtccctccaaccttgttgcagatgctctttcgaggaccaattgtgataattccggccagctcctccttctctcggtccccaattttgtcttcattgatgatctccgccggactctacatgacagccctacgttcatggcccagttcgataaagtcaaggcccaacctactgcctttcctgattttcaccttcataacgggcttctcttcttcaagggccgtatatggttggatcccaccaaccccttcatccccaaccttctgctcgaatttcacgctacccccttgggaggtcatttgggggttgccaagaccctccatagacttcagtcgagcttccactgggacaccatccgcaaggatgtcacgcgctttgttcgggaatgtcatacctgccagcagaccaaacctagcacccgtcgtcctgccggcctcttacaacccctgccaattccgagtggggtttgggaagacgtttcaatggattttattacccatttaccaccatctcacggcttcacggttgtgctcgtcgtcgtcgaccgttactccaagggtgttcatttcggagccctcccaacccactactccgcctttaaggttgcctctctattcctcgatatggtctgcaagctccacggctttccccggagcatcgtttctgaccgcgaccccgtcttcatcagctccttctggcgggaacttttccggctaagcggtacacggctgcgcatgagtacggcctatcatcctcagtccgatggacagaccgaggtaatgaaccgcatcttggaacagtacttgcgtgccttcgtccactctcaaccctctcagtggttccgtttccttcccttggccgagtggtcctacaacacctccttacactccgggtccggttacaccccctttgaagtaatttacgggaaaccgccgccgtccctcccacagtaccttgccggaacatctaacaacgaggccgttgactccttgttgacttctcgacaggaactccatgacactctccagcgccgtctcctcaaggcacaggcttctatgaaggtccacgctgattctaaacgccaggacattactttcgagcctggccaatgggtatacgtgaggttacgcccattccggcaacgttccatgcatatcactatgaaccccaagctttccaagcgctattttgggccttttcaaatcattgctcgcgtgggacaagttgcctatcaccttcgtcttcccgcagccgcccgcatccaccctgtcttccattgctccctcctccgtcctcaccatggaccgcttcccccttcacccgataactggcccctacaagttattgaccataagcccgtccctcagcccttatccttcctcgcaaccaaaactgaccattctacgtctcccccaacccgttacgtgctcacccagtggttaggccaacctcctgaggacacatcatgggagccatggcaggagcttcgtaacacctaccaccttgaggacaaggtggtttttgaggaggggggtattgttagcaatacaccagactttataatagaccccacagcagaacccaaccccgcagaacccaaccccgcagaacccaaccccacagcagaacccaacatatcagaaaggcccaaacgagcaaccaagcaaccaaattaccttcaggattatgaagtctga

SEQ ID NO: 69639 - DNA, 1524 bp, Glycine max
  Peptide Sequence Number=SeqID_186417
atgcctgaggctcctagagactccaccaaagactatgttcttgaagagaagaacaagaagattctggacttcatagaggacgtgaccaacaacgcagatgaagtccagaataaggttctctctgaaattctgtcccgcaatgcaaacgttgagtacttgcggcgacacggtgtcaacggccaaaccgtcgaccgtgacaccttcaagaggcttctccctgtcattacctacgaggacatccaaccagacatcaaccgcatcgccaatggtgacaaatctcccatccttaccacaaaacctatcacagagtttctcaccagctctggcacatcagggggtgagagaaagttgatgccaacaattgaggaggagctagggaggaggtgtatattatacagcctcttgatgccaataatgagccaatttgtccccgacctagaaaagggcaaaggaatgtacctaatgttcataaaatgcgagtccaaaacccccggaggcatagtggctcgcccagtcctcacaagctattacaaaagcccttactttagggacagaccctatgatccatacacaaaaggttcaagagtaggtgccatatttgcctctggcttcatccgtgccattaggttccttgaaaaacattggacccttttatgcaatgacatcaaaacaggaaccatcaacaactcaatcactgattcatcagtgagagaggctgtgatgaggatcctcaaggctgatcctaagcttgcggattttatccacaatgagtgtagcaaagggtcatggcaggggattattactaggctttggcccaatacaaagtatgtggacgttattgtgacggggactatggcacaatatatacccactttggattactatagcaatgacctcccacttgtgtgcaccatgtatgcttctagtgagtgttattttggggtcaacctcaaccctctttgcaaacctagccaagtgtcttacacccttatccccaccatgtgctactatgaattcttaccggttaatcgaagcaacaatgagcttgctgtttcaagaccttcaccaacttctctcaatcaggcacaacatgaagaattggtggagcttgttgatgtcaagcttggccaagaatatgagcttgttgttacaactcatgctggattcaagaacaaggcccctcaattcagctttgtttgtagaaagaatgttgccctgagcatagattctgacaaaactgatgaggttgagcttcagaacgcaatgaaaaatgcagtgacacacttggagccatttgatgcacacgtgagtgagtacacaagctatgcagacaccaccacaatcccgggtcactatgtgttgtactgggagctcaacctcaaagggtcaacccctatcccaccttgtgtgtacgaggagtcgctcaacagcgtgtatcgccaagggcgtgtgtcagataaatcaataggggcccttgagatcaagattgtggaacaaggcacctttgacaaactcatggactga

SEQ ID NO: 69640 - DNA, 231 bp, Glycine max
  Peptide Sequence Number=SeqID_186418
cacttcttctctgtccttcatatcttgagagctagagcctctactctggttttcctagataagaggcataccgaggtaggaggcttcctccatagacaatttcaaaaggcattatacgtgtggatgcttcatgtaacatcgttggttgttaacttctcaacggctcacacactgcaacacttacacattgacacttcactcaatgtccttgttggtcagaacctttcatag

SEQ ID NO: 69641 - DNA, 153 bp, Glycine max
  Peptide Sequence Number=SeqID_186419
atgagcaagggaccgggtctcttcaccgatatcggcaaaaaatccaaagatcttttgactaaggactacagctccgatcagaaactcaccgtttcctcctacagcgtctccggagtgcgtattccacattacattgttagtatgttaagttaa

SEQ ID NO: 69642 - DNA, 1170 bp, Glycine max
  Peptide Sequence Number=SeqID_186420
atggctgcaaatcaaagtgagcctacgagctcgggatcgcagaataggggagtccggaacttgccctatcaagagtatctttgccgccgcgaagcaaaactgttaccattgtggaggacaatttgttgttggtcacaaggggagatttcaagattggaaggggagcttgagaatacatttgacaatacagtagaaacaaaggtggagtgtcaatggatggacttatccatttgctcagctggtggatttactcaaccacaaacaatgaaattggaagggctgattcagggcaaaaaagtgttgatttttattgatagtggtgctagccacaactttatttctcaagacttagtgcagcaactaggtttgaaagtgactcctactcaaacctatggagtgagattgggtgatggaaacaagaaaaatgctcaaggctgttgtgagcagatggaggttcagctgggacaaatgaccataacagagaaattctttctatttgatttgggtggtatagatatcatatttggggtagcatggctggaaaagttgggagatgtcaaggtacaggatactgtggatacacaagaagcagtgcaatatggaggttctattgtagaacaaaaacaagtgcaaggggtactggatgaattttctagtgtattttctgagaggaaaggactacctccacctcgggcagtcgatcatgccatccctatcagaacaggaactaatccaatcaatgttaagccttatagatacccttatctacaggcaaatgaaactgaaaagaaagtcagtgagatgcttcatgctgaaattataaggcccaacaacagtccttactcgacccctatgatttcggttaaaaagaaagatagaagttggcgactatgcactgactacagggctttaaataaggtgactacactacaaccatttcttaggaaatttgttctagttttcttcgatgacgtattgatatatagttcatcatgggaagatcatttacaacatttgaggactgttttgggaaccctggttcaacatgagtttactgccaacctcaagaagtgcagttttgggcagcaagaaattgaatatctaggtcacattatttctgcaaagggagtggctatggatacaaggaaaattgaggcagtgcttcaatga

SEQ ID NO: 69643 - DNA, 504 bp, Glycine max
  Peptide Sequence Number=SeqID_186421
atggagacgaggaaaaagagacatttttatgagacaacagaggaatttgaatttctcaaaacgtgttcgtactcacaccgtgctgtactcattagtcttcttccaaagtcaagcaatctctgtgttcgaaatggctcgtacgacgcaaaccgcaaggaagtccaccagaggaaaagcttcgagaaagcaacttgccacgaaagcagcacacaagtccgctccggcgaccggcggcgtgaagaagccgcaccgtttcaggccaagtacggtggcgctaagggagatccgaaagtaccagaagaacaccgagcttctcataaggaagcttcctttccaaagactcgtaagggaaatcgctctggacttcaagaccaatctctacttccacagcagcgccgtctccactctccaagaagtcgcagaggcctacctcgttgtgctcttcgaggacaccaacctctgcaccattcacccaagagagttaccattatgcccaaggactga

SEQ ID NO: 69644 - DNA, 699 bp, Glycine max
  Peptide Sequence Number=SeqID_186422
atggatggcaatgaggctcgattcactgtgctggaatcttcggttacagcattgaaaacaacaaccagcaaattaaaggcgatgaccactgagttgcagaaatcatccaagaaacaaactgaggtgattgcgaagaacagtgggttggaggatgcggagtccgtgacggaacccaagccttcatcagcattggaggatgaagcaagcgagtctgaggaggatttgatactgcattcgtcacgccattattgggcaaaaggggtcaaaatgccagtgtttgaaggggaggatccgttaggatggatcacatgtggagaagtttgtttccgtgcaacacgtccaacagagcgcgaaagtgagattggcctttatcagtatggagggaaacgccttgcattggttccagtattggaagcaaaaggcaaagcggaagagttggaattcgaggtgctggtggctcaagtcttgggtacaaaggaagtgcaattgggaggatattttttggcgggacttcgcaatgacatctgcgcaaaattttgtccccacaaaccgaaggatctgtcaagtgccatggagttggcggctgatttcgaggaatttgaaaaagaagggaatctagagattgatttgcatagtcgtgaatttcattttcaacccaagggaggaacatggatagcagtgttggaggatccactatga

SEQ ID NO: 69645 - DNA, 966 bp, Glycine max
  Peptide Sequence Number=SeqID_186423
atggataccacgttgtttagggtagtgagtagtttccaacaccaacaccaacccgatcacgatcaatccctcaacaactccaccacaagcagcagctctcgatcctccagacaacaacaaaactatccctacccacaagaagacgaagaatgcttcaactttttcatggatgaagaagacctatcctcgtcttcttccaagcactattgtccctatcaaccccaccctccctccactaccaccatccaccactccttctcccccactccctgcgactttgaattctccggcaagtgggcccaggacatcctcctcgaaaccgcacgggccgtggccgacaagaacaccacgcgcctccaacaactcatgtggatgctaaacgagctaagctccccctacggcgacaccgaccagaaactggcctcgtacttcctccaagccttcttcagccgcatctcccaagccggggaccgaacctaccgaaccttagcttcggcctcggagaaaacatgctccttcgaatcgacccgcaagacggtgctcaagttccaggaggtgagtccctggacaaccttcggccacgtggcgtccaatggcgccatcttggaagccttggaaggcgagcccaaactacacataattgacatcagcaacacctattgcacccaatggccaaccctcttcgaagccttggccactcgaaatgacgacactccgcacctccgtttaacctccgtcgtcaccgctgacgccaccgcgcagaaactcatgaaggaaatcggcgccagaatggagaaattcgccagactcatgggcgtgccctttaaattcaacgtcgttcatcacgtaggtcaactctctgacttggatttcagcatgttggacattaaagaagacgaggccttggcgattaactgcgtcaacaccttgcattcgatcgccgccgttgggaaccaccgtgacgcg

SEQ ID NO: 69646 - DNA, 1980 bp, Glycine max
  Peptide Sequence Number=SeqID_186424
atggggaagaagcagcacagcaaagacagaatgttcatcaccaaaacggagtgggcaacggagtggggaggcgctaaatccaaagaaaatcgcactcccttcaaacgtcttcccttctattgctgctcgcttacgtttacgccgtttgaagaaccggtctgcacacctgatggcagtgttttcgataatatgaatataactccctatattgtaaaatatggcaaacatccagtcaatggagctcctctcaagcatcaggatctcattccactaactttccacaagaattcagaaggagaatatcattgtccagtgctaaacaaagttttcactgaatttacacatattgtggcagtgaagaccacaggaaacgtgttctgctatgaggctgttaaagagttaaacattaagacaaaaaactggaaggagctcctcactgatgagccattcactaaggatgaccttataaccattcaaaatcctaatgcacttgacagcaaggttcttctggattttgatcatgttaaaaatagtttgaaagttgatgatgaagaactacagaaaatgagttcagatccaacctataatataaacatgtcgggtgatataaagcaaatgcttaaggagcttggaactgagaaagggaaggaaactgcattgcatgggggaggcggtggcaaggcacaaaaagaaagggctgctgcacttgctgccatcttagctgcaaggtcacgtgttgaagaagattccaaatcaaatccaaataaagaggccaaagctcctcaggcatttagtgttgttgatgctgcatctgcttcagtacatggaagaagtgcagctgctgctaaagcctcagcaggtgataaaactgcagctagaatagctatgcatgtggctggtgacagggcaccagtgaatgcaaagatggtaaaaagccgtttcacgactggtgctgcttcccggtctttcacttcaacatcatttgatccagttacaaaaaatgaatttgagtatgtgaaagttgagaagaatccaaaaaagaagggatatgtacaactgcatacaacacatggtgatttgaacattgagctgcattgtgatataacccccagggcatgcgagaacttcatcactctttgtgaacgtggatattataatggagttgcttttcatagaaacattaggaattttatgatacagggcggtgatcctactggtaccggtcgaggaggtgaatctatatggggaaagccttttaaagatgaactcaactccaaattaattcactccggaaggggtgtggtaagcatggcaaacagtggcccacacactaatggttcccagtttttcatcttgtacaagtctgcaaatcatctaaacttcaaacatacagtttttggaggagttgtgggtggcttgactaccctagcggcaatggaaaaggttcctgttgatgatgatgaccggcctctggaggaaatcaagataacaagtgtcacgatttttgtcaatccttacacagaaccagatgagggagaagagcaggataatgccaaagagaagaatgcagaggatgaagataatgataaggtaggctcatggtatagcaatcctggcgctgcaacgtctgtttctggaggtacgggggctggtggtggcgttggcaagtacttaaaagctaggagcactcaagctaaatctgctactgttgacaacaccggtacagacgttgtagtaaagaaaagaaaagtgggagttgccagcagtgaatttaaagatttttctgcatgggaatttctcttattcctgttcagtaatcagttgtctggcgtgaatgctaacttcagccttgggtgtcattcccaagggcacttcaagtcagtgagcctagctagttttttcactgactttagtgatggatttctggtcacactttggcatcgtatacaggggatgtacaactcagagtacagaaaatga

SEQ ID NO: 69647 - DNA, 1392 bp, Glycine max
  Peptide Sequence Number=SeqID_186425
atgaggggttggaaccaatttgagaccatctacgaggaagaacaggagctttcttcaacctcctctccctttctttcaccatcttcctcctcttctcctcctcctcctccatcactccactccatagtcaatgcttggtctcttgactccgggtctgaaccagatgtcttgatatgtgttcaaggaacctcttttcgtctgcacaagtacaaaaatccctcaaagaaagttcgtttgatatcacgaagttcatacctcaaacgacacctaacgggagtttctgacttaactctctccccgccgttaaacttaacggccgagactttcgccgcggtagccgaattctgttacagccgcagagtccacttaacgccgagcaacgttgccgccgttagagtggcagcggagttattgggcatgacgggggaagagaatctccgtgaagtaacggaatcgtactttgagagagtcgttggcattggcgcgtcgatggttctgcgttcgtgcgtggctctgcttcccgaagccgaaacgacggcgtcgcttgccagcaggtgcattgaagcgttggtttgggaagacgacgtttcgtgtatgagcgacgtcgtaggaatgcaccctcaggattttcaaacggtttcgtattcactgaacagacggttacccaaccacgacgttctatacaagatggttgatctttatcttaaggaaaacaagtgccgtaaactaacggaggaacagaaaacggagatatgcaacagcatagattgttctaagctgtcgccacacaccctcgtgaactgtgttcaaaacccacaaatgccgctgagattcatagtgcaagcgatactgatggagcatctcaacactcgccgctccgtcactgcggcggccaccaccggtgcacaacaacaactggaacgaacgacgctaagagaaattctgcagcgtgacacggctgatcgccaaacgacacagatcaaagagaccatggattccacctactctcgtattcaaagcctcgagaaagagctaaggggaatgaagaagatccttcatgaacatcaccaagccgagggtgagaagataaggaataataatgtgttgaactcagagcgttctgcgagtttccatttcgatccagcagatgcagagagcagtaaaatacagaggggaggaagagggtccgtttcgtcttcgggttttgggcttgacaacgtaaggaggaaaaataaggaagtggccggggggatgtgtaatttgtctgtgggatcatcatgtcgtcatgatagcaagaccccaaaaatgaccaagttttttcgccatagtaagttcataactggtctcaagaatgcttttcggatatcaaattctacgtcaaacccctactga

SEQ ID NO: 69648 - DNA, 477 bp, Glycine max
  Peptide Sequence Number=SeqID_186426
atgaagtttaaccctagggtttcctcaagccgtcgcaagagccgcaaggctcacttcaccgctccgtcgagcgtgcgccgcgtcctgatgagcgcgcctctctccaccgatctccggtcaaagtacaacgtgcggtccattccggttcgcaaggacgacgaggttcaggtcgtgaggggaacctacaagggccgcgagggcaaagtggtccaggtctatcgccgcaagtgggtcatccacatcgagcgcatcacccgcgagaaggttaacggctccaccgttaacgttggcattcacccttccaaggttgtcgtcaccaagctccgaatggacaaggaccgcaaatccttgctcgatcggaaggccaagggtcgcgccgccgccgacaaggaaaagggtaccaagttcgctcctgaggatattatgcagacctttgagggtcttgtggtttggatcttaagggttccgctattgtga

SEQ ID NO: 69649 - DNA, 147 bp, Glycine max
  Peptide Sequence Number=SeqID_186427
gattgtggaaatttatggacgagatgcagctggtaagactacaattgcacttcgaattattaaagaagctcaaaagcttggagtctgtttatggagatttctgttcgagattcttatgagtactgatgatgttaataagggactgga

SEQ ID NO: 69650 - DNA, 1803 bp, Glycine max
  Peptide Sequence Number=SeqID_186428
atggcaccttccttatgtctatcccttccaaacacttccaccttctctgatttcaacaagctacactgtttctgtttccacccaaaaaaaccgaaccggcaatttatgtctggttgggtcccagaagctcggcccgtggcggcccatttgggttaccgaaagaagcttaatgcgttgagccaagatggagagagctaccacgggacgatggaggataagcaattcgatatagctttccttaatcacctaggtatccgctttgttcttgttccggggacacatgtgcagatagacaagcttctgaatgagagagggtgccagcctaagtatgttggtagatataggataactgatgatgaatctctggaagctgcgatggaagcagctggaggcataagattgatgatagaagcaaaactttctcctggaccttctatatgcaatattcgtcgacatggtgacaatagtcgatggcacgaagttggtgtcagtgttgccagtggtaactttcttgcagccaagagaagaggggtggtcaatggaattgattttgggtcaactggggaagttaaaaaagtagacgtatctcgcatgcgtgagagacttgatggtggttgtgtagttatattaaccaacttgggctactccagctctggagaagtattaaattgcaacacttatgaagttgccacagcttgtgccttggctataggggcagacaaattaatatgccttatagatggtccaatacttgatgagagtggacgcttaattcgtttcttgccacttcaagaagcagacatgctaattcgtaaacgggctgagcaaagtgaagcagctgctaactatgtgaaagctgttgacgaagaaggtttcaactctcttgagtataacaattttaatggagcagtcaaatcaccacctattggacgttttacagaatggcataatgcaaccttccataatggtgttggttttgagagtggaaatggcttagggtctggtgagcaaggttttgctattggaggtcaagaacggctaagtcgaatgaatggttacctgtcagaattggctgctgcagcttttgtttgcagaggtggtgttcaaagagttcacttgctggatggaactattagtggagttttgttgttggaattgtttaaaagagatgggatgggaacgatggtggctagagaaataggtggtaaggtttggggctatgacactgtccaactatttaagtatagattagtgggcatcctagtggatttcctgctggtggcaccatacaggtcacatattgacctttatgaaggcactcggacagcaggggtaaaagatatttctggaataaaacaacttattcagcctttggaggcatctggcatattggttaagcggactgatgaagagctgttaaaaacattggattcgttcattgttgtggaaagagaaggtcacataattgcttgtgctgccctttttcctcactttgaggagaagtgcggagaggttgcttgtattgcagtatctcctgattgccgtggccaaggacagggtgacaaattgcttgattatatggagaagaaagcatcatctcttggattgaatatgcttttccttcttacaacacgtacagcagattggtttgtaaggcgtggattttcggaatgttcaattgattatcttcctgaaaagaaaaggagaatgatcaatctttcccgcaattctaagtattatatgaagaagcttctgccaaatattagtggaattactgttggtgtaaaatctgcttcaagttag

SEQ ID NO: 69651 - DNA, 648 bp, Glycine max
  Peptide Sequence Number=SeqID_186429
atgggtgctcctaagcagaaatggaccgcagaggaagaagcagcattgaaagctggagtagtcaaacacggggctggaaaatggcgcaccatacttacagacccagagttcagttccattttgcgcatgcgttcaaatgtagatctcaaggacaaatggaggaacataaatgtgacagcaatatggggatcgaggcagaaagcaaagctagctcttaaaaagaacctactaccatccaccaaaattgacaataaccacttggccttgagtactgtagttcaacgtgacaaagaagttgcaaatcccaagcctttggcagtttctagtgggacatctcctaattcaaaggaaaaaatatcgaagctacagaacttccagcccaaagattctccaaaagcagagaagactggtgtcaacatcctttcaaaatccgaaattgatgcagagctatcgaaaatgaagggtgtgacacctcaagaggctgcggcggcagctgcaaaagcagttgcagaggcagaagctgccattgccgaggctgaggcagcagctagggaggcagatgctgcagaagccgaggcagaggctgcacgagtgtttgcaaaagcagcaatgaaagcactaaaatgcaagacacttcgtatttggtaa

SEQ ID NO: 69652 - DNA, 1536 bp, Glycine max
  Peptide Sequence Number=SeqID_186430
atggtggtttcggggcttgtacactcagttgcaacttccatttgtcaaagcatcttatggatggacagcgcagttgatatctggaaagatttgaaagcccgatactcacaaggtgatttgcttcgaatttctgatttacaacataaattagcttcaattaaacaaggagacatggatattactgattattttacaaagctaagaacaatttgggatgagcttgagagttatcgagccgatcctgtgtgtacgtgtgcttctaaatgtggctgtgatgctcttgttgaagtaaagaaaaggaaagatcaagatagaataatggagtttatgcgtggtctcaatgatcaatacaatcatgttagatcaaacatactcatgacggatcccttgccatcgattaacaaagctttctcttatatggcacaacaagaaaggcaatttgcaagttctgatgcacttggcaatctgagtttagttaatgctgctgctaatacaagattatctaattcttgcagttactgtagtagagacaatcacacagtagaaacatgttataagaaaaatggttttccacctaacttcttctctaagacagaacctaagtcatttaaagaagcttcccaatcagacaaatggatcaaagcaatgaatgttgaaattgaggctttagaggctaatcatacttggattttgactgacctccctcctaacaaatctgctattggctgtaaatgggtttataaagtcaaacacaaggctgatgggtcagtagaaagatataaggctaggttagtagccaaggagtatactcagattgagggtcaagactaccttgatactttttccccagtgactaagataactactgtgagattgttacttgcattagttgttgttaacaactggcatttaaagcaattagatgtgaataacgcctttttgtatggagaccttaatgaagaagtttacatgactttgcctcctgatgatattgtcttgtcaggcaatgatcttctagagattaagtccatcactcagcttctggatgaagtttttaaaatcaaagaccttggcatgttaggaagcaaacctgtctttactccaattgattatgctgtaagactacaccaacaatctggaactccacttgatgatacaacagcttcatcatatcgtaggctcattggtcgccttatttacctcaccaatacaaggcccgatatcacatttgcgatgcaacacttaagtcaatttgtagctcatccttcttcagctcatcagcaagcagcctataggattcttagatacttgaaagcagcaccaggttctggtatatttttctctgcttccagcatattgcagctcaaagcatttagtgactctgactgggcaggatgcattgataccaggcgatctatcactgactactcagtttatcttggtaattcccttatttcttggaaatccaaaaagcaggccacggtctctagaagttcttccgaggctgagtatcgggcaatagccagtgctacatga

SEQ ID NO: 69653 - DNA, 337 bp, Glycine max
  Peptide Sequence Number=SeqID_186431
ggtttactttgaggcgttggacgagagttttccgcggacgagcaacgagaggttgttgctggagagggcggcggggagggcggtggtggacctagtggcgtgttcggcggcggagtcggtggagcggagagagacggcggcgcggtgggcgaggaggatgcatggaggggggttaaatacggtggcgtttagcgaagaggtttgcgatgatgtgagggcgttgctgaggaggtatagggaggggtgggcaatgacacagtgctccgacgccggaatattcctgacgtggaaggagcagccggtggtgtgggccagtgcatggagggccttgacgtag

SEQ ID NO: 69654 - DNA, 972 bp, Glycine max
  Peptide Sequence Number=SeqID_186432
atggagattttgatgttcgaaacaagcattatgtggcttctgcggcatttacaggagtccacggctacgcatttgcatgcgtcaggttgctgttggctctgcttcattaccttgtttggacaattactatctccacatttccttcctacttctcttcttcacctctctcgccatacaaaattggaattgaggcaattggggtggtatgacagaattgcttccagttttgtcctggtcactagtcagaagaccctacggaggacagaaaaactgaaagaatgtgtcgagggtataggagaagatgcccttaggaccataggcagagtcatgaaaacaacgaaccaaatgcagatcctcttgcttccgtataatccacagatatgtgtatgtagcgcatttgttgttctgacagtcaacttagtgacactggttgcagcactagttctaatgctattgcattggcgtcctggatttataatctttgcagaagatgcatgcttcgcttttgaagacttcctggaaaatcgtcaaaacagttgcctgggttcgatgttgccctgcattgatgaatccttctctgggaaattgatagctcaaattggctacaccatccacagtttcatagttgagttaaattctaatatgtcggtgatttatcggctcctaggagcgagtgaagaaaatgaagaactaatgggagtcataaaaatttgtgaccctttctctggatccccaaacttgagctacgttccacatagctgccctcaggatgctatttggattggtgatttatcaaaaattcttgcaaagttcacgtgtcacgaagagggcacaagagaagaatgcagaaaagaggggagatttcttccagaagcctcatacaacatggctcatgcttatagtagatccatccaggatttgctggggatatgtatccagacttacaaagactgtccaaatgcaccgctgtga

SEQ ID NO: 69655 - DNA, 399 bp, Glycine max
  Peptide Sequence Number=SeqID_186433
atgactagggtagtactctgtgtgaggaagactttgattctcaatcatgtcacctttaatatgctacttttgtatgttatcgtgagtcatatccttaacttaatcctaaaaattcatctagtggagggtgttatgatctgtgctcaagtggtaaaaaataaactagcacccgcagcaacgaaaagggctgaacagggtatcaagtttggaagagggttttgccatgagtcagatgtcttagatttggcttgtgaacatggaatcattgtgaaacatgagggaagctactttattgaagggagcagtttggatagtagagaagcagctgaactatttttggctcaaaatgatgcagtttgtgacaagttggttagggatatgacaagactttatttttaa

SEQ ID NO: 69656 - DNA, 768 bp, Glycine max
  Peptide Sequence Number=SeqID_186434
atggcgatggcgggcactcacactcggcaatctgcttggtttcttcgcctgctctgtctatgggcttctgcagttctcgtattcgctgatgaacgctccttatgtcttactcaaaattccacactgcagctatcccgtggcttgcccgtgggaaattctcctgcttctaagcctggtgctactgtggttgtcgaaagagttcatatacatggactgtcaaggtttagaaacttggggaaatttgcacattcctttaaagtgaaggtgttgccactgcctacaaactcaaatgttcgcctgccaaacatagaggtttgtttccataggaatgtgtctcttgtagctgggatgtgcccacatgggcagtgggagaaagttaccaaaggttcttgggctcgatcaatgtctccttttgaccacaagatcttagacataaggactactggttccacactggaaaattttgaggtttctgttgaagaagtcaaccataccttcaatttcaattcttcctctcaagaaaaccattcttatgcattgtttgtagatctaatgcagatttatgtttctgttcgttcatcttggatggtctcagtgggaatgaaacttcttccaactggtcgcaagagttcccttgctatatttttatattcaactgctgttggttttgggacttttctcctccgttacattcctggtctagttcgttctgtactcacagagttaggaattgatgaagacatgtataatcctgtatctatcagataa

SEQ ID NO: 69657 - DNA, 462 bp, Glycine max
  Peptide Sequence Number=SeqID_186435
atgtacgtttgcagagtcactacctacgactttagccatctcggtcacacttgcgctatcgtttccttcgataacctctttggtgctgttcttcattatggccatgcagcagctcctaatggcaatacttgggaagataaagacatggcgttgtttgatatgggagctgattaccatttctatgggtgttgcttttatgccacatggtctggggcatttcttggtattgacacacatgaccctagaggctacttaaagggcctagaaataagaaaggaacctggattaaaatctctgcggacaatcatagatctccgggaaggaatggttatcattgtgaagcctggctactacttcattgatgctttgttacttgctgcaactattaacaatcccattatctcttcccttgcgatcttagacactcgttgggaagacttaaggcatggtccgcgtttctga

SEQ ID NO: 69658 - DNA, 261 bp, Glycine max
  Peptide Sequence Number=SeqID_186436
atgtgttcgaggtcgttgtcgttggtgacaaagatgagggcatcgaggtctttgtcggagagccgatacttaaaggtgaggcggggagtcatagagggcgacgaccttggagaggaaggcggggaacttaatggagcggtcgacggtgaagatcttggtatcatcgccgacgtaggaaagttgattgtcgtgttttggttctcttgctcatcccgcagtgagaggttctcgaagttgatctcgcgtgagcgcgaggagtag

SEQ ID NO: 69659 - DNA, 567 bp, Glycine max
  Peptide Sequence Number=SeqID_186437
atggcatacattatgctcaggctcgactatgctggaattgcagccctgatatctacctctttctatcctccagtatattactcttttatgtgtgacccatttttctgtaacctatacttgggatttatcactgtattgggcatcgcaaccatcttgttttctcttctcccagtgttccaaaatccagaattccgcaccatccgagcatctctcttctttggaatgggtttgtctggtgcagcacctattctgcacaagctttatctattctggggccagccagaagtgtttcacacaactgcttacgagattctgatgggtgttctctatggaattggagcattggtttatgccactaggattccagaacgatggatgcccgggaaatttgacattgccggacacagtcaccaattgtttcatatattggtggtggcgggggcatacgctcattatcgggcaggtatacactcctctaactggtgtgaatttgtgattccagcaggggatgtttctgcagccatagggattatgtacacacttagaacccttagcacaaatcactag

SEQ ID NO: 69660 - DNA, 546 bp, Glycine max
  Peptide Sequence Number=SeqID_186438
atggcagaaaacgaaggttcaacgaagccatcgttaatatgctatatccctctcccgattctcctcctcaaccacaagtactatctttctgcctttccttcttcaactttgtttttttttaattcgatggagttggaacctgtggaagcagcttttatcgacgacgggtctggttctgacatcatttcagacaatttggacgattgcgacaacaacgcctccacgagcggcaacgaagaacatgatgactctgagacgacggagaagctcacaagggttcaacgaaagaaaatccgtaagaagaagctgaatgaagaagccattcatcgcggaaaactaattgggccgttgttgccacctccgatgctccagctgttatgccacgcacaactttgtttaggtgatgatgtggcggcttgtgctaaatcagtgaaagtgaagcaacggagaatggcaaaaaggctcgccaaagaaaagcaaaatgccactacttcggagaacgccaatcaaagttccactgtagatatcaaagaaacccatttataa

SEQ ID NO: 69661 - DNA, 717 bp, Glycine max
  Peptide Sequence Number=SeqID_186439
atgagggcattgttgttgatacctatctccaagtggaaagatttaaaagatgacaaggaagcaattcaagtattggaagaggtatacgatgatgacgttgaagagcttgaagtgctagtaggcctgatggcagagaagaaaataaagggttttgcaatcagtgagacaacttatgtaatattccaactcatggcaaccagagatagtacatgcgcatgtgtcacggtgatgagaaagatcatcaacttgagttttgtaagtagttctgatctcataaatgccaagcttgaagagcatcagttttatggatccaagcagtgcctcggttgcaaacacaagtttcaagggaagctgattcacggtgtagtggaagataagaaaggtacaacagtggcaactctatttgagaaatgggatgagagcttgcattacgtaattggagggaattttgggaagcgaagcctaacaccagagtaccaaacaagatataacgtcacacaattttctattacactatatgaaatcacacctagattaaaggcacaaaagatgaaagagaaaggttggaaaccacggtggtttgccaaggaaaaaggcaacaactcttaccattatgttggagggtactgggagactagggaaaaggagaattgggagtcttgtcttgacatttttgaccaagcctcaactgatactgattttaagcaaacttcataa

SEQ ID NO: 69662 - DNA, 1350 bp, Glycine max
  Peptide Sequence Number=SeqID_186440
atggttaaatctgaactctccaatcactaccacaacaacaacaagtctcccatgatgatggcgaagccccacagaaacaaaagctcctctttatttctctccgatggatgtctcttcctcggaggagcattctccgctctcatcctcgtctggggtttctcctccttcaccaccaccatccctaacgacacccccaacttcgaatctctttcaaaaaacgacgccgcttcgcaccacatcgctcccgatttcaacttcgacccacccgacagaacattctacgacgacccgcaaatgggttacaccatggacaagaaagttcgcaactgggacgagaagcgcgaggagtggctgaaactccacccttccttcgccgccggagcgagagaaagggttttcatggtgaccggttctcagccgaagccgtgccggaaccctacaggcgaccaccttctcctgcggttctttaaaaacaaagtggactactgtcggctccacgggtgcgacattttctacaacaacgcgctgttggaaccgaagatgttcgcgtactgggcaaagtacccagcggtgcgggccgcgatggtggcccacccggaggccgagtggatctggtgggttgactcggacgcgctgttcaccgacatggagttcaagctcccccttgagcgttacagggagcacaatctcgtggttcacggctgggcccacctcatacacgagaagcggagctggacgggcctcaacgccggcgtgttcctcatcaggaactgccagtggtcgttggacttcatggaagcgtgggccagcatgggcccacagagccccaattacgaaaagtggggccagacgctgaggtcaactttcaaggacaagttcttcccggagtcagacgatcagacgggcctggcatacttaatcgccatggagaaggataaatgggcggagaggatttacctagagagcgagtactacttcgaagggtactgggaagaaattcagggaacgttcaagaacataacggaaaaatacaaggagatggaaaaaggggtgcagaggttaaggaggcgtcacgcggagaaggtgagtgaaacatacggggagatgagggaagagtatttgaaggatgctgggaacgctaaagggagttggaggagacccttcattacgcacttcaccggctgtcaaccttgtagtggaaagtataatgccatgtattcagcccatgattgctggaacgcaatgcacaatgctctcaattttgccgataaccaagtcatgcgtaaatttggttacagtctactggataacgccgtttcccctctcccttttgattatccccgtcattga

SEQ ID NO: 69663 - DNA, 363 bp, Glycine max
  Peptide Sequence Number=SeqID_186441
atgaggaatcgggatagtttatacacctgttcatattcacacttatctttacacaccagacatctatttgctgaaatagcttaccaaataacacaagttccccgagagttcgatactcggttcttaccattttatattacttatgatattcggtgcacttgccagaagccgaacagtataggacggggtcggggatacccgataccttatgggtacggggatgggataataaactttaacccgtcgagtatcgggtacgggtatagggatatgttggggagtcagggtcagagattggggagacaatacccttatccgcctcacctcactgccatgtctatgcatgatgatcacattaattag

SEQ ID NO: 69664 - DNA, 1104 bp, Glycine max
  Peptide Sequence Number=SeqID_186442
atggctaattgcagaaaacaacaaggagagggtcatcatcaagtgggtcactggcgatcctcctacaacaggaagccacccttgggaaataagtggcattcaacagtgcctgcctgggaaaggaaattctgcacttcaattggctcagttccatggcgaaagctagtagaaagcaagaagtatatgcacctgtttgaacatgtggtgaactgggatgactctgccggcaaagaggcatttgacaatgcaaaaacaaggtattgggctgagatcaacggtgttccctgcaacatttcgccacctgatcccaacattttcatcgatgaagtagattggaatgcaactgttgaccctcaacttattctagacgtggaaacagaattagcaaaggtccccaatgaggaactaaggaagaacgatcatgagattgtgatgattggtggcgctctcttcttgaacgagcaaaagcttccatgtactggatgggacgatgattatgctgccgaaggaccaaagccttttgatccaaattctgctgtccaaggctggggggaaaatctgcaagaacacaatggagtagaatctgggaaactgaatcatgctcctgctgaacatgcaggtgaacatgttgctcctgctgaacctgcaaaagaagatttttctcttgctgaacctgcaaaagaagatttttctcttgctgaacatgcaaaagggcatgaatggcaagattggaggaatgattcttggggttggaatcaaagggagaactatggtggtggtggtggtggtgacttgcacaaaatgggaagagggagaaatggtggaggagggtatggtaattggggaacatgggatggttataacagaaggagagaaaacaacatgtcatggtctaagaccccttctgcatataatggtaacaatgagtatcatgtgaataacaataggggaagaagaaattatagaggaggaggaagaaggggcaattttgtttatgtgcctaaggaggtgcctcctactcctactcatgctggatggtttatggtatattctagtacctgccgtggtgataggtttatgtatattcagagaaaatatgcatag

SEQ ID NO: 69665 - DNA, 1074 bp, Glycine max
  Peptide Sequence Number=SeqID_186443
atgttgtacgcagccttacccttgcatatgcaaagaggctgtttccggattcgaacccatgaccaacaagtcactaaagcacaactttaccgctgcaccagggctcgccctcagatatttgatgcacaatccggggtatgttatggaagacttggcaacaacttaccaacccctcaagaagttgtggccctctacaatcaagccaacattcgcaggatgcgaatctacggtccaagcccagaagtcctcgaagcactaagaggttccaacattgagcttttgctagacattccaaatgacaacctcagaaacctagcatctagccaagacaatgcaaacaaatgggtgcaagacaacatcaaaaactatgccaacaatgtcagattcagatacgtttcagtgggaaatgaagtgaaacccgaacactcatttgcacaatttctagtgcctgcattggaaaacattcagagggccatttctaatgctggccttggaaaccaagtaaaagtttccactgccattgatactggtgccttggcagaatcattcccaccatcaaagggttccttcaaatctgattatagaggagcatatcttgatggtgtcatcagatttctagtgaacaataatgccccattaatggttaatgtgtactcttacttcgcttacactgcaaaccctaaggacattagtcttgactatgcactttttaggtctccttcggtggtagtgcaagatggttcacttggttaccgtaacctctttgatgcttcggttgatgctgtttatgctgcattggagaaagcaggaggagggtcattgaacatagttgtgtctgagagtggatggccttcttctggtggaactgcaacttcacttgataatgcaagaacttacaacacaaacttggttcggaatgtgaagcaaggaacccctaaaaggcctggtgcaccccttgaaacttatgtgtttgccatgtttgatgaaaatcagaagcagccagagtttgaaaaattttgggggctcttttctcctataactaagcagcccaaatactcgattaatttcaattaa

SEQ ID NO: 69666 - DNA, 1350 bp, Glycine max
  Peptide Sequence Number=SeqID_186444
atgccgatgtttcagccttgtcggaaggacatggttactgggtacgagggtggtgccgatggccagattctagatctggacaccgccgtgaaagacggcgttttgggcggcgtggagggcggcgttgtgggaggcggggttggtgagaaggtggatctggggaagatgattgaggagcttgagttatgtgaagtgccgagtgtgttcatttgcccaatctctttggaaccaatgcaagaccctattaccctctgcacaggccaaacctacgagaggtccaacattcttaaatggttcaacttggggcatttcacctgccccaccacgatgcaggagctctgggacgattccgtcactccgaacaccaccctttacaggctcatacacacgtggttctcgcagaagtacttgctcatgaagaagaggtctgaggatgttcagggaagggcttctgaacttctcgagacactgaagaaggtgaagggtcaggctcgggttcaggccctcaaggagattcaccaattagtggcttctcatgccactgcgcgaaaggctgtgattgatgaaggtggagtttctgttgtgtcttctttgcttggtccttttacttcccatgccgttggctctgaggttattggtattcttgtgactttgacccttgattcggaatctaggaagaatctcttgcagcctgctaaggtttccttgatggtggacatcttgaatgagggttccattgagacgaagatcaattgcacccggctgattgaatcgttgattgaggagaaggattttcgatcggaggttatatcgagtcatagtctcttggttgggttgatgaggcttgttaaggataagcggcacagcaatggagtgtgtcctgggttgagtctcctcagaacaatttgtttgcataaggaagttaggaatttgcttgtgagcattggggctgtttctcagttggttgaattgttgtctggcatggagcctgattgtacggaattggccctttgtgttttggatgcgttggcgtcggtccccgaaggtagagtggctttgaaggattgctctaacaccatacccatcatggtgaagctgttgatgaggatctcagaaaactgcactcagtatgctttgtcgattctatggtccgtgtgcaagctttcacctgatgagtgctcgtcgattgcggttgatgcagggcttgctgcgaaactcctgctcgtgattcagagtggttgcaatcctatattgaaacaacagtctgctgagcttttgaagctgtgtagtttaaattattcagatactatctttatttccaagtgcaagcttaccagaaccatccaatga

SEQ ID NO: 69667 - DNA, 219 bp, Glycine max
  Peptide Sequence Number=SeqID_186445
atgccaggcagagatagagagagggaaggaaaccaagaaaacaaaccccctaaagatcagtgcaatgagaaagagaagaaagaaataattgagaagggagatcagagaataatgatggaaaacagcaagaaggcttggaagttaaaagaggtgaagatggtgaaccaaaaggaccgtaccaccatgggctacactacagagtgggaagagaagaagtag

SEQ ID NO: 69668 - DNA, 297 bp, Glycine max
  Peptide Sequence Number=SeqID_186446
atggcagaatggtgtcgcggaatttcgaaaaaacatcaccaaatagcggaggcattgcgggttgcatatggcggcgccatggcggccgccatagcatggcagtcatggcagaatcgcgttaatggcggaatagcaggttttttttttaaaacatgcgcgacaggggttgggctgacccgacccaaccctacccgagtttctcctgcaaaaggaaactcggagcgcgagaacaaagccacgaatagaacagtaccacagtctttagcggcgcgatcagcagcagtctccagcgcatga

SEQ ID NO: 69669 - DNA, 1221 bp, Glycine max
  Peptide Sequence Number=SeqID_186447
atggaagtgcagttagttgataatttccgtagaaaaaagaaatggatcttgattctgtgtgcggttggtttgggtgggtttagcgctttcaagctctatcacgcgccttccgtagctcgcaagagaaagaggctttcgaatcttctcagtgcattggtctccgtagcggaagccgtatccgaatctgctgataccattggaatcgtctccagagacgttaaggattttctggaatccaattcagatcaaatccccaacagcttgaagcagatttccaagatagctcgctcggaacagttgtctgagtctttggttagcgtcacccgtgctgtgaccgtgggagtcttgcgtggctatgaatccatgaaccggaccggtggtgaccaaaccggttcaaccgtcgtggaccgggtgcttgacaaaattttaacatcagcagggtcaggttttgcttctgtagttcttggaagctttgctaggaaccttgttcttgccttctattcagaccaacataaccactcaggtagggaatttaactcgagcaattccaattcggaaactgttctagcatgggtggatgtagtttgtggtgataggtgtggggaactaattgggaattgtgttcaattgtttgtgagcaccgcggttgcggtttatctcgacaagaccatgcatatcaacacctatgatgatttctttgctggcttaactaacccaaagcatgagaccaatgtgagggacatgttgttatctgtttgtaatggcgctgtggagactctcgtcaagacatctcaccaagtgataacaagttcaaatgctgatgttggttctggttcggattcatatttatctatcggagaaactgtgagaaatgaggacttgggtgtaggaatgtcgtcggttgaatcgaaagtggatgtttgtgatgatgaaaataagagtggttggctgagcaaggtttcgtctacgttggcggttcccagcaataggagccttgttctcgatgtgaccggcagggtgacatttgagactgttaggtcgttcatggagtttgttttgcagatattttgtgcttctgtgagaagatgtgctcatattgttcatgaggcagtacttgagattgtgagatatgttgcagcaaaatcctctgttatcgtcacaatatgtctctcgttgtgcctgcacataatgggtggaggttgggctttggtgacagcttaa

SEQ ID NO: 69670 - DNA, 1347 bp, Glycine max
  Peptide Sequence Number=SeqID_186448
atgtgtgttgtggaaaagcaggttgatagtgcaaacaggaagggcatattattggagatggtccaagtgttgacagatcttgacctcatcatttccaaatcatacatttcctctgatggtggatggtgtatggacgtgttccacgtgactgatgaagctggcaagaagctcacagacgaaaccctcatgctccacatccagcaggaactgtgcgccactagaagtaaaagggagatttcaagggatacagaaatggttagtcagaaagcaccacaggcacagcaacaaaacgtgccaaaggagaacacagcgttggagatgagtgtgacagaccgaccgggcctactatcagagctatcagcagtgcttgttgagttgggctgcagcgttacctctgctatggcttggacccacaatgacagggtggcctgcattatattcctggaagacgcatcctcacctgggcccataagcgacccagaacggttgggcctagtggaggagcagctggagaatgtggttgcggctcacggcgaaaccggccagaagaagagcgtgagggtgacgacgctgggcaccgggcgcacccacacggaacggcggctccaccagctaatgtacgccgacagggattacgagagttgccgcgcttgtgacggggacagtagcggggagcacaagaagggctgtgatgggacccacgtctctgttggtcgatgcgaggacaaaggctacttggtcgtcaacgttaggagcagagaccgtcctaagctcttgttcgacaccgtttgcgttctaacggacatgcagtatgtggtttttcatgctgccattagttccaagagatccatggctcatcaggagtacttcataaggaactgcaagggtagtttagctcttcccagtgaaagggagaaggaagaactcaccttatgcttaatcgctgcaattgaacgcagagtctcgcatggattaatggtagatattcgaactgataatagaatggggcttctatcgaatgtgacccgggtgtttcgtgaaaatggactatccatatcaagatttgagattggaacagagggagaaaaagcggtaggatcattctttgtcacggattcttcaggtgaagaagtgaacccagacatcgtggaattggtaaggcaagcttccggtggatctgttgttactgatcacaagtcgccacatagggtgcatcaatcatcctcctcctcggatataaatgaaaccatgggcagtatggaacctaaaccaaaattctctctaggaagcttgctatggtctcgattagaacgcctttccggtggttttgggccccttagatcctga

SEQ ID NO: 69671 - DNA, 1401 bp, Glycine max
  Peptide Sequence Number=SeqID_186449
atgtcgtggtttgcaaggacaatcgcaaactcactcagactcgacgacgacgacgacgaccacaatggcagtgacctaaaatcccctccgaagaaacccgattccgtatccacccccagtcctaccgcgcgcggcgtcaaagaggatttctccgagctcaccaaatccttttcccgccagctctggggcgtcgcctccttcctcgccccgccgcccgatcccctatctgaaaatcccgtcgccgatcccaatcccattcccaccgacgaagaagaagaagacgtaattgcaggtatccgaaacgatttcgcggagattagtggcaagttcaagaacgggatcttcaaaatctccggtaataagacggtatccgaattcaccaagatcgcttccagtttccttcagcttggatccgaagaggaacacgatctcgacggtgtcctcggagttacagaggatgtggttgccttcgccagaagcgtagctttgcatccagaaacttggctcgattttccccttcccgatgatgaggattctgatgattttgatttgtccgatgcacaacaagaacatgctctagctgttgaacatctggcaccaagcttagctgctcttagaatggagctgtgccccggatacatgagtgatggtaacttttggaagatatactttgtactcgtgcaccctagacttagcaaaactgatgctgctattttatccactccacaaataatggaagctagagcgatgttgactcaggctttagacaaaagaagtaaggaaaagaaagaatctgacttatctgcaggagggaatattccctcaaaagaggaggaacagcatctctttgtgccaagcaatgctcaacttgaaccagtacctctccagacatctgctgctgaagctgccccatctgtggttgtttctgatgttgagatggagaaacatgttgttccggagattattgacaagtctgtggttaaagaagcaccagtaatttcatctgcagaacaatcatcatctggttcaaccaatagatttttggatgaaacctatgacgatgatgctgatgattggttgaaagaagaggatacttctgaaatggttggtcccagtggaacttcagttcacaccgggaatgacgaggatgtgtcattcagtgatcttgaggaggatgatggtgatgtacatgaaagttataaaaaaactagatcaggctctgattcttcaacaaaagactctcgagattgggttcagttaggtagaagttcgcctaactctgataaggatataaactctgttgaaggcaaacatgttggctcccagcattcaagtgctcgtaattctgtgaccaaggattccaatgattggcttaatgttgatgatattgatgtaatatga

SEQ ID NO: 69672 - DNA, 519 bp, Glycine max
  Peptide Sequence Number=SeqID_186450
atgctttctgctatttcttttcagggaaacccattcccggcgttggaatacggtttcacgccttgggatgggcttcactctttgggcttcaagcccaccagccccgaccccaaccacgtcacttcgagttccggttcagacgacccaaaccgaacccatgccgaagaaaaactggcctcggacgagtcgaaccgcgttgcatccatcatggaggagcgaaaacggaggcgaatgatatcgaaccgggaatctgcccgaaggtcacgcgtgcgtaaacaaagacacctagagaacttacggaatcaggtgaacctatttagggttgaaaaccgggaactgaacaatgggttgcagtttctccttcaccacggtaaccgcttgcgaaccgaaaacgagtggctccggtccgaacgagccctgctccgtcaaaaactggccaacataaatcaacttttgcttttccaacaattgcaagcattttcctctgcatggccctgcaatattgtcatggcggaataa

SEQ ID NO: 69673 - DNA, 1779 bp, Glycine max
  Peptide Sequence Number=SeqID_186451
atgaagcctatagaaaatggcaataccgttagcatcaactatcaaaatagctggttaggcttctccctctccccacaaatgaatataggtgttccttcacaccttcatcagacacagccttcatcagcagctgttgaagcagttccaccaaacttttaccatcatacacctctccataattatggcctttactatgaactggaaggtgaacacgttggaatgagttcatccttgcctatcatgccccttaagtccaatgcttctctctctggaatagaagctctgagtagatcacaagcacaagcaacgacaactatttcagcaatgcattcaagcttaaatagtatgcttatcaacgaactcttatgtcatggactaaacaatccaaataacttaaatcacgttcaagaggatatcagccagcaacaattctcgtattactctaccttaaggaaccaagatgtgattttagaaggttccaaacaccagctcccatgtatagctgaggatgaaaatccaggtttgaagagttggttctcaagggattttcatgctagacatgcagaagaatcaaggatgattgttcctttggagtgtaatggaggcgaatctggatccattggatcaataacatatggggatttgcattcatcgaatttgtctgtgagtcctacctcaggatcaagcagtgttacaagttcacctgctctcactaatactgttgccactaatactaagaaaaggtggcttgaaatggtggaccagaatcagaagcaaatagttcataggaaatccatagatacctttgggcaaagaacatctcaatatagaggtgtaacaaggcataggtggactggtagatatgaagctcatctatgggacaacagctgcaagaaagagggccaaggaaggaaaggaaggcaagggggttatgatatggaagaaaaagcagcaagagcttatgatatggccgcactcaagtattggggaccctcctctcatataaatttcccattggaaaattatcaaaacgaacttgaggaaatgaagaacatgacgagacaagaatatgttgctcatttacgaaggcaccaccaacatggaaggtggcaagctcgaattggaagggtagccggaaacaaagatctatatcttggaacctttagtacccaagaggaagcagctgaagcctatgacattgctgctattaaattcagaggagttaatgctgtcactaactttgatataacaagatatgacgtggaaaaaattatggagagcaataaccttcttagcagtgaacaagctaagcggaaaagagagatggatgatggaactagaagcgaggctaccgttaaccaaaaaccttctacatatgaccacactcaagaaaccattctaatgcagaaaagatgcaaaaaccaatcagaatggaagatggttcagtttccatgcccccaacagcttgatcagaatcaaagaatcgagagttgtagaactcagcccttctcaacggacttagataacatgtttcgtcaccaagttgaggaacggagcaacatgggaacacacttgtcaaatccttcttctctggtgacaagtttgagtagctcaagagaagagagcccagataagacaagcatgccaatgctctttggaatgccttcaacagtgtccaaattattggctaacgtggattcttgggatctatcttccaatctcaggactgcgctttctatgcctcagatgccaatttttgctgcttggacagatgcataa

SEQ ID NO: 69674 - DNA, 771 bp, Glycine max
  Peptide Sequence Number=SeqID_186452
atggtgaaatcagccatggctagtgttgattcttcttcttgtaacaatgattcattttcctctaacaacaacattgatagctgtaagatgttcaaaggggtgaggaagagaaaatggggcaaatgggtgtccgaaattcggcttcccaacagccgcgagcgcatatggttggggtcgtatgacacccaagtgaaggctgccagggcatttgatgccgcgctttattgcctacgtggtcaaagcgcgacattcaatttccctgacacgcctcgacacttggaaaccaacatggtattgtcacgtgacaaacagccgcaacctctatcccaccaagaaattcaagaggtagccgtgaagttcgcgaacaacgacgaccaccctttggaggaggaggagtgtgctttccaaaaacaagaacaagaacgctcgttagaggagtcacaaagtgatgagtctaaatccggcaatacaataatggagatgagcaacttccctagtatttatgatggtgagactcataataacaatgtgcaagtggaccaattaaaaggggattgggacaccatggattggacatttttgaacatgttggatgacttgaatggctcggattttggcctctatgtggggctagacaagatgcacccgagtgaatttttgtgtcccatgactcaagctccactactttatcatggagatgatgaaattgaaggtgatgatgatcatgatgctttttctaaccattccttgctttggagttggaacttttga

SEQ ID NO: 69675 - DNA, 225 bp, Glycine max
  Peptide Sequence Number=SeqID_186453
atgccacttagattgttgcaaatttacagaggtagcaggtttagtccaagctcatcgcctctgattacttggatactaatttggatcttatggatgtcttggtatttgggtcattttggtcatggctttatatcaatatgttctggactcactacgaagaagttttttgactacattcagcttccaaattttgacatagctgcagatgccgcagcaacttttaag

SEQ ID NO: 69676 - DNA, 900 bp, Glycine max
  Peptide Sequence Number=SeqID_186454
atgttgagtttgcgatgcgaactagccatggttcctttctccgaaccacgcgtcacggacaccgccatggctacgggagaagatggttatggttacaaacacgatgattcgccgaatcgaatgcggttccatgaaactaacaagatggctcgtcgtttggaagttggaggttggaactatctaactagtcacggcatggaagagagattggagagggtgctgtggggtgaagacatcggagagggtgctgtgggggtggacggcgaaggagcggcggcgagggaagggagcgaggccagcagactagggttcaatgcgaaaggagaatgtggaaggacgccttttgagtgtttgtgtggtggtgatgataacaacaatgacgacgatagagatactagtagtggtcgtggtggtgatagtaacgatggtagtagcggtaatgcatatggtggtgacagtgacaatacaatggtggtggcaatcaataatggtgacattggtggtgatggtggtgacaaatgtagtattagtggtggtgatgatgaaggtggtattagtgatgttggtggtggttgtaatagcagtaacaaaggtgatattggttgtagtgatggtggtgataatgagattgatagtgatagcaataccgataatgatgatgatgtcagtgataacgatggttgtaatgacaatagtgttagtgatgatagtgataataataaggatggtggggatgttggtggtagttgtgatattgttgatagtaatgatggtgatgataacgataataatgacgacaatgatattaatagtgttggtgataataataatgtcaagagtgatgatgttatctgtgatgacgatgatcacagtgatattggtggtggcatcaagtggtag

SEQ ID NO: 69677 - DNA, 390 bp, Glycine max
  Peptide Sequence Number=SeqID_186455
atgtccttgacgtattgtcgctgtcttaggcctcatatttgcaggtcatcgctccccacaaactccaattcgaaaggccccactcaaaccctctccgcttctgcttccctctatctacactttcattttcactccatcaaaccaaaccccgaccctgcgcgaggaaaacatatgcgcaaacctgaaaacacaaaaaaaatagtaggactcaacaccggtatacacttagacagtggcacggcattgggattggacgctgtagaatcagtggacaaaagtgatgtcggaagttgtgctctgctgcctccatggattgtgcaacccacagagttggatcctataatctggtgtacttccacaaagttgagcacatcaagtcataaccgttag

SEQ ID NO: 69678 - DNA, 171 bp, Glycine max
  Peptide Sequence Number=SeqID_186456
atgtatgccatgcaagtctttcctggaactgcttcaaccctcaaaacgtatgaactagtccctaatggttctgtcaaggatcgtggtctcattcaaagaaagagaattaagcctaagaaattagccaatggaaagggtattaaccaaagagaggcgagatttttattgtag

SEQ ID NO: 69679 - DNA, 261 bp, Glycine max
  Peptide Sequence Number=SeqID_186457
atgacaggagtatgcctccaattagaccagtttatcagaggtcttgaaagctcaaagggacctccatatttctcgttgggtatggaagatgttggattacacaagaatcagatggatgagatcgatcttgttggtggaagcacaaggattccaaaggtacgacatcttttgaaggactactttgaaggaaaaaagccaaacaagggtgtcaaccctgatgaagagttgcatatggtgatgcagtgcaaagaagcattttga

SEQ ID NO: 69680 - DNA, 420 bp, Glycine max
  Peptide Sequence Number=SeqID_186458
atgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataaaaaaggatctcgaaattaatggtttggatagaagtatgttagacaatgagcatctaaattctctgttcgtcccatacactcttttttctcagactcatcgaaggagtgtgtttcaagtaggacaaggtgaccccaaacggatccacagattgtcagtgtcgtggatgcagaagagatgttacagaacataa

SEQ ID NO: 69681 - DNA, 858 bp, Glycine max
  Peptide Sequence Number=SeqID_186459
atgaacctcaagatggactcccttctggaacatcttgcaaaccttacccctatccccacctcacctaaattcacaccaacccctacaccagctagttgttctcgctctcacatgaaacttgaaataccccgttttgatggcagcaaccctatagggtggatattcaaggctactcaatttttcgaatatcaaaacctccccgatcaagagaaaatcactattgctagattttatatggagggtcccgcactttcgtggtttcaatggatgcaccgcaatgggttcctcacgacctggccaagcatgcataccgacgttcacaggttcaccaagggggttcatttcggcgctctaccttcacaataccctgcttttaaagccgccactttgttcatcgacactttttgcaaattgcatggcttcccacgcagcattgtgtccgaccgcgaccctcttttcattagtgccttatggcgggaactttttcgtctaagtgggacgaagctcaggatgagcacaacttatcacccgcagaccgatggacagatggaggtcctcaaccgcgtcctcaagcaatatttacgctccttcgtccatgaccgcccctcccagtggttcaaatatctagccctcgctgagtggtcctacaatacctccgttcactcaggcaccggcatcttaccttttaaggccacttacggcaagtcgctgccgtctattccacattacattcatggtacctctcatcttgagcctgttgatgacctgttagcaactcgcttcgccatccatgatactctccgccgccatttacaaaaagctcaagcatcaatgaaggctgtcgcagatgcccactga

SEQ ID NO: 69682 - DNA, 315 bp, Glycine max
  Peptide Sequence Number=SeqID_186460
atggaccttgtcctcaaggtcataggcaactcgaatcttctcccagttttctcaggtggtatctttgggggccaagcccgcccattggaccaaaaccaactttgttggaggtgttgtagagcggtcccacttccagtccacaaaggaaagtggttggtggtaatgcacctagaagagaaggcagtggatcgagatgttgttttaacaatgatacatgaaaaacgagatggatcttggatgaagcagggagttctaggcgataagctacaggtcctacacgttcttggatgcgaaacgggccaaagaatcgcttag

SEQ ID NO: 69683 - DNA, 258 bp, Glycine max
  Peptide Sequence Number=SeqID_186461
atggaggagtttgacgcacaggtggcctggccaggagaccagccttcttcctctagagggggtggggcctccacaggccaggagcctgtgactgaggagcccatagcgccagcaccatcaccagcaatagcagaggaggagaccactccagctcagaccccacagccatctctaccatatgcacctactcctaaggagactcagccatcaaaactggatcttaatgaagaccagccaaaggaggaggaggacgtttaa

SEQ ID NO: 69684 - DNA, 471 bp, Glycine max
  Peptide Sequence Number=SeqID_186462
atgaccaccttagctcagacatggagtgttctttccttctctaacttgattcccaccttccatacttctgatgtcactcttgacagggccagactcatttatggcattattatgaaaatggatatgaatgtggggtacctcatttcccaccagatctccctcactgctcaacatgatacatccagacttggattcctagccttgattacagctttatgtaaggctaggggaattcagtctgactctagatccttggagagcctgagtcctaccattaatttgacttacattaagaagaactattggaatcttgatgatccaacagtaactttcataggacccaagaaggccagagggaagagatctgaggccccttccactttagcatcagaggcaccaacaccttcttcttctacacttcctccttcttcctccatagatattccagtgattcctccaacaccttcatag

SEQ ID NO: 69685 - DNA, 741 bp, Glycine max
  Peptide Sequence Number=SeqID_186463
atgggagtggtaccttcgacgcttcaccaaaagctgatgtttatggtggatggacgcttggtcattgtttcaggggaagaagacctcttgctaagttgctcgtcttctacgccctacattgaggccacaaatgaatccttggaaacggcctttcaatccttcgaggtagtaagcaacaccttcgtggaatccctgccaatgcagcctcgcatgttcgatgctgctatgatggtggtctgtgtcatgctagggcaaggttttgaacccggcatgggcttggggaagaataacgacggcatggccagcttagtggatgtcaaagaaaaccgtgggaagttcgggctaggatataagcccacacgggctgacttgaggagaagtgttgtagaaaggaggaacagggtcgtgggccttaaaagcttcgtgagtgcgggattgagactcgaagagcaagtcgccgtgatatacgacgaggtccctcaagaacgttcagacttggaagaccgagagatgaggccgcaccaagaagaaatagagatcgtaaacttaggtgttggcgacgagaagaaagaagtaaaggtgggtacgggaatgactgcacccgtccatgatgaattagtggttctgcttagggactaccaagatgtcttcgcttggacgtaccaagacatgcctggcttgaaccctgacattgtgcagcataggttgcctttgaatcccgattgttccttggtgaaatag

SEQ ID NO: 69686 - DNA, 210 bp, Glycine max
  Peptide Sequence Number=SeqID_186464
gcgaaaggaggctgttccaaatatccctcaacccccttggctatgcattttagctattttgggtgtaaaaaattatttccgtgaggaaaattcaagccgaggtgcttttgtaaagcttctgagacgtttccgggagcaaatccgtgaaggttttccgtctttcttcactgttcttcatccgttctttgttcgttcttcgtttttcaatgg

SEQ ID NO: 69687 - DNA, 504 bp, Glycine max
  Peptide Sequence Number=SeqID_186465
cattcagaatcatttgctgtcaaattacccattgccttccctactgtattgtgtggcattatgttgagtcagcatcccaatatgttaaactacactgactctgtgataaagagagaatctcctctatccctgcattacaaactgtttgaagggacacatgtcccagacattgtctcgacatcagggaaatttgctgcttcaggtgctgtgtccaaggatgccttgattgctgaactcaaggacacatgcaaagtgctggaagcaaccatcaaagccaccacagaaaagaagatccagctgagcaagaagaggcagctgaggaagaaggagaagcagctgaagaagaagaagaagctgctgaggaagaggaagatgcagcagaagagacagaatcagatgatgattctgaagatagtaggatacgatgtatgcatgattcatgaccttgagggggagttgtatgaatatgattttgagggggagactgctgctgatgacgactga

SEQ ID NO: 69688 - DNA, 255 bp, Glycine max
  Peptide Sequence Number=SeqID_186466
atggaaaacggcagcaccacgcgcgcccggagggcaggcatggtgctcagagggggttttccggttcgctgggacagcgagggaggtgcggatccgtgcggcggcaggcgccggaccgggaccaccgtgcgaggtcggggcggccgtgccggtcaaatcgaccgtcacctgcgacccgccatgctggaagccacgcttggccgctccagcccattcgcaaagggtggacacgcacttactcccggaaagccatag

SEQ ID NO: 69689 - DNA, 170 bp, Glycine max
  Peptide Sequence Number=SeqID_186467
atgtcgctgcatgttctttatctttatgtgttttctgggtatcccccagggatttcccgtctactgtatctctcgttacaatctttcaaagaagtaaacgtgggggcaggatcatctcgagctaccttttggggtagagacaaagttaaagcagcaaaaaaccaatcaag

SEQ ID NO: 69690 - DNA, 317 bp, Glycine max
  Peptide Sequence Number=SeqID_186468
cattcattaagcacgacattcagtggctaagcgcgaggaataatccagaagaagatgagttgtcaagtttgctaagcgcaccgctccaggtcatcaagcgcaccgcttcagctcatctgctaaatcctagaggtgaaggagacatcctcaccacctgtgtttttgcagtctttcatcttgttcttctctttgttgtaaaggaggttttcggactatggaaagctaaatcctctgttggatcttcccttgggaactggtctgattctaaagtcctcggtagtacgagactaagtcgttgtgctatcacgagggattag

SEQ ID NO: 69691 - DNA, 843 bp, Glycine max
  Peptide Sequence Number=SeqID_186469
atgatatctcactttgaatccattcatattgacctatgggtgatggtggaaaatggaaagtgcattccatacgatgatcagttaaatgaaattcctagaagttggtggatggagaagcaaaaacttagattcttgctcgactccaaggctcaaaatgtgatgctatgtgctctatcagaagaggagtacaccaaggtaaagaggagtaaattcaatctcctcactcgtaagtatgaactcttctctatggaagaaggcaaggacataaaacaagacgaaggacccaagagagagaagtctttggtcttcgtagtcaaaagaacaaaaaggcctcatcatctagagaacaagtctcaagaagctcatcgaaagcccttaaagttgataattcctctgatgactaatttgaggaaaactctaatgaagatgaactcgccttcatctcacagaagatccacaagatatggaaaaacaaagagaaggttcaagacaagaagaaacactacaataccaaagaaaaaagaagatcttatgagcaactgggaagatctggatgacactttgtctaataaagatgaagaagaagccaatctatgcctgatggtaaatacgacttttgaagaatctgaattagatcaagaggatgagaaaacccttcaagaccaagtagatgtttcaccagatgagtccactcagacatgtaaagcctgtggaactcttaaggaaaaagagtccaagctatgtcttgagaatgagataattgccaaggaaaaatctactaaagaactttcaagacttgtaaagcaaactgaaagatcttcaaaaggatctgacagagcttaa

SEQ ID NO: 69692 - DNA, 567 bp, Glycine max
  Peptide Sequence Number=SeqID_186470
atggttaaggacgagtgtaaggaggtaagtgtcccctccaagaggttagctaagaaggaaagtcattttgaaataaagacgaatattaaagaaacttcccctctaggacaacctccacatcttctcctttgtaaaaagacacttgttagcactgtcacacctcttagacttgatattattcctcaagtaaaggagttgttggataagggtttgattcataagagcttaaatccttatgctttgttggtgcccaaaataggtattagtaggcatcaaatccctaaaataggttatatgatgaatgtgttgagtggtacaatcctcttttataaaatcactcatgcgcccaacatcttcaagattcgtgtagatagggactcattaggtaggattgttcttatttttagtttcaatacaaacttaggttctcatatggcacaccttagtgatcaaggggttcccacgaacactaagagaataaaggttattcctgagtggcccactccaccaagtataaggaaaatttgggacttccatgacttaacaaacttttacaaaaggtgttga

SEQ ID NO: 69693 - DNA, 284 bp, Glycine max
  Peptide Sequence Number=SeqID_186471
cctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 69694 - DNA, 426 bp, Glycine max
  Peptide Sequence Number=SeqID_186472
atggctattcccgcaatgatgaaaaaaatcctgcttgcctgctgtggcgccctgctgagtggcgccccgcatgccgatgccgtcagcggccggatcggcgttactctgaccattgaaccgcaatgggccgtgcgcctcgaggccgccgccccccgggccgaatgcagccattcggcggcgcagccgaacattacccgccaaccggcgctggagaacggggcggaagcaaactcagatgctgaacgaccaaccgcaaccgcaagtggttttggcattcgggttggtcaccaccaagcgcgacccttccagcccttcggtgtagtccaccgaaccgccgaccagatactgcaggctcatcggatcgaccaccagcgccacgccctgcttctcgatggtcatatcgccatcgttgaccttgtcgtcaaa

SEQ ID NO: 69695 - DNA, 927 bp, Glycine max
  Peptide Sequence Number=SeqID_186473
atggttatgacggtacatcactccgttacgcaacaaggttcacatgcttccgccgccgatgcgcggctggaaaccacctccgggcgcaaagatttctggcgcgccaccttctcctgctggctgggcaccgcgatggaatacgcggatttcgccctgtatggcctcgctgccggcatcatttttggcgatgtgttcttccccgaagccaccccggcgatggcgctgctctccagctttgccacctggtcggtcggctttattgcacgcccgatcggggcgctgctgtttggctggattggcgatcgcaagggccgcaaggtagtgatgatcagcaccatcattctgatgggcgcttcgaccacgctgatcggcctgattccttcctatgcaacgattggcctgtgggcgccggcctgcctggtgctgctgcgtttcacgcaggggctgggcgccggcgctgagctctcgggcggcacggtgatgctgggtgaatacgcgccggttgagcgccgtggcctggtgtcgtcggtgattgcgcttggttccaacagcggcacgctgattgcgtcgctggtgtggctggcggtgattcagatggataaagccacgctgctcgactggggctggcgaattccgttcctcagcagcgtgctgattgctgcggtcgcgctgtggattcgccgtcatctgcgtgaaacgccggtgtttgagcgtcagcaggcggaactgcaggcgcagcgccatgaaacgctggcgcaaagcgcgacgcaacccgacagccgcagcttctggcagcgcagccgcgccttctggaccctggtgggcctgcgcatcggtgagaacggcccgtcctatctggcacagggctttatcgtcggctacgtcgccaaagtgctgatgctggacaaatcggtgccgaccaccgcg

SEQ ID NO: 69696 - DNA, 432 bp, Glycine max
  Peptide Sequence Number=SeqID_186474
atggaactactccttttaagagctggacttagggaggaggaaagaacaagcatagctaggttccttagtgggcttaatatggaagtgagggacaaggttgaacttcttccatatagggacctagatgagctagtccaactttgtataagagtggagcaacaacttaaaagaaagccttcttcaaaatcttatggctctcactcttatccaaggaaggaccaagcccatggaattttaggggctgcaccttcaaaacccaaggaagataagggccccaactctcctaggccagcatttggctcacttgggccaccaaataacttcaaggctaaggcactagcttgcctgggcgagctcactgcttcagggttaagtttcagctcgcctgggcgagctgcaactgccccagggtggccttttgcctataaatag

SEQ ID NO: 69697 - DNA, 170 bp, Glycine max
  Peptide Sequence Number=SeqID_186475
tggaagcagatttgtgtagtatgattactgttgtttctggaaataatcagcgcgagggaagtggtagtgtcgtggctgtgctagaaagtatgggtagcaaaggatcggtggtagtgaatgagactctcgtcaagaagagtaccagttgcatgtttaactctggggatgag

SEQ ID NO: 69698 - DNA, 1128 bp, Glycine max
  Peptide Sequence Number=SeqID_186476
atgacctttgcggtgttcggtgccggcttcctgatgcggccgattggtgcgattgtgctgggcgcttatatcgataaggttggccggcgcaaagggctgatcgtcacgctgtcgatcatggcggcgggcacctttctgatcgtgctgattccgtcgtaccagtcgattggcctgtgggcgccgctgctggtgctgattggtcgtctgttgcagggcttctcggccggggctgaactgggtggcgtgtcggtttatctggcagagattgccacgccagggcgcaaaggtttctacaccagctggcaatccggcagtcagcaggttgccatcatggtcgcggccgcgatgggcttcgcgctcaatgccgcgctggagcagagcgccatcagcgcctggggctggcgtattccattcctgtttggctgcctgatcgtgccgtttatctttattctgcgtcgccgtctggaggaaacgcaggagttcagcgcgcgccgtcatcatctggatatgcgtcaggtgtttagcacgctgttgcagaactggccggtggtgattgccgggatgctgatggtggcgatgaccaccaccgcgttctacctcattaccgtctatgcgcctacctttggcaaaaaggtgctgatgctgagcgcctcggacagcctgctggtgacgctgctggtggcgatctccaactttatctggctgccaattggcggtgcgctgtcggaccgctttgggcgtaaaccggtgctgctggcgatgacgctgctggcgctggcgaccgcctatccggcactgacgctgctagcgcagacgccgaccttcagcatgatgctgagcgtgctgctgtggctgtcgtttatttacggcctgtataacggtgcgatgatcccggcgctgactgaagtgatgccggcagaagtgcgcgtcgccggtttctcgctggcctacagcctggccaccgcgctgtttggcggcttcacgccggtggtctctaccgcgctgatcgaatacaccggcgacaaagcgtcaccgggctactggatgagctttgcggcgatttgcgcgctgctggcgacgctttacctgtatcgccgccgcgcgctgacgttgcaaaccgcgcgttaa

SEQ ID NO: 69699 - DNA, 519 bp, Glycine max
  Peptide Sequence Number=SeqID_186477
aatggccactgtttaagacctggtgatggacaacaagaagaggaggcccattatttccagaaccaagccagacctcaacaaaacattcaaggaagctaccaaggctatagaggtggctcaggttcaaatcagccttatggctggagactacaaaactctggtcccactaacacttcttttgtaggtccttctaacaactcttctggaggtttttcaaatagaggtccacaacaacatcaagctcaactagatagaatgtcaaagatggaagatactttaacacagtttatgcaggataataatgagaaaaagaataaagaaggaattgaaaaagaaaatgagataaatgatgaagtggtgactagtgaaaaagtggtaattgaagaagagaagaacaaatcaaatgaacaaaccactgataaagttaaagctatagtaaacatccaccaattgagcatcttccttattcgcatactccgtcaaagaaagataaggaaaggcagtacaagtgttttatag

SEQ ID NO: 69700 - DNA, 354 bp, Glycine max
  Peptide Sequence Number=SeqID_186478
gtggtggcgcctccaggatccattccttccattgagcaatttctggagagggtagcctggcctggggcccaaccttctcttcatagggaagatgaaggtcccacaacccaggaagttgctgctacttctgagaggtcacgagaggtcacatcagatccacccataccagtggtggacctatcctcacctcagcatgcaatagatccctccactcctatacttgagataccagaagacctgaccacaccagtcctgactctgaacacttctcctccagctactccagtacttcatctgacagatgaggaggatgttcagacacaggatactcaggaccagtcacaggaattctaa

SEQ ID NO: 69701 - DNA, 897 bp, Glycine max
  Peptide Sequence Number=SeqID_186479
atgaggaacaaactttcacaccctctttgtcttttccttttgatttcactgagcttgtttgcaaagtcagatgcaggaagccttgtggtgtattggggccaaaatgcagctgaaggccatttgacaaaaacatgcaaaactggactcttccacattgtgaacatagcattcctctcaacttttggcaatggtactcaacctcaaatcaatttagcaggccattgctcccctgtgtcaaacggttgcaaaaggttaggcataggcatcaagaactgccaaaggagaggcatcaaggttatgctttcaattgggggtggcaccaagacctactcattgtcatccccagatgatgccagacaagttgcagactacatttgggacaacttcttgggagggaaatcaaaatctaggccatttggggatgccatattggatggggtggattttgacattgaaagtggtgaactccactatgcagcacttgcttataagctgcatgaccattatgctggttctagcaaaaagttctacttaactgctgcaccacaatgtccattccaaaacaacttactccatggagcactcaccacaggcctttttgatcatgtttggattaagttctacaccaatcctcaatgtgagtttaccccaaaggaccccactgggtttaagagtgcatggaatcagtggaccacatcaattaatgctgctggcaagttctttgttggacttcctgcctcacatgcagcagctagaacgggtttcgtgtcatcacatgctctcataaatcatttgctgcctatagttcggtcacctaaatatggaggtgttatgctttgggataggttccacgatttgcaatctggatatagtggtaaaattagaagaagcgtttga

SEQ ID NO: 69702 - DNA, 210 bp, Glycine max
  Peptide Sequence Number=SeqID_186480
atgaatttaggagagagttttcggaacttaagggttcccgcaacccagttatcaatgccttggatcttcttcatcaatggattcctttacttcttgaagattaatgacaacaaaatggagaaagagaaagataattggagacaccactttaaggagaagataagtcaagaagaagctcaccaccatagaaagctatggataagagcttga

SEQ ID NO: 69703 - DNA, 243 bp, Glycine max
  Peptide Sequence Number=SeqID_186481
atggtgttgtgttacatgaagaaggttgtgggagaagagagtgcaatgggggctttgaatctcggtgacgccaaaacaatgaggcttggcaaggaacataatcaatcccaattcccaaatcaaaccctaatcaagaaagagagaattcccgataacctaggtgagggaacagagaaagagaaaggaacatcacaaattaaacctaaatcaaaacctagggagaaccctaatcaaaccctatga

SEQ ID NO: 69704 - DNA, 246 bp, Glycine max
  Peptide Sequence Number=SeqID_186482
atggctccatatgaagctctatatgcaaggagatgtagaactccattatgttggtttaagactagagaaacttttgatgcaatcctccctaggaagggaccagttaccagagccatgagcaagaggctccaaaaggattgggctagagctactgaagaaggccctagggttctcatgaacctcagggtagggtaccctagaaatgtaagatttttcagcccttgtattttagggcacttagactag

SEQ ID NO: 69705 - DNA, 282 bp, Glycine max
  Peptide Sequence Number=SeqID_186483
atgaaactcatcgtccccctccagggtctggtgctgggccgcagagggcttctcctcgggaccctcgtcccctgcacgcttttctacttcctccagcagcactcgcgactacatgacgaggaaggaataggaagaagaagagactgtgtctttgagaaagagagtgttacgagaggccaccaggaagagcacaaggaattggcagccaccatttgtcatccttccttggaacaatttttcggaatgaggccccacgtaatcgactcgaattccctgttttag

SEQ ID NO: 69706 - DNA, 360 bp, Glycine max
  Peptide Sequence Number=SeqID_186484
atgaggtcgctgcgggcaaggatgcagcctaaggtttgggtggtgaagaagcagaaggacattgccttcgtcctccgcttcctacactacctcaacgtggtgaccctcatttcgaagatttcgaggccactctctagtgggtttctgaggttggctttgacgaacgtgaatgcaaatcctgtggtgagattcaattacttcaacaaccccgttgagatggagcggtgcatgaatgggatgaggaagatagcgaagatcctagggagcagagctttgagggtttcaagttcaacaattgtttcggggagccagacttcaggttcatttactactacaaaaaacatcttttacgacggttaa

SEQ ID NO: 69707 - DNA, 861 bp, Glycine max
  Peptide Sequence Number=SeqID_186485
atgagaggagagagaggagagagaaacaggggatgggagagtgtcagacacagagagagattccaagcgggccctcaacagataagcactaggatgagggatggacaacataaccacagaaatcagacaaactggcgagatcaaagagggataacatcctattacttcacacgatttgccgatgacatcaatgagaaggttttgtggcaacattttaagaggtggggagacgtcagagaggtgtacatctctaagcaaaccaatgagaatggtagaaggtacggttttgtacgctacaaagacgtaaaagacgaataccggctggagaggcaactggacagtatagtggtcggaggactgaagctatatgtcaatctcccacgatttgggaggaggaacggaggaaatagaagtcaaggggctaaacggcaagagcagcaacaggtgaagataactgaagcatggagccaaaaacagagaggcgaaggagcaaataaatcaacttacgtggaggtggtagcagggaaaagaaatacagcaaagagcagagaaggggggtcatcttccgtataccttgagccctccgacgagatgttgaagtggctgaaagacgcgtgggtagggaggttgtcgaacccggcgaagtttgataaggtggaagacgaattgaggtgggactatggggtggatatctcagctaagtacatgggggatgacatggttttgttgcttgggctgaatgaggcaagtgcagaaaacttgttgcacgaagattcccacggaacgccaccgttgttcatatattccattcatgctcaataccttgcaaaccatacattaaataggaaacctaatgaatga

SEQ ID NO: 69708 - DNA, 459 bp, Glycine max
  Peptide Sequence Number=SeqID_186486
atgttgatggagtctgaagtaaatccatttgatggacaggaagctaagccatacaagaatgaccccgaaattttggtaatgacaaacttaatagcagcttatcaacggaatgaaatatcggaattcgagaaaatcctgaagagtaacagaagaaccatcatggatgatccatttatcagaaattacattgaggatctgctaaagaatattagaacccaagtcttgctgaagcttatcaaaccatatacaaggatcaggatcccttttatatctaaagaacttaatgttcctgagcatgatgttgagcagctattggtgtcactgattttggataatagaatccaagggcatattgatcaagtgaaccggtcgaaaggaatgaagaagtacactgcagttgacaaatggaacacgcagcttaaatctctttatcaaactattaacaacagagtttcttaa

SEQ ID NO: 69709 - DNA, 414 bp, Glycine max
  Peptide Sequence Number=SeqID_186487
atggggaataagtggaagcaagaactaggcaatatacagatacatcaagcatggccaaaaatcatatcttccaatgaaacataccccccacacttattcccagcttattcccaaaacaattccaaagctccaaaattccttaagggtaagggccttcatcgagaaatactgaatccccaggtaggcatagggccagacaccgcagcagccagaggaggaccaacagccagctatagatttgccaccgtcgcctcaagaggaggtaccatctctgagaggcagctgaacgagacgttctaccattacaacctgcaccaacaaagtcaggaccccagtccattcccttggcccactcccgagcagttcgaggccacggtggcctggcctggggacaagaccgagtttgagatgtag

SEQ ID NO: 69710 - DNA, 628 bp, Glycine max
  Peptide Sequence Number=SeqID_186488
atgtctttcgaccgagactactttagtctccccctcgtcatccagtggcaagcgagcccgttgacacgcagagaccaacatggttgtctgcatccttcgtcgaaggatcaatgtctttcgaccgagactactttagtctccccttcatcatccagagacaatcaatctccccctcgtcatccagaggcaagccaacccgttgacacgcagagaccaacatggtcgtttgcacccttcatcgaagactcaatgtctttcgaccatcactactttagtctccccttcgtcatccagagaaaatcaagtccgatgacacacagagaccaacgtggtcgtctgcacccttcgtcgaagactcaatgtctatcgaccgagactactgaggtctcccctcgtcatccagaggcaagcgagcccattgacacgcagagaccaacatggtcgtctgcacccttcgtcgaagactcaatgtctatcgaccgagactactttagtctctccattttgtcatccatagacaatcaacattgggcccatctaggcccatcaggaagcttcaacatgaagcaaccagctcggctaggcgagcatgttgcttctagaggaagcttccagctcacctgggcta

SEQ ID NO: 69711 - DNA, 249 bp, Glycine max
  Peptide Sequence Number=SeqID_186489
atgaccacattggcctctgcttgtcaattggacttgggttctctgaatgacgaggtgtggataacccgtttcgtttctaaacgaccatttagaggaaacattgggtccaacaaaatagaagaaaatcactcaaagtgtatcaatctcacacaggtttatggtggtttgaggttttggctcaaaaggcttgtagaacagctgaacatgatatatgtcagggcgttggtttggccagcgattcagggataa

SEQ ID NO: 69712 - DNA, 156 bp, Glycine max
  Peptide Sequence Number=SeqID_186490
atggcagatgttatcaggccttacaaagaatcacttactaggcaaagtcgttgcatacatgtacacagtggaattccaacaacgaggacttcctcatgtccatttattgttatttttacacgccaacaacaaatatccatctcgaaacgatattga

SEQ ID NO: 69713 - DNA, 216 bp, Glycine max
  Peptide Sequence Number=SeqID_186491
atgcccttacggacactattcctacttccccatcaggctctgataccagaggtcagcggagtaggatcaaacggacagataggaagtaagaatgcaatatcaaggtcacaccggagaccggcttacaaaacccaggttttcataaacaaagaaactgaagcggcggcagagccgcacaggatcggtgaagggagaagagagaaagatgaccaatag

SEQ ID NO: 69714 - DNA, 816 bp, Glycine max
  Peptide Sequence Number=SeqID_186492
atgaaggcaaagatattagagaatgttttaatcatgtctagattattgcgatccttttcccgtatttcttttcgctcgaattcctcctcttcatcttcttcaagaaacaccaatctcttaaatgatcaagataaccagacccaagaggtcgccccaaaacacaatctcttcgatgaggaagtccgattcgaagatattaatcaaaacatggatgactggaacattccagaaatccctcaggatcaactatacgttcctgaaacaattaaagacaaacacaactttgattacataatcaaaacagtagaaaacaatattcctctaggacaagatataggggaagaatttcatctactttcaaaaaattcaatttatgaacatagccgtaagtataaatatttacacatcggttgtgtacaagtagccatcaagcccttaattgatatgggcatagatgcagcagttttaatgtgtctaagagatattaggcataatcaatttgaagactccctaattggaacagtcgaaaccagcctaggacaaggtccaatatattttaattgttatccaaacaaaacagtgagtctgatggacagaaacattcttgactctttgttcttaaacatccattttcatggccttgacatgaatgaaggatcaatcccagtagccttaatctataggatccagtacaaggtcatgaacacttgtgcatctagagtcctgttaaaacctcaaaaaggagaaacaaccttgtttatcactgatatgacaaaggctaacgtttctctcccgagaaaaataaaatgcgatgag

SEQ ID NO: 69715 - DNA, 366 bp, Glycine max
  Peptide Sequence Number=SeqID_186493
atgaagaacactcaaatttatcaatcaattctcataagaacatcaattgagtttccaagcattacagaaaaggagaagggattgaagcctcaattccatggtcctacgtgcaatgcatctttctccctccatagagactattttgaaaatcccaacggaaatgttgcaataaaaagggtttttctctcaactccgacattgtttcaaaattcccaacggtgtgaatgttcagaagccaggtttggtggtatgcgggaaaatgagagggttttgagaggaggagaagggaaaatgaaagtgagagggagagaaggtgtagagggtatcgtcagtctcaaaactgacctaagatgtccctatttatag

SEQ ID NO: 69716 - DNA, 135 bp, Glycine max
  Peptide Sequence Number=SeqID_186494
atgaatctgcaattgaatgtggactggttacatgatgtggcaattgcttatggattcaatgctattaggtatcaagcagcagtagataataaaggctcgaagaggttggttccttccttgactctactcaagtga

SEQ ID NO: 69717 - DNA, 123 bp, Glycine max
  Peptide Sequence Number=SeqID_186495
atggccaaacaactgaagtccctggagctggagaagaaaggccatttgcagcaaggacagaaggaccacgctgaaccaaattcagcagtgagatgcctcataattgtaatcaaacacatatga

SEQ ID NO: 69718 - DNA, 630 bp, Glycine max
  Peptide Sequence Number=SeqID_186496
atggcaccgaattccatagctttccctgttgttgtcacagttaccttaatgtatagaaactctagtttcagactattcaaggggtattcagaaggcaacttacaaagaggaacatctcagaacgttactactactgctgagcggttgccaaacgttacaaaaactcatggctttcaattgggaagagcaatccaaaatacaacacatgacagctcaggaggaaaagatcaagggaataataacagtattgtcagcagtggagttaaggaacgacaaaggagatcccaaaatcatacctctattgaaggaagaatcaacaataatattacaacagtagatgatgtcattatggaattgttatctgcagaagactgttactgcagaagactaaaaatatttctggctaccttactgcagaagactgttactgcagaagagaagaagccttatgaggggatataccatgcggggaaagaagcttatttgcaggtgattgcaaaggaaaaacgtgaaactgactcaatgaggttcttggaagacgagcagaagcagaggactgcaatggaattgcttgaacagtacatgcaattcaaacaagaggcagaaaaagatggaaagaagaacaagtaa

SEQ ID NO: 69719 - DNA, 174 bp, Glycine max
  Peptide Sequence Number=SeqID_186497
atggtcacatatccatgtggattgaagataattgttttggaagatacaaaagagtacattagttatgtctcaaaggaagaggctaaaactcaacatagaagacctactgatcttttggtatgtttagatgttgagatgagaagtacaagctattgcatacctgttattacttaa

SEQ ID NO: 69720 - DNA, 1077 bp, Glycine max
  Peptide Sequence Number=SeqID_186498
atggcacccaccacttccactactaccaatgagttaaaagaactcatggagttcaacaacaattttcagtttccaatcaagcttactgctaccaattaccctgcttggtacaaacaggttcatgctctactcattgttcgtgaccttgaaggctatgtcaccagcaaaattgtttgtccacttgccaccgttggttctggcgatgctgcagcaccaaatcctgcatattccttatggattcggcaagataagctcatttatcttgctcttcttggctcgtgcgattctgaagcacgatctgtcatggctgctgtcgacacttcttgtgatgcttgggtagcccttgcacgtgcattttctaatcaatctcaatctagaatcatgtctctcagagaacgtctcagttctatcaccaaaggcacctcctcggtttccacttatctaccgtcgattcgcaatattgctgatgagttggctctaattggccatccaattgatgaccttgaaatggtcatacatactctgaatggtctaggaccaacatttcgagagttcattgcctccattcgcactcgtgattcaccaattgccttcaatgagttatatgataaattggtggatttcgagatgtatttacagcgtgaagaacgcctctcaactaacatccccatcactgccaatgttgttcagcatcatcaacatggtcaaagtcgtgggcactttttccatggccaccaacataaccatcattattgtgaaaagcctggtcacttcgtaaagcaatgctataagattcatggctatccaaataagccacgccaaccatttgctaatgttgcgcaaacaacttcatctcactcacctccaccctcatggctctttgacttaggggcatctcatcacatcaccaatgatctgacaaacttgactctcaaggatgactaccatggaaatgacaatcttcaagttgcaaacggtaatcaacttcctattactcacattggctccaccactattcccactaatggttcttctttaaggcttttagatattctttatgttccaaatgtcacctaa

SEQ ID NO: 69721 - DNA, 528 bp, Glycine max
  Peptide Sequence Number=SeqID_186499
atgctgaacttgaagcacctctctataatttgcagcattcttgttgtggctatcatttcaatgtcagcatgtcattgcagagttttgcaaccaaatgatttgaaactcattgaggaaacttgcaagagaaccccaaatcctaatctttgtcttcaactcctaaaagctgacccccgtgcccctagcgctgatattgcaggccttgcattgattttggtcgatgtgatcaaagccaaagcaaccgaagccgagaaaacaatcaagcaacttcttaagcagggtgggaataagaaagccttaagtgaatgtgctgacgattacgatgggattttgaagcttgatgtgccaactgccactagggctgtgaggggaaaccccaaatttgcagaaaatgcggtaagtgactgtgctgttgaggctgattcttgtgagaatggcttccatgggaaatcaccactcacccatgtgaataatggtatgcatgatgtggcgaatgtggcaagggctattattaggaatttgctctag

SEQ ID NO: 69722 - DNA, 306 bp, Glycine max
  Peptide Sequence Number=SeqID_186500
atggaatccagttctgtcataatctcctctcaccgaaaccgcttcaatgcaattgttgatcatcagcaacaccatggagtaaaacaccacaggcatcctggtgtttgggagagccatctgaaaaatggacgcccaaatcagtatatcacagctccaaagttcattagaattcttatactacctagtacctatatgcctgctgtgaaagtcattttcacaccagcatgctcaagtcaccaacctctcaatggtggtgaatgtttctacattactttaggtctttctagaattttcatgatagattag

SEQ ID NO: 69723 - DNA, 423 bp, Glycine max
  Peptide Sequence Number=SeqID_186501
atgatacctcagatcccgggaatcggttcagccggtgtagatatggattttaacggcgaggatgaggacatagtagagcgcgaacaagatgaacgtgtggatgaaaatagctttgtcattggtcttcatgctaccgaactcaagctgcttcccgttcccaggaaaggagaaaagcagccctggttggagcagcatgaacagaaccaccccgttcaacaccggagaaaaagggtggtagaaggaagcgagtgtttggcgtggctatgctattctgtggtcgggactagggtattggggttttgtgttaacgtttggcgtggctatgctcttcttgatctcatcaagggcttgtcagagcccttgctgagtcgcgacgccaaagaggataacaaccatgcttggagtgtggctcgtggtccctga

SEQ ID NO: 69724 - DNA, 2683 bp, Glycine max
  Peptide Sequence Number=SeqID_186502
atgaaaggaggagaaaaagtggaagagtactttgctcggacacttacaattgtgaacaagatgaagatttatggtgagaacataactcaagttatgattgtagaaaagatcttgagatctatgacctcaagatttgactatgttgtgtgctcagtagaggagtccaacaacttggattcactgacagtagatgagcttcaaagcagccttttggttcatgaacaaagaatgaattctcatggtggtgacacaagggatgagcaagcattgaaggtctcacatgaagaacagaatggaggtagaggctttggtcggggtcgaggcagaggcagaggaaggcagtctccaaacaaagccacagtggagtgctttaagtgccacaaactaggatacttccaatacgaatgcccaagatggaaggagagtgcaaactatgctgagatttatgaagaagaagagatgctgctcatgtctcttgtcgaagctgacaacttgcaacaagaagagacttggtttctcgactccggttgtagcaatcacatgtgtggaaatagggagtggttctctaccattgatgaggctttcagacactcggtaaagcttggcaacgattcaaaaatggaagtactgggcaaagggaacatcagacttcagatcaatggtgcaattcatgtagtcactgatgtttactatgtcccagatttgaaaaataatttactgagtgtaggccaacttcaagaaagaggactagctttacttatacaagatgggaaatgcaagttgtaccaccctagaagaggattgataatgcaaacagaaatgacagcaaatcggatgtttgtgctgttggctagtgtagtgcttgaagagacttcaacatttctacaactagctactgaagatagttcacaattgtggcaccgtagatttggacacttgagttacaaaggtttgaggactttgcaacacaaacagatggtgaaaggtcttccatttttcaaagattcaagtaaaagttgccctggatgctttgtaggaaagcaacatagagatgtcattccaaagaagagtcaatggagagcttcccataaattacagcttgtacatgctgacatttgtggacccattactcccaactccaatagcaacaaaaggtactttataacatttattgatgactttagtataaaggtgtggatatactttctagttgaaaaatctgaagcatttacaactttcaaatattataaaagcttagttgagaaggagtcaggtgcctttatatgttgtttacgcacagatagggggggtgaattcacctcaaatgagtttaatgaattttgtaaaattcatggcataagcaggcaactcacaacatcttacactccacaacaaaacggcgtagcggagtgtaaaaatcgaaccattatgaatatggtccggtgcatgctttgtgacaaacaagtaccaaaggttttttggccagaagctgcaaaatggacagttcatgttctcaacaggagtcctacattgacagtgaaagataaaactccagaagagatgtggagtggaatcaaacctaaagtagattactttaaagtatttgggtgcctaactcatgtccatgtacctgatcagaaaagaacaaagctggatgacaagagcctgcagtgtgtattgcttggggtaagtgatgaatctaaagcttatagattgttcgatccagttgcaagaaaaattatagtcagcagagatgtgagttttgaagaggataagggctggaattggggaaggattgcagaagaagtgaagcatgatgtgttgatttgggaaggtagtaatgatagtgaggatgcctcctctgaaaatgaagaagaagctgttgtggaaggtactgaaacagcaggagttacagaccaagatgcagaagcaacaacctctacatcaagtgattcatctaatgaagatgcatctgtacatgctacagctgaaggaaggagtcgaagagcacccaactacttgcaggattatgaaactggtgaaggattatctgaagatgaagattattttgcaatgtttatctctgatgatgaagattattttgcaatgtttacctctcatgaagatccaagctcatttgaagaagctgaaagagatgagaaatggagaaaggcaatggatttggagattgaagcaatcaaaaagaatgaaacctggcagcttacagctttgcccaaaggtgctaagaagattggagtgaaatgggtttttagaaccaagttaaatgagaatggtgaagttgataggctcaaagcccgactagtagctaaaggctatgctcagcaacaagggattgactacaacgaagtgtttgccccagtagcaaggtgggacacaatccggatggttttagctctagcagcacaaaagggatggaatgtgtatcaactagatgtcaaaagcgcatttcttcacggagaattgacagaggacgtgtatgtggaacaaccactgggttatgttcgaaagggtgaagaagagaaggtctacaagcttaagaaagctttatatgggttaaagcaagcaccacgtgcttggtatagcaaaattgcagcctattttgtgaaggagagatttgaacgatgcgatcatgagcacactctctttgtcaaaacaggaggag

SEQ ID NO: 69725 - DNA, 327 bp, Glycine max
  Peptide Sequence Number=SeqID_186503
atggatatgaataatgaggcattgaatatgagtaaagatggtggattatcgaattctgctatcctcacatcaatgcagaacataaggtggcagacactgtacagaaacagcccacaccacctaaaggaagaaggggttgataaagatgcagatggcaaaatcaccgaggaagaaattaaagagatagacaaccctggagatgctcttgttgcatggaccagaggaaactacaagaggaaaaaaatagatacacaaccttgggatgaagttcttgttgcatggggaggacaaggaagggaattcctacttcatgattcaatattatga

SEQ ID NO: 69726 - DNA, 261 bp, Glycine max
  Peptide Sequence Number=SeqID_186504
atgacttcatcaaacaaacagatacatacatatttcatcaatataagctgtaaaattgccacaagtacaaagcatcaacattggttggaaaagaataggcaagtgatgcaagctccattggagcttgtaggcctaggatcttcttcatcaatggattcctttgcttcttggaagatgaatggcagtggaatggagaaggaagagagagaggagacgccacttcaaggagaagatgagtctagaagatgctcaccaccatag

SEQ ID NO: 69727 - DNA, 384 bp, Glycine max
  Peptide Sequence Number=SeqID_186505
atgatctcacataatcatttagatagcctgaaagctaaatatctgcctatgcacgctgttgatttcaggaatatattcaagatgacattggttgcagtttacccaggaaatgtcttggccttgcacatgtctaaaccacaaggatttaagtactctagtggacaatatatttttttgagctgcccagatgtctcgccttttcaatggtgtttgtgtggaagtttatccactcttgatttgccagtgattggatatgacttgctgatgcaatcctaccccgcaagggcattggatagaaaactccaagtagattgggccaaagatgcaagagaaggccctagggttcttatgagccttagggtagatttcgagcccatggactaa

SEQ ID NO: 69728 - DNA, 357 bp, Glycine max
  Peptide Sequence Number=SeqID_186506
atgcttgcttttcctttcgaaatgttgcgaaactttacggattatgcaacaatgcttattttgagggtctcgaagggaacaaacaagagaagagtcttgcacgtcgtcggacttgaatgtctctggatgacaaaggcgaccatatattgtcttcgtgcgtcatcggacttgtcgtctctggatgacgagggtgcagataaccatgaggtatctccacatgctatcggaccctcgagtcacgatagtagaattgagactttttcgcggtctcggccgaaagatgctgacatctccgggaagggtgcagatgaccacattggtctctgcgtgtcaacgggctcgcttgcctttggttga

SEQ ID NO: 69729 - DNA, 304 bp, Glycine max
  Peptide Sequence Number=SeqID_186507
atggcctcctctggacctgttttttcgttttctgggactccaactatcaccactgcaaagctgaactggaaaaactatccttcgtggtctgcttccgtggagttgtggttccttggtcaaggacaccatgaccacttggagaaaacctcggattctgtttcagttgataaaagacctgaatgggagaagcttgactatcaactatgtgtcgaaatctttgccaatgatatccaaagcttgtttgatgcaaccatgaaggttatagccctcaagcaaacaagtcatgacatgattgctcatgtgg

SEQ ID NO: 69730 - DNA, 666 bp, Glycine max
  Peptide Sequence Number=SeqID_186508
atgttgactgtgatgctgaaaaggttcaaagttcaaggattcccaactatcttggtgtttggtgctgataaagatagtcctattccttatgaaggcgcaagaactgccttggctattgaatcatttgcattagagcagctggaaacaaacgttgctcctccagaagtgacagagctacacagtccagatgttttggaagagaaatgtggttctgccgcaatctgttttgttgccttccttcctgacattttagattccaaggctgaggggagaaacatatatcttcagcagttactatctgttgcagagaagtttaaaaggagtccatacaggcaagtaaaaaactacgtctgggtagctgcagggaatcagccagatcttgagaagaatgtgggtgttggagggtacggttatccagctttagtggcccttaaccttaagaaagctgtttatgctcctctcaagagtgcttttgaacttgaccagattatagaatttgtgaaagaagctggacgtggaggcaaagggaatttgcccctgcaaggcactccaaccattgtaaagacagaaccatgggatggaaaagatggagaaataattgaggaggatgaattttctcttgaagaactaatgggggaagatgcttcaagcaaggatgagctatga

SEQ ID NO: 69731 - DNA, 177 bp, Glycine max
  Peptide Sequence Number=SeqID_186509
atgatggttcaggagcttggtacacccggtcatggtgggctgaaagtgctgcagcctgttatccctccactgtcaggagccggaggtgctcgctgctctgttaaaccagcctcacgctgtgccctccaccatgaggtgaaaaataaaaacgagtatatctattcagacaactggtaa

SEQ ID NO: 69732 - DNA, 327 bp, Glycine max
  Peptide Sequence Number=SeqID_186510
atggcgaagattaatatcgggtgtagttttgcaaatagagaagaaatttgggagtggtatgccttaggatggagaggtggaatctggtatgcaactaagaagttccgaaaggagcagatgaaaatgctaggacagattacacctaaaagatggcaattgcttgggaagataaagcctagagggtttcaattccagttccttagaaggaaacttacaagattcaaagtgtctgacactgccacaaaaaatctgaaacgattgctcgcccttcataaattcttcatccctcatgggaggagtgccttagaaacttatgttctgttttga

SEQ ID NO: 69733 - DNA, 321 bp, Glycine max
  Peptide Sequence Number=SeqID_186511
atggcagaggagtgcacagcgatggatgtgcatggcagcatggtgatggtggcggtgcaatgtggaggagatgggatagggatacttttgagagacatcgcgtggttttcaccgttggaacttccattgcttccgttgccactgcttggttcgatgaaaaacaattccaatctccaacattcccaaatcaaagacattgtcgcgggttccgcttccggagcttttagtatccctgcttgtgttgccactgctggaacctccttaatcatcgggtttgctcccacacttacttgcaaacaacatgctcgctctgctccttaa

SEQ ID NO: 69734 - DNA, 2685 bp, Glycine max
  Peptide Sequence Number=SeqID_186512
atgatatgctccctccaggctgacgcaggagtcttacagttccagaatcagcagcttgttcaacagatagacatccaaaaacatgctttgcatgatcttgaagaaaaaattagagaattaaaaggaaagcaaagttcctatgacgacttgttaattgcattgaaccaactctggactcagttggttgatgatatgattcttcttggaatacgagctgggagaggcaaaggcaaagacacattgcaacatttgactgacattgataatcctcaaggttcagttcctttgtgtcctgctgaggatatgtttctatgtagattaatccagaaagattccattaaaggaatcagtgatgatgagatcattagttatgttgaggaggcccttgctttgcgtcagtcatatacaagggagctgttgaaactcctgaaagataccattgatgatcagatggaaagagcaggcagtatagctcaggttttacatggagatttatcttctgaagatgctataatccaaatgtctaagattgatgatatgacgaaagaggaggtagataatttccgtgaagtggttgatactctccatgcaaaacataaagagtatacagttgctattcaaaattctattaatgagtactcacaagatcaatctgagattaaacgccttgcagatgtagtcttaaccctactagcagataggctgtttccaggatttgaaccagtgactggtcataaggcagcaaccttactgttgtgccaaggtgagcttgatgagattgtggctgaactagaagagagtagaagaaaactagtcaatctggaaatgcaaaaggatgcagcaataggaatgaattcccccaaagcagatgcagtgaatggaaacctgtcccctgaaaacattgctgacaggaccatgggtttgcgtgagttgaaggattcaattgaggaagcaaagatagtggatgctgatcgtctttctgagcttcaagatgcacaagaagacaatcagaccttgacgaagcagttccaagatcttcagaatgaactgaaagatgataagtatgtgcgcacttctcgaatatactctttggctaatgatcagcttcaacattggatgactgaattggcccgatataaaacatcggtagaatctctgcaggctggcagtgttcatgttgcaaaatgggagaatgaactaaatttgaaattggagtctgctgatagtgcaaggcagatccttggcaattctgaccataggattgatgacctagagcttcagttgcagaagtgtattattgaaaagaatgatcttgaaattaaaatggaagaagctaaacaggatactggtcagcatataacttgttctgtgtttagacttgtggtgcatgtgattggatcccagtttcttacatcattaaatgtttcagggagaaaagatatcaaatctgagtttcatgttatggcttcagctttatctaaagaaatgggaatgatggaaggtcaattaaagcgatggaaagatgcagctcatgaggctgtatcattacgtgagaaagcacattcactaagagaagcattgagcacgaagactgaaaagttacagaaggagaatcaggaattagagtttgttctggatatgcatggcctggagaattatgataaaagatattcggaagtaagagaatctgaaagtaaagctcactctcaagctgaaatgctgaaaaatgctttagatgagcatagcctagagttgagagtaaaagctgctaatgaagctgaagctgcttgtgaacaaaggctttctgccgcagaagctgaaatagaggacttgaggtccaagctggatgcatctgagagaaaagtttctggtgatgaggagtggggaagggatattttggagctgactgaggctgttaaagttaaagatgctgaggcagaggcatatatatctgaaattgagactattggtcaagcatatgaagatatgcagacacagaaccaaaatctgttgaaccaggtgatcgagagggatgactataatattaagcttgtatcagatagtgtgaagacaaaacaggcgcacaacactttaatgtcccagaagcaggccttagctaagcaacttcaacaaatcaatacatcaatagaaaattcaaagacgaggattacacacagtgaagagcagatgaaagctattctatccgatgccattaaatgtaaccaagaagaaaaacaccttgcagtcaccctggaatttgcaaaatgggaattggctgatgccgagaaggaattgaagttgctcaagtctgctgtttcctcttcagagaaagaatacgatcaaattcagaaagatacggaagctattgaaatggaattggagagtgaaaggagtttacggaagaagcttgaggaagaactaagagaattgaactgcaaaattgatgagctgacttctgaaactggagaaaccacgatacaaaaactcgaaaaagaaataaggatttgcaagaacatgatcaagtgtactgtctgtactgatcgtccaaaggaggttgtgattgtcaagtgctatcatctgttctgcaatccatgcattcagagaaatctagagcttcggcaccgcaaatgtcctgcatgtggaacagcatttggacagagtgatgtccgctttgtaaaaatatga

SEQ ID NO: 69735 - DNA, 330 bp, Glycine max
  Peptide Sequence Number=SeqID_186513
atgtactttgatttgaaggatctaggcaacactactagtcagtgggacttgtacggctccgatgcaccttcaccctataacactcttcagattattcagaaaggtttccatcggaccaagaacgtgcatcgcaaaggactgttcattgggaaggaaaccacaactgttggtggcaatgcagaacttacagatgaaaccacattgatagttgatcctcttgatggaactactaattttgtgcatgggattccaacttctaaacacatgcccgatatatttggaaccattgtattcatgagcttgtgcaaacttagaaggtacaaaatctaa

SEQ ID NO: 69736 - DNA, 300 bp, Glycine max
  Peptide Sequence Number=SeqID_186514
atggttattattatagtgaggaccagccaacccgagagtagcgtggttagggaaaaaatagaactccttgtcctcaatctggaggagatcttgggaattgagcttgacaggggggttaccggggaggtgaaggatgccctcgatgaggcagccattcttgttgaggacctcgagggcgaagtggcggcaacgacaaaatcaccggcgattataatggaaaaatcaagtagaatggttgttgcggcaggcttcagaggtcgcagcagagtgaagaggatgacaatgagggcacaagagtaa

SEQ ID NO: 69737 - DNA, 168 bp, Glycine max
  Peptide Sequence Number=SeqID_186515
atgaagaaggcgctgcaaagggagtatcatgaggaggagtttgacgatgaagatgatgttagtggaaagaagatgcggggggataggtatgatggctacggctacactggtggcaagtctttaatgtccacacctatggattgtagatgtagacaaggtttatggtga

SEQ ID NO: 69738 - DNA, 147 bp, Glycine max
  Peptide Sequence Number=SeqID_186516
atgaaaaatgttctggtagacatgattgtcttgacaaatggtagtcatattcttggcttgggtgaccttggagttcagggcattggaatacctataggaaaacttgacttgtatgttgctattgttggcacgaaaagaatcaaatag

SEQ ID NO: 69739 - DNA, 538 bp, Glycine max
  Peptide Sequence Number=SeqID_186517
atgcataaatgccctaggtgtggggtatcacagtacaaagtgaaggatgatgacgactgtagcaatgatgaaagcacaaagaaaggcctcctagcaatgaagaagattaatcgtttgtatttggattttgggaaagagacaagaaatcttagacttggacttgccacttatggaatgaatcccttcggcagtttaaccactaagcacagtttgtggcctggtttactagtaatttacaacttgtctccttggtcgtgcataaagtgcaaatacatgacgttgtctatgatgatatcaggggcaaggaaaccaagaaatgacattgatgtttatccaagtcccttgattgaagacttgagaaagttgtgggatgagcgggttaacgtgattgatgggaatcaaaatgagacattcaagttgcatacaatgggccattgtgcatgccctatctgtgaagaagacacaagcgggttgaagactagtgacgactacaaagaggccgcagagagcacactcatcgagttctacactatcatag

SEQ ID NO: 69740 - DNA, 258 bp, Glycine max
  Peptide Sequence Number=SeqID_186518
atggagagggagatgataacaatgatagtagacacgttaccagtgttctactatgagaatatggtgggttacatgccttcaagctttgccaatctagttttcaccgtcgaaaggattgaagtgggtctgagaagaggcaaatttgattatcctgttttgatgaataggaagcctggggcaaatggagagaataagaaggagggagaaacccatgttgtggttgtcgttccaacatggtcaaatttcccattagcctaa

SEQ ID NO: 69741 - DNA, 549 bp, Glycine max
  Peptide Sequence Number=SeqID_186519
atgacagtggaaaggtctatgttcctagacctaaagccacatgaaggaggtgcagttgcctttggaggcataggtaagggaaagatctctggtatagatatacttgggtatacttccttgctcataagcaagggtatttctaggtctttgaaatattctataaaagagttcaacatgaaaaaggattttgcaaatgctgaaaaaggaagtaggttttcacagagtgaccatggaactaagtttgaaaatgctgagttcagatcattctatgaaaaagaatggtattttccacaacttctcttcaccaaggagacctcgacaaaatgggagataagactatttgtacctcctaaagaaagagagatcaaactgtttgaagaaattcttcctcaacttgaagaatcttcaaatcataagcctcaggtgaaggactggaatgctcttgtgtctaaaatagagcccaagaccatagaagaaaccctgacagatgatgaatggatcattgctatagaagaagagcttcaccaatttactagaaataatgtatga

SEQ ID NO: 69742 - DNA, 417 bp, Glycine max
  Peptide Sequence Number=SeqID_186520
atgtcttccaatcttgaaatggttgcttatgacataggtttagcaagcagagcatcaacaacaacttcgttatcaattgtgattggacgagagtgtgcaaagttaagagttgaggtgttgcaacagtctccactatctttttggtcactggcagttgcctgtcttagctcctcttcacttatcaagcattttgtaagagagtgttgcttggtcttggtaattgcaccaactttgcccttgctgggagtgggtgaaccaggcttaggtattggttgggagggagggctacggacagttgggaaggttcagggttctaaacaggttgggatgatgatgataaagatatatgtgttgttaaagattgggaaggcttggcttcctccccttgcgtctattgagaagacgctccaaacttaa

SEQ ID NO: 69743 - DNA, 345 bp, Glycine max
  Peptide Sequence Number=SeqID_186521
atgaagaagatactaggcctagaagctccaatggagcttacatcaggaagttttcaagttcttctaaacaatctagaggctcttggacaaatatactttaaggctcagataaacttgaaggtgctggatagctttctcaaggacaagaagaagaaaagtatgatgggcacctgtaatgactcaaatagtgagaagaatagcatttcagatgatgaacaagccaatatttgtctcatggcagatacaaatgataatgttgagataagaacttgtcctgaatcctatacctcttcttgtgcttcatcagacgatgaaaatgatatgccttatgatcttcttctttag

SEQ ID NO: 69744 - DNA, 300 bp, Glycine max
  Peptide Sequence Number=SeqID_186522
atggaagatgctaagcctatgaaaactcttatgcatgcttccaatcctctaagcaaagatgaatcaggtaaactagtcgatcaggcactctatagagatgccattcaagttttccctgaagactggtttataattgagaagtggataaactttcaaaatctgaaggaagaaggctttgacatgaagggactttttggaaggcaagatggagtcagcatcaaggggaatgatgttgagaaacgggtggtgatctctccaaccaccattattgttgcgtctgggtgtgctttggatggttag

SEQ ID NO: 69745 - DNA, 300 bp, Glycine max
  Peptide Sequence Number=SeqID_186523
atgccaaactttacaatgactgtaagggatacaaattgtctgaagggaaaacaaacagccaagcacagcacaccgtctaaaaggaaggtctaccctctaggagctatagtttggagaagcagagaggttgcctttcatgaaatgcctttctctattcctctatacttacaacaacttcttagtctgatggctaccttcaacgtagtccttccttggaatcatgcaaaatctatggaatccgtctacatagaagacatctaccttgaagatcttgagctaagtccaaccttctcaaaatag

SEQ ID NO: 69746 - DNA, 447 bp, Glycine max
  Peptide Sequence Number=SeqID_186524
atgaagctttgcttctacatcatgcacagtgacctacttgttgcatattatgaactgaagcgctcaacaagagtgttgaagctatcgatggactttgaaggattccatcatatcaggctcagagctgttggagagtatcaatatctgtcatggttgttggaagaggattcgagccttcgaaaggggactagtgaaaaggagaggtcgtggggtatgttttactacggccccacggtgggcatcaaatgtacttaccaaaattcagagctgtcccacgtcaaggtagacgtggctaaggtggacttcaagaactcgcatgtcatactgagggtagcttttgttaagaggacaagaggggagacctacaaaacaaagaactttgaccctcaaataattaggtacctaccacgagataaagatatagcaatatattcaagtaataagtag

SEQ ID NO: 69747 - DNA, 351 bp, Glycine max
  Peptide Sequence Number=SeqID_186525
atggctggtcggtgggtccgtaagcaagatttgccaccacctattcccaacgagcgtacaccatctcctccaccacaacgggacacttcctcttctctgctgactaaagtcctcacagagttttgcgatcttcaagcatttgtggttgttttctccggacgtttttggctttttgatgttgccaaagggggagagaacttaagggtagaatttatcatcaatttaggcagaaactccaatcttaagggggacgagcatctgctaagcacgaggaagaatctagaagaagatgagttgtacaggttcgctaagcgcaccgcttcagttcatccgctaagcgagaaaggcagg

SEQ ID NO: 69748 - DNA, 774 bp, Glycine max
  Peptide Sequence Number=SeqID_186526
atggagttgcaacggaagataaaggagaagagcaaaaatatatcgttccaaagaagggaaacaagtttgtgttttgtaaagcaaatgatgcttggaggtaatataaatgctacattaaaggaagcattttaccaagaaatcagtcaaaagaatgttcaatttatagctcaacagaaatggagacatcgaaaagggcctataagcttggctcgtataagtgaaagattggcattaccttatttaatattgcaacgtgcaagcaagaaggataaagatctccctactcaagctgaaatgatcattgaaactccacaaagtatgaatggtaaaaagccggtggatgtagaaacaaatgatgcaattataaagcttcaagacttggttgaaaattctggccagtctccttttgaggctttcatgactatgtttggcaaagaaaaatcagggagagtgtgttgccttggaagaacaaaaacacctactctattgaaaagaaatatagaaattaaaaaaagacacgctaatgaggtgaaagagttaaatgataagattcaagagataaaaggaaaatccaggaaagaaatggcagcagcagaggaaaaacgtagtcaggaaatggcagcaatggatcaaaagtttcagattcttttaaagaccgtgttaaatcaaaacgactctaaatttaatgtggcagctttgatatcaactccagctaatgccaacagtggcttgcattcttctacatctacacatgctccaattaatgaagattga

SEQ ID NO: 69749 - DNA, 1239 bp, Glycine max
  Peptide Sequence Number=SeqID_186527
atgttgaaggtgtttggatgtccgacatactatcaagtgagtgaaggtaagctagagcctagagccaagaagggattttttatcgactatgaagatggagtcaaaggattccaagttaaggatgtcactaagcaggtggagtttgagagctctacaatcagaaacatgagtgatcagaagaaatttgaagcacctaatgagactaatcaagatcttcaaatgcatcctcagcatcataatacaacaccagttgaaaggactaaatggacaaggaggtgcaagtggatcttcaagaagaaatatggatcatccactgaagaagttgttcgttatagagcatgtctagtagctaaaggctatatggcaattatggacatggagttagagcaactcaatgtcaaaacttcctttctccatggaagattagaggaagacattctgatgcaacgacctgaaggttttaaggaggaaggaaaggaaaaaattgtctatagattgaagaggtctctttataagctggagcaattatcaaggcaatggtacaagagattcgatgatttcattgtctttcatgggacatgggatcttgtgaaaagattttgggcatggagatcaagaggaatcgagttcagaagaagctcttttagtgttagaaggaatacattcagaaatactgctcaatcaaaattaaagaaggaatacatgtttcatgttccttatacaagtgttataggtggtctcatgtatgttatggtattcaccagaccggacctagcacaggcattcagtgttatgagtagagacacgtcctatgctctcactggttactcagattatgactatgctacatatttggatggaaggatatttatgattgggtatgcattcacgattggaaactcccttgccaattgtaaggcaacaattttgctcacatttgctttatccaccacaagggcagagtacatggctctagtagaagcaacaaagcaagggattttgttgaagggtctgattagcaatcaagggtttccaaaggaaaaagctatcattttctacgtcaatctgagtgtaatatcgatcctcaatgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagttga

SEQ ID NO: 69750 - DNA, 1518 bp, Glycine max
  Peptide Sequence Number=SeqID_186528
ggtcgcgagttcttggagcccccaagtatggacaagtattgtctgatgttgagagtggtgaacatgcttttggctttacgggcgggatctgacatgtcaggcaatagtgactccgggggttctgatgcaatcctctctaggaagggaccagttaccagagtaatgagcaagaggctccaagaggattgggctagagctactaaagaaggccctagggttctcatgaaccttaggcatcctcttcaagcttcttatccaaggcacattcttggtggtgaagttccttcttccatggcttattccctagtggatgatgtctcccctctcctcttctcctttgccttctgctgcatctccatgcaacccctggtggacccaaaggtcatctccatcgacacttcttgcctttgtgggagggcgaacccttccgttgcttctctagtcgggaaacctatttcggccaccatgattctaaccccttctatttctaagggagcaaggaaaagtggttgcggggacggcggcatagggcagtccgcccttcttttttatgtacaggtgtctgttcaaggtcttgagtctggttctttccttgacctctttccatctgaccccgccaggtttaagtcttttgatgaggatcttctgacccttgtacaggggacgatcctcttgcgaccttggatggtaaagtgtcttaccttgttctcttttatgtctgaggtcagaccagcaggtgggactatgccaccgtctgctgccattcctcatgctgaagaagggggtaaaactgttgttgaggttggccttactattgaagttgttgaggtctcccctagtgttccttcctttgttttggttaagaggaagcaagatggcaaccctagggatcctcctccgactttgttggctgaccaggcttctgctcctactgttgttttcatttatgctcctccacctcctcctgctacgcctgttcatgctatcgtggctcatttgcccaccgtcgatgcacccttgctgagtgtcggtgtggcgacaatgagtgctcccgagatgttacctcctccttcttcagcttcaccagttcccccctcaatcgtattggcatcgacatcaccttccacctcttcccatcattgtgtttctttagatcacatctacacctccaacgatgttgattcactgtggtgcattggttacaaacctgagaagaagaccctgagagtggagcaccctaaggtagttagtgtcacctccgtctttgctgaagctttgaagtcaaaccaacaactatcttccaaggatggaagtgtccttgccagggagaaaaatgagttggctgatagggtggagaacactgtggcgaagaaggatgagccttccaaggtggttgctaacttagaggccagactgaaggagtcagagtccaggctagaagagttcgagctacgggcatccaaggagatggaggccagaaaagagctagaagaggagctgctaatatacaagaaatag

SEQ ID NO: 69751 - DNA, 429 bp, Glycine max
  Peptide Sequence Number=SeqID_186529
atgaattgtacaggttttctaagtgcaccacttcatctctctaagcgcaccgcttcaattcatccgctaagcgagaaaggcgcgctaagccaaaaatcactaacgtgcgctaagcacacgaacacgaacaaggccacctatttaagcctgaaatcagattttgtgaagagagtttggactgggattcagagcttttcatgtctagggtttctagagagagaaagtggaaattggtctgactctaaagtccttgatagttcagggttgagttgttgtgctttcacaaggaatcggggtgcgaaagtcagttggtttagtcttacaagaggaatctgcggacgaggcttgatcaggactaggctcaacgatcatgaggaatcagggtttagtatctcaggagataccataagaacacatgagcattgttag

SEQ ID NO: 69752 - DNA, 423 bp, Glycine max
  Peptide Sequence Number=SeqID_186530
atggcttgggataagatgaccgtttgtaagaagctaggaggtacgagctttaaaagtatctatggttttaacttagcagtgcttggaaaatggagaacaaggagtgatgctaatataattgtttggtccgacccttggctaaggaaggatgatcactctagactcataacccctatgaatctagacctgccccaactattggttcaaagtctattgagtcccaatgagaagaagtggaatcttgatgttttgtctattttgtttaattatgatgatgtgcaagcaattcttagtaccctattgtttaactatgtccaagaggataactatatctggagcccgggaagaatggtgattacagtgtcaagtcagcttatagacttcttatggagagcattattaaccaggcttacttgttcctag

SEQ ID NO: 69753 - DNA, 258 bp, Glycine max
  Peptide Sequence Number=SeqID_186531
atggcaacaaatctccgtacgacatcagaattgaggcgaactccagaagcttcttcactagagggttcctcctcagattggcatcgtgtcaggattggaaatgccggcggggcgagtttatgtaggagccgggctttgagtgggggccctttgtggttaaacgggtgccctttgctagatgggtgccgggttggaggggtttccggcgcaggccaaaaagcttggttgatgttaggcatactggggcgacatagttga

SEQ ID NO: 69754 - DNA, 213 bp, Glycine max
  Peptide Sequence Number=SeqID_186532
atgtacaaagataattggacccaaccttggcccatgggctcagaaatctaccctatggttcatgagaaccctagggccttcttcagcagctctagcccaatcttcttggagtctcttgctcatggttctagtgattggtcccttcctagggaggattgcatcacctaccctctgttatcagcagaagtcgtaaggcatccttcaactatataa

SEQ ID NO: 69755 - DNA, 1027 bp, Glycine max
  Peptide Sequence Number=SeqID_186533
agggtacatctacctggggattgttatactaagaacaagagagggtacatctcttgtggatcagttcaagtggagggtacatccacttggttttttcaaagagaacaagggagggtacatcccttgtggatctttggtttgtaaaggattttacaaggttgaaagaaatctcaagaaccacaggttgcttggggactggatgccacctgatcctacagggggtaccccggggcattcgatagaacagcgtgtggccctcaagcataaggtccaaattaatgcaatagaggagtatggacttcagaggccaaagcaaataaaagatgtggtaacctctaggaggtttatatttgaggcgctgcaagaagcgggcatgatttcctttgatgggcacaagggggattcttgtttaatgcatccgggtgcatcacatgacatggaaacatgctcaacgacagaggagctattacaaggaatgatggaccaagcccggtttgaaattggtgatgcaagcaagggagaacaacatgtgtgcatgcaattggcagacaaaagcccaagcaaacccaaacctttgatgatccacttcaccagagatgctgcctcccaaaaaccgcgaggctcccaacctatcccgggtaagaagtttgtcccattcccttgcagaagcaacaaggcggtcccatggaggtatgcccctcaaaagcccaacgaaaagaaggacaaggccgtcggagatgacctatcctttgccaaagttacttacatctctggcatgagtggtgtgacccgcagtgggcgtgtcttcgcagcaccggacccgttggtgtggtccaaggatgcgaagggaaaggcaaaggtaggcacgaaagaaaatgacaaggcaagcccaattctcgatgaggagatcccggttgggagatttgctaagggagaggaagacttcagtacgaagaagatatccaccaaagaagcaaatgagttccttcgaatcattcaacaaaacgagttcaaagtgattgaatag

SEQ ID NO: 69756 - DNA, 1383 bp, Glycine max
  Peptide Sequence Number=SeqID_186534
atggatttgaagattcaacatattaaatgggtggggaatatttaccagaagtttgaagcagtgtgtcaggaggtggatgatattgtaggccaggatgcagttaaatatcttgagaatcaggtccaaaatgttggagacagtgtgaaaaagttctattctggagttgtacatgagctacttccttttcctacctcggctgattcaaaatatgaatctcattcagtggctttgacaaataatattggctttccagttgagtcagttgttggtcataaagataataataaaaaaagggatgaggaaaatcccaccaataatgttatcaagtcattacaggaatctagtgccattgatattgctaacaatcagcaagttggtgttcctatcaagcacaaacttattgatgaaacttgttcagattccctggaggtggaagattcttacataactcaggaagaggtcggtgatgattcaagagaaacttccggggctaagaaagaaaagttgaatacaagcattgaagaggtttctgttgagtctgtgcctaaatcgatgaacttgatgtctcttagagagaaagaatcccttgaattccctatacacagtgaatcttattctgattcttctgacagcgggtgtgaagattcaatcgcaaaaaaggataacatagatgtgactgtggaacaaaactcatgtttggttgttgaaaaaaatgctatgaattcatccacctcagaagtgttgagttcccagtctcttgacggggaagaatcaattaaagtttccttgttcagtgaatcatctgatgctgttgatgaggatacccatgacatactagctgaagtttcacctgatgcttctgtgtcaagcgaaagacctattatcacaatgacagaacctttatgctccagaaacttcataacttctgacagtctatattcaaagtcactcggaagctaccccttggaaattgaatcttgcaaaaacaattcagataaatcactgttcagctctgttgaatccagtttggaagacattgatttgaatgatgatccaaagcttgaggaaaactgtgtatttgtggacgatagtgaactctatgcagtctcttgtagagcccaaaagcttagatcatataagaaaagaattctggatgcattttcttcaaagaagaggttatcaaaggagtatgaacagctagcaatatggtatggagacaccgatattgagccaaaacaaggattttcacaaacttcattgccatttatctccagaacgtacatggactcgaagaatgtgcaagttcagcgtgcttctgaaactgagtgggagctgctgtggcagactggcagactgaaaattacgttgtttaggtttccatga

SEQ ID NO: 69757 - DNA, 339 bp, Glycine max
  Peptide Sequence Number=SeqID_186535
atggagcagaaaggagaacgcacttacctcgacgtcgccaacaacggtgaacagaagaacgcgcaaggtgaacaacaccatcaccacctcgccaacaatggtgaagaaccaacaaccactccgccaaaagcaagaacgtccagtggtcgcggaagcaagaacacgcaaaaggaagaagaggaactaagttcgcgaaagagaaaaggaactgcacagctcgcagaagagaataagaacagacgcaaaatgtactgctggtatgaaatcaagggtcacaagtttgactccggaatcagcctcttgcaaatgcaagttaaggctgcctacatggatccataa

SEQ ID NO: 69758 - DNA, 456 bp, Glycine max
  Peptide Sequence Number=SeqID_186536
atggttaagactagaggattaggccatgccttaggggattgtgatgattttgacggtgctccccagcgtcgaaggtcgaccgcatcggcgcgcaggcaacaagtacttgtcactgttgccgatgaagtgcctgtggtacctggggacttgcctgtcgtacctgcggttgagcctgctgtagctatcgatgagccgatggtagatgctgacgcacagaacaccggtgtagaggctgacgcacaggacactggtgcagaggctgctgcagatgaggctgagggatttcctggtggacctagggacctatcagtgcttagggagtatgttaagaattttgcatctagcatatggtccgaagaggaatgttctgagttgaagttatcctcccatgggaggaaggtgcataaattaggcaagcctgttcctgcaattgaggacatggttgctgggacatga

SEQ ID NO: 69759 - DNA, 558 bp, Glycine max
  Peptide Sequence Number=SeqID_186537
atgagagggctgcaagccctcagcttcagaggactacacgtccttggcatcggagggctgcatgccctcaccttcagaggactacacatcctcaccttcagagggttgcatgcccccacttgcagaggactacacgtccttaccatcaaagggctgcacgccctcatttgcagagaactacatgtcctcgccatcatattgttgcacgccctcaccttcagaagactacacgtcatcgccatcagagggctacacgccctcgccatcagaaggctgaacgccctcccctttagaggactacacgtcctcgccatcagagggctggacaccctcaccttcagtggactacatgtcctcaccatcagagggcagaacaccctcaccttcagaggactacacgtcctcgccatcagagggcagcacgccctcaccttcagaggacttcacgacctcaacatcaaagggttgcacgccctcacttgcagaggactacacgtcctcaccaccaaagggctacgcgccttcacttgcagaggactacacatcctcgccatctga

SEQ ID NO: 69760 - DNA, 294 bp, Glycine max
  Peptide Sequence Number=SeqID_186538
atgtgccatttagctaaagggaaaagaaatgaaaaagttgcccaacaacttatgcaggtagattcgagtgtttacataggatcaagaggacctaagactccaactctccaagagcccagactaaaaaacacctatacccaagcttttgatctagataatttaatttttgtggaacctaatgatgatgcacaatctgaggaagatcttgatgatgataatggagatggagatgatgaagaaagtgatgatattcatggagatgatcctattagaggattggacaagcttctttga

SEQ ID NO: 69761 - DNA, 495 bp, Glycine max
  Peptide Sequence Number=SeqID_186539
atggagttagcaagtgttcacgactttctaaagggaaaaaccattttagttaccggtgcaacgggattcttagcaaaacttttcgtggagaagatattaagggttcaaccaaacataaagaagttataccttcttctaagagcagaaaatcctcatatagctacccaacgcttgcacgatgaggttttggcgaaggacttgttcaaggtggtacgagaaatgtggggtgcagattttggctccttcatatccgagaaagtgttggctgttgctggcgatgtttctcttgagaacttgggacttaaagacctaaacctaagggaaaagatgtgggaagatatagatatcatagttcacgctgctgctgctaccaagtttgacgagagatttgatattgcaatgagcataaacacgatgggagctcttcatgctctgaacttcgctaagaactgtagtaaaatgcaaattcttctccacttatctactggtatgtaa

SEQ ID NO: 69762 - DNA, 363 bp, Glycine max
  Peptide Sequence Number=SeqID_186540
atgacacagcaagtggtggtgaccaactgtgatggatgcattactgttgggaagggctggagaggcatcggcaacgaagaagagcagaacccgacagtgattgaacaggtggatctagtggttcgacgtccatgcttgcccattgtggtctgctgcaacacacgcgacaacctcaactctctctgctcctctctctccagtcttcccttcctttcgtcttctgctctgaattctcgcaactgtgcaaatggaattgtcattaatatggttgttggcgggaaagtggtaactctaaaaagcatagaagaaagcagtaatattgtcatgcaagaaatgcctatgcaaattcttgaaattttatga

SEQ ID NO: 69763 - DNA, 492 bp, Glycine max
  Peptide Sequence Number=SeqID_186541
atggtagaggaagaggaggaacggttaaaccctgataatctaaccctaatttggcgctcttctcagaaagtggagactgagactgagacctctgacttctcattagcttgtggggagggattcacttgtgaggaggtcaacgttgacggactaatatgttggggactcactttggcaagtttgggaaacatttccaatagtttcacagttttggcgattggtgatagtgccatatgtagcgttttcagcattttcaactgccagaccttaatttcatccgggtatgatattttatcattcacctatgatgttttgatcattactgatcgaattacggtgtttggcaccagttacagcgcgaagtcagggatcactctgggttttgaccaagaaaacaaaaaaatacaagggaaagggggcaaaagggtcattttgtggacttttttggacccaagctcgcccaggctagcatctgactcgcctaggtcatga

SEQ ID NO: 69764 - DNA, 963 bp, Glycine max
  Peptide Sequence Number=SeqID_186542
atggatccaaccaagaagcgcaagctcgacgagaacggcttcaacaacaacgactcttccgaccccctcaagctctccccctccgaagtccgcaagctcatcgagcgcttcacctccgaccagctcctcgacatcctccaggacgcggtggcgcgccacctcgacgtccttgccgccgtgcgcgccgtcgcggaccctgacgtctcccagcgcaagctcttcatccgcggcctcggctgggacaccaccaccgacggcctccgctcgctcttctccaccttcggcgacctcgaggaggccgttgtcatcctcgacaaggccactggcaagtccaagggatacggcttcgtcaccttccgccacgtcgacggcgcgcttctcgccctccgcgagcccagcaagcgcatcgacggccgcgtgacggtcacgcagctcgccgccgccgggaactccgcgtcgaacgtcaaccccgctgacgtagctctccgtaagatctacgtcgccaacgtgccgccggacctgcccgcggacaagcttctcgcgcacttctccgtgtacggcgaaatcgaagaaggtccgttagggtttgataaacaaacaggaaagtcgaaagggtttgctttatttgtttataagtctcccgagggtgctcaggccgcattgatagatcctgtgaagactgtggaagggaggcagttgagttgtaagttggcgattactgatgggaagcagggaaagcgggtagggccggactcggcccaggcccatcacgggaatgttcagcacgggcatggagatggagtgggggcgggaatggggatgcctcctaatgcggggtccgggcctgggcagtatggtggacctggacagtatgggcccccggttgggatgggttcttatggtgggtttggcggacagcctccgatgggcaatcataaccatcctcttaattcgacgaatcct

SEQ ID NO: 69765 - DNA, 468 bp, Glycine max
  Peptide Sequence Number=SeqID_186543
atggataaccatgaagatgaatgttgcaatgatttgaattcctcagtgattatagaaaagattgtttggttggtcaatgcttccaaacttgattttgatccttatttggagcttttgattcctaggttctgcaaagctagttcgtgtagggttgatgagtttgctttcaatgtgagtgttcttaacgagctagttttgacaagcttgtgtgttagagaggatttgttcgccttgtggaccaaagagctccaaagggcacagagagcgacgtggtgggtttcatcggatctagatctcgaggtaaggcactgtttggatttgcgaaacaacagtgagagctgcaaaaggttatacaataaggtcaaagatggtgacatggtgggttgtagtggggccggagatggcgacgtggagggttgcaacggagtcaaagatggtgatttggggtccactaatttgggaatttag

SEQ ID NO: 69766 - DNA, 453 bp, Glycine max
  Peptide Sequence Number=SeqID_186544
atgggagagatgattttgttcaatatgaaaggtgatgtacctttgatcatcgcacgccctactacagtactcagcactcactctgaaccattccccggttggattgaaggtgtgagaacggttgatgtttttgttgtcttgtacggtaaaggaaaattaagaagatcgataccagctgacatggtgataaattccatgataatagcattattagaggctcaatattcaaagagcctttccaagacattgctttaccatattggttcttcgttgagaaatccattcacaatttccgatcttgaggatgtagcctatcaatacttcacaaaaaatcctttgatcaacaaaaatggaaaacccgtggctatctccaacaaagttacgtggatctctagtatgagttcatttgaaagatacatgaagattcgatacgtgctacctctaatggtttga

SEQ ID NO: 69767 - DNA, 233 bp, Glycine max
  Peptide Sequence Number=SeqID_186545
cttacgtatgcggtgaggccaaaggactagtacctgaggagccttttcacatgggtcagaccccaaataggtcctcaacattagacatcaacgttgaaaaactgctaattgaggaaaaaatggaggagctccgggcacaaaatgctggtgaacaaacagccacatcggtcatgaaaaaccttggaattataaggtgtttcgtggaatctgttattctttttcttccaaaatag

SEQ ID NO: 69768 - DNA, 213 bp, Glycine max
  Peptide Sequence Number=SeqID_186546
atgtgttgcctgggtgggaagggtcagcaggagattcttgagtattgcgagacgccttgcatcgtcaaaaccgtctccatattccaaatgcaccttatcaagggactagatatcggaaacacccctcaaaactacaaggagttatttaatcttcgtcatgcaagtgcaaggaatgttattgaaaggtcatttggggtattgaagaaaagatga

SEQ ID NO: 69769 - DNA, 243 bp, Glycine max
  Peptide Sequence Number=SeqID_186547
atgacttttgattcacctaaagaaatttgggattatttaaaggaagagtatgaaggggatgagcacgttcatgacatacaaatgttaaacctaatgagagaatttgatgtgcaaaagatgaaggaatccaacacaattaaaggatactcagacagattgctaggcatctctaacaagattacaaaggatctgtccaagatctcgttgacagaggtgatacatgtcttgcaagcccaggattag

SEQ ID NO: 69770 - DNA, 1191 bp, Glycine max
  Peptide Sequence Number=SeqID_186548
atgactagttgctttcatcttttcagaaagaaaggatcttcctcaggcacacagttgaccggagttgatttagatgtttcagaaattcagaatgtcaacatctacacttacagagaattgcgaattgccactgaaggttttagcaatgcaaacaagatagggcagggaggttttggagtagtctataagataacttcctccactgtacagggaaagctgagaaacggttctttggcagctataaaggttttatcggctgaatcaagacaaggggtccgggagttcttgacagaaatcaaggtgatctctagtatagagcatgagaatctagtcaagttacatggatgttgtgtggaagacaaccacagaattttggtatatggctatcttgagaataacagcctagcacaaacacttattggttcaggccatagcagcatccaattaagttggcctgtaaggaggaacatttgcataggtgttgctcggggccttgcattccttcatgaggaggttcggccacacattatccatagagacataaaagcaagcaatgtactacttgataaagacctccagcccaaaatttcagattttggccttgcaaagcttattccaccaaacctgacccatattagtactcgtgttgctggaacagttgggtatctagcacctgaatatgcaatccgaaatcaagtgactagaaaatcagatgtctatagttttggagttctactattagagattgttagtaggaggcctaacacaaacagacgtttgcctgttgaagaacagtatcttctcacaagggcttgggatttgtatgagagtggggaggcagaaaaattggtggatgcttttctagaaggagacttcaatattgaggaggcagtcagattttgtaagattggtctcctttgcacgcaggattctccgcagctccggccctctatgtccagtgtgcttgagatgcttttaggtgaaaaagacgtgaatgaggagaatgtgacaaaaccgggcatgatatttgaatttgtggaagccaaaagtgcaggtaaacaaaaatgcaaagctgaagtggatagtaaatctttgttggctgaagggaagcaagatgattcatcttcatcaggaaccatgagctcttttgctaccatgaccttcacagcaatttatgatagaagcgattag

SEQ ID NO: 69771 - DNA, 2919 bp, Glycine max
  Peptide Sequence Number=SeqID_186549
atgtcggaatccttgtattctggacgccctaacactgggcgaggtgctaataatggatctggcttggcgacaaacttggaacatggctcgtctgctctcaattctgacataccgctcctgacttatggggaggaggatcctgagatatcttctgatagacacgcgctaattgttccgccttatgtgaatcatgggagcagagtccatccaatgccttataccgatccgtctattccattgcaacccagacccatggtccccaagaaagacattgctgtgtatgggtatggaagtgtggcttggaaagaccgcatggaagattggaaaaaaagacagagtgacaaacttcaggtggtgaagcatgaagggagcaatgatggaaattttggtgatgattttgaggaccccgatttacctatgatggatgaaggcaggcagccactttctcggaagctacctatcccttcaagcaagataaatccttacagaatgattataatactccgccttgttgtgcttgggctctttttccattatagaattctccacccagttaatgatgcatatggcttgtggttgacatcagtcatctgtgaaatatggtttgctgtatcatggataatggatcagtttccaaaatggtacccaatacagcgagaaacataccttgatcgtctgtcactcaggtatgaaaaagaagggaagccatctgagttgtccagtgtagacgtctttgtcagtactgttgatcccatgaaggaacctccactgattacagcaaacactgttctatctatccttgctgttgattatccagttgataaagttgcatgctatgtctcagatgatggtgctgctatgcttacttttgaagcactgtctgagacatctgaatttgctaggagatgggttccattttgtaagaaatacaatattgagccccgggcaccagaatggtactttggtcagaagatggactatctgaaaaataaagtacacccagcatttgtcagggaaaggagagcaatgaagagggattatgaagaatttaaggtgaggattaacagtttggtggcaacagcacaaaaggttcctgaggatggatggaccatgcaagatgggactccttggcctggaaataatgtgagggatcatcctggcatgattcaggtcttccttgggcaggatggtgttcgtgatgttgaaggaaatgagctaccccgcttggtctacgtttctagagaaaagaggccagggtttgatcaccacaaaaaggctggtgcaatgaatgctctggtacgggcttcagcaattatcactaatgcaccctatcttctgaatgttgattgtgatcactacattaacaatagcaaggcacttagagaagctatgtgttttatgatggatcctcaactagggaaaaaggtttgctatgtgcaatttcctcagcgatttgatggaattgatagacatgatagatattcaaacagaaatgttgtatttttcgatattaacatgaaaggattggatgggatacaaggtccaatatatgtcggaactggatgtgttttcagaaggtacgcactttatggatatgatgcacctgccaagaagaaaccaccgagcaaaacttgtaactgttggccaaagtggtgctgcctatgttgtggctctagaaagaaaaagaatgccaatagtaagaaggagaaaaagaggaaggtgaagcacagtgaagcatcaaagcagatacatgcacttgaaaatattgaggcggggaatgaaggaaccaacaatgagaagacatccaatctgactcaaacaaagttggagaagaggtttggacagtctccagtatttgtagcctccacacttttggatgatggtggagttccacatggcgtgagtcctgcatcacttttaaaagaagccatccaggtcatcagttgtggttatgaagacaaaacagaatggggaaaagaagttgggtggatatatggttctgtgacagaggatatcttgactggatttaaaatgcattgccatggttggcggtctgtgtattgcattcctaagcggcctgcatttaaggggtctgcgcctatcaacctttcagatcgtctgcaccaagttcttcggtgggctcttgggtctgttgagatttttttcagcagacattgtccaatctggtatggctatggtggtggattgaaattgttggaacgattttcctacattaactcggtcgtatatccctggacttccctcccattgcttgtctactgtactctaccagccatatgccttctgactggaaaatttatcgtacccgagattagcaactatgccagtcttgtgttcatggccctcttcatatccattgcagcaactggcatccttgagatgcaatggggcggtgttagcatagacgactggtggaggaacgaacagttttgggtgatcggaggtgtttcttcccatctatttgccctatttcagggtttactgaaggtcttggctggtgtgaacacaaacttcactgtgacctcaaaagcagcagatgatggagaattctcagaactctacatattcaagtggacatcactcttgatccctccaatgactttacttatcatgaatattgtcggggtggttgtcgggatctcagatgccatcaacaatggttatgactcatggggacctctctttggtagattgttctttgcattgtgggtgatcctccatctctaccccttcttgaaggggttgcttggaaaacaagatagaatgccaaccattatattggtttggtcaatccttctggcctccatcttgactctcatgtgggtcagaattaacccgtttgtgtcaagagacggccccgtgttagaaatttgtggattgaattgcgacgagtcgtga

SEQ ID NO: 69772 - DNA, 264 bp, Glycine max
  Peptide Sequence Number=SeqID_186550
atgcagtgcgccgtcatcatcgcctctggattcggatgcggccacgaccagtctgagcaccacacggctgccggcggcggtccggttcaccagagtcgccacaaagttcttcgtggtcgaactcatgggagcgatggcggaatgcaccacgagtggagccgagatcttgccactgcggtacaggtttgttgcttgcttagggtcgatggtggattcatttctcgtagtgacggtattggtgggttcatttctaaggacgaaaag

SEQ ID NO: 69773 - DNA, 1449 bp, Glycine max
  Peptide Sequence Number=SeqID_186551
atggagcggaagcaagggttcttctctgcgctcaaagacgaggtggttcgcggcctctcgccggcgcggtcacgcgccaagagccccgccaggagtgcatcgcccatgtcctcgctgctccgccgccgcaggaagcaccacgcgccgccgcctgagctcttcattgcgagatcgggaagcctcaggcccgccgaggccctctcgccgctcaaggaaggtcctgacggaaccgacggcggccaggactcctcgcgcggagagggaaggtggggccagtggatgaaaggaccactcgctagagcaccctctgtttcttcttcctcgtcctcttgcaacaacaaaaagtccgatctgaggttgcttcttggcgtgttgggtgctccactcgctcccgtgcacgtgtgcaccacggatcccttccctcacctcagcatcaaagacatccccattgttagtccctctcttcttgttatcgaggagacttcttctgctcagtacatattgcagcagtacattgctgcctctggagggcagaagcttcagaattcgattaacaatgcgtatgccatggggaaggtgaggatgatagcctccgagttcgagaccgcaaacaaggtcacgcggagccggaactcgtccaaggccgcggagtccggtgggtttgtcttgtggcagatgaacccagacatgtggtatgtcgagcttgctcttggtggcagcaaggttcacgccggttgcaatgggagattagtgtggcggcacacgccctggcttggtgctcatgcggcaaaagggccggttaggcctttgcgacgcacccttcagggtcttgacccaagaacaactgcaagcatgtttatcaacacaagatgcattggggagaagaagataaatgaagaggactgtttcatcctcaagctttgtgcagacccctcaacattaaaagcaaggagtgagggtccagcagagatcattaggcatgttttgtttgggtactttagccagaaaacaggactccttgttcacttggaggactcccatttgacacgcattcagaacaatggtggcgaggcagtatattgggagaccacaataaattcatttcttgacgattacaggcctgtcgaggggataatgattgctcactcgggtcgatccgtggtgacgcttttccggtttggggaaacagcgatgagtcacactaaaaccaggatggaagaagcttggacgattgaggaggttgcgttcaatgtccctggcctttctgtggactgtttcattcctccgtctgagctaaggtttgcttctatgagtgaagcctgtgagcttccccaaggtcagagggtgaagactgctgtggcagcagctgcataccatgccaaagtcactcaactacaaaaatcgcacgatagccacacgaataacattaactggacagtggatgtttag

SEQ ID NO: 69774 - DNA, 468 bp, Glycine max
  Peptide Sequence Number=SeqID_186552
atgtcagcgcttcagaaggaagtagcagaatatgatgatttcattttgttggatatccaagaggagtacagtaagctcccatacaaaacgttagctttcttcaaagctgcttatgcactttttgatgctgaattttatgtcaaagctgatgacgacatatatttaaggccagttgtctcactggtgcaaatggattgggagctatgctcttattgttatccagacaatcttcggagtttccggatgttcagcaatgaggatgttactattggagcttggatgcttgcaatgaatgtcaaccatgagaataatcatgaactttgtgctacagattgtacagccacatctattgcagtgtgggatattccaaagtgttcaggcctatgtaatccagaaaagaaaatgttggaactccatcaaaaggaagcctgctctaagagcccaactctggaatcagatgatgaatag

SEQ ID NO: 69775 - DNA, 330 bp, Glycine max
  Peptide Sequence Number=SeqID_186553
atggggtttcatttccccgagcgcagtgaagaagaagaagaagaagaagaagaagaagaagaagagatgagcgtggaagatcttcctgggaaagaggtaaacgtgctgaagggtcacgagggtggcgtgttagccgcgaggttcaacggcgatggcaattatgttctgagttgcggcaaagaccgtaccatacgcctttggaatcctcaccgtggcatccatatcaagacctataaatcccacgctcgcgaagtccgcgatgtccacgtcacacagtactctctctctctcagaatcatgcatgcatattcggaatgcttcaattcttag

SEQ ID NO: 69776 - DNA, 297 bp, Glycine max
  Peptide Sequence Number=SeqID_186554
atgggcttctacttcatcctcaccctcttcatttgccccaattttctcattcgtccaagcaggatgactaaatttgccacttttcagacccacatcgatcctttcactggtgaagaccaaatccgcaaagctttgaaggtcctcccaggaatggactcgggaaggttccaagttagtgtaccaggtaacaactaccccaggattgcctttgtggataactgggcggtgggtaaggagaaggtttgttattggctgagtaatgacattgttgggttggtgggatacttggccatatag

SEQ ID NO: 69777 - DNA, 219 bp, Glycine max
  Peptide Sequence Number=SeqID_186555
gaacaacaagctgagtgggaacaacaagttgagtgggtaaacgcgcagagacagattctgcgccctttatcattcaggaacgacaagctgagtgggagcagcgaggcgggtgataaacgtgcaaaaattgattttgcgccctttgtcattcaaaaacgggcgatcgtgtccggtggcatgcagagacaagttatggtcattctgtatctccccacctag

SEQ ID NO: 69778 - DNA, 267 bp, Glycine max
  Peptide Sequence Number=SeqID_186556
atggggaccaccacggctgaaatacatcaccagggggatccgggaccttataacagcccccttcaacctatttataggaaaaagggggaggaggtagccgcccagctcgcctggttgcttcctccagaagcaatccagcttcaaaaatactctggaaggcccattttcaaaatttcaaaattgctatttgcaccccccgcatttttgataagttcacccccttctttcgtaatttacggaaaagttacgaaagcctattggacttga

SEQ ID NO: 69779 - DNA, 664 bp, Glycine max
  Peptide Sequence Number=SeqID_186557
ggtggacccttgggtactagtacctattaccttcagaggactacacgtcctcaccttcagagggctacacgcccccgccttcaaaggactacacgtcctcgctttcagagagttacacgccctcgccttgccttcaaaggactacacatcctcgccttcagaggactacacagggcttcacatcctcgccattagaggattgtacatcctcgtctttggaggactgcacgtcctcgccttcagagggctacacgccctcgcctttagaggactacacatcctcgcctttagagggctgcaaatccttgcctttaaaggactactaataccctcacctttagaggatgccttcagaggactacacgtcctcaccatcagagtactacacacaggactacatgtcctcgccttcagagggctacacgtcctcgccttcagagggctacccatcctccctttcagagggaaacacgccctcgccttcaaaggactacacgtcctcccttttagagggttacacgccctcaccttcgtagggctacatgtcgtcgccttcagaggactgcacgtcctcgcctttagaggacaacacgtcctccccttcagagggctacacgccctcgccttcagaggactacacgtcctcgccttcaaagggctatag

SEQ ID NO: 69780 - DNA, 405 bp, Glycine max
  Peptide Sequence Number=SeqID_186558
atgaacaagaaaaaattgcaaaaagatcttgtcagggctcctgtggtgcagtgggctggtccagaggtgaggagggagtatcttgggctggctggggtgtgtcctgaactgttgtggaccaagggtcccaaaaatgctaaagttgatgtctcgctaagcgagctcaacgcgcttagcgagtgtcatccgctaagcgagacatcaacgcgcttagtggataagagtaatctggaaggcaatctgtcacgcaggcacgtgctcaatgcattatcagctcgctcagtgagtcgtttctctccttccaggcttagcgcgagtttggcgctgagcaaaaattcacttactcgcgctaagcgcaacgtcgaggtcagagagtcctttttaagcttgatttgcgcagaatga

SEQ ID NO: 69781 - DNA, 579 bp, Glycine max
  Peptide Sequence Number=SeqID_186559
gcaatcaactacaataatttcactatccgagtggttgatccaggagtcgatcaacaaacaaattgctcctcccttcctcgctatttcttgtctcgctccaatttcactgatacttacagtgatatttacaacatggatccataccaagctggtcaatattcaggtcgtagtaattgggacaggcttgctttccagcatatagtgtatatgaattgtagcaatccagtgactcagaatgggaagtatgtggatactgcttcatacgtcaactgggactccaaagacaagtacatatacgctattgctggtgacttaaaagcagaggacttccaagttggttgtcacgtaaagctggttgctctgacatcttggtggggtttggatacaaacaattattcctactctgccatgcacacggggctagtctatggatttgagatttcatggatgcgcctcatatgtgaccagcactgtccaagtaaacacggctgctactactacaaggtctgctttttcgactctgtcagccaggaggttcattattggaactgggaaacatcatggggttggagtgagtga

SEQ ID NO: 69782 - DNA, 174 bp, Glycine max
  Peptide Sequence Number=SeqID_186560
atggcatttgatgagccggtggagctcgccgctctcgtggagcaggtggacatcgtcggctccgccaatgtagatgccaccgatgaatacgcgtggcaagggaaggttgctgcaacagccgaggacgatgtggagctcgtcgcggaagtcggtgatgctcttgtgcggccgtga

SEQ ID NO: 69783 - DNA, 660 bp, Glycine max
  Peptide Sequence Number=SeqID_186561
atggcaggaggttttaaagacaagttgggtgaaggaggatatggctctgtgttcaagggaaaattgggtagcgggtcttgtgtggcaataaagatgttagtggctcgtggaattgcttatctccactatgggtgtgagatgcagattttgcactttgatatcaagccccataacattctactagatgaaaacttcaccccaaaggtctctgactttggattggcaaaattatatccaatagataatagcattgtcccaaggacagcagcaagaggaacaattggatatatggctccagaattgttttataataatattgggggaatatcccataaggctgatgtttatagctatggaatgttgttgatggagatggcaagcaagaggaaaaatctaaatccccatgcagagcgttcaagtcaacttttctttcccttttggatttataatcatattggagatgaggaagatatagaaatggaagatgtcacagaggaggaaaagaaaatgattatagttgcactttggtgtatacaattgaaaccaaatgaccgtccttcaatgaacaaagtagtcgaaatgcttgaaggagacattgaaaacttggaaatacctccaaagccaactctgtatccaagtgaaactatcacaaaagattaa

SEQ ID NO: 69784 - DNA, 405 bp, Glycine max
  Peptide Sequence Number=SeqID_186562
atggattttctgctttggtttcttggagttaaacttgactgtgtgtttggtgaggacttggatttggatgaaataacatttctattagagttatacgacgacaatgactgtgacctaaaatcacctctgaagaaacccgattccgcatccacccccagtcccaccgcgtgcggcgtcaaagaggatttctccgtgctcaccaacgacgaagaagaagaagatgtaattgccgattgtcatcttcctcttcagtcatctacttttcctcttttctctccggtgattgttggaactcaaagagcttctttgatggaacagtacgaaaaggttgagaagatagggtcgcgaccgcgtcaccaacgagaccatcgcgttgaagaagattcgcctcgagcaggaggatga

SEQ ID NO: 69785 - DNA, 531 bp, Glycine max
  Peptide Sequence Number=SeqID_186563
atgcggccaaattgggttgaaactgttcccaccgtgaagaaagttgtggaagaaaggtggagttctcttggtgagttgagggtgtcggggtcttggggaaagcaaaagtgccaacaagtggtagctgacggtgccggggtcttagggaaagctttatgcatgattttggggaaagctatattaatgaaatctaagggttcaattgcatgttcaaaatttatgttaagcaaatctaaggagcctccagtgttcaaaagtcaaaatttgggcctcaaggatcttgttgtttgtagagttggacaaacagggtctgaaaaagttggtgtctcgctaagcgaggcatatgcgcctagcgagcaacatccgctaagcgaggcatcagctcgctttgcgagtcaagggaatcttgaagagaatctgccacgcatgcatgcgctcagtgcgccatcagctcacccaacgagtagtttgtctcttctggcgcttagcgcgcctggctcactaagccaagagtcacttactcgcgcttag

SEQ ID NO: 69786 - DNA, 291 bp, Glycine max
  Peptide Sequence Number=SeqID_186564
atggcagcttttccttctactgtttttgactcaggaaaatatttcttcataaatttttcaattacttcatcccaattcttcaaactattacccttaaatgagtgtagccatctcttggcttctccagacagtgaaaatgaaaacaaactcagcctaactgcaccctctggcacaccggcaatcttgactctattgcaaatctcatgtaggttgctaggtgtgcatatgggtcttcattaccatgaaataaattgccttgtattagctgtattaaagaatgaggataagtaa

SEQ ID NO: 69787 - DNA, 420 bp, Glycine max
  Peptide Sequence Number=SeqID_186565
atgtttgacatcgttacaccagttttggcttacgggatgcagcgaaattcgttggatttgagatggtttgaagcaaattctagtaagtgcaaagcaaaaggaaagaaatgtaaatggaagaacaacaaaggttcgattcttttggggttcatagttattgccatttttaagatcatataccattttagacagaaagaagaggaccaagcaagggtgaagaagttcttagaggaatacagggcagaaaagcctgcaagatttacttatgctgatgtgaaaagaatcacaggtggttttaaagagaagttaggggaaggagctcatggggttgtattaagaggaaaaatttcaattgagattctggtggctgtgaagatcctcaataatacagagggaaaaagggaaagagttcatcaatga

SEQ ID NO: 69788 - DNA, 165 bp, Glycine max
  Peptide Sequence Number=SeqID_186566
atggtggcgacgaggtctttgtgggggttcaggttaataaaggaggtagcgacgagggtttgggtctgtggtggtgacaacaaggttgtcatagggagtttggcaacgtggtggcggggtggggtcgtggtggcagtgatgtggttgatgctacaacttatataa

SEQ ID NO: 69789 - DNA, 432 bp, Glycine max
  Peptide Sequence Number=SeqID_186567
atgaacctcgttgggaccctttgtgtttacgctgctatttgcaagcatgagggtgttccgttgtggtttccagggacgaaagctgtgtgggagtgttataacactgcttcggatgctgatttgattgcggagcagcacatttggggtgcagtggatccacgcgcgaagaacgaggcgtttaattgtagcaacggggacgtgttcaagtggaagcatgtttggaaggaagagattgtgaagaagaatgggttgcagagaacgaagcttgaagatgttggggattggtggtttgcggatcttattctgagaatggaggctgtgttggatagcatgaacaaggcgagggagcacgggttttttggatttagggactccaagaaatcgtttatgaattggatagataagaccaaagcttgcaagatcgtaccatga

SEQ ID NO: 69790 - DNA, 198 bp, Glycine max
  Peptide Sequence Number=SeqID_186568
atggtggataagggtttggggtttatagatttctctttaaccaatggtgttaatgctcttggcatgcttgttcgttataaggtcaataggaagactcaagggcctagtctcattgttgtagaagaacctgaaagatgtaatcatgctaggcagaaacacttggtctatataggtcctttaagtataggtttggtttaa

SEQ ID NO: 69791 - DNA, 1824 bp, Glycine max
  Peptide Sequence Number=SeqID_186569
atggtgaaagattttcgccccatctcttgctgtactgttgtttacaaaatcataacgaggataatgtctacgcggctggggaaagtgttgagttcagttctgcatcagagtcaagcagcgtttataccgggccagcgtattcatgaccatatattgttggcttatgagctgatcaaaggttacaacaccaagggaggaactccgagatgcatgctccaaatggacttacaaaaagcgtacgactccgtggaatggtcggcgttagaagccattttaaatgaattaagcatccctcacatgttcattaagtggattatgattacggtgactactgtgtcgtatagataccaagtgaatggtgcgctttctaatattgtgcaagctaagagagggctcaggcaaggggaccccctttcccccttgctctttgtgatcgttatggaatatctctaccgtgttctgcagaagttgaagcaggttccgaacttcaattttcatccgaagtgcgaaaagttagccataatcaaccttagctttaccgacgatctgcttatgtttacaagaggagatcccatgtctgtaagattggcgatgaatgcttttaatgatttctcagcagccactggtttaaaggttaacccatccaaatgtaacatttattttgaaaatgttgcggatgaggtgaagaaagagattcaggccaatgtgaactacaatgaaggcaccattccatttcgttatctgggcatccctttatcgaacaaaaggctttctgttgcgcattgcctgctcatagcggataaaattacggcgagaatcacacattggagtgcgcggcttctgagttttgcgggcagggcacaattgattaacagtgttctttttgcagtttcgaatttctggctgcaatgcataccgctacccaaggaagttatcaagaggattaatgcaatttgtcgctcgttcctgtggtcgggtggagataagcttacgcgtaaatcccccatagcttggaagcgagtctgtacaccgacgaagcaaggaggtctgaatattatttctattgaggaatggaacaaagctaatctcatcaagttattgtggaatctaaatggtaaaaccgatagtttgtggataaaatgggttcactgttatttcttaaagaaatggagtatcatgaatgtccctatgaagactaacacttcctggattttgaaagcagttttatctcaaagacaagaagtgtgtatcaatccaatttggcaaagtgtgttgcagggacaaaaatatcaaacaggcagaatgtacaagtctctaattcatcaattccaagaggttaaatggagatacttattcaaaggtaacatggcccgtccgagagcccgctttatcctttggatggcttgtcatgagagaatggcaactaaagatagattaatgcgatttggaatgctcaatgatgatacttgctgttactgtaaagaaaaagagaccattcaacatattttcttccaatgtaatgtgttgagtcaattttggaaacacacccttaaatggctagaggttccacattctccgggtggttggaatgaggagttggattggattattaagaagtgcaagagtaaggggagcaaagcgaagatcataaaatgtgcgttcacgaaagcggtttatgaaacctggatgttcaaaaacaacaagtgttttggtctggatactactagtagtgatgtaggcactagaatcaccgacaccattgtttacagatgttggttgaatcctaagcttaggaatcatttgggtaggcttatgatcccttag

SEQ ID NO: 69792 - DNA, 129 bp, Glycine max
  Peptide Sequence Number=SeqID_186570
atgacgtcaaccttcgttatgttccatgtcgctttgaaaaatttcgcattgtacccatctatccccggcgttatgttccattatgctattattcgggggaaggcacacgatgatattaatagggattag

SEQ ID NO: 69793 - DNA, 372 bp, Glycine max
  Peptide Sequence Number=SeqID_186571
atggaaataagctcagtgccttacccgatggcatcttgtgtcatattctatcttttctatcaactgatgattccattacaacaagcatcaacccattacactatcctcaaccttgataacaatacttttattcgaaagggtagatcctactcttccttctttaattttgcctatgccaccattctctcgcgcaacatacatcaacccattacactagcacgcttcctcctcaactttcacgcatgtggatttcacaccaacctcccctactctcatttcacgatatgggttaacattgtcgttcagcgtggtcttgagcacctgcatattgagattccccatgcactcgagttgccaaaagcactgttttga

SEQ ID NO: 69794 - DNA, 1182 bp, Glycine max
  Peptide Sequence Number=SeqID_186572
atggagcttctgacggtggtggatgatttttttgtcacggcttccctggcgcttcttctcaccttcatcgtcttaaagctcgttgaggtcatcaacgacactcacgccataccaaaacgtcacgtcgtccaccgcgaaccggatcgtccggtttctcatgccgaacaacgcttcacggttcagcccgctccagccaagaccaaggtcggtttcgttagtccggttcaggaggaatttgccacgtgtgcagtaggaaccgaacacaagatagaaaaaaaggctgccgtcaaaccggttcgtcctcgtgggaaacggttcacggttcatcccgctcaaagcaagagtggcgtagaaacagaatgtaatagagaagagattgcagtcgaaccggaacgcaagatagaagaggctgtggtcgaaccggttccggttcagaccgaggtcactgttggtttaattagtccggttcaagatgacacgtgtgtaggaaccgcagagaagatagaagaggctactacggtagaatccgataaaaacgttgaagaggaaatcgctgagggcaatgaaggaacacaagagttggatgattctgcggagaagaggaacgtgaaaagcgttgaagaaatcagcgtagaaccttcaactgaaattgaagcttctgttacagatagcggcgtaaaagagaacttcgatgatgatgatgatgattgggaagggattgaaaggagcgagttggagaaagagtttatggcggctacgaaatttgttagtggcgaggaaaatcgattggggggtgctggaagcaatttgaggatggagttgtatgggcttcacaaggttgccaccgaagggccatgccgtgaacctcaaccaatggctctcaagctcgccgcacgtgccaagtggaatgcttggcaaaaactggggaacatgaatccagaggttgcaatggagcagtatgtcagccttctttcggataaatttcccggatggatgaaagatacttctgctggaataggtgaacatgaaaccacaaggcctgaagtttctgagtctgctgcttctgatttgagcacaactttgtctaatcaacaacaaatgatcacaactgaaagggagcttgaacaagagtctgattccaaggaccgtagcccacttacagtgtcagatttggagaacagt

SEQ ID NO: 69795 - DNA, 990 bp, Glycine max
  Peptide Sequence Number=SeqID_186573
atggcaaatgaactacccgtcaaagcttttggttgggctgcttcagacacttctggcacccttgccccttttcatttctccagaagggaaaatggcgtcgatgacgtcactctcaagattctcttctgcggggtttgccactctgatctccacactctcaaaaacgactggggtttcaccacctaccctgtcgttcctgggtgtggtcggagtaaaaggcatgaaattgttggtgttgtgacagaagttggaaacaatgtgaaaaacttcaaagtgggtgataaagttggagttggtgtgatagtggagtcttgcaaggaatgtgaaaattgccaacaggatctggagaattactgtccccgccctgtgtttacctataactctccttattatgatgggacacgaacccaaggtggttattctaacattgtggtcgtgcaccagcgttatgtgctccggtttcctgagaacttgccccttgatgctggtgctcctctgctgtgtgctgggataactgtgtatagcccaatgaaatattatgggatgacagagccaggcaaacatttgggagtggcagggcttggtgggttaggccatgttgcaatcaaacttgctaaggcttttgggctcaaagttactgtcattagtagttctccaaacaagcaagctgaggccattgaccgactcggggctgattttttccttgtttcatcagaccctgcaaaaatgaaggctgctttgggaaccatggactatatcatagacacaatttctgctgttcattccttgattccactgcttggtctgctgaagctgaatgggaagctagttactgtagggttgcctaacaaaccccttgagcttcctatctttcctttagttgcagtttatttagtattgaatgtcatacaatgtaagtgcaatcataccagtattaatgcatcagatcccaacaaaactctacagttaagtgtgcttggacgaaagtag

SEQ ID NO: 69796 - DNA, 324 bp, Glycine max
  Peptide Sequence Number=SeqID_186574
atggttgttggagaaggattggagccttcaaaaggagttttgcatctgaggctagaccgcgtgctaaccatgggtgaaaaagagagactgcaaggtatgttttaccataaccccacggtggacgccaaccgtatttatcaaaattcggagttgtccaaggttaggatagacatggatgagaatatgagtgagtatgaaaagagtgagatggaacctgatacttatagaatagagtgggagctacaagtccttatttgtaggaactgttacggtgacgtaacaacccttgtagataattattggcttatagataataaccaatag

SEQ ID NO: 69797 - DNA, 555 bp, Glycine max
  Peptide Sequence Number=SeqID_186575
atgagttttgaattaggtgtcgttgtcgatgacaatggcgtaagggaggccatacctgcatatgaggtgtttacaagtgaacttctccacctcgttggttgtgatttctcgcaatggtcttgcctccatccacttggtgaagtagtcgatagcgattatggtcccagtatgtctattccctacatggcgagggccaaggagagctcaggctatggagattgtcaggaagaatgcacgggatgcgttgggctttgttctcgtctagaggcaacaccccctgaattaggaaattcttgtaaaggtgtctatgatgggagtttggagtgtctcctagatgatagtcttgaggtacccggtatttttggtgctggccaggttggagagcatgtctgctctagtgttgctctcccttggtatgtagtacatctcaaagcattcaaagttgtcgatgagagttttggcaaagtggtagaacttgtgcaacactatttccttggtctggtatttgttggaaccttgcccattgacaagctacgagtcagtgtagcatcgtag

SEQ ID NO: 69798 - DNA, 678 bp, Glycine max
  Peptide Sequence Number=SeqID_186576
atgctatcagaacttgatgtcttgacaaaacccaagacaagcgcatccctagtcgcagctccaaaggcttgcaaaacccaaagtcttcccttggtgagtctcatttctccaaaggctcgcaaaaccctaggtatgtccttggttagtctcacttctccaaaggcttgtcaaacccaaggttcgtccttggtgagtctcgcttctccaaaggcttgtcaaacccaaggttcgtccttggtgagtctcgtttctccaaaggctcgcaaaacccaaggctcgcaaaacctaaggtttatccttgttgattcctctctaaagcctcgtcaaacccaaggttcatccttgatgagtctcatttctccaaaggctcgtcaaacccaagtgagcctcgccaaaactcgggataaatgcgtccctggtccaaagctcgttaaaccgaaggttcgccattggcgagtccatctacagaaatataaggaatacaagtctacaggaacattagaaacccaaggtccacccttggtacaaaaatgcattcctacaaaaatccaaggaccacccttggtacgcattcctacaaaaacccaaggcatgcccttggtaagctcactccttaggaactatgaaaaccataacctaaagtccatgattccacaaggcgaaaagaagcatcactag

SEQ ID NO: 69799 - DNA, 366 bp, Glycine max
  Peptide Sequence Number=SeqID_186577
atggatgattataaatctttgcaaattgagtttggaaagttcaaaaaggattactatgaagaacgtatgaagtggcaaactgagctttcctatcgtaaagatctttttagaaaaatgaacaatggaaagagtaatcttagtcacttgcttagtgtgcaaaagcatactattgataagactggtttggggtataacaagcaaactcccttttctaagaaaaccaagtttgcatcctccaaaaaggtgtgcctaaaagcaaaagactcactatggtacttggatagtggctgctctagtcacatgacgggtgacaagtcgagacttactgacatggtgtcaaaggaaggaggatatgtcactttttga

SEQ ID NO: 69800 - DNA, 999 bp, Glycine max
  Peptide Sequence Number=SeqID_186578
atgcccctagtaaagcaggtcggacctgctggtgggactgtgctaccatttgttgtcattcctcctacaaaagaagggggtcaaactgctgtggaggttggcactgctactagtgttgctgaggtctcccccaatattctttcctctattttggctaagaggaagccaaatgacggtgtcggggtgtcaggctcttctactccttttgttgctattgttgttgttgcggctcctactcctccacctcctcttactatctctattaaggagatttctatttctcatgcgactgaagttagtgcgccagtcgcttcggtcagtgctgtcgaggctcctctgtctactattgttgcacccttgttgagcgtcggtgtggcaaccataagtactcccgtgatgtcccttcctccttcttcagcttcatcagttccccccttgaccgtgttggtgtcagcgttgtcttccacttgtcttttcacccaagtgtttctttggatcacatcttcacttcttgtgatgttgattttctatggggtatgggttacaagcctgaccagaagaccctgctggggtctagaatgctacggattctgtcaaagtcttcctatagtgaagtttggtgatcctggaagagaatggacaaaggcaccaagaggcgctaaattagatgatgatgagctatttgagcgctgcaagtgcttgcagagggagaagaatgaattggctaacaaggtggtggcggaccttgaggcccaactgaaggagttggagtccaggctgcaggagtctgagctgcaggcgtctaaggaaagggaggctagcaaggaacttgaagaagagttgctaatttacaagaaggaggaccttgacttgggtcttttcgaccctttcaaggatgtgaaggacgatattctgcttgaggaggaagatattcatgttgaggaagaggttggggaagagcaggatgctgaagagaaaggcgataatgctaatatttag

SEQ ID NO: 69801 - DNA, 2757 bp, Glycine max
  Peptide Sequence Number=SeqID_186579
atgtgtggaaatagggagtggttctctaccattgatgaggctttcagacactcggtaaagcttggcaacgattcaaaaatggaagtactaggcaaagggaacatcagacttcagatcaatggtgcaattcatgtagtcactgatgtttactatgtcccagatttgaaaaataatttactgagtgtaggccaacttcaagaaagaggactagctttacttatacaagatgggaaatgcaagttgtaccaccctagaagaggattgataatgcaaacagaaatgacagcaaatcggatgtttgtgctgctggctagtgtagtgcttgaagagacttcaacatttctacaactagctactgaagatagttcacaattgtggcaccgtagatttggacacttgagttacaaaggtttgaggactttgcaacacaaacagatggtgaaaggtcttccatttttcaaagattcaagtaaaagttgccctggatgctttgtaggaaagcaacatagagatgtcataccaaagaagagtcaatggagagcttcccataaattacagcttgtacatgctgacatttgtggacccattactcccaactccaatagcaacaaaaggcaactcacaacatcttacactccacaacaaaacggcgtagcggagcgtaaaaatcgaaccattatgaatatggtccggtgcatgctttgtgacaaacaagtaccaaaggctttttggccagaagctgcaaaatggacagttcatgttctcaacaggagtcctacattgacagtgaaagataaaactccaaaagagatgtggagtggaatcaaacctaaagtagattactttaaagtatttgggtgcctaactcatgtccatgtacctgatcagaaaagaacaaagctggatgacaagagcctgcagtgtgtattgcttggggtaagtgatgaatctaaagcttatagattgttcgatccagttgcaagaaaaattatagtcagcagagatgtgagttttgaagaggataagggctggaattgggggaggactgcagaagaagtgaagcatgacgtgttgatttgggaaggtagtaatgatagtgaggatgcctcctctgaaaatgaagaagaagctgttgtggaaggtactgaaacagcaggagttatagaccaagatgcagaagcaacaacctctacatcaagtgattcatctaatgaagatgcatctgtacatgctacagctgaaggaaggagtcaaagagcacccaactacttgcaggattatgaaactggtgaaggattatctgaagatgaagattattttgcaatgtttatctctgatgatgaagattattttgcaatgtttacctctcatgaagatccaagctcatttgaagaagctgaaagagatgagaaatggagaaaggcaatggatttggagattgaagcaatcaaaaagaatgaaacctggcagcttacaactttgcccaaaggtgctaagaagattggagtgaaatggtgggacacaatccggatggttttagctcaagcagcacaaaagggatggaatgtgtatcaactagatgtcaaaagcgcatttcttcacggagaattgacagaggacgtgtatgtggaacaaccaccgggttatgttcgaaagggtgaagaagagaaggtctacaagcttaagaaagctttatatgggttaaagcaagcaccacgtgcttggtatagcaaaattgaagcctattttgtgaaggagggatttgaacgatgcgatcatgagcacactctctttgtcaaaacaggaggaggtaaaagaattttaattgtgagtttgtatgttgatgacttaattttcactgggaatgatgcatgcatgtttgaaagctttaagaagtccatgaagattgagtttgatatgacagatttagggaagatgaaatatttccttggtgtagaaattcagcaaaattcagaaggcatctacttaagtcagaagaaatatgcttgtgaattacttgagaagtttgggctgcaaaattgcaattcagtaaagaatcctatagtgcctggttctaagttgtcaaagaaaggagaaggtgctaggattgatgctactgcctacaagcaattaattgggagtctcatgtacattactgtaacaaggcctgatttaatccccaatgaattgcatatgcatgcagcaaagagggttcttcgttatttaaagggaactgtggagttaggtgtgttttataagagaggagatgttaaagacttggtggcttacactgatagtgattatgctggagatattgatgatagaaggagcacatccggatatgtatttttactgagtggtggagcagtctcatgggcatcaaagaagcaaccggtagtaacattgtccaccactgaggcagagtatgtggcagctgctgtttgtgcttgtcaatgtgtgtggatgagaaaggtgttggagaagattgggctctcacaaagcaagtgctctgttattatgtgtgacaacagctcaacaattaaattgtccaaaaatccagtcatgcatggaagatgcaaacatatagatgtaaggtttcatttcttgagggatctaacaaaaaaggaagtggtgaagctcattcattgtggcacaagcaatcaagtagctgatattatgaccaaatcattgaaacttgatgtgttcctgaaattaagagtccagcttggagttcgtgaggttccaaatttaaactga

SEQ ID NO: 69802 - DNA, 108 bp, Glycine max
  Peptide Sequence Number=SeqID_186580
atgaaacctggtacttatagagtagctttgacaagtaggaaggttgtgagtatatcaagcccccaagcatgggcaagagtttcaggcgaaatcaggcatgtcaagtga

SEQ ID NO: 69803 - DNA, 342 bp, Glycine max
  Peptide Sequence Number=SeqID_186581
atgcgtggatgtgttgagtatagtccccgctgggaatggggcaccatagagctcctgtacatgcagacatatgcgcccacaacttttggtagcagcatgggacttctagacactaagatacacaagtttggaagatggaagtattgtgctgttgcttatagggtgtggcttaagaatgcgataataatatgtgagagatcattgacatccttaactggtggccccacagggcctccttctacaacctttgtaagagctgaaatgcttcccagtggttttctagttagaccttgtgagggtggtggatccattattcacattattgatcatattgatttagat

SEQ ID NO: 69804 - DNA, 528 bp, Glycine max
  Peptide Sequence Number=SeqID_186582
atgactatgccaagactggggttcagagactatgttaacaagaaggatagattttgcatgtacaaggtgatggatttcaaagaaagattcaaccctaaagtgaagaagaatcatgtcccttttggtatgcttttcactcagatcataaaagacccacctccatcatcatctggtcctaaaccttcaaaccaaccaaagaaagcacctcccccaaaccctaaaccttcagatcatagaataacccaaaagaggaaggtcacatactctaagtctaaacttgaatttgaacttacacccaaagaccagctatcaaaattaaacaccctcaaccccaacctcagcttactcctccctaaggatggcaacgaggtatactggcagatttctcaatccttatttcaacctaaccccccaaccataccagcttcaccctttccaagcaagaaggaagttgttgctttggctaaggctaagaagaagtctccggttgcctccaagaagaaggccgaacttgatcacactctgtaa

SEQ ID NO: 69805 - DNA, 228 bp, Glycine max
  Peptide Sequence Number=SeqID_186583
atggcagttccaccagaaatggagcatcccaggaaggcttttggatggacagctagagacacatctggggttctctcccctttcaagttctcaagaagggaaacaggagagaaagatgtagcattcaaagtattgtactgtgctatatgtcactcggacctccatatgttgaagaacgaatggggcatttccacttatcctctagtacccggtcaacacaagttgtag

SEQ ID NO: 69806 - DNA, 318 bp, Glycine max
  Peptide Sequence Number=SeqID_186584
atggagatgcagcggaagacaaaggaaaagaggaatttgtcaaccttgaatctttgtggggagatatcacccgccattggtgacttagtaaacttgcaatccatcttttcctaccctgttggagtttccatgtatgtgtcattcttttcataccctgttggagtttcccatgatacaaatgctgatcacatgcctgaacatgaagctgaggaaggccaagccaatagtcttagttctatttcttcttggcctcatcatttggagaatgttttccctatttatgccatgggaacttccaaccctgtcttggattcttaa

SEQ ID NO: 69807 - DNA, 1647 bp, Glycine max
  Peptide Sequence Number=SeqID_186585
atggacagctcaagtctccccttaaacatagacaaaaggtatattttacgtagaggtagttcaggattatacatatacgctatatttgagcatcccaaagattttcctgcactggagatagatcacattaggatcgttttcaagctacaaagggacaggttccactacatggctatagcagatgataggcaacgagtcatgccaacggcagaagatagatctaaagggagacgccttgattttgatgaagcagttctaataaccaaccctagtaatccagaacttcaaggagaggttgatgacaaataccaatattcttgtgagaacaaagacaataaagttcatgggtggattaacttggactccaattccaatgaatctgtgggcttctggatgataacaccaagtaatgagtttcgtagtggtggcccaattaagcaaggcctcacttctcatgtcgggccaaccacactcaatatacttcataccactcattactcggggaaggaggtaaccatggcattaaaagaaggggaacccttcaagaaagtttatggccctgtttttgcttatctgaactcagtttctagtggccatgattcacaagccctatggagtgatgctgtacaacagctgtctgaggaaatcaaaagttggccttatgatttccctaattcagaagaatttttcccagccaataaacgaggaagggtggaaggaagattactagtccaagaccgaaaagagctaatgttccttatctttacctccaggcacattcagggagggaattttgtatatggcgacaatgcttatgttggtttggctcttccgggagatgtgggatcatggcaaagacaaagcaagggttaccaattttggactgaagctgacaaagtaggtcaattcacaattgaaaatattctaccgggggactatgatttatatgcatgggttcctggcatttttggggactataaacataacactactataaccatcacaccaggttgtgttatccaattgggttcactaatataccatccaccaagaaatggacctaccatatgggaaattggcattccagatcgctctgctgcggagttctatgttccagatccttatcctaacctcatcaaccgattatacattgggaaaccagcacacaagtttagacaatacggattatggcagcgttataccgagttatacccaagtcaggacctcgtttataatgttgatgtcagtaattatagtaaagattggttttatgctcagattcccaggaacataggaaacaacacatttagcccaacaacatgggagattaaattccatctcccatttgttataagaggcacctacacactgcaacttgccttggcctcagctactcgttctaacttggtggttcggctcaataaccctgtggctcgtcctccacacttctcaacgggattaataggccgagacaattccgtagcaagacatggcatccatggattgcacaggccttacagcattgaagtaccaagctatctattggtggaaggaaccaacaccatctatttgaggcaatcaaaaggtctaagtcctttcctaggagttatgtatgactacatccgtttggaaagacctgaaacttag

SEQ ID NO: 69808 - DNA, 885 bp, Glycine max
  Peptide Sequence Number=SeqID_186586
ataatgatcaaactgagaatggtgacactcataatgatgagatcaaagaatatctagattacagaaaacctgctgttgaaagattacacttccatcttccaggccaacatagtgatctctatgaagaccatgatgatattgatgatgaattgtctaagccaagtatctctgattcaaagtttatttcatggatgaacaccaaccaaaattctgttgaagggagaaatcttacttatgcagaacttgtttctaagtttgtatacaatcagaagaaaatatgttggcaccttaggaagaaaggctataccattggcagattactatgggttccaccaattataggggaattattttatttgagaatgatgcttactgtttgtaaaggacctacctcatttgaggatttaagaacagttgataatgttcagtattctacatataaagaagcatgttttgctatgggatttttacaagatgataaagaatttattgaggctatcaaggaagcaaaagactggggtttaacacattatataagaaagctatttgtgttgttacttttaactgcaacaatgagcaaacctaaacaagtttgggaccaaacttggcattggatggctgatgacattgtctataattataaaaaattatcaacaagtccagcattacagcttgatgatagaactcttcaaaatctggtcttgcttgaaattgaagaactgctgcaagtaaatcaaagatcgtttagagactatccttcaatgccatatccagaggatgcgaattgtccagcttatctagacaatagccttatattagctgaactgaactacaacaatgaagaacttagatcaaagtttgaacatctattttctcacatgacag

SEQ ID NO: 69809 - DNA, 252 bp, Glycine max
  Peptide Sequence Number=SeqID_186587
atggaaaaggcagaggcaactgtgcctctgataccaaatttaagtttcacaatgctgggtggtgatagtggctgtccggctgaaatccttcccgtgtatagggtagttgcggccacggccactgtcacgaccacgttggcatgcaagaatgcccgttctgttggtgacggcagtggcgctgttgctggtggtcgcggtggctggaacccggcgactggaatcaattactttgttccaaggtggcttacatga

SEQ ID NO: 69810 - DNA, 198 bp, Glycine max
  Peptide Sequence Number=SeqID_186588
atgtgtgttcaggaagaagaaaggcttgtaatagagatgggtaaaagtgcattactgacaattgcttgtgggaagaacaaaactactaagtctcaagctaatcagaaggagaatggtagaataccacctcaagatgatattaagaaggtggcaatgtgtttttggtattccaaacctaaggaaactagtgggaagtga

SEQ ID NO: 69811 - DNA, 204 bp, Glycine max
  Peptide Sequence Number=SeqID_186589
atgtgccagttaggctacgtccagtgcattcctgcacaccctgtccattcgtgggtgtcatatgatgacgtggacgatacttggacgcactactcagaccatctggaggcagcaggtgatctatgtgttgtgccaagaggcttgccatgcgatcgcggaggcattggagcaacatctaaatgcgccaggcacatccacacatga

SEQ ID NO: 69812 - DNA, 309 bp, Glycine max
  Peptide Sequence Number=SeqID_186590
atgaaaaagaaaaagagaaggttgatgaggagaaaaagaagagcaagagtgaggtttcaagaaagaaaaagtgagagattacttcagctgaaggcaaggaagtaccatatccattggtaccttccaagaaggataaaaagagagactaaagtagtctcagtccatggacgtcgcatcttctacaaagagtgcagacgaccatgttggttgctacgtgtcatcaaactttactgtctctggatgacgaaaatggagactaaagtagtctcggtcgatagacatcgagtcttcgacaaagggagcagatga

SEQ ID NO: 69813 - DNA, 297 bp, Glycine max
  Peptide Sequence Number=SeqID_186591
atgtggacactcaagcatcaagtttggtggccatataatgtcaaatccaggggaaataacacaataaaaggtaatgaagacaatcacaagtttggtgatcccggccgtaggactttgcttcctccaaggaagtcaaacaggtcggccatgtcctcatccccctgggcttcgtccccacctctggaatcagtgtctgtcgaagtctgtgtcggcttgcgggaccgcactggaaccctcttcagtggtgcccttcctggacttcttcgcggggagcttcttcagaactatttccggtga

SEQ ID NO: 69814 - DNA, 719 bp, Glycine max
  Peptide Sequence Number=SeqID_186592
agggctgcacgcccttagccttcagagggctacttgccctcacctttagaggactacacgtcctcccattcagaggactagaggtcctcgcctttcgaggactacacgtcctcaccttcagaggactaaacgtccttgccttcagaggattacaagtcctcacctttagagggcgacacgcccttgccttcaacgaggactacacgtactcaccttcagcggactacaacacctcgccttttgagggctgcatgcccttcgccttcagagggctacttgccctcacctttagaggactacgcgtcctcccatttagagcactacaggtcctcgccttccgaggactacacgtcctcacctttagaggactacacgtcctcgccttcagaggactacatgccctcaccttgagagggctgcattcccttgccttcagaggaatgcacgtccttgccatcagaggactacacgtcctcgccatcagaggattacacgtcctcaccttcagaggactgcatgccctcgccttcagagggctacacgtcctcacctttagagggctgcacgccctcgcctttagagggctacacgtcctcaccttcagaggactacacgtcctcgccttcagagggctgcatgccctcgccttcaaagcctacagagggctacacgtcctcgcctttagagggatgcacgccctcgcctttacagggctacac

SEQ ID NO: 69815 - DNA, 846 bp, Glycine max
  Peptide Sequence Number=SeqID_186593
atggaagacatttgtaagaggtggactgagtatcttgacagcacacgatcaagggtcaatcacccacaatcgataaattgtgatttttgtggagaagagcatttcaatgacaactgtcatctctactccatgaaaaattcttggtggggacaagagttatacccttacaatcaatatgaagaaagaactcctaatcttgaaagtgtgttcacgaaattcacggcataccatcctagctctactgccaatcaaaactcaatgcaaaatcaggaaattcaggttggaaacagctactccatggaaaattatcaatgggagcaagagttacaaccctacaatcaatatgaggaagaaagaacttctaatctggatactttattgatgcaattcaaggaggtcactgaatatactcaacaagcatttaaaagtttagaaattcaagttggtaagctagcagaagaagtgactaaatttatggccagaagagaagaaaactttataaaggttgaagctcaagaggaaagccctgtacgaaagcatgattcaaaagaaaaagatgaagataaaagtgaggagaaagcacaacaatgggagaagtactcacaagtagaaattcaacaagaaagtattctccaagtcaatacccatcctcatcaactgattgtcaaggaagaaagacatggagaacatgagaaagccttaagtgctattctttccttgatcactagcacttctcttgcaatgatatggaaggtgctttcagaatacatgactttcatggagtctctagctaggaggcaaaaatacaaggaatatgtgttctttgtgaccttcatgccaccttga

SEQ ID NO: 69816 - DNA, 231 bp, Glycine max
  Peptide Sequence Number=SeqID_186594
atggctgaactcaattccacaaaaccagcttttaaggtgatgattgccccaacctttataaggagtggacctttggagcatggacaaaggttgtttagtgactcaagtgattcaaatgggcagttgattcttctgcaccttctaaagctatatcagagcaccgaacctgaacaagagttctggtcatatcccttgctgcatgttttagttcatccggggatgctcttatga

SEQ ID NO: 69817 - DNA, 393 bp, Glycine max
  Peptide Sequence Number=SeqID_186595
atgcttacggatcacttgatccgtaaacaactccaagcttccctgctccgacatcaatggcggaaaacgattgaaatgcctacctcgacgatcgacgctgacgatgctagacggtggacgctggttcgtggctcgtggctcctcttgacggcaacaccgctcccttcacggtggttcgtgaagaatgcgacgaagaagaagaagaatgcgacgaagaagaatgactttgtggggggaaagaagaagaatgcaaggaagaagaggctacaaggaaggaagaagacgaacgcggggaagaagaagagtgctgggtgtgcgaggaggagagagagagtagcgggagagagagagtcagacgttttttttttaaaattaacccaaggacataactga

SEQ ID NO: 69818 - DNA, 171 bp, Glycine max
  Peptide Sequence Number=SeqID_186596
atggctcaagccgtattggagttgtatcctaatatgcttgacattagtccctgggggtttaagctaacaatttgcaagagaatcaagtccatgggattcaaccatgttagactcacatggccacttctcttgctcaccaccaaggtcggttcaacgaaaaatgaggcctaa

SEQ ID NO: 69819 - DNA, 417 bp, Glycine max
  Peptide Sequence Number=SeqID_186597
atggaatcgttggactttgttgtcgtctgccaagaagttggtgttatggttgcgaatgttacaatcattgcttctattattcggacttctcctcttcgtccaactcctcaggacattgtgctacctggggataagaacaaaaagaaaaaagccaagagagcctttactttggtgccagggaaggagtttttcaactccacctatcatcctcaaaacttgatgtcgagtagtgttgttattgactatggcaaagacattttgcaaaatactgatgtgacttcaaattgggccctgtattcagagttagagtcgagggttgctgtcgttgcccaacatatgattttacgagggggaatctggcttcaattcaagacatccctaagaagactcctaggaattcctgaatgtcaactctag

SEQ ID NO: 69820 - DNA, 378 bp, Glycine max
  Peptide Sequence Number=SeqID_186598
atgaatcattccatagagattgaggaaaaggtcgaagaaccaagaagggttgtaaacactatagcagaaggctttgcaagaggaggaagtacttccacggcaaggaaaaaacatttgcacaatgtacgatttgtaagcttggtagccatgcggaatagagtatacatgttagatattaccttcacaggcgcagacttcaagggtttagaccctaagcaagatgaccccatggcgatcaccatccaagtagcaaatttcctgtacttcttacaaccttttgcttggccaacaagagatactaagaccctaggttgtcaacatggtaaccctggtggaacaagacctagaataacccttggatttagatccaagaactga

SEQ ID NO: 69821 - DNA, 321 bp, Glycine max
  Peptide Sequence Number=SeqID_186599
atgtggaacaaggacttaaaggtactcaagtactcggccaagccgaatactcgagtaccaccacatttgtacacatatcgtaaacatgtggcaatgaaatattcaggtaaaactcccatgcgtccccaagaaaagtatgatagtgacaacttgatctatggtggatccacaacctatgcaacaactgacgatcgagcaacctcacatgattcgaacatcctcccccatgttagcaacgaccacgaggaagccattcaagttatgagagaagagattatcaacatgcaccgaaggcatgctgaggacatagagccattgtag

SEQ ID NO: 69822 - DNA, 1548 bp, Glycine max
  Peptide Sequence Number=SeqID_186600
atggttagaaaggcaaacgacaggtggagaatgtgtactaattacactaacctcaacaaagcatgccccaaggatgcatatcccttacctattattgaccgactagtagatggagcagcaagacatcagattctcagcttcttagatgtttatttccggtacaagattttcatgcatccacgggatgaagagataatagccttcataaccgaatcaaccaattattgtttccagctcatgcctttcaacctgaaaaatgcaggagccatataccaacatctcacggacaagatctttaaagatcagattagtaaaagcatggaggtgcttttgggtttcatgctttctcaccaaggaatacaagcaaatctcgataagtgtcaagttgtgattgatgtgcaaagccccagggcccttaaggaaataaaaaagctcataggccgaatagcttctttgataagattattaccttggatagttgaaaagcttaagccaatcatgaatttgttgaagaaaaccaaaacatttagatgggatcaagaatgtgaaaaggtttttaagaacctgaaactaacactggcaacacctttggggttggccaaactagacgcacagaagaagttgatcatatacttatcgatcttcgatgaagctttatcagagtttgatatccgatatgaacctaggggatcgattaaagcccaacatttagcatactttctcaatgagttgcaccctatcgaccattttgacaaccaatggtggacattgcatgtagatagatcctccaacaaacaagggtgtagagctagagtcctcttagaaggaccaaatcaagtcatcctggaacaattccttaagtttgaattcaaggcatctaacaatcaagctgaatacgaggcatttttagtaggttcaagacttgcaaaagaggtcaacacaaaatggttaaagtgttggagtgattctaaggttacctccgaccagataaatagagagtatcaagttaaagaacctcaacttctgaagtactaccatgccttcatgagattgaaatatgattttgaagaagttcaagtgaagcacattgatagagaccatacgacagagctgacagaagagtgcatgaacatatccttggaaggagaagattggagaagtagtatagtagaaaatttgaccaaagggatagctcctaaaaaccctctagaagctaagtgcctttgtcaagatcaagccaactacatcataagggagttacatgaaggtgtctgtagggcccttcactatgtggggaatggatctactctaaccatttccaatagccaaagggcaatgcaagcatctactgttgtagttgattacttcacgaagtggatagagaagaagtttgacaaagctaaaggaagatggaccaagaacctgctagaggtcttatggggagtcaaatgtatgtctctatcaacaataggagagaccccattcaggtcagtctatggaaccgatgctttggtaccaactgagattggagagccctctttccggtag

SEQ ID NO: 69823 - DNA, 135 bp, Glycine max
  Peptide Sequence Number=SeqID_186601
atggcaacttccttcaaggtcatcgagtataggagtggcaaacttgcaacagagtctggaaggagaaatgagatgttggctctcacatcgtccaccttgagatgcagcaagctgctcttgaaaagcttgatttag

SEQ ID NO: 69824 - DNA, 285 bp, Glycine max
  Peptide Sequence Number=SeqID_186602
atgtggggactgagtaggaggagtggagaagggactgagaaccagcaaacacccagtgaagtctgtctggaaaggagactggttccaaattcaaagatggtggggagtgaacgcggtccaaattacaagagttcgtctacagcagccggcaacgtcaggggttctcaacccaatgacttttccttgtcttgcaactttgaatgtgatcatgaccatggattcttccttgttcctcctttcattgaagcaccccatttcaaatttacaagagaatcaagagattaa

SEQ ID NO: 69825 - DNA, 650 bp, Glycine max
  Peptide Sequence Number=SeqID_186603
gaggagtcatcaaattggattcacttgtgtatgttcctccaagaaatggaccaaccctatgggaaattgggtttccagatcgcacgtctgcagaattctatgtaccagacccttatcctacgctcatgaacaaattatacaacgaagagcacagagacaagtttaggcaatacgggttgtgggaacgttatactgatctatatccaaatgatgatcttgtttacacggttggtgttagcaagtatagaaaggattggttttatgctcatgttacgagaagcacaggaaataagacataccagccaaccacatggcagattgtatttgaacatccaaatcaaataataagaggaaactacacattgcaactggccttggcatgtactgctgatgctgaccttcaggttcgggtcaataaccctagtgctaatccaccagactttgcaacggggaaaatgggaggagatagtgccatagcaaggcatggtgtgcatggattatataggctattcagcattaacgtaccaagtgatcgatttgtgaaaggaaccaacaccatctatctgaggcagtcaagagccatgaacccttttcaaggagttatgtatgattatatccgtttagaacgacctccattaacactgatttaa

SEQ ID NO: 69826 - DNA, 2070 bp, Glycine max
  Peptide Sequence Number=SeqID_186604
atgtcacattccgggaagaaacccgtgtcgtccgagttagggctcaccgagcggttccgcgactcactgagttgctccgacgacaacaaacccgatttccgagaactcgatttgagttcgccggtttcaacattgcggccacgtcagcaccacagtgcgcccaccacaacgagtagcagtagcacgagcactagcagcggctcgaccgggtccggttcgggtcggaacggaaacaataacgcggtttcgaagagatctcattctggtgagttgtctgggtcgagcgagaccaatagtccgacccgggtttcgaaaccgggtcaccggagatccaattcgggtcaaagccagagatctccttcgtcgtcctcctccgctgtcaattctccgccgctgaacgttctcccggccgggaacatctgcccgtccggaagggttctcaaggcggcgaccgcggccgtggcgccaagccggagctccaggtcggatgttctgggctccggcacggggaattacggccacgggagcataatgcgaggtggaaaaggtggcggcggcggcggcggtggtggtggtgatgtgaggatcgctggcgaatcggcgaagggcgtggatccggaggaggtgaagaggattgggaatgaagagtataagagagggcactttgttgaggcgttgtgtttgtatgatcgagcaattgcaatgtctcccggcaatgccgcttaccggagcaaccgtgcggcggcgttgaccggtttaggacggttgccggaggcggtgaaggcgtgtgaggaggctgtggggttggatcctaattatgggagggcgcatcagcgcttggcaatgttgtttctcaggttaggacaggttgaggatgctaggaagcacctttgttatcctggcctgcagctggatcctgctgagttgcagaagttgcaaattgtggaaaagcatattaacaaatgtggtgatgtacggaggatacgagattggaaaggtgtactgagggaggttgatgctgctgttgctgctggagcagactcttgtgttcagctctttatgtgtagagcagaagcccttctcaagctacaccagattgatgatgctgaatcatgtatatcatggattcccaaaagcaagccacatcctggttccttatcacaggcaagattttttgggatgttttctgaggcttattgcttcttcgttagagctcagattgagatggcttttggaaggtttgagaacgcagttacaactgctgagaaagctagtcagattgacccccgaaacgttgaagttgctgttttgctcaacaatgtgaggatggttgctagagctcgattgcgtggtaatgatctttttaaatcagaaaggttcactgaggcatgctcggcatatggggagggtttgaggctcgacccttcaaactctgtcctctattgcaatagagcagcatgttggtttaagcttgggcaatgggaaagatcaattgaagactgcaatcaagctttacacatccaacctgattacactaaagccattcttcgaagggctgcctcaaatagcaaggtaaatggtgtcatcccttgtcttgttatgcagttagaaaggtgggaagaagcagtaacagattatgagcttttgcggagagaactaccagatgacaatgaagttgccgaaaatctgtttcatgcgcaagtagcattaaagaaatcacgtggggaagaagtgcataatttaaagtttggtggtgaagtggaggacatatcaggtcttgagcagtttagagcggcaatatctttaccaggtgtttctgttgtccattttgaaactgcgtcaaacttgcaatgtaagcagatatcgccattggtgaatacactatgcagtcgtaatccatctattaacttcctcaaggtgaatattcaaacaagccccgcagtcgctgctgctgagaatgttagggttgtaccaaccttcaagatctataaaaatggcagtcaagtgaaggaaattatatgtcctagtcatgatatgttggaacactccattaggcattacagcttgtag

SEQ ID NO: 69827 - DNA, 1203 bp, Glycine max
  Peptide Sequence Number=SeqID_186605
atggagattattgaggctatggcctctaatgcttacaatggtgtgggtgacagaataattcttaggagatcctctggggttcatcaagtggaagctaattcatctagttcttctcttgaacaaaagatagatatggagacaagacatgtggttggagactgcccatacacccaggccctgaaggaagtgaactatgctagtggaaagagtattggttatgatctctactctaatacctacaaccaagggtggagagatcacccacacttctcttggaaagagtggagagatcaaaggcaagtgatgaaaagttcaaatccttggaatccaacatcaaaccttgtcactcttgtgtctcaaagaactcctgacacacttccttcccaaactaaagctaatcctaagaatgaggacatgaatgttgtgaaaaccaaaagtagaaagtttatgccagaatcgaagaagaatgagaagatgtataagaaattacatgttaacattccttttgatgaggaaattgttgaaatgccaaagtatgataagtttttaaaggaaattacttcaaataaaaagaaaatggaagactttacgatagttagtctcaacgaggaatgttctattgttgttctaaagaaaatgcctcttaatcttaaagacccaaggagttttttagtcctttgtgccattagcaacttgtcctttgatagatcattgtgtgacgatgaagacataccaatcattttgggatcacccttcctcaacacaggaggagcattgattgatgtcaaagaagggaaattgacttggtggctaggtgatgaggaagaagtatttaaggtgtttggtactacagagagctcattctctccccctttctacaattttgtgcaagtcactaacaagatggaagtcactgtggttaagcctcacccaagtgtgggaatgaaagaccctcctaggaacaaagtcattccaaaaaacacaagatgtagcaagaaaaagggagatgacatcaccattgaagctcttggttatggagtagatgattatagtagaggatcaatgaaaaacatgttcgaggggagaggctggcttgggtggagaggttacaagaatctcaggtacaggtttagattcaagagaagtttgacaatcgaaagggatgtgaacacgagtcctagcatgcaatgtcaaaacccttag

SEQ ID NO: 69828 - DNA, 234 bp, Glycine max
  Peptide Sequence Number=SeqID_186606
atgggtagggagttgctacgtgcacccagtattattgttggggcacccagcattattgttggggcacccagcaaacagttcttccggaaaagttccggaaataatttttccggaaagtttccggaagaatcttcttccggaagaataatttgtgtcttccggaagtactcacagacaacttccggaagaacgtcatccggaatgtttccggaagaagcttcttccggaagttag

SEQ ID NO: 69829 - DNA, 1188 bp, Glycine max
  Peptide Sequence Number=SeqID_186607
atgtccttcatctccagaagaggtttaagggagaccctggccaagaaatcgagaacttctaattctggagtcatgctgaattctaacaaccgccaacagttggtggttgacaatggtattgtcgcggttaccttttcaaagcctgagggctacatacttggaatatcatataacggaattcacaatatacttgaagatgaaaacgaagatcaagatagagggtacttggacgtggtttggaatacaccgggaaagcctagtaattgtcagagaatatacgggacaaaattttcggttatagcagctgacgagaatatggtcgaggtttcattctcaagaacatggacatcatccatgaatgactcaagtgtccccatgaatattgacatgagatacatttttcgaaatggtgattcagggttttattcatatgcaatatttgatcgccctgaaggattgcccgcggcggagattgaccaaattaggattgtattcaaactcaagaaagacaggtttaactacatggctatatcagatgaaaggcagagaaatatgccaacgatgagagacagagaagctggacaaatcctagcattcccagaagcagttctattaaccagaccaatcagcccaaaattcagaggagaggtggatgataaataccagtactcatgtgagaacaaggacaacaatgttcatgggtggatcagtgttgattcttctaatgcaccatccgtgggtttctggatgataacgcccagcaacgagtttcgcaatgctgggcccatcaagcaggaccttacttcccatgttggccccatcactctcgcgatgtttatgagtactcactatgctggcaaggaggtaaccatggcatttcaacaaggagagacttataaaaaggtttttggccctgtattcgcctattttaacaatgcttcaagagaggatgatatactatccctctggtcagatgctgtgcagcagcaatctaaagaagtcacaagttggccttacgattttcctaaatcagtagatttcattccaccgaatcaaaggggaatagttttgggaagattattagtccaagataggtacttcagaggaggtaaacttctatatgctaacaatgcttatgttgggctagctttgcctggagatgaaggatcatggcagatagaaagcaag

SEQ ID NO: 69830 - DNA, 661 bp, Glycine max
  Peptide Sequence Number=SeqID_186608
gggaaatggaagtagacaggtttctatggatgtccggataggagtcagaggaaggagtcttaggattgtctttgctatcttcataccatgtcgggtcttccatgaggagaagtcagattgccaccttattgatattcccttggaggggagaagctatactaagagtacaaagaggaggttacacttagagaatgtgtggctaccaaagaaggatgttgaggaggtggtgagggatgggtgtaatcaagatggtattggagaagaggaagttacaactaccaagaaagacccagaatggtataggaagtttgatgataacactttagtgtctaaaatgaaatcgttgaaggagaagctggcaaaagtgctcatgaaggatgatgtttattggaggcagagagcgaaaatgcttttgctccagaagggaggctataactcgaagttcttccactccatggcattagtgaggaaaaaggttaatggtatcaaacaactattgaatgagcagggagaagcaatcttgagtgaatctattggttcctatgatgtagtggtggaggttttggagctagtggttacttcagaagttaattgtatgttgagtgttccattatctaaagatgaagttcatgatgcattttttcgaatgcaccaagactaa

SEQ ID NO: 69831 - DNA, 855 bp, Glycine max
  Peptide Sequence Number=SeqID_186609
atggccctcatagctcactttgatttggagttgcaccaaatggatgtgaagacaacttttttgaatggtgatttaagcgagacagtatacatgcaacaccctgaaggtttttgcattagtggtaatgaagacttggatcttggtgaggcctattttatgttggggattgagattcatagagatagatcgtgccatacactcgggttatctcaaaaggcttacattgatagagtcttagagagattcaatatgcataattgtaaacctagagatgtttcagttgtcaaaagtgacaaattcaacaaggaccaatgtcctaagaataagattgagcaaacagagatgaacgacatacctttttttggagtgctttgggaagtctcatgtatgctcaggagagttgataacttagaggttgcaggatacacaaattcagatcttggtgggtgctctgatgataggagatcaaattctggatacatctttatgatggctaagggtgcgatatcttggaagagtaagaaacaaactcttattccctcttctattctgcaagcagagttcattgcttattttgctaccagtactcatgttatttggttgaggaatcttatgagaaggcttcgcattatggactctattgctaggccactgaagattttttgtgataacaacgttgttgtgttttatacaaagaataacaagatttctagaggatctatgcacttggagttgaagtacttgattgttagagatcttgtgaaggatggttctatagtagtagatcatgtggacacacattccatgttgactggtccattgaccaagggacttaagcctgttgtttttaaatga

SEQ ID NO: 69832 - DNA, 1053 bp, Glycine max
  Peptide Sequence Number=SeqID_186610
atggaacctgcaggagccttccctgatggagaatgggatttctttcgccgaatatttgccggtgaggatcatgagcatgatttattcacaccccaatttccacttctgcttgatggcgatgatgaattgaacattgtgacacaacccacattttgtgctgctcctgaagttggtgaaaatgagcgtatgttttattctttagatgctcaccactcaaattcttctcagtatatttcacaagaaagtagccatagtaatagtagcaattgtagtggtgatgacactatcttcattgccaatccgggtagcacaaactattattttagttaccctgatcatgtgctagcaaataatgcatgtgtatattccatggatgagaaatattttgcctcttttgtcccatcgcttgctgacattgtaacggaagagagtgtcaagttgcatgaagatgtagcaagtgatgacagattggagaattctgaatgcaatcaaatggaacctatcgtttttcccagcaagcagttgcagctcaaaaggaagcttgatgtgcctgctgaagataaaatgaacaaaggatctgagaatcaaaagaaaagggctcgtgctttaaaagatgggcaaggatgcatgaaaaacacatggtccaagaagaatcagaaacatgccagcaacggggaagaagcagaagagactaatgcaggttcagatgggcaaagctctagtagtaacatgtcagaggatgataacatttctaaatctgctctcaactcaaatgggaaaacaagagcaagtaggggatcagcaacagatccccagagtctgtatgcaaggaaaagaagagagagaataaatgagagactaagaatcctacagaatcttgtcccaaatggaaccaaggttgatataagcacaatgcttgaagaggcagtcaattacgtgaaatttttgcagctccagatcaagcttttaagctccgatgatctatggatgtatgctccacttgcttacaatgggcttgatattggactcaatctcaactccctatcactttaa

SEQ ID NO: 69833 - DNA, 153 bp, Glycine max
  Peptide Sequence Number=SeqID_186611
atggagttattttctccaaccttgggactaataatgtgttttattgaccagggtttctttaagcctttaccaaaggtcgtgcaatggccggtgcaatttccaaagaacaacgaagacctcacccaactttgtttgaagacaaatgctatataa

SEQ ID NO: 69834 - DNA, 630 bp, Glycine max
  Peptide Sequence Number=SeqID_186612
atgacaaccttccatccaggatgtgctaatgcaaagcgaatattatacgggttgcatggagtgtctagagatggcatgtttgtgaatgttgtgactcaagttgctcaagttcaggctagagattgcactagaggtgttggtaaagtacttgagcatggtggagtggaagcaaaatctgttgttgtcaagtctgcacaagaggcacccaccagcatatctttgttatatgccccaccttgtcacaatattcacatttttcattttgatatcgctcttgttctgcaaaagtcatgcaacgttttcccaacggcggaggacgtccttgctgggcttgataattccctaggtgttgagaggaaacttgatgtgatcgttgttgttggccatagaaagccacttgaggagcagaagagttgtgcatattggaaaacctatcatgacattgatcatgactttggaggtgtgagattaactcagagtaaaatggccttggaggcttgtgaggagatagagtactttttctttgtctgggacatgtttcccaattgcagcaaagttgccgcagagacctttgaaagtgtgaatgtgtttgtcaaatgctttggtcatcttgcctgcgaaaatatgtga

SEQ ID NO: 69835 - DNA, 444 bp, Glycine max
  Peptide Sequence Number=SeqID_186613
atggccttctcgatggggaacatggttgctgtgacggtgatggtggtggcctttcaaacaggttttgaagaaaggtgtgaaaggttccgttgtagcagtgaagaagaaggttcaggagaaggtgacaaatcctttgttcaggatcagaggtgcgctgctgctaaagcgggacttgacgcgattcgtgaagtggccaaagaacatccatatccaacacaagaagtgcatcctcaagcagagactcaagatggccctgcatctgcatcctgtcatcttgatcttagtgttgctgatattgttggatttggtggtttagagacaatatccttaaaaatatggtttcttgccattatctacttcataggaggggttcctgaagcatatgttatgtggtattgcccattatatcgtgcttttaggaaacttgcatttgacttttattga

SEQ ID NO: 69836 - DNA, 270 bp, Glycine max
  Peptide Sequence Number=SeqID_186614
atgactaaatataataaacttttggctaagtgggagaggtctaatacattgaatttgattgctattaagaagaccatctctaaacatcttctaagtggtctgccaaagaaagcgatagttaaggagttcctcgatgctttaggaaagagatatcaaggttcggaaaaccaagtaaaagggagaaggggaataagaaatttgattgtggaaagttcaaggcttggctataggcaaaaattaagagaggttcagaaatttaagggaacctag

SEQ ID NO: 69837 - DNA, 399 bp, Glycine max
  Peptide Sequence Number=SeqID_186615
atgcccccgactgtccctgttaatcattactccgatcccgaaggccaacacaataggatcagaatcctgtggtgttatcccatgctaatgtatacagagcgtaggcttgctttgagcactctaatttcttcaaagagcgcatcgccggccgaagggacgagccgaccggtgcacaccggaggcggaccgatcgacccaacccaaggtccaactactagctttttaactgcaacaacttatatatacgctattggagctggaattaccgcggctgctggcaccagacttgccctccaatggatcctcgttaagggatttacattgtactcattccaattaccatactcaatgagcccggtattgttatttattgtcactacctccccgtgtcatgattga

SEQ ID NO: 69838 - DNA, 273 bp, Glycine max
  Peptide Sequence Number=SeqID_186616
atggattctctcatcactaggctgcttcgtgttccccatgcattgaaagaagaaaatccggctgatgtagtggagacgtcagccatggctgcacctcgtgggagagggggaggacgtaacagtagaggaggccgtggtgggagaggtggacgtcctcaatgcacatattgcaagaggatgggccacacacaagagacttgctactccttgcatggcttccctgacaaagtagctcagcaacttcaaaccccaaacttttgcatgatcgtctag

SEQ ID NO: 69839 - DNA, 438 bp, Glycine max
  Peptide Sequence Number=SeqID_186617
caaaataggggaggagcttgccacccagcttgcccaggcgagctaggttgcttcctccagaagcaaccgccttctggaggaagaatctggaaggcccaagtgggcctgctttcgaaaaagttacggaaactcacggattgcgtaacaatacttccttttggtttctgtcacattatggaatttcacggattgcgtaaccaaaggattgtcatcatcaaaaagggggagaatgtggaagcaatgtcttctaaggttattttgatgatgccaaagaatcaagagttaagcaaattccaaagattcaagaatcaagtcctcaagaatcatgattcaagattcaaggataatcaagatcaagattcaagactcaagattcaagaatcaagagaagactcaatcaagataagtactaaaaaagtttttcaaaacattgagtag

SEQ ID NO: 69840 - DNA, 123 bp, Glycine max
  Peptide Sequence Number=SeqID_186618
atggctcacaaattctgttttgaggcacttgatcagagtcttagagatatcatcaaacacaaatcaaaggacaatacaatctttggagatcctgccagtcattccaagaggcagccgcaataa

SEQ ID NO: 69841 - DNA, 882 bp, Glycine max
  Peptide Sequence Number=SeqID_186619
atgatcgcccgctttcgcggtgagagcgaccagccgctctattcccgcgttgataatccgacggttaaagcgctacaggataaagttgccgcgctggaaggcggtgacgcctgcctcgcctttgccagcggcatggccgccatcagcaacgcgattttgagtgtggttcagccaggcgcgaaagtggtctgcgtcaatcatgtctatcccgatacctaccgctttttgcgcggcttttgtcagcgtttcggcatcacgacgcagtttgttgatggcgacgatgaagcggcgatagccgccgcgctgcccggcgccagcctgctctatctggaaagtccctccagctgggtgatgagtgaacagaacctgcggcagctggccacgctggcgcgggatgcgggcgtcgtcaccttgattgataacagctgggcttcgcccattttccagcagccgctgctgtgtggtatcgacatcgtggtgcactccgcctcgaagtacatcagcggccacagcgatgtagtggccggcctggtgattgccagccgccagcacatcaacaacattgcccgtcacattagtccgttccttggcggcaaactgtctgcgaacgaagcgtctttgctgatgcgtggcctgcgcacgctgccgctgcgtatgaagcagcatcagcacagcgccctgcagctggcgcaaaagctgcgtgatcatccgcaggtcagcgcggtttgccaccccgggctcaatccccgtgcacggtccacgatgcgcggtaacagcgggctgttttcctttgccgtgaccgaacaggtagacataccgcaattttgcaacgccatgcaactgttccacatgggcgtcagctggggaggtttcgagagcctg

SEQ ID NO: 69842 - DNA, 171 bp, Glycine max
  Peptide Sequence Number=SeqID_186620
atggtggggacattgaatatagagattttggaccgaggttgcctaccctatctaagtaggataacatctgccatggcagctacatatccaaactatgatgttggagaaaaaccttcttggaaaggtaaaggcacatcaatggttttgctgcaactttggatgaagaagtag

SEQ ID NO: 69843 - DNA, 388 bp, Glycine max
  Peptide Sequence Number=SeqID_186621
atgaaaagagaagaaaagaaagagactgttgactgcgaagagcgatttagcaagggaagaattgacggcggaacttccaatttccatgacaggctttccgggataaaacatgagagacgagggatttggcgtgggttgcgtttggatgaacatgctcctgcattgcccatgtccgctaaagaatatgaggcactggactacagtgacgatgaccgtggcggcggtactcacaaatcccacgatggaggaggtgggagggtcgcaaacgacgaaactacaactttggatgccagatctataacttctttggctagatttgtggctcttgtagtgtgtgagagagagttgtgtgagagactaagagagcgcgagcgaaaggcaatgatag

SEQ ID NO: 69844 - DNA, 393 bp, Glycine max
  Peptide Sequence Number=SeqID_186622
atgcaaaggcatcaattccatacaccaaaggaaattcagcattgtgggtggtccaaaattgccaagcatctacccggaaggactgataatgagattaagaactactggaggacaaggatccagaagcacctcaagcaagcttccagcagcttccagcaacagagtagtaattctgagataatttatcatccccaagcttgcactagccaagtgtccaccatggcgcagcccatagaaacctattctccacccagttatcaaggaatgttagatccattttcaattcagttcccaacaaatcctcatcattctagttgttgtaccaatgacgacgacaacaacaactattggagcatggaggatatctggtcaatgcaattagccaattactga

SEQ ID NO: 69845 - DNA, 453 bp, Glycine max
  Peptide Sequence Number=SeqID_186623
atggatggtaaaaagaagcaccatgtctatgcagtacgaccacgttttttgctgggcaaatcctcgtcctcgaaattcttgcaagtccgggggtggcgtagaggacccaacagtttgccgacgccgtcgaatatgttcgccgcgctgtcgggaagggaggtcgatcacggcagcggcaatgtaacggtaatggagaaaatggtgaacacagtaaataggaaatacatcgaacataaggtgggcaagtggattggacaagggaaaacgcacccgttgtatgcaaagtatgcaaagatacaaccaaacatacatgggaggcatttgaatgccaatctcagattttattcacaagcaagcaaatgtggggttttcttccatgttttgaatggtggggtttcgttagtattatgcttgttcattttttttccccagcatgctgagtccttgttctag

SEQ ID NO: 69846 - DNA, 114 bp, Glycine max
  Peptide Sequence Number=SeqID_186624
atggactggactcgggacacagtgcacgggtttacagcgccttctcggcaattagggatccaacgggtcgggtcagacacggatagtggcttcccgcttctcgtccggaagtga

SEQ ID NO: 69847 - DNA, 1044 bp, Glycine max
  Peptide Sequence Number=SeqID_186625
atggcttcagcggagcagcctctgaagaagcgaaagctctacgagcctttaccagaaccgccaccgtcttcgccgccgccggaatccgaagcaacccctccctctccgcaaaccctacctacgccgtccactccctcgctgtctcaggaggatattctcgcgaagcggtggaacaaggatgaaattcgaagcgtgtacgaaggctacaagcggattaagcgttgcttgcttcggaaagacgctcgctcctccatgtctgaactcgaacagagttatctcgctctcatcacttcttccagaggttgtatgcgtgtacaaagaattgtggcagatcttattcctcggtacgcatgtcactgtccaactgctttggaagctgcagctaaagttgtcattaatatgcacaacttgagtttgacattgatcagcagaggagaggattccagtggtattgcatttgaaactgctagagcctgtatttgtggcctagctgatgtttgctgtgttgcttcgtcggtggcgccaacatcagctgtaattagaggaatttgtgcagcagtttttcagaatgtgctcaccttttttatagccttatttgaaggaaaggatgtcttacagatggttgacaagaattttctgaatatgcaagatacccctgaggccttttctgagttgaaacaaaaggttttagatgaagatgaatcttcattgactaaactgtccaagttgcgtgtgttatgtttactttggatattcttctcttgtccaaaagatttgcttgcagcttgtttggatctcttaggctctgccacaaaagagggaactaatgacgaaggacagcattttctgagcctggtgactagcacatttgatgatgataaggcagttcatcttttggaaagagcaattggtggacctaaatcatgtacagattctattgggtcaggcatcagagacaatgaggctggtgagaccattatgactgaagacaaacatgcttctggtggtgattcatctgttggcaagagctgcttgcttatacag

SEQ ID NO: 69848 - DNA, 3072 bp, Glycine max
  Peptide Sequence Number=SeqID_186626
gtccttaacaaggacccctcactgctgaaatggatgttgtgtagatgtaagaagttacttgacttgctctctaatgcatcgttggaaattgcatcactagtgcgaggaattcttggaatgtttcctcagcaaacagatttggaggactgtcaagcagatagtgatgaagataaatctgattcttcaatttacatgaatagcaactacattgttcctaggatctctgaggaacatgaaagcattggtgaatcatctgtaaaaggcagcagtttgagagttcatgttggttcttctaatgatgattttactgataaggtttctgataaatatgtgatggctcatagctctgctgtttctcttgaccatgctcctgcattaaaagtgggtttgctttatgataatggagtctcaaagcccatgagcattggggtgggggaggatgggaatatgcccacacctagggactcgataagccatcaaatgttctcacctgcagttagaacaccagtaaactttaggagcaattcatttgaaggtagaaatgatttcctgaatgtagagaaaaatcaagtcttaaatttcaattcacctccactgggatcctctagtggatctgttagtaattctttggcatctcctaatcatcattttatgtcaccatctgcttcaacaaaaggtcaaattgtctggtgctgtgatggggatcctgcagccatgggtattgtctctgcttctaagcagctatggataggttatgtaggtcctgatgtgcctgaaagtcatattaggtttcacatagaaaggtttggtcctgttgaacaatttattttctttccagtaaaaggatttgccttggttgagtacagaaggatcgttgatgcaataaaaactcgacactgtttacctggatgttttccttgccatgtaaaattcatggatataggacttggcactaggggtgcaatgaatggtgttgcagttggctctagttctcatatttatgttggaaatattcccagtcaatgggccaaggatgagatcatgcatgaaacaaggaaggtgatccacaagggtcctcttgcattcatcgatcttagctgtgagtttgcattacttatggaatttgaatctcctgaagaagctacaactgtcatgttgcatttgagacaactccgaagagaaagaagtaaccacaaccagcatttttgtccaggaacagttaatgttggaattgggcatgcttatatggatggtgcaaggcctatacctgcccctccccctccccatcttgaccttaaagttaacaaccctgctggatcacctcatgctcgaactctatcagggagccccgctgatagcagtcaaacaaggatatctcacttgtccaccttacttgcttcattgcacacaaagtataatattaatcaaaacctaggtctcaatgataattatatgactggaaataattgtcctcccatgcgtgaggaagatatggttccatccagcactctgtgcataactattccacgtagtagctctttgttcctcacagacgatgagttaatggccatttgcaatcttgccattggaaacactggatccattgtgcagttgacacaagcaaacatgcagatgggatgtagttggtttgttgaatgtagtaatgttgatggtgcagtttctgttctaaagaatctccgtggttgtccaggattgttctttcagatagaattcagcaaacctggacatcagaatgctgtaccattttcagttaaaccagagaacaattcaatggagcttgtatcccccagaataaattcagaaaatcatactagtggaatacagggtgcacctctgcttcagtcaaactggcactttcctggttctacagagatgtcagaggttggagcaaggaaacctgatggttatgataatttgtcacaggatcctcatcaaggaggtaatgttccgcattcatactctggagcacatggaccttccattccaccaccacaacaaattcagtcatttccttttgtacaccctgtttatgttcctccaaatggtccatgggattgtcagggaataaataatcatttacctgtcggccaattcaggacaggagtaatgccaaatcattttcatggtaatgctgttgtcagtccttttattcctgcttcagtaactccacttgctcagatacaaggaactccaatgcatccttataaccagcaggtgcctccatcaattatgccaccacctttgtcatccttgccacctcctcagcctgaaatgccacctccacttcctccttctccaccacctttaccccaggttcagccacccttggttcctccactgcctagttctcctcctccccctcctcctccgcaactgcctgttcaagaaccagtcaatatggaatgttcagggcagtccttgcagtatcaatggcaggggaatctctgtaaaagcggggttaattactgtacaatttatgcaagcaaagcagattcaaatatttgtcgatattcaaatgccatacctgagcctgccgagtggccctcaaaattagacatgacaaaacgaacagatcttcgacatgtgaaatcaacatttgctgctactccatctcatagaatgtcaccttccataaaacagagtccttctacactagttctcactcctcagcttcaggagaagagtagtctagaagttgagtctcttgtgttgcctttctttcatattcaggatatgacatcttcctctagcacactaactgagaatgataagacacctactaaggaggacaaggaccttggaccagcggctaatggtgatcagtgggttgatagaagatgctgggtttggctagaaataaatatagcagacggtcgaacaagtggattcgtcagaaaaccaccaggttgcatgaaaatcacccccaaaaacaagtgtgctgctgaatgttgggaggttgtctgcattgccctttcgttccctgaatctgactttatggtattggtttctggtgcagagggaagtgtgccgtttgattccatcttcctctag

SEQ ID NO: 69849 - DNA, 259 bp, Glycine max
  Peptide Sequence Number=SeqID_186627
atggtattgctctttctcaccaatggcattctagaccatgacaacaatggtattgatggcgaaaaccacgtcggatgtctgaacctcggtgtcaaagaaccgaatgtcccgagtcaacgtagcctccagaacctaggtgtcggaggggatgaagctcgaaatgatggcatggggattgctaagtgcatcttcccatcttctcctgcagttgtggtgtatgttgatggcagtcgtgttagggttatgtggctcgtcgggg

SEQ ID NO: 69850 - DNA, 150 bp, Glycine max
  Peptide Sequence Number=SeqID_186628
atgactggatggaccggtggatgtgaccggttggcgaagcagttacttactagcatacagctggcaaaccaacacgcgtgggagttggaggctcttgacggttacactatcgttaagttgactttttctaattttgatgcttttacataa

SEQ ID NO: 69851 - DNA, 777 bp, Glycine max
  Peptide Sequence Number=SeqID_186629
atggaagatgctgtggaaaaagcatgtgacagcaggatcagtgttattacagaatcaggtgggagtatcagagaccaggatgtcatagattgttgtaaaaagtatggtgtttcgctactctttaccaatgtgaagcactatagacacttagttttttgcttcggaataacttcctgcttccgttatccaagcgtgtgtatggaagaacttatccaaataggacctcttaaagtgcttcctgatttgagagataggcacatgtcaaccagatttgatcagtttgaaatgcttcctgataatgttgtgatagatgatggtgatctaattcactttgctttacttgctgatattgaacttctcaaactaaactcgaatggattagtggtcaggcacaaagccaggttagtggctaaaggatttctgctaaaggctagaatagattacaaagaagtttttgcaccggtggccagaattgaaacaatcagactatctatggctctagctagcaaaagaaattggtttgtgtatcacttagatgtgaaatctgctttcctgaatggatctcttaatgaagatgtatatgttactcaactacctgggtttgaaataaaaaggaaagagaagctagtcttcaagctaaataaggctatatatggcctaaagcaagcacctagatgttggaatcagaaaatcaattcatttctgatcaagcatggattcaaacagtgcccaattgaatatggagtgtactacaaggaagagtttgaatcaaattga

SEQ ID NO: 69852 - DNA, 189 bp, Glycine max
  Peptide Sequence Number=SeqID_186630
atgaggagaggtggtttggcgggtggtgtgggttgtggtggttggagctggtatggcaaccattggagctcaatgaaagcactaaatgttacgggcttgtttacttcttgcaccgctacttgcacccttgcttctggctttgtgaatatgttctttgctgctgtctttggttcctttatcacttcctaa

SEQ ID NO: 69853 - DNA, 273 bp, Glycine max
  Peptide Sequence Number=SeqID_186631
atgcagatgaagaagagtagtctttggattgtgatgattatcacagtgcttgtggtgtcatcgcaattttgttctgtgcatggaagagttcttcgatcagaggtgttaaagacaccggtaggtgacggttgtgaggatttcaaaggagaagattcttctcttggaatggcaacatttgctgttgcttctaacaactccagcactcgtcaatttgcacgaagcttggcgtataaactagcttctggacctagcaaaaaaggccctggacattag

SEQ ID NO: 69854 - DNA, 321 bp, Glycine max
  Peptide Sequence Number=SeqID_186632
atgaagtatcttccgagtttgaccttgttcacccagcaccatgcactctccctcgttatcttcattcttgtcttgattttcttcacatcatcattgcttgcggaagcctcaaggcctcaaccgcgagcgtttcagcgttcacctgtttctgtccccatcaaccacttccacatggctcgagttttatcgggtcctagtcatggaggaattgctagagatcatacccaagttcaacaaaagcaaaaattctaccatctgcaatgcatatttggaatagaaggaacaaaaggtcatggatatctatatatagtagatttttag

SEQ ID NO: 69855 - DNA, 364 bp, Glycine max
  Peptide Sequence Number=SeqID_186633
tgaggacttgattttgatgtgggcttaccttaccgatcgtcaaatcgactgggctcacttggttaggtaccgaatgcataaggcattatgggccaatgcacctcatacgtatcctcaattagtcaccctttttcttcgtcattttcaaattccttttgatgatgaaccttttgtccaagtcaagagatcttttgccataggtgctggtgcagtaacttcatttggttaccgtaaggatcatgatggacaatggctgaagaagaacgcgcaacctccacaagatgactatgttggcgaaggctttgattctttggatggttgctttgaaggaatggatacttgtatgacgcagcttgaagaggat

SEQ ID NO: 69856 - DNA, 210 bp, Glycine max
  Peptide Sequence Number=SeqID_186634
atgactcaacggttgtggagaggatctgatgcattgggaacctttctcttctactatgaatgtgagcagaacaaaaaccatgaacctcttcaaccccccaacaagagagcactggtgaaagtgcatgttttggtggcttcagaggagaggagagcgtggttgaaaaagttggaggaattaaaggaaagcaaagggcacttggagatctga

SEQ ID NO: 69857 - DNA, 231 bp, Glycine max
  Peptide Sequence Number=SeqID_186635
atggtcatcaagtctcaaagcatagcccaacacgtggcagacttggaaaaagtctttggggaactccgcaaatatgacatgcgcctcaaccttgaaaaatgtactttcgggataagcaaaggcaagttctttggcttcatgatcactcatcaggggattgaagccaaccccaacaaatgcactaccatattggaaatgtgcagcccaacttggaaaaagtccagaagttga

SEQ ID NO: 69858 - DNA, 300 bp, Glycine max
  Peptide Sequence Number=SeqID_186636
atggctattcctttgctggtggagcacgacgctgatgaggtgatcacacggtggcattggggagggactaaaaggctaaaagatgaagaaaatagcaaaaagctgaaaaaaggcccagcccaagacgcgctcagcgcaaaaacaagcactgacgttaagcgaggaagagatgcgttaagcgtgaatatagacacccgcactaagcgagcaacgtgtgctaagcacgaatacaagcatccactgatgtgccatcattttcttctattttctaaaccctttttgcaccattttaattattga

SEQ ID NO: 69859 - DNA, 183 bp, Glycine max
  Peptide Sequence Number=SeqID_186637
atggcattcaaagcaacagggatacccagaatcgttcaaaacttgaaatttggacagaacaaagattacccagaaacagaaacaaagagagagtggacgggtcataaaaaaactgcaaccttagtgcactttccctgggagtggtacaagcacatgggtttcctgcgaaacttcggattgtaa

SEQ ID NO: 69860 - DNA, 1245 bp, Glycine max
  Peptide Sequence Number=SeqID_186638
atgtggtctgagcattctggatgtagaaaactgattgaagatgtttggaagctaccagcttatggttaccctatgaaaatccttagacagaagctaagaaatgttaaatctgctttgaaaccctctgattcccttatcaacttggaaacccaagcccaagtggatcttcaaaaagctcttgattttgaagagttgttttggaaggataaagctcgtttgaattggttcacacgaggggatcgtaatactgcattcgttcacaaatttgccaaacaaagaagggctcttaatcacataagtgtcctcggggatggggattgtttgctccaaactcaggaccagattcaacaacatatcatccacttttactcagctcttttcgctacagacaacaagtgcaggccaaataatttaatttctagcctcgtccttcccttggttactagtgaggacaatgctttcctcacaaatctcccttcccctgaagagcctattgctatgggtaacttccagtttaagatcatttctaaaattctagcggaccttgctagtatcgctcctaaattagtttctcctgagcagaggggaattatcaaagggcgtagagttgctaaatgcatccgcaccacttcggtggcctataatttgctgcaatgcaaatcttttggaggaaacattgccctaaaaattgatatcaaaaaagcttttggctctctgaaatctttcaatactcctttgcactcgctttatgctgatgacattctgattttctgcagaggtactaagagaaatatgtacaacctattgaatttgtttgacagttatggccaagcttccgggcagatgatcagtcctgaaaaatgtctcttcttcctgggtgctatgtctcctagaaaaatttatgaagttaaggatcaattggggtttttgctattgggtccatccccttctcatacctgggcatccctctttttattgctagttaactccattatcaatggcatgttggcttactcgttcaaagtttactcttggcctcgcagcatgatcaaagaccttgacagttgcatccggaattttgtttgggtcggtaatcctaatcaacgcaagatttgcactgtcaaatggcaaaaagtatgcaacccccttgctgagggtggccttggtcttagacagatttcagctattaacaatgctgcagctctcatgctcagctgggactttattcactcaaaggatcaatga

SEQ ID NO: 69861 - DNA, 198 bp, Glycine max
  Peptide Sequence Number=SeqID_186639
atgactggagctgcatcgttgggtgacccagactttgaagtggttctctcaaaatgccaaaagaaaagctccaacacaagaacaagactccagattcaggaagatttcataacacccgcactaggggcactcagcgaggtcgtgtccaatgaagtgtttgttttggaactccagaggcattgccaatccagagactag

SEQ ID NO: 69862 - DNA, 165 bp, Glycine max
  Peptide Sequence Number=SeqID_186640
atgggtaaggaacactctgctcatacattgcctgagcacactcaaggggagtcatttcctcgatgcacagtcaacactcaagatgatccatccaccgtcccacatggtggactactcgtcaacaccctttcatcgactgcatcatggaagctaacatgtccctag

SEQ ID NO: 69863 - DNA, 279 bp, Glycine max
  Peptide Sequence Number=SeqID_186641
atgcagagatcattggaggcatttctaggctggaaaggaaccaaagctgacctaatgggggccttttctagagctggagaaccagagatggaaataaaatacattatcattctgaggggaaggagtagtcttaggaatgaccagatcttagaaagcttcaaaaataaatcagaggatttcagggagaagagccctttgggagaaagaccctgccgtggagatggtgacttgaggcaatgcatagggagctggcttaaagggatattgcatgaatggtga

SEQ ID NO: 69864 - DNA, 225 bp, Glycine max
  Peptide Sequence Number=SeqID_186642
atgtcgggtggagagtggtcttggttaggagggcaaaagggaagacttgcaaaacaaaggactttgacactcaagtgtgtgtatgcgttagcgtgttctgagagtatgaggaaacttgatacttatagtgtggagaatgagccgtgggtccttattgataggggttgttatagtgacgtagcaacccttacagataattaccggcttgtagataataactactag

SEQ ID NO: 69865 - DNA, 1263 bp, Glycine max
  Peptide Sequence Number=SeqID_186643
ggggctcttggacttcgtacgtcggctagagagtggcctttgttagaaggacaagaagggggacctgcaaaacaaaggactctgatgctcaagagattgttccgtatcgagggagcttgtctgatgtcagggatagtggccttgacaagtaggagggtgactagtcagtcgagccccaagcatagacaagtattgtccagtgtcgggagtggtagcatcgaccggtgtgagaattgcagtctctttgctttcgtgcttgcttcttgcgattccttttcttcttcattcatcctcttcaatcttcaaggtattccttctctaacaatgtctttatttctatttgactctgccatcgacatgggtggtagtgattctgggggttcgattcaacaacccttgatggatcgggaggtcatttccattggcggttcctcctcgaagtatactcaccacggtgcctctgacaatgaattcttttcctcggaaaggttaagggtttcgcactgtactaggggaggcacctctcgcctccgtgggagggcatggccttccgttgcttccctgatcagggaacctgtcccgatcacggtgattttccccctttctattttcaggggagcatggagaagtggtggggacgttagggatgatgttctaaaatacaagtcctacatcatttctgcaactagtgttgttgcactacaacaccagatgaagctgacaggcaagattggttgggtctccatgaacagtgtgtctaagaagctacccgagtttgactcgaatgtctttcaccatttcaaggactatttcttcaaggtcttggctactgatgtcatagctaatggtttgccattgatgttcaataggtatgagtcccgcttaatgttctactggcagtctgaccccaccaggttcaagtcgtttgacgaagatctattgacctttgtggagagggttgacaaggctatcttagagcagctatcggcctccctagacgtgtgggctgttttgtctcttcccttggcgagcaatcccttcactgccttggatggtaaatgttttaccctgacccttgtgaagcaagccaaacctccttttatgtccaaacttgctgcttgcatattatgcactgaagagctcgacaaaagtgtcgaatctgtcaatggaccttggagggagtccatcgtaccaggtcaatgtcgcccctttgagagacgtcggaaagacatgactcaggattgcattgtcattggtgtataa

SEQ ID NO: 69866 - DNA, 165 bp, Glycine max
  Peptide Sequence Number=SeqID_186644
atggaacaagtgtgttgtggccttaaggcagtgtgggtgcattgtttaaggggttttgttgttgctacaagagcttggatagagctctatgtaagggtgaaccttgggttgagtgtaaatctcactgggagagtgaggatgggacatagcattgggttggagtaa

SEQ ID NO: 69867 - DNA, 930 bp, Glycine max
  Peptide Sequence Number=SeqID_186645
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 69868 - DNA, 1771 bp, Glycine max
  Peptide Sequence Number=SeqID_186646
atgaaaaaacgagccaaaaccctgcccggtgtcacacgacgccaggtactgacctggtcgacgctgggcgttgccgctggcgtcacccgcgccgccgatgctgtctccctcaagggcgctcccggctggacgcccttcgccgataacccaccggaacagttccaggctcagggctggctgttcttcaccgaagaagaagcgcgcaccgtggaggccatggttgaccgcattatcccggcggacgagctgagcgtgggcggcaaagaagccggctgcgctgtctttatcgaccgccagctgcacggcttttatggcaccttcgaacgcctctacatgcagggcccgtttcagcagggcaccaccgagcagggcgaccagtcgccgctggtgccgcaacagcgctatcgccaggggctggcggcgctcaaccgctacgtgcagcaaacatcgcaaaagaactttgttgatctgacgccggcgcagcaggacgcgctgctggcagacatggaagccggaaaggtgcatttcagcggctttgatgcgcagtcgctgtttctcgaggtgctgaacaacaccatggaaggcttctttgccgatccgatctacggcggcaacaaagacatgaaattaccgaaaaccgatgtggtggtgattggtctcggctgggccggatcgattatcgccaatgaactggccgacgaaggcctggaagtgatcggcattgagcgcggcccatggcgcgacaccgcacgcgacttcaatattggcaccgtcaccgacgaactgcgctacgtgatgcgcgaagagctgatgctgcgtacgcggcagaacacctgcaccatgcgcaacaatccgtcgcaaaccgccctgccgatgcgtacctggggctcgttccatccgggcaacggcaccggcggcgcgggcaaccactgggccggcattacctttcgctttcagccggaagagtttcgcctgaaaagccacctgaccgaacgctacggtgccagtgccattccggatgagctggtgttgcaggactggggcaccagctgggaagagatggagccgcactacatgcagtttgagcgcgtggccggcacctcgggttacgccggtaatattcagggacagaaacgcacgggcggcaatccgttcgaaggtgcccgttcggccgactatccgacgccgccgctgcgccagccctatggtccgacgctgtttgccgaagcagcaaaaaatctcggctaccagccgtttccggtgccctcctcgctggtctccgaggcgtacaccaatccctatggcgtcaccatgggtccctgcaccttctgcggcttctgcaccaactacggctgcgccaactactcgaaagccagcgccatcaccaccgtgctgccggcgctgatgcgcaaagagaactttaccgcgtataccaactgcgaagtgctggaagtgctgaccgatgccagcggcaaacaggccaccggtgtcacctacattgattcctccggcgataagtgggaacagccagccgatctggtgatcgtcgccgcctttacctttgaaaacgtgcgcctgatgctgctctccggcattggccaggcttatgatccggtcaccaataaaggcaccaccggtcgcaattacgcctaccagaccgccaacggcgtcacgctgtttttcgacaacaaaaactttaacccgtttatcggtgccggcgcggtgggcatgggcattgatgaattcaataacgataattttgaccacagcg

SEQ ID NO: 69869 - DNA, 207 bp, Glycine max
  Peptide Sequence Number=SeqID_186647
atggcggcggagtttcatgacgccagcggccgaccctcagcggagatcgccaaagcgattcagcagcaggcgctggccgaaggattgatcctgctgacctgcggcgtgcacagcaacgtgatccgctttctttatccgctaaccattccggacgcccagttcagtacggcgctgaacattctcacccgcattctcagccagcattaa

SEQ ID NO: 69870 - DNA, 1012 bp, Glycine max
  Peptide Sequence Number=SeqID_186648
cctgaatgaatcctcggccatcgccgaatacctcgaagagcgttttccggcgccggagtttgagcgcctctatccgcgcgatcgcgaaaaacgtgcccacgcgcgcgaagtgcaggcgtggctgcgcagcgatttactggcgctgcgcacggagcgacctaccgaagtgctgtttgctgctgaacgctttgctccgctcacgcccgctggcgaacaggccgccagtaaactgattgccgcggtgcagcggttgctgccggacggccaacagaatctgtttggcgagtggtcgattgccgacaccgacctggcggtgatgattaaccggctggcgctgcacgtcgatccgctgccggtgaagctgcagcactatgcagaattccagtggcagcgcgcctcggtgcagctgtggctggccgagtcgggcgcgtgctgggcacgccgaaaacagagaaagggttaccggatggtagatcaaacggcaggtgacggtatcgagtgggtggatatcgttagcgaagaaaacgaagtgattgcgcaggccagccgtgcgcagatgcgtgcgcaatgtctgcgccatcgcgctacctatattgtggtgcacgacggcatgggcaagattctggtgcaacgccgtaccgagagcaaagatttcatgccgggtatgctggatgccactgcgggcggcgtggtgcaaagcggtgaagacctgctggaatccgcccgtcgtgaagcggaagaggagctcggcatcgctgatgttccgttcgccgagcacggcaaattctacttcgaagatcagcactgccgcgtatggggtgggctgttcagctgcgtgtcgcacggtccgtttgccatgcaggaagaggaagtggatgaagtgttctggatgacgccggaagagatcaccgcccgctgtgatgaattcaccgatgattcactcaaagccctgtcgctgtggctgagccgcaacagtgacgcggtgcgcagtaagcaaagcagcgaagcctga

SEQ ID NO: 69871 - DNA, 453 bp, Glycine max
  Peptide Sequence Number=SeqID_186649
atggcgaatgacgcaggcaatccaggctggttcggcttatttcagcgcggccagcactacatgaaaacctggcccgccgacaaacgtctggcgccggtgtttcctgagaaccgtgtggtgacggcaacccgctttgcgattcgctttatgccaccgctggccatttttacgctgacgtggcaaatcgcgctcggcgggcagctcggtccggcgattgccaccgcgctgtttgcctgtagcctgccgatgcagggattatggtggctgggtaaacgttccgtcacgccgctgccgccaacgctgctgcactggttccacgaagtgcgcgccaaactggaagaggccggacaggccattgcccccgtcgacggcaagccgacttaccaggcgctggcggatgtgctcaagcgtgcttttaagcagctcgaccgtactttcctcgacgatctttga

SEQ ID NO: 69872 - DNA, 2055 bp, Glycine max
  Peptide Sequence Number=SeqID_186650
atgtcgacgaagttagtactggtcctcaactgcggcagctcctctcttaagtttgccattctcaatccagccagcggtgacgaatacctttccgcgaaagcgctgaacttcatcgttaaaactattctggcacaaaaaccagagctttcggcacaaatcgctgcaatcggccatcgtatcgttcacggcggcgagcagctgacgcaatcggtggtgattgacgagtccgtcattcagggcatcaaagacgcgtcgtccttcgcgccactgcacaatccggcgcacctgatcggtatcgacgaagccatgaaaaacttcccgcacctgtcggataaaaatgtcgccgttttcgacaccgccttccatcagactatgccggaagagtcctatctctatgccctgccgtacaacctgtataaagagcacggcgtgcgccgctacggcgcgcacggcaccagtcactactatgtgacgcaggaagccgccaaaatgctgaacaagccggtcagcgagctgaacatcatcacctgccatctcggcaacggcggttctgtggcggccatccgtaacggccagtgcgtagatacctcaatgggtctgacgccgctggaaggtctggtgatgggcacccgcagcggtgacatcgatccggctatcgtcttcttcctgcacgatacgctgggcatgagcgtggatgcgatcaacaaactgctgaccaaagagtccggcctgctcggcctgaccgaagtcaccagcgactgccgttacgtggaagataactacgccaccaaagacgatgccaaacgtgcgatggatgtgttctgtcaccgcctggcgaagtacatcggcagctacaccgcactgatggaaggccgtctggatgcggtggtgtttaccggcggtatcggtgaaaacgcggcgatggtgcgtgagctggcgctggacaaactgggtctgcttggcttcgaggttgaccacgagcgcaacctggctgcacgcttcggcaagtccggcttcatcaataaagaaggtacccgcccggcggtggtgattccaactaatgaagagtgggtcatcgcccaggacgccgcgcgcctcaccgccgtcggcctgaccagcgtcagccttggcgtgattcgtgccatggagcgcaaaggcgtgcgcctgagcgtgttcaaaccgatcgcccagccgcgcgctggcggcgatgcgccagaccagaccaccaccatcattcgcaaaaactccgctattccggccgcggttccgctgccgatgtcccgcgttgagtcgctgctgggttctaaccagcaggatgtgctgatggaagagattatcgccaactaccacgccaacgccaaagatgcggaagtggtgctggtggaaggcctggttccgacgcgcaaacatcagtttgcctcggcgctgaactatgaaattgccaaaacgctgaacgcggagatcgtcttcgtcatgtcgctgggtaacgactcaccggcacagctgaaagagcgcatcgaactgacgcagagcagcttcggcggcagcaaaaacaaaaacatcaccggcgtcatcatcaacaaactcaacgcgccagtggatgagcagggccgtacccgtccggatctgtcagaaattttcgacgactcctcgaaagccagcatcgccaacatcgatcctaagcaactgttcgctaacagcccgctgccggtgctgggctgcgtgccgtggagctttgatctgatcgcgacgcgcgccattgatatgtgccgccatctcaacgcggagatcatcaacgaaggtgaaatccacacgcgtcgcgtcaaatccgtcaccttctgcgcgcgcagcatcccgcatatgctggagcacttccgtccgggctcgctgctggtgacctcagccgaccgtcctgacgtgctggtggcggcctgtctggcggcgatgaacggcatcgaaattggtgcggtgctgctgaccggcggctatcagattgaagcgccgatcgcccgtctgtgcgaacgcgccttccagaccggcctgccggtgttcatg

SEQ ID NO: 69873 - DNA, 207 bp, Glycine max
  Peptide Sequence Number=SeqID_186651
atggctgctaatgtcatcaaagaaaaagggaaagtgatggataatggtaccatcaaagaaaaagagaaagtaatggatattgatgccatcaaagaggaaaaagaaataagagatgataaggagaaatcaaaagatgttttcaacaaaaatggaatcaaagttgataaaaataaggcaaaagacattttggagacttcccctccatag

SEQ ID NO: 69874 - DNA, 267 bp, Glycine max
  Peptide Sequence Number=SeqID_186652
atgttccgtgaagaaaatccaagccgaggtgcttccgtaactcttccgagacgtttccgtgagcaaatccgtcaaggtttttcgtctttcttcaccgttcttcatacgttcttcgttctttcttcgttcttcaacggctttcatcttcatttcgttcattttcggttttcttttcttccgtttttaacgagctttaaccgatcgtttaagccgttatctcgcctcataaatgataaaatgaatttcaaccggtcatttgcattgtaa

SEQ ID NO: 69875 - DNA, 687 bp, Glycine max
  Peptide Sequence Number=SeqID_186653
atgaaccctccagtgcctgtgccaccggtgcttggaaggccccttatcctatacatgattgtgttggatgagtcgatggggtgtatgctagggcaacatgacaagtccgaaaagaggaaacgggccgtttattacttaagcaaaaagttcacagcatgcagcccaccgtctaaggcaatacatgctgagcaacaccacttggttggtgtccaaaatggacccagtcaagcaataaagggaagtgccttggaagactacttggctcagcagcccatcaatgactatcaaccaatgcaccccgagttccctgacgaggtcatcatgaccttgttcgaggaggagatgggggatgaagatagggagaaatggattgtgtggtttgacggcaagtccaacgcactaggccatagagtaggggcagttttggttacccccgatgatcaatgtatacccttcacagctaggttgggcttagactgcatgaataacatgtctgagtacgaggcatgcgcccttgggatccaagcagcaattgacttcaaggtcaagttgctcaaaatgaatggcagcggaatgaagaaggaagagagagaggagatgcaacttcaaggagaagatgagtctagaagaagctcaccaccaaaggaggccatggataagagcttggaggaagaaggagatgaatga

SEQ ID NO: 69876 - DNA, 1326 bp, Glycine max
  Peptide Sequence Number=SeqID_186654
atgcgtttcgcgccactgaatccggcaaagcctggctatcgcgccaaaacccagcgctgcccttcttttgttacggttaaaaggactctgcccattaaggcggtaacgatgaattttcaaattgataaatccggcaagctggaaaatgtctgttacgacattcgtggcccggtactgaaagaagctaaacgtctcgaagaagaaggcaacaaagttctcaaactcaacatcggcaaccctgccccgtttggttttgaagcccctgatgaaatcctggtagacgtgattcgtaacctgccgagcgcgcaaggctattgcgactcgaaaggtctctattcagcacgtaaagccatcatgcagcactaccaggcgcgcgacatgcgcgacgttacggtagaagatatctatattggcaacggtgtgtctgaactgatcgtgcaggcgatgcaggcgctgctgaacagcggcgatgagatgctggtgcccgcgccagattatccgctgtggacggcggcggtttcgctgtcgagcggcaaagcggtgcactatctgtgcgacgaatccgcgggctggttcccggatctggatgatatccgcagcaaaatcacaccgcgtacccgcgggatcgtgatcatcaaccccaacaacccgaccggtgcggtgtacagcaaagagctgctgctggagatcgtggagatcgcccgccagcataacctgatcatcttcgccgacgagatctacgacaagattctgtatgacgaagcccagcatcattcgattgccgcgctggcaccggatctgctaaccgtgaccttcaacgggctgtccaaaacctaccgcgtggccggtttccgccagggctggatggtactgaacggaccgaagaagcacgccaaaggctatatcgaaggtctggagatgctggcctcgatgcgtctgtgcgctaacgtgccagcgcagcatgccattcagactgcgctgggcggctatcaaagcatcagcgagtttatcgcgccgggtggacggctgttcgagcagcgccagcgcgcctgggaactgatcaacgatattcccggcgtcagctgcgtgaagccgcagggcgcgctgtatatgttcccgcgcatcgatgcgaagaaattcaacatcatggacgaccagaaaatggtgctggatttcctgctgcaggaaaaagtgctgctggtgcagggcaccgcctttaactggccgtggccggatcacgtgcgcatcgttaccctgccgcgcgtggacgacctcgagatggcgatcaacaagtttggtcgcttcctgcaaggctatcgccagtaa

SEQ ID NO: 69877 - DNA, 441 bp, Glycine max
  Peptide Sequence Number=SeqID_186655
ctggaagcagaagacacggcaggcgtgcaggcgattgccggtgcacacgcgttgctgaccaccctgaacgcactcgacattccctgggcgattgtgacttcgggatcgatcccggtggcgcatgcccgtcacaaagcggccggtttaccgctgccggaggtgtttattaccgccgaggacattaaattcggtaagcccaatcctgaaccttatttgctgggcgctgagcggctcgggctttctgcgccagaatgcgtggtggtggaagatgcaccggcgggcattatcgccgggctggaagcaggcagcgcggtggtggcggtcaatccaccagccgatgcgccacgcctgagtgaagtggcgctgcaggtggaaaatctgcagccgctgcacatcagtaaacagccggacggttatttcagcgtgacgctccgcgcctga

SEQ ID NO: 69878 - DNA, 327 bp, Glycine max
  Peptide Sequence Number=SeqID_186656
atggttggctcatggtacgtcacacaggcaactaagaatgcaatgaaaatgcaaggatcatgcatgagcaaacatgaaaacaaaagtgccccatgtgtagttaagaaggtgatatggaccttccagcttcccatgacaaaagacgagaccaacattcaacactccccagtggagtcaccaactatcgcaacctaccctccggcgggagggcgacgcgagggctcacgggtgcgtcttccatgggagaaagatgcacggagtcgccaccaatgtttattcgaggaaaacgttgtaaaaaccggaaaagatgtggtctacgaactttaa

SEQ ID NO: 69879 - DNA, 141 bp, Glycine max
  Peptide Sequence Number=SeqID_186657
atgaaggggaggcagagaaagggttccaagggtcaaaagattgtttcaaggtccaacgccttaacgattctctccgcttttcaaaacttaaaacatcgtttcaaggttgaacaccttaaaggactttttgttcgcgattaa

SEQ ID NO: 69880 - DNA, 627 bp, Glycine max
  Peptide Sequence Number=SeqID_186658
atgatggaagccatgttgagtatgagaaaaatgatggaggttaacacagtgacagtcattgccgtaagtatcgccactaaggtggacccgactcacctatatggtctcaaccaagtaaattgcccagcctcggatatggtaggtcagggcagcgaagcattaagaagtgtgggcggcccccattttgtgcaggaacaggtccctcaacccatgggggagacacatgaagtaccccgagaccatactctagccaactccgagccttgcctcggatatgccactgaagggcaggcgtttggtggcccctcagtatcgcccacaaccataacccttacattttgtggtggaaagactgcctcctgccatggagatggcaattatgcctttgctgacatgaaagagttgtgcctagtgcctaacgtggtcattcctccgaagttcaaggtgtcagacttcgataagtacaaggggactacttgccctaagaatcacttgaagatgtactgcaagaaaatgggggcatacgcaaaagatgaaacattattaatgcatttcttccaagaaagtcttaatggggcagccataacctggtacaccaatctggagtcttcccgggtccgttcctga

SEQ ID NO: 69881 - DNA, 1064 bp, Glycine max
  Peptide Sequence Number=SeqID_186659
gtgcaacaaaatgtttctgcagaagaaataccctcatgtgcgcgaacatctcccactcctgaggcggatgcagtgaatgttgagaaatggggtgaaggtcaaggcattggatccagtagtcctcatggttgggcagaggtcgatgaccctcatgagccgaaccagtcagataataccattcctcatgaatcgagtcagaaaagttcatccgaagaaaactttttcgatgaagacgccataaaagaggctgaagctggaggctcagacatttacccggtgtcctcaacatctaaactttccgctagcatagggatcgcagaagatacattcattcaaatgcaaaatggagaccctgctgcagcccttcgactcctgctgaacacaagtcaagccaacacctcaagtgaaaagattcctggtgcttcgtcctcatctgatgctgaaataaactcttcagtacgccaagattctctgctcttgaagttatcaacggaatacgcacggaaagatgtgcttaaatccattgaagagaacccctctgctgcctttgggcacctgaactttttgaagaaattgcacaacccccttacctctgatgagactctaggcaaagttatccaaatcgaggccatcattgaccaatttgcaagtactgtgcagagaaaacgcgaaaatggcacaagactagatgcccagaaacaggcacatatccttctgctcgagaaagcccgagctgctcaacatgaagtcgaacgtctcaccaaagaggcgaaagaaggatcttctgagatcaaagactgtgatgataacatctcctcctgggaggcaactattacggatctgctgtttcaagtcgatgatctaaggcagaaaattgtgacagagcaggccaaacgcaaggaactccaggagaaggccgctaactcgattcagaaactggttgatgaaaaagggagggaaggcctgaaggcctttagcgcatctcaggctgtagtagatgaggcaaaggttatggagagtgctgaccaggtcttaactaaagagatggccaccttgaaaaagct

SEQ ID NO: 69882 - DNA, 204 bp, Glycine max
  Peptide Sequence Number=SeqID_186660
atgtgtgcgagtcaacgggcgagtaaacccgtaaggcgcaaggaagctgattggtgggatccccctaactggcgatgcgggatgaaccggaagctgggttacggtgcccaactgcgcgctaacctagaccccacaaagggtgttggtcgattaagacagcaggacggtggtcatggaagtcgagatccgctaaggagtgtgtaa

SEQ ID NO: 69883 - DNA, 939 bp, Glycine max
  Peptide Sequence Number=SeqID_186661
atggcccacttggagctctcgattccatggcgcggctcaacagagcagccgcaccgtcctacctatttaaactatcctgagggaaacttcggagggaaccagctactagacggttcgattagtctttcgcccctatacccaagtcagacgaacgatttgcacgtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggag

SEQ ID NO: 69884 - DNA, 255 bp, Glycine max
  Peptide Sequence Number=SeqID_186662
atgaacccagatttcaaccaaccacgaggcgggtgctcgcgggaggtcagcatacaccccgcgcagcaacattgttacatgtttgcgttggggaaacgatgttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 69885 - DNA, 327 bp, Glycine max
  Peptide Sequence Number=SeqID_186663
atgtttcagtttgatctcgttccgcaagaggcgtgcaaacatgcgcatgctgaaggttcgggcgcaacccttctctaccgcatttatggcccaaagccaatacaaaggatttcggttccatcttgctcgaatcttactgtaccccagaggaaaaggggattttgtgctgtgaaggtgggatcggtacacacggataaggactatcatgaggctctatgtacttcattccgtttaccccgccttcctaatttgacatttcccattttccatggaataagtaggattcaggtgataacggggataaccattgctgtgggtgagggatag

SEQ ID NO: 69886 - DNA, 297 bp, Glycine max
  Peptide Sequence Number=SeqID_186664
atggggttgttttcaaacatattcctaaggggtactcttttttcacgtaaatcccatgcatggcaccaccaccattggcgctttcggggaggaggtgacacgtggcgttggtgtcgtcattcccaccagcgccttgcgttttggctacatggcgttggagacgccagcagcaatggcgcattcagcatggcgccagtcaaactggcgacttacgcgtttggcagggagagcagctttggcggcagggagagcagcagcttttcagtgagagcagcatcagcagggaagcgcaaatga

SEQ ID NO: 69887 - DNA, 1341 bp, Glycine max
  Peptide Sequence Number=SeqID_186665
atggttactaatgaatgcactacccacaaactcggagtttcctatgccaggatgttagtggaggtcgacattactagaaaattggtggaagcaattgctatcaaggataaagatggtcggaaaatgatgcaacctaagcctaagcctcaatgtcagaagatagggcatcaatgtggaaatggggtcaagaagaaaaaatggcagcctaagcctcaacaggagagaaaacacgaaatccctgttgaggtctctacaccaaggaaagaaacaacaacgagtaaagctaatggagatgaaggaaagacatggattagaactgctgaacatgatgaagagacgtggactaaagtgagcaaagcttcaaaggatagaggttttgaatggcccccaagccttcgattggggaccatgattgtttcatggaatgtaagggggcttaacaaggctggaaagctaagggagataagctcccgtctcctagagcttcagccagaaattgcaattttgatcaaaacaagagttaaagaaaataaagctgctaaagttagagagaaacttcgcctaaatgggaattatcttgataactatacttgtcatgcaaatggtaggctttggatccattgggacttaaatagggtggatgtgaaatgtgttagcaggactagccaacttatacactgtggtgtttatgatgtaactggaaatttcaagttttggctaactgctatttatgcaagtaatgcattggatagaaggaaaattttatggaaagatattgagaaaattcatgagactcatcaaggggcttggtgtgtggtgggtgactataacaacgtggccaaggcccaagacagaattggcggaaagatggttaccgaagcggaatttgttgatctgcaaaatatgatggatgttaccggtctaagtgagatggatagtattggtgatttcttcacctggtcgaataagcgcagcgctgatccaatatattcccgcattgacagagtcctagctaatgtcctttggtttcaagagaatacggataaggtgctgaatgtccttccccccaacgtttcggatcattccttgttgtatctgaatgttgatcgtgctaggaggacacacggatttaaggaagtagttcaggaaagctggaagcaacctacaaaaggtagtccaatgggtgttttatggcacaaactgaaaagattgaaacaagtactaaaagattttaataaacctgccaatgatatcaagcagaaaatcgtgaaggctagacaagagcttcacaacgcacagaatgagttaatcaattgcagaaagcgaaacttgactggctga

SEQ ID NO: 69888 - DNA, 405 bp, Glycine max
  Peptide Sequence Number=SeqID_186666
atgacggcgacgacgacgaagcgggggcgagggcgagggcgtccgaaatccacggtgccttcgtcaacgaagaatcagaattcgcctgaaccacaatcggagatggaaacagggaagcatgatgagattgaagatgagaacaaactggatggggaaaagctgattgaggagagatccaaagaggtggaaacccctaaagatgatccgaaaggaaatcaagaggcgagaagattatgggttgacgtgataagtgagaatcgaaatccaacaaaaggaaggatgatgtcttatgtggcaccgaaaatggtagagggacaaattgaaatcgagattgaggatgaggacatcgaatctgaaattagatattgggaaaatgccctaatcctatatgtgctgggggggtga

SEQ ID NO: 69889 - DNA, 171 bp, Glycine max
  Peptide Sequence Number=SeqID_186667
atgtggtggggtcctattgaacatgggcgtggaaaattcaagggtggacttagtaatcaagttatgaggaaaattcagcacaaaattttggatttagtcaaaagctactcaaagttgcttcaatccataatcgattctaaatacttctccaatgtgaaaccaaacatgtga

SEQ ID NO: 69890 - DNA, 168 bp, Glycine max
  Peptide Sequence Number=SeqID_186668
atgaattttgatgatgtcaaagaagaatcaaacaaggctgctacaaaggataagcattacttcaagactaatactagattgcttcaacaaacaaagccttgcttcaagattactttaagatcaagccttgcctcaaaacaaattgtttccaagacatgcaaggttctg

SEQ ID NO: 69891 - DNA, 489 bp, Glycine max
  Peptide Sequence Number=SeqID_186669
atggatcaagaaaaggttcaagcagtcctgaattggccatatcctataaatctgaagcaattgagaggcttcctcggtctgactggatactacaggaaatttatcaaaggttatgtgtcaatcgcaactcctttatccaatctgttgaagaaggaaaactttcattggaatgaccacacttccatggcttttgacaatttgaaagctgcaattaccaaggcaccagtactggcattgcctgatttttccaaagcctttacattggaaactgatgcctctggtataggcattagggctgtattgagtcaagaacaacacccaatagcttttttctctaagaagctcacacctaggatgcaaagacagtcagcttatataagggagtcctatgctatcatagaagcagttgcaaaattcagacattatttacttgggcaacgatttgtgatcaaaactgaccaaagaaacctcaagtcactcactgagtaa

SEQ ID NO: 69892 - DNA, 216 bp, Glycine max
  Peptide Sequence Number=SeqID_186670
atgaccactcttacacagatatggatgacgtttctacttagcaacattctgcccagcgaccacaatgcttatctccccctacgaaaggatcacgcccacaagacaccaagtggacccgaaggagtccaacagggccctggtgtttctagctttggttacgggcctctgtcagtcctacagggtgcccgcccccctagcaaggtcatgccatcgtga

SEQ ID NO: 69893 - DNA, 964 bp, Glycine max
  Peptide Sequence Number=SeqID_186671
atggtgcagtggcccacgccgtcctcagccaaagaacttaggtccttcctaggactcacaggtttctacagaaagttcattaagaactatgctatgattacggcccccctcacttctctctgctccaaggaaccattcgaatggccctcggaagcccagtccgcgtttgatcgattaaagacagctatgacttcagccccagtccttgcgttacccgatttcgatgaaccatttatcatcgaaacagatgcttccgacgccggcatgggcgcggttctaatgcagaaaggccaccctctcgcgttctttagtaagcaattcggcccacgaatggttcatgcctccacttacgtcagagaactccacgcgatagtagctgcagtccgcaaatggcgccagtaccttctgggccatcctttcaccattttcaccgatcataaaagcctccgcgagctcatgtcccaagttatccaaacacctgagcaacactactatctttctaagcttttgggtttcgactacacgatacaatacaaggtgggttcttcaaacgcagttgcggacgctctatcccgtactactccctccggcgagttcctactcctatcagtgcctcaccttgacttcatgcgtgatttacgcaacaccctccattccagcaacgaatttcaagaactactctccaaagtacgtgacaatcctggtgactttcctgactatcgcattcatcagggactcatcctcttcaagaatagaatctggctcaacaacgataatccgtccatacctagcctcatgttcgaatttcacgcaactccaatcggaggtcatctcggcgtaaccaaaaccacccataggttagagtctaacttcttctggtcctcattacgaaaggacatcaaacgattcgtgaaggaatgcaccacgtgtcagcagactaagtctagcacacagcgacctgccg

SEQ ID NO: 69894 - DNA, 219 bp, Glycine max
  Peptide Sequence Number=SeqID_186672
atgaagtctgcatgctgtaagcatgagattatcatccagacagatccaaggaacttcaaaagaaaagagttgctgcagaagaaattgcttccagcttcagaacatgatgccgccagtgcagtgaaagtgaagttttcaagtgagtttgatcaatgctgctccatcttcccaggattatctctgtctcttccatgtctgataacagaaggctggagctag

SEQ ID NO: 69895 - DNA, 651 bp, Glycine max
  Peptide Sequence Number=SeqID_186673
atggcgaggacgtgttgtcctctgaatgcgagggcgtgtagccctctaaaggcgaggatgtgcagtcctcttaaggcgaggacatgtagtcatctaaaggtgagggtacgtgaccctctgatggtgaggatgtgtagtcctctgaaggtgatggcatgcatccctccgatggcgaggacgtgttgtcctctgaatgcgagggcgtgtagccctctaaaggcgaggatgtgcagtcctcttaaggcgaggacatgtagtcatctaaaggtgagggtacgtcaccctctggaggcgaggatgtgtagtcctctgaaggtgagggcgtgtagccctctgaaggtgaggacgtgtagtcctctaaaggtgaggacgtgtagtcctctgaaggtgatggcatgcatccctccgatggcgaggacgtgttgtcctctgaatgcgagggcgtgtagccctctaaaggcgaggatgtgcagtcctcttaaggcgaggacatgtagtcatctaaaggtgagggtacgtgaccctctgatggtgaggatgtgtagtcctctgaaggtgatggcatgcatccctccgatggcgaggacgtgttgtcctctgaatgcgagggcgtgtagccctctaaaggcgaggatgtgcagtcctcttaag

SEQ ID NO: 69896 - DNA, 163 bp, Glycine max
  Peptide Sequence Number=SeqID_186674
atgaggaattggaagacaacactgatgaagacaactgcagtggaatgcttggagcgatttgtatcagccatctgcaccatatttgggaatgagtacttgaggagatcaaataatgaagacatcaaacgcctactacaaatgggaacggcacgcagatttcctg

SEQ ID NO: 69897 - DNA, 150 bp, Glycine max
  Peptide Sequence Number=SeqID_186675
ctaaaggaggcacaggaaaggcgtctgcaagaacaggaacggcgtatggagtatgaaatcctcatgaaggatacatccaacatgtccgaacagcaacacaaagaccatgaaaagtattgtgagcatattaggaaaaaactaggatattaa

SEQ ID NO: 69898 - DNA, 213 bp, Glycine max
  Peptide Sequence Number=SeqID_186676
atgtcgcttgagcaaacaaaccaatggcttgcacccacattccagtggaagttgaataagcaaagatgtgtttccagcccgcatcaagtggaccttgcaccttatgcttcagggccctacaatgctcaatggaaggccccggggctcctccatgataagcacacgttgcgttcgagtcatatcctcagaaaaatggaggttgaggaaacctag

SEQ ID NO: 69899 - DNA, 345 bp, Glycine max
  Peptide Sequence Number=SeqID_186677
atggattcatcaggagattcagaaaatgaagtcgtgattctaagtctcatggccaaaaattatgaaagtgaagaagcagtaacatcttctaacaataacttatctatttcctttgatgaacttcaagatgcattcaatgacttgcataaagaatcagtcaaacttgccacactagattctttgaagagaagttggtacattgatagcagatgctttaaacacatgacgaaagatgcatcaaagtttactcatatttctcccaagaatagtggacatgtgacttatggaggcaacaacaaaggtaaaaactcttcgagtcagaaaaataggtatgaatccatctaa

SEQ ID NO: 69900 - DNA, 306 bp, Glycine max
  Peptide Sequence Number=SeqID_186678
atgccgcacgcgaagtgcgagatcagtgcgctaagcacaacatttgtcttcagccaagctcagtgcatgactagcgctaagctcaaatcctcttactcgcgcttagcgcaacatcgtggatttagagcctatttaaagcctgtcttgtgcaaaattagggattggcacaaaattccagagcacaccacaatgcctattttgggaatagagctctggaggcagcaagaggagcaacttttgcagagatacctaggttttggaattagagagagattattaagtggcagagtaattgtgaaatgctga

SEQ ID NO: 69901 - DNA, 156 bp, Glycine max
  Peptide Sequence Number=SeqID_186679
atggaggagatacatatagaggatgcaaaagaacatcatctagatgaagatgctctcataccacataatgtagctctatgtagagcttgtaggccttggatcttctacatcaatggtgtcctttgcttcttgaagatcaatggaaacttaatgtag

SEQ ID NO: 69902 - DNA, 117 bp, Glycine max
  Peptide Sequence Number=SeqID_186680
atgaaagcaaaatgcaaccaaagatggcttggggaagcaaaaaccgggttgctcgcccaggggaaacataaccatggccccctacaggttagcgtttgcctactcgaacctacttaa

SEQ ID NO: 69903 - DNA, 168 bp, Glycine max
  Peptide Sequence Number=SeqID_186681
atgtactactcggactcgattaaccttcgtactcccgaccgagtaaactactcggaatccaaagaatctaacaagattattaagtgcgaaattggcctcaaggtcaaggaaagcgtggtgactggtgagttgaagttgaaggaagcgaatatgcgtggagcgaaatag

SEQ ID NO: 69904 - DNA, 306 bp, Glycine max
  Peptide Sequence Number=SeqID_186682
gcggttgcttctggaggaagcaaccttgctcgcctgggcgagctgggtggcaagctcctcccctattttgctataaatagggggaagagtgaagaggaaaggggttcagccttcttggcacagcttattctctcgaaattgctgaggaaaattgtttccgtgaagaaaatccaagccgaggcgcttccgggtgagatgaatatcttgacggtacacgatcaagagtgggaacaggagttaagtctttacaatcaatatgaagaagaaagaactcctaatcttgaaagtgtgtttaaggaattcatg

SEQ ID NO: 69905 - DNA, 1116 bp, Glycine max
  Peptide Sequence Number=SeqID_186683
atggacgacgaactgcgcggcaggctgctcggcctcccgctgtcgcgcctgtggcggccgtggatcacctggaagacccgcttcgtcggtgccaccagcaccgagtacaccccgctgccggcacacgtcgcgccggaggcgctggccgaggacgtgacgcgtcacgcgatcggcgatacccggctgctggtggtcaaggacctggcgatcgattcaccactgctggacgacgcggccaacgcgcacagcgctgccttcctgcaggcattgctggcgcgcggcttcgttgaactggaaggcatgccgctggcctgggtggcgatcgatttcgattcgatcgacggctatctcggccgcctgtcgtcctcgcgccgcaagaacatccggcgcaagctgcgctcgcgcgacgacctgcagatcgactgcatcgccaccggtgatccggccctggccgacccacggctgcaggccgaactgcatgcgctgtacctgggtgtgtatgcgcagagcgcggtgcacttcgaccagctcggcctgccctacttccagcatctgctggccgacagccagggccagggacggatgttcctgtaccgccaccagggccagctgatcggctggaacctgtgctacgtgcatgccggcaagctggtggacaagtacatcggcctggcttacccgcagtcgcgcgagcacaacctgtacgcggtcagctggatgcacaacctcgagtacgccctgcagcacggcctgagccactacgtggctggctggaccgactcgcggatcaaggccgagctgggggcccgcttcacctccacccggcacgcgatccatgcccgttccccgctgctgcgtgccgccctgcgccggctggccccgtacctgcagggcgaacctgatgggaggcggctgagcgatgctggtgcgttccccgctgatcctggacctggacggtggcgtgctgccactgccccaagcgcagaccctgtccctgccgcagtggcacgacacgctgcgattcgcctgcagcaacggcaccctggatcgcttcagcaccgaggtgcttgcgccgctgccggccctgctcggcacagtgatgctcggcagtggtga

SEQ ID NO: 69906 - DNA, 543 bp, Glycine max
  Peptide Sequence Number=SeqID_186684
atggccattgccatgcattcggacccctgggtaaaagccaggtggacgttacctaccatgaaaagtcaaaagatatttacgaaggtatacagggccctcattttgaaccaccaaggtgctgggccaagttgcaactcgggcccaaacaccatacaggaggggtgtagtaagcaggatgcttaccctgtagccttctcggatgtgcaacacaaccactctcaaaaagctggtgacacaagcaaaaacataggcccaacttcgaaacctaaggggtgtaataaggaggatttattatctgtagcccaacccactaaagaaactccagacaagtattccaaagtctatactagacaaaaacactccctctctaaagctcgacccctgcagattgaggaaaatcaccctcagcttcaacaaggagatgatgtttcactaactcaaactgccaaccaggacaatgctagcaaccaaagatatgtggaagcagaaagaaggctaaaaagtattattgagtgcagtgcagaggtattggaagaagcttag

SEQ ID NO: 69907 - DNA, 237 bp, Glycine max
  Peptide Sequence Number=SeqID_186685
atgaccacattggcctctgcttgtcaatccaacttgcaatctccgaatgacgcggtgtggataaccggaaggtgtttccgcatgctaccagactcttgggtcatgatagaaaaaggtggggtggtcgacaaaagcgaggtttttgctcctatgtatcctccatttgtgatgaggaactcaggcctacgtagttctttcaaaagtgagactaaaatagtctcggtgttctctcactaa

SEQ ID NO: 69908 - DNA, 352 bp, Glycine max
  Peptide Sequence Number=SeqID_186686
tctccagctggtagcacctccagactccatccctacagtagagcaatttaatgaatgggtagcttggccaaggactcaacctcctcctcatagggatgacgaggatcccgctgctcaggtaccacatcagccatcggatgagtcatcagagtcttccacccctgagcccttgataaggaagaggagggtagttctaactaaggaagccgtagccactcctgaaaagtctcctgaggccactctagagcctccgacaccaatggcagataccacttctccacagcaggcagcaaatccttcaacgcctgaagttcaaaccactcagtcctgtctccaaacacttctcccgtag

SEQ ID NO: 69909 - DNA, 306 bp, Glycine max
  Peptide Sequence Number=SeqID_186687
atggcacagaataagttgctttctaggaaacttgagattttaacagaaacacttggttgtagcatatgtggtgaggctcatgaaacagaccaatgtattcccattgaagaaaaaactcaagaagttcactatatgggaaatcaacagagacaaggatatactcaaggaggtaacaatgtcaacaaggatagtggagatcacaccctggcaatcaattcaacaaggaccagggtggaccttccaacaggccaattcaacaagggcctaacatctttcagaggactactaagctggaggagactttga

SEQ ID NO: 69910 - DNA, 861 bp, Glycine max
  Peptide Sequence Number=SeqID_186688
atgagtctgatcaatgtagtaggcaacaatccattgaattctgggcattcatgcacttattatgggaaacataatcacactattgatagatgctataggaagaatggttttcctcaaaattatgcttccaaagaaggaaagggaactcaaagcaatcctggcagaggaaattcaggagcaaaaggaaacaaggtgtgcaaatattgtggtttttctaaccatactgttgatgattgttacaagaagcatgagtactcacctggacacaaactttataaggttcaaaatccaaacatcaataatgacagtgttgtaagagaagaagatgtaaataatgctttcttacatggtgatttgaatgaagaggtgtacatgatgcttcctcaaggcaatgatttgattgaaatacaaggtattacagagttgctggacaatgcttttaagataaaggatttaggtgagttgagatgcttcttaggttttgaagtagccagaaaacatgttggtatcaatttgtgtcaaaggaagtatgccttagacattctcagtgatgctgatgcttcctcttttagaaggttaattggaaggctgatctacttgactaatacaagaccaaatatcacttatgttgtgcaacatctaagccaatttgttgttgctctcacctcagctcatcaacaggggattagtgattttgactgggctagttgcattgacaccaaaagaactatcactggttatgctatgtacattggtgactcattgatttcatggaaatccaagaagcaagccactgtatccagaagctcatcagaagtcgaatacagagcactagcctgtaccatttgtgagctacaatga

SEQ ID NO: 69911 - DNA, 903 bp, Glycine max
  Peptide Sequence Number=SeqID_186689
atgacgccagcaaacgtcgccgtaatcagaacggcgtcggagctactgggaatgacggcaggagacggcctaagccacgtggcggaaacgcgcttccgcgaagtcgttggcactaaccaagagcacgcgttaacggttctccgttcttgcatgctgttacttccggaggccgaaacgacggcgtgtctcgttagcagatgcattgaagcgctcgtttcagttcacggcgttagtcgtttaaacgacgtgaatgaaatgcagccaggagattttcaaatcgtggctgaatccatgggtagaagattggaggagagccacgacgtcctctataagatggttgatctgtatcttaaggaaaacaagtttgagaaagtaaccgaggaagagaggagtggaatatgcaactccatagactgcaccaagctttcaagtgagaccttggtagagtgtgttcaaaacccgagaatgccgttgagattggtggtgcgagcggtgatgctagaacatctcaacactcgccactccatcgccttagctggtgcacaacgtcatcaactccgattcgagaacaacacgcgacgacaacgacaacgacaacgacgtcgttccatgacgctaggggacttcctctaccgcgacgcaactttgcgcgaaacggcgaaactaaagacaatgatggattccacagatgctcgcattcgaagccttgaagaagaggttaggtgcatgaacagagtgttgttacgagagtgccaagtgagtgtgttggggtcagagcgttcggcgagtttccattttgtgacggatgagaatgttgggagtgtgaagaatgggacttttcggcagaggttgatgattggactcaagaatgcgtttcgggtgccaaattcagtgtcaacttga

SEQ ID NO: 69912 - DNA, 1068 bp, Glycine max
  Peptide Sequence Number=SeqID_186690
atgccagaacgagaatccaccaatggttactgcagcagtggcgaagaagacggtgacgccgcttggagagcagcaatcgattccattgctcaaaccaccacctatgtcgcttccaccaccaaacacaatcacccaaatcatcatattgatgatgatgaccacaaacccaacacacaacagcttaagcactaccaactcaaggcacaaaagcttctgaatgaaatattggaaaattcaatagagatagtgagaaaacctgtccctgtcgtggatgaggatcccgagagcaatgaatgcggcattcgcttgtttaaacatgctcagccaggaatagtgtttgatcacttttgtttgcttttactttgctatggtaacttggctttatgtggtaattttgttggtggtggcagtaggtcactagtcaccattgttcttgacttgaacatgaaaaatttgagaactactctgaaatatgaaaaagctgcattgtgcatgcttggggcctctgccatgacttgtggtaatggtctttctcagctggttggccaacttaaccagaattactggtccaggcttttacattatatggctgcagatgaactccaaccaccaaggaaacggcctagactacttcctggaggagatattgatgagaaatcaaagaagcagtttagaaaacagattagatctgttgctgttaacgggatagatataatagctgcagcaaatgatgcatacaagaagtcattagctagactagaagctaaagatgccgcagcaaaagctaaagccaagagagaagaggaaagaattgaaaatttgaaaaagattaggggagaaaggtggctaccttccatggccaaggagatgcaggggtacataccaagctttatgtggtctagcattttcaatgccaaatggataattgacgaaggcacatactggagagttgacaatggacgtgatataatgctcaacttacctgggtgcaaaattccaccacatgaaagcaatttcgtagaggagaatatgagggttgcgaacatcataaatcctgagtcaagctaa

SEQ ID NO: 69913 - DNA, 282 bp, Glycine max
  Peptide Sequence Number=SeqID_186691
atggcgcatgtgctggcaatggtggtggacggtgttggaggcttcgtcaaaacgctttgggctctgcaagagcggcgatggtcttacactttcgacgctgtggcctctgctgcggtgtccgtaaccatggcattggtgctctgcttgttggctattcgtgctagttatagacatagacgaggcgatatcagatgcacaggaaacgatgatttccttactgctggaagggagaaattattacatgatttgggactaccatggtcccagctaatctctacatga

SEQ ID NO: 69914 - DNA, 3066 bp, Glycine max
  Peptide Sequence Number=SeqID_186692
atggaggaaggtatgtggggttgtaaagaacccgaaacgacgctttcgtttcactgccaacatctccaagcgctccgaagcagctgctatgcgtcgtaccaatcagggttagagaccactgaaaaatcactgggtcagagattaatcccgctcgtggagcgtgactgtcgctggcccccaaaggaaattttatacatggagaagctaagggttgctgttttggtttccaaagctgcatttcaatttatccaaggtgttcaaccgagcgattatgtgttacctgacgaagtaaaagctgcgggtttccaaatctgtgctgaagaactggggtctattgttgaaggccatgacgtaaagaagcttaagtttcatggtggagtagatggcattgcaggaaagctttcaacatcaaccaccacggggcttagcggtgattctgaatcacggcacaggagacaagagctttttggagtcaataaattcaccgaaagcgaagttcggagtttctggatttttgtttatgaagcccttcaagacatgactctcatgatcctaggagtgtgtgcttttgtgtctctgatagttggcatagcaacggaaggatggcctaaaggtgctcatgatggacttggaatcgttgcaagtatcttactagttgtcttcgtgacagcaatgagcgattatcgccaatcgttgcaattcaaggacttagacaaggagaagaaaaagatttccattcaggtcacaagaaacggttacaggcagaaaatgtcaatatatagtttactccctggtgaccttgtgcatctttctattggagaccaagtccctgcagatggtttatttgtttcagggttttctgtgttgattgatgagtcgagtttaaccggtgagagtgagccggtgatggtgacttcccaaaatccttttcttctctctggaaccaaggtccaagatggatcttgcaccatgttgattaccactgttgggatgaggactcaatggggcaagttgatggcaactctgagtgaaggtggagatgatgaaaccccattgcaggtgaaactgaatggagtagcaaccatcattgggaagataggacttgtctttgccgtaattacctttgcagttttggtgaaaggactaatgggccgcaaactccaagaaggaagattctggtggtggtccgcggacgatgcactggagatgttagaattcttcgccattgcagttaccattgttgttgttgctgttccggaggggttacccttagctgtgacattgagtcttgcattcgcaatgaagaagatgatgaatgacaaggccttggtgaggcatttggcagcatgtgaaaccatgggatcagccacaactatatgcagtgacaagactgggacactaacaaccaaccgcatgactgtggtgaaaacatgcatctgtatgaatatcaaggaagtgactagtaatgattccactttgtccagtgaactcccagattctactttgaaaatgttgcttcagtcaatctttagtaacactggaggagaggttgtggttaacaaaaagggtaagcgcgaaatcttggggactccaacagagtcagcactattggagtttggcttatcactgggaggggattttcatgcagagagacaaacatgtaaagttgttaaagttgagccattcaactctgagaggaaaagaatgggtgtggttttggagatccctggaggaggtttaagggctcatagtaaaggtgcttcggaaatcattttggctgcttgtgacaaggtgatcaactcgaacggcgatgttgtctccatcgatgaagaatcaagtaattatctgaatagtacaatcgaccagtttgctggtgaggcacttagaactctttgccttgcatatttggaattggaaaacgggttttccacggaagaccctattcctgtttctggctacacgtgtgtaggaattgttggcatcaaagatcctgttcgtcctggcgttaaggaatcggttgaagtgtgtcgttcggctggaatcgtggtgagaatggttacaggagacaatattaatactgcaaaggccatagccagggaatgtgggattttaacagatgatggaatagccattgagggtccagactttagagagaagactcaggaagaattgtttgaactgattcccaaaattcaggttatggctcgatcctcacctctagacaaacatacactggtgaaacacctacgtaccacgttcggggaagtcgtagctgtaactggtgatggaacaaatgatgctccggcccttcatgaagctgatattggacttgcaatgggaattgctggaactgaggttgctaaagaaagtgcagatgtcataattctggatgataatttctccacaatagtgacagtggccaaatggggacgttcagtttacataaatattcaaaaattcgtacagttccagcttactgtaaatgtggttgcattactagtaaacttctcatcagcatgcatgacaggcagtgcacccctcacagctgttcaacttttgtgggtgaacatgataatggacacgctgggagcacttgcacttgcaactgaacctccaaccgatgatttaatgaagcgcatgccagtggggaggaagggtgaattcatcaacaatgtcatgtggaggaatatcttaggacaagcattgtatcagtttgtggtgatatggttccttcagtcagtaggaaaatgggtcttttttctccgaggcccgaatgctgaagtggtcttaaacacacttattttcaacacatttgtattctgtcaggttttcaatgaggtcaactctcgcgagatggaggatacagatgtttttaaaggcatatgggataatcatgtgttcatcggtgtccttggtgcaacggttttctttcaaatcctaatagttgagtacttgggaacctttgccaacacaacccctctaagtctggtacaatggatcttttgcttaggagctgggtatgtgggtctgccacttgcagttcgcttaaagcagatcccagtctga

SEQ ID NO: 69915 - DNA, 240 bp, Glycine max
  Peptide Sequence Number=SeqID_186693
atgaggggtttgaatcaattaggggcagtagttgagaccatctacgaggaagaatgcgagttttcttcctctaactcctctccttcttccccttcaccatcattttcctcttcttctgcatctctccactccagagtaaaggcctggtctctgaaaatcggccgcgaaacagatgtcttgatacgagttcaaggaatatgttttcgtctacacaaggtctctgttgattcaccattgtga

SEQ ID NO: 69916 - DNA, 2539 bp, Glycine max
  Peptide Sequence Number=SeqID_186694
atggcttcggagactgaacaacaagtagggcccgcttggaatggaaaaagaagtgagacacactctatcactgataatttaaatccagagttagctggtgcgccattgttcccggcggtgtcggctccaccgccggttactccaccgccgccaccaccaccggacattccgtcctctcccgacattcctttcttcaacgagtatcccgccgggcagccgcctcccgtgcagaacctgccgccggcgaagacctccggcggcgtgattgcgaacccgacggcgacgcagccaacgaaaccggggaagaaggtggcgattgcgatctccgtgggcattgttacacttggaatgttctccgcattgggcttcttcttatacagacacagagtaagacacccggcggagacacagaaacttgtttctcgcagggttctagaagattctccgcgggccccaccgctgccaccaccctcgagttttctctacattggcacggtggagcccgccagaacttcgctgagcgaacccaacagaatgaccgttaacacttccccttaccggaaacttgattccattaagcttagctccgatcaccgttaccgccccagcccagagctgcagccgcttccgccgccgcacaagcccccggacgagagccactcgccgccggcggaattctctgactcgtcatcgtcctccgaggaggaaagctgcgagacggcgttccactcgccgcgcggctcgtcgctcggccgcgaagagaatttcttcacgccggtctcgcgccacagctgtctctccgccgccgcgtcggtggttccttactcgaagagaacttcgccgaaatcccggttttcggccccgtcgccggatatcagaaacatggtcgtcccgtccgttaggccttctccggcagaattaccggcgccggcagattcaacaacatttcatcccgtgaaaaaagaaatgactttgggtccatctagaagacccaaattctcatcgcatcccccagcaccgaatttgactcatcttcattcaaacgagtccactacttcacttaaacctcctcctcctcctccgccaccgccgccgccaccacttccgtcgcgaaagggttggtctccgtcaattagttcatcttcttcctctgtgtcgaggaagaaccgagagtcatggtccccatatgaaggagaatcttctggtaacagtgttagtgtaaggaaaggtccttcttctgaggaagtttacaaaaggcgtgaaggtgatgacgtggatggagcaaaacccaagttgaaggctctgcattgggataaagtgtctgctacttcggaccgtgccactgtgtgggaccagttaaaatccagctcctttcagttaaatgaggacatgatggagacactgtttggctgcaaatccacaggttctgcttttaaagagagtgttactagaagatcagttcttcctcctgttgaaccggagaatagggtgttggatcccaagaaatctcaaaacatagctatacttctcagggcactcaacgtgacaagagatgaggtgtgcgaagctcttttagatgggaatcctgaaggtttgggaactgagctattggagactctagtgaagatggctctaacaaaggaggaagaaataaaacttaaaaattatgatggtgacctctcaagacttggatctgcagaaagatttcttaaagcagtgcttgatatccctttagcttttaagagaattgaagccatgctgtacagagctaattttgaaactgaagttaactaccttaggaagtcctttcagaccctggaggcagcaagtgaggaattaaagaacagtcggttattcctcaaacttcttgaagctgttctaaggacaggaaacagaatgaatgttggcacaaatcgcggtggcgctaaatctttcaaactggacacacttctaaaacttgtagacataaagggcacagatggcaagacaacactgctccactttgtggttcaagagatcattagatccgaaggaacaggcggagaatctgcagacgagaatgttcaaaaccaatcaaattcccaattcaacgaggatgagttcagaaagaaaggattgcaggttgtggctggactgagtagagaccttggtaatgtcaaaaaggcagcaggaatggattcggatgttttaagcagctatgtctcaaagcttgaaattggacttgacaaagtgagattagttttgcaatgtagaaagccagatatgcacgggaatttctttaactcgaccgcactgtttctgaaagatgctgaagaggaaattgttaggatcaaggctgatgagagaaaggccttgttccttgtgaaagaagttacaaaatactttcacggggatgcagcaaaggaagaagcgcaccctttccgaatttttatggttgtaagagactttctaaatagtttggatcaagtctgcaaagaagtggggaggatgcaggataggactgtgattggttcagctagatccttcaggatagccgcaa

SEQ ID NO: 69917 - DNA, 330 bp, Glycine max
  Peptide Sequence Number=SeqID_186695
atgggaggatgtacaatatggttaaagtcttgggcatcgtatcgtatggcattcattcaaccgagggtcaagcaccagccgttatatccacttgtaactagatggagcgacagagggctatggttttctggaatcccacgcggtgatgtgataggctacaagtcaagattcaacaacatgcataggaaagaggttgttgaaccatttgtatggcatcaaactgacaaggtcatgctccaatttggactttttcaagacataccaaatccaccgcataatcttgacaaagtccatcatactgacatgagaggacatcgtgacacaaattag

SEQ ID NO: 69918 - DNA, 270 bp, Glycine max
  Peptide Sequence Number=SeqID_186696
atggaggataaatacaccaaggttgcctcctcccaaaagcaatcagttaaggttgagttgaaaaagaagaactacccacttaccaagggcaagctgaacacaaaattagaagagaaaaggctgaatgtgtgtgagagaagagagtattggagtttgtgtggtggtggctgtgggactcaaggaagagggaaggtagtggattccacatgtccacttgtgggcatgtggagtgacatttgtattgtgaggtgtcaccgagcgagggtttaa

SEQ ID NO: 69919 - DNA, 162 bp, Glycine max
  Peptide Sequence Number=SeqID_186697
atgcagtttgggatttctggggtcgaactcgccatctgcgcacccctaatggatcagatgacaggggaggagccgacacttcgtctcgaggatgagggcaattggaggtggtggatacccaacacaactagatgcatggattactttcttgggtatctatga

SEQ ID NO: 69920 - DNA, 1851 bp, Glycine max
  Peptide Sequence Number=SeqID_186698
atgtacctgcatatttttgtcaggtatgtggcaactgagctagcaactgacatagttgttaatgttggaaatgtaaaattttatctccataagtttcctcttttgtcaaaaagtgcgggctttcaaaagctgattacaaacactaatgaggagaacaatgatgaagttcacatccatgacattcctggcggacctgctgcttttgaaatatgtgtcaagttctgttatggtatgacagtcactcttaatgcatacaacgtcgttgctgctcgctgcgccgcagaatatcttgagatgtatgaaactgttgagaaaggaaatcttatctacaagattgaagtcttcctcgactcaagcattttcaggagttggaaagactcgattattgttcttcaaactaccaagtctcttcttccatggtctgaggaacttaagttagtgagccatggcattgactccattgctaccaaggcttcaattgatacatcaaaggtggagtggtcatacacctataacaggaaaaagctaccatctgaaaatagtaatgatcctcccttcaatagtgtgaggaaacaacaattggttccaaaggactggtgggtggaggacctttgtgagctccaacttgatctttatgagcgggttataaaaacaattataagcaaaggtaatgtttctggcactgtaattggagaagctctaaatgcttatgcctcaagaaggatgcctggtttcaacaagggtgtgatccaaggagatattgtaagaaatagattactgttggagaccataatccgaatattacccttggacgtgggcagtgtctctttcagtttcttggtgaagttattaagggtagctattcagttggaacgtgaagagttggagagatctgaactgattaggagaataggtatgtgccttgaggaggctaaggtgtctgatttattaatttgcgccccagttggtgacacagtttttgatgttgacattgtgcaaaggctagtagaagagtttgtagcatgtgatcaacatgttcagacggatactctgttggaagatgactttcaggaggagatcagaagccccgggatggtttcagaatcttcaaaggcaaaagtggcaaaattggtggatggataccttgctgagattgcacgtgatccaaatttaccttttgcaaaatttgttaatcttgctgaattagtatcaagctttccaagagcctctcatgatggcctttatcgtgccattgacatgtatttaaaggagcatcctggaatcagcaaaagcgaaaagaaaagaatatgcaggttgatgaactgcaggaagttgtctgcagaggcttgcatgcatgctgtgcagaacgagcggcttcccatgcgcgttgttgtgcaggttctcttctttgaacagctgagagctacaacatcttctggaggcaatggcacaccggatcatcctggctccatcagggccttacttcctggtggatctcatgggagctcaaggtctactataacaaacacagaagaggaatgggatgccgtgggaacaatggaagacataaaatccctgaaaggggagcttgatgcactgaaattatctggtggaaccagcggggccagcagcagaagcgacaacaacgatggcggtaaagacaatgctgagaaagttgctgctagtaaaatgaaaggtctcatgtcgaagaagataatctctaagatttggtcaagcaaagaaagaagtggtgagctaagtagttctgatacatcagagagccctgcttctactgttgtagaggaaacaaaatctactccatctagaagtaggaggcattcattgtcttag

SEQ ID NO: 69921 - DNA, 126 bp, Glycine max
  Peptide Sequence Number=SeqID_186699
atggcaagtacacacccgattcccaccaattttgttgaggtccatggccatgtggtggaagatgtaggagagccattcggaggtgtagttgcagaggacagtggcgttgaggggagagatatctaa

SEQ ID NO: 69922 - DNA, 219 bp, Glycine max
  Peptide Sequence Number=SeqID_186700
atgacattggcccagacatcgagtgtcttctcttactccaacctagctcccacatcccacacctcaaatttgaatatggatagagctaggttggtctatgacttggtaaccaacatggacatggacattggagcccttatctctggtcagatttcttctattgctcagagtaactcctctaggctcggatttccagccttgatcactgccctatgctga

SEQ ID NO: 69923 - DNA, 459 bp, Glycine max
  Peptide Sequence Number=SeqID_186701
gaacatgaaatggaactccaacgacttaatcaaaatgaagaaaccgacaaaaagaaaagaagtatagcactcaaagcctcttcatcaatgcaagaagaaaatgaagaagaagaatcaaaagatgaagaagacttctcactctttgtgaagaagtttcaaaaatttgtcaagaagagaagaatcgagaggcttcagaacttcaacaatggaagaatatctcaagaaaactctcaaattcttagatgctacaaatgcatccaacttggtcacattaaagcaaattgtccctcaaatgaggaatggcctgagaaaagtgataagaaaaggtatgaagaaagaaggaccaagaaggcctacattgcttgggatgacaatgactcatccgacggttcagagaaggagatcaacgttctaaccaaggactatgagagtgatgagaacatctctcaagaagattaa

SEQ ID NO: 69924 - DNA, 1299 bp, Glycine max
  Peptide Sequence Number=SeqID_186702
atgggagaaatagaggaagttcaagagcggatgaaggacgacatggaggccatgatgagcatgaagaagataatggaggtcaatgcggctgcagttgccgctaccagcgccgttgctagggtggacccgattcccccatctagcctcaaccaaataaattatccaaccttggatatggtaggtcagggaggccaaaagttgggaagtacaggcggcccccattttgtgcaagttcagaacaagcatgccttcctgccatatggcttgcctcccaactatacaccacccaatgtttcacacactcccgatgagaatttcaataactctacccccatactcgttgagatccaacaacctcaatttgatcatgcacatgtctctcaacccatggggaagacacatgaaataccccaccacaatctagccgacttcaagcctcgcctcggatacgccattgaggggcaagcaattggtggtggacccttgccaaacacttcggagcaccctccatttcgtccacaaccacaacccttgcatttcgcggtagggagagtccctcctgctatggcaggaaaaggaaagttggatcatatagaagaaaggctcattgccattgaaggaggtggagattattcctttgctgacatggaagagttgtgcctagtaccctatgtggtcattcctccgaagttcaaagtgccagattttgatatgtacaaggggactactttccccaagagtcacttgaagttgtattgtcggaagataggggcgtacgcgaaagatgaaaaattgttaatgcatttcttccaagagagccttactggggcagccgtcacctggtatactaacttggaaccttcccaagaatacgcccagaggtggagggaattggcagctcgagtggccccttcaatgacggagaaagagatgatcacaacgatagtagacacgttaccggtgttctactatgagaaaatggtgggttactcaccttcaagctttgctaatttagtttttgtcggcaaaaggattgaagtgggtctgaaaagaggcgaatttgattatcctgctttgacaaataaaaagcctggggcaaatagagaggatgagaaggaggaaggaacccatgctgtgactgtcgctcttacatggccaaatttcccaccagctcaacaatgtcattactcagccaatatcagcccttctcattacccaccatccaatcagccacaaagtctgcctgccgcacatccaataccaaactccacccttaacacaaaccaaaacaccaactag

SEQ ID NO: 69925 - DNA, 642 bp, Glycine max
  Peptide Sequence Number=SeqID_186703
atgcgtgctggagctagagtaatgggagaaatagaggaagttcaagagcggatgaagggcgacatggaggccatgatgagcatcaagaagataatggaggtcaatgcagctgcagttaccgctaccagcatccttgctagggtggatccgattcccccatctggactcaacaaaataaattatccaacctcggatatggtaggtcagggaggcaaagagttgggaagtacaagcgtctcccattttgtgcaggttcagaacaagcatgccttcccgccatatcgcttgcctcccaactatacaccacccaatgttgtgcacactcccgatgagaatgtcaataactccacccccatactcgttaagagccaacaacctcaatttgatcatgcacatgtctctcaacccatggggaagacacatgaaataccccaccacaatctagccgacttcgatcctcgcctcggatacgccattgaggggcaagcatttggtggtgttccgctgccaaacactttggaggaccctccatttcgtctacaaccacaacccttgtatttcgcattagggagagtccctcctgctatggcagaaaagggaaagttggatcatatagaagaaaggctcagggccattgaatga

SEQ ID NO: 69926 - DNA, 309 bp, Glycine max
  Peptide Sequence Number=SeqID_186704
atgactacatcttgtagagtgatagtcatgaaactaaaaggaaatacaaaggtatttatggaaatcgaccagaagctcaaaaagctaaaaatcaagggtcacccttttgagccacctatagtagggatcagagcccctaggccagctggcatgatgaagatagtagtcaagaaacgtgatgacatccataacatcatcatcacaaggatgaaggtaataatgtccctcatgagctttcaacgtatttttgacactcccaaggatttcaggctattcttggtcgttggagaaactggaagacaattttga

SEQ ID NO: 69927 - DNA, 378 bp, Glycine max
  Peptide Sequence Number=SeqID_186705
atggatagccaaacgagtttgaggtggtccaaaattgccaagcatctacctggtaggacagataatgagatcaagaactattggaggaccaggatccagaagcacatcaagcaagctgagaactttcagcaacaaatcagcaataactctgagataaatgatcaccaagctagcactagccatgtttctaccatggctgaacccatggagacctattctccacccttttatcaaggaatgttagagccattttcttcaattcagttccccacaattaatcctgatcaatccagttgttgtaccaatgacaacaacaacagcattaactattggagcatggaggatatctggtcaatgcagttactgaacggggattaa

SEQ ID NO: 69928 - DNA, 600 bp, Glycine max
  Peptide Sequence Number=SeqID_186706
atggaccattcagtcactggaggatcttttgagggtgtgtgtcttagaacaaaaagggagttgggagagttttcagtcgttgatagctataacaatagttttcattttaccattgacatgactcttgatgaagctctatatggtagaaggtatacgagacccatgtgctggctagaacccagagaaaacctcaccttaggacctgaagtggtagaacataccatgaagaagagtaggcagaagagctatcaggacaagagaaggaaaaacctagagtttgaggttggtgatcatgtattcttgagagttaatccatggactggggttggtttagctttgaaatgccgaaaactcacacctcgttttgtcaaccctttccgaattctcaaaagagttgatcctgtggcttaccaaattgcattacccctgtcgctttctaaccttcagaatttctttcatgtgtctcaactccgtaagtatatccatgatttatcttatgtgatcaaattgtatgacatacaattaaaggagaacttgacatatgaaacttttcctttgaggatcgaggataggcgaacaaagcacttaagagggaaatag

SEQ ID NO: 69929 - DNA, 144 bp, Glycine max
  Peptide Sequence Number=SeqID_186707
atggtgcagaaaaattcgcctagacgagctaaactcgcttatgcgaatttgttgcttaattctgaaggcacagactcgcccagattcatccatgattctgtaggttttgaaggttgtttgttgaatccagaaacatcagaataa

SEQ ID NO: 69930 - DNA, 207 bp, Glycine max
  Peptide Sequence Number=SeqID_186708
atggggttcatctacctcaagtccttgtctaccttggtgccgtcaaaagacatcgatgacgtcatgcctcccaagagtgaccctcgaaatcacgatgaacccccaaatctcctactagacaaggtcgatatgcgccgccgtaggctaatctctcaccaaggactctgctcgttgctgcaaactcccacaatccccacttgcgattaa

SEQ ID NO: 69931 - DNA, 183 bp, Glycine max
  Peptide Sequence Number=SeqID_186709
atgtggaattttaatttccttctaaaagaaacaccatctgaactcacggagtgtcaattggatgcaggcgtagggggacacgtagaactacacccgctagtcaggggagcaaccgtcgctattcatcacgcggtggaggtgctcgccgatgccgatggcctaggccatgccttacgtcattga

SEQ ID NO: 69932 - DNA, 225 bp, Glycine max
  Peptide Sequence Number=SeqID_186710
gagggtcctctctaatgccttccctttttcttctcatcggagttatttcacaaaagacttgccatggtaaagaagaagggggaacaagcacacttggagagcgcagtacaacggatagttgtgcgatgatttacttcacgggcgaggtctctgctcagttggtagagctccgctcttgcaattgggtcgttgcgattacgggttggatgtctaattgtccaggcg

SEQ ID NO: 69933 - DNA, 354 bp, Glycine max
  Peptide Sequence Number=SeqID_186711
atggaagaaagacatggaaaacatgagaaagccttaagtgtcattctttccttgatcgctaccacttctcttgcaataatgtggaaggtgcttccagaatacacgattttcatggcgtctctagctaagaggcgaaaatgcaaggaaaattcactatttaggctttttctgaagaattcaacacttgaaatgctacatgacaattgtgaaaatactggtttcctagaagcaagactcagtcaaacagtggaacatgaatcacaaagagagaaaagccactcagccaaaaagctaacctgtgatgaatttatcccttgcacccctgttgagccaaaaggttctaagaaagcataa

SEQ ID NO: 69934 - DNA, 318 bp, Glycine max
  Peptide Sequence Number=SeqID_186712
atggagaacaatggcggtttgtggtggctactggtggctgtggatgatggagaaagatcttggaacgttggaaatgattttggaagaaagaaggagaagaaatggcatttttccaaagctacacgaaaagcaaaggctgaaacactcaagtgtttctgcttgcgggaaaggaagcgctcctcacacgccagacgtcatatcgaagatcgcaacggtcaggtcgtggacatctgtcctgtgaacctccagacaaatttcaagaagattcaacagttagcgaaggatgggcagcatttttatcgagacaacttcatgtag

SEQ ID NO: 69935 - DNA, 183 bp, Glycine max
  Peptide Sequence Number=SeqID_186713
atggtgtgtgcaaatgagggtattgttgaagttccaagtgtggacacaaccaacttcaacaagataattgttgcaaccactatgaatgaggcatgggaaatcttggagaaatgtcatgtcggtgctgaaaaggcaaagaaggtgaagcttcaaaccaagagaagatgttacaagttactgtag

SEQ ID NO: 69936 - DNA, 240 bp, Glycine max
  Peptide Sequence Number=SeqID_186714
atgacatctctcactctcgctctcactgtcactcatctcttgtgctctcattcttgctctcacttatctcttgcactctcgttttcactctcactctcacgtagtctctgcggcggcacaacaacaccattctcgctcttgctctcgctatcatctctgactctcattctcgctctcggtcatgaaagcgagaagttagggctcgttcttggttttgatgatatccaattctcattttga

SEQ ID NO: 69937 - DNA, 879 bp, Glycine max
  Peptide Sequence Number=SeqID_186715
atgcaagaagccttgatactgatggataatgctttaatgagccctcatcttcttgcgtttgcttcaccgcagctctgcgggagggagcccaaaagcctaccatcaccctccatcctcgccctccaccctcaccgcagctccacgatgcttaccagaacgcaggagcgtggctgctgcttgacctacgactacgtcaccgacgatgccactgatctgctcggcgagaaggacttggattcgatctccgcactgagagggttgctcgtttcgcggcccgcggatttgagcttttcgcacaagaacgcgctgcaccgctgcgtggaacacgccaagctatggcttgctcaggatagagagcatatggggttcgtgagcagtttcttgggggttcttggttttgccgttggaatacctcttggcctcttagttgggttctttctctttgtctactcaaaaaccaaacatgtcaaggaccctgttgttaggccaatcagtgaattaggcccaaatgctctgcaggaacttctgcccgagattcctctctgggtgaagacgcctgattatgaacgagtttatgatgacgacgatgatgatgttactgtgttattgatattatctttgcatgttattcaggttgattggttgaacaagtttttgttggatatgtggcccttcttagacacggcaatttgtaagattattagaagcacgactcaaccgatatttgccgaatacactgggaagtatcagatcaaagcgattgattttgatgagttaagccttggtactcttcctcctactgtctgtggaaaaattggaagctttcccccaaaaacacagaaatatgcacatttccaaatgaagattgaagactactag

SEQ ID NO: 69938 - DNA, 669 bp, Glycine max
  Peptide Sequence Number=SeqID_186716
atggtggaacctgacagttggaaccccatcctagaccgcctcaaggttgccattgcccacttcgttgtcacccaagcctccatggctaccaaactagatgttcttctcctgaaaatggataccctattaattagccaaaactctccatcttcttcctctatgaaggcaccacccacacatgcacccatgtggactctgcctcccatgtcgattctgcctccatgcctcacactcatgcaacaaagccccacactcgcacccatgccaactccaccgcccatgtcgattccgattccatgccccacactcatgcaacaaagccacgcacccttgttggctctgcttcccatggctgcttcccacctccccgatctcaatcaagctcgcacccccgtttcctttgacaacctcttcaatgttgttgttcattatgggcatgcaacaactcctaatggcaagactttggaagaaagaaacatggcactgcttgatatgggagctgagtactatgggtcagccatggccgcacgcaagcaccaaccaactacttttgcactatggatggctgctaaaccaggtgatcctcgcagggatagaccttgggatcctggaggacctaggaggactcgtaacacattgaggacaaggagaataatagagagaaagtag

SEQ ID NO: 69939 - DNA, 747 bp, Glycine max
  Peptide Sequence Number=SeqID_186717
atggcgaggacgtgtagtcctctgaagctgagggcgtgcagccccctgatggcgaggacgtgtagtcctctgaaggtgagggcgtgtagccctctgatggcgaggacgtgtagtcctctacaggagaggacgtgtagtcctctgatggcgtggacgtgtagtcctctgaaggtgagggcttgcagccctctagtggtgaggacgtgtagtcctctgaagctgagggcgtggaaccctctgatggcgaggacgtgtaggtttctaaaggcgaggtgttgcaagcctctgatggtgaagacatgtagtcgtctgaaggtgagggcgtgcaaccctctgatggagaggacgtgtagtcctctgaaggtgagggcgtgcaaccctcagatggcgaggacgtgtagtcctctgaaggtgagggcgtgcagccctttgatggctaggacgtgtaattctcttgtggcgaggacgtgtagtcctttgatggcgaggacgtgtagtcctctaaaggtgagggcgtgcagccctctgctggcgaggaggtgtagttctctgatggtgagggcgtgcaaccctctgattgagaagacgtgtagtcctctaaaggcgagggtgtgcagccctctgatggcgaggacgtgttgtcctctgaaggtgagggcttccagccctccgatggctaggatgtgttgtcctctgaagctgacggcgtgcagccctctgatggggaggacgtgtagtcctctaatg

SEQ ID NO: 69940 - DNA, 291 bp, Glycine max
  Peptide Sequence Number=SeqID_186718
atgggctacgtgggagtacgtgagctcagttggaggtgggctacaggggatggtgggtttatgcgcgcattgtggatggtgaaacttcctgcttttattgttgaccacagagtggtacctggagatatgtcgcgggggtcaggagaccttggggacgtcaggcgagctcctggcagtcaacagataaaaggaaaacaagaccacaaagcaaggaggcttgtggtggctggccagctgcttgaaaacgaggtcaggaagctaaggaagcctctggtaatcgattaccaaggg

SEQ ID NO: 69941 - DNA, 396 bp, Glycine max
  Peptide Sequence Number=SeqID_186719
atgggaactgcttttgctgttaagaagtattctaagaaaggaatctgcaagtgtacccatggcaatagggataatcatgtcgtggagacatgttttaaactccatggttatccggattggcatccaaaaggcaaaactactccaagtaccaaggtagacgctacttccaagagccatatttctactgctgttggatttgtgaccaaatcatccattccaaggagaagattggcagtggtagagggagtgaaggactgtattatccagaaaatgtctcacaacaaacccataaaggagcattggcttgtcttgcgaatgaacacatacaagctaaaaacaaaaaggaaatatggctatggcataaacgattgggacatccctcttttggttatctaa

SEQ ID NO: 69942 - DNA, 1041 bp, Glycine max
  Peptide Sequence Number=SeqID_186720
cttcagagagctacacgccctcaccttcagagggctacgcgccctcgcctaaagaggactacacatcgtcaccttcagaggtctacacgccctcgccttcaaagggcaacacgccctcgccatcaaacgactgcacgtcctcaccttcagaggactacacatccttgcctttaaaggactacacgtcctcacctttagagggctacatgccctcgccttcagagagctacacgtcctcaccgttagagggctacacgccctcgcattcagaggactacacatcctcatcttcagagggctacacgccctcgctttcagatgactacatgtcctcaccgttagaggactacacgtcctcacctacagagggctatacgccctcgccttcagaggactacacgtcttcgcctttagagggctgcacgccctcgccttcagaggactacacgttcttatttttagaagggctacacgccctcgcttttagagggctacgcgcccacgccttcagaggactacacgtcctcgccttcaaaggactacacgtcctcacctacagagggttacacgccctcaccttcagagggctacacttcctcaccttcagagggctacactccctcgcctttagagtactacacgtcttcaccttcaaaggactacatgtcttcaccttcagaggacaacgcgtccctgccttcagaggactaggcgccctcgccttcagaggactaggcgcccttaccttcagagggctacacgtcctcgccttcagagggctacatgccctcgccttcagagggctacacgccctcgccttcagaggactacacgtcctcaccttcagagggcttcgccttcagagggctacacgccctcgcctacaaaggactacatgtcctcaccttcagaggacggcacgtcctccccttcagagggctacatgtcgtcgccttcagagggctacacgccctcgccttcagaggactacacgtccttgccttcagagggccacatgccctcgcctttggaggactacac

SEQ ID NO: 69943 - DNA, 672 bp, Glycine max
  Peptide Sequence Number=SeqID_186721
atggttagaactagaggttttggtcgggctttaggccgagcaataggaaaagtcttggggaggaaagatgtgagtgacgatgatgccccccaacggcgaaggcctattgcattagcccgtagacagcgacaacaacagcgtgttgtcaaggaccctcctacggccgcggaggaattgatcgacgagcagccagaagcacctactgaagaagttgttactaatgttgagggttttccaagcggaccccatgacacatcaattctcacagattttgaaaataacattgctttgagagtttggaatggagatgaatgttctgagttgaagctatcttcccatggaaggaagatggctaagttcgagaggcctgctccacagattgaaggcattgtggcagtcagtggactaagtcctttgatcgcctattccctagatacgggtgattggggactaatgtctgcttttatggaatgccgacataaggaaactagcagtttccatttgcctgtcagagagatgactatcaccttggatgtcgttgcgtcgttgctacatctgcctattgtaagggtgttccatagcttcaagctacttcatgtcgacgacgttgtcgaaatgttggtggaattactcgaggtcagcgctgcagaggtgagagttgagacgatttag

SEQ ID NO: 69944 - DNA, 902 bp, Glycine max
  Peptide Sequence Number=SeqID_186722
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattcgacaccggcgtcgatccccgacccgtcagcgcgcggcgctgcccaggtcaccgtggccccgctcagctcgcccgcgtcgacgagcccctgggcggcgtccaggagctgggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 69945 - DNA, 741 bp, Glycine max
  Peptide Sequence Number=SeqID_186723
atgccgcctttgagagatagaaaaggagatattcatctgcttttcagaaagtttgcaatcgattttgctgaaaaatacagaatgcctgagttggttttagagccaagtgcagttcattatatagaaaattatagctttcccgggaatgtacgtcagttaagaaacttagttgagcagatgaccgtggtggaaagagaaagaaatataagcgttgaaaaactggcggagtacataccgaccgaaagccatttgccaatggttgttaatacgcctaatgctcagaaacagagtgacttcggaaacgaaagagagattatgtataaaatcctgtttgatatgaggaatgatatcaatgatctgagatctctgacttctgaattaataaaaaacagaggagcaggcgatctaagttcccaggaaaaaactttgatcaacagactttacacttcggattcacagcagaatactaatgctaattccctactttattttgaagataatcatcctgtagtccagactccaactattatttcgactcccgatgatagttatgaagatattcaggatatagagattgaagaaaataagccggaatcactttcgcttcaaaataatgaaaaagatttgattattaaagcattagagaagcataagggacgtaggaataaagcagctgatgagttgggcatttcacaaagaacactatacagaaagataaaacaatataatctagaagactaa

SEQ ID NO: 69946 - DNA, 1011 bp, Glycine max
  Peptide Sequence Number=SeqID_186724
atgacggtgggggttcttggatgtatggcggagagattaaaaactaagtttctcgaagaagaacagcttgttgatcttgttgtggggcctgatgcctacagggatctgcctaatttattaaaggaaacagaagatggcagggatgcgatcaatgttattttgtccaaagaagaaacctatgcagatataaatcctgtccgtctgggtggaaatggagtaaccgcgtttgtaactattacaagggggtgtgataacatgtgtaccttctgtgttgttccttttacaagaggaagagaaagaagccgtgatccacattcaattcttgaagaatgtaaagatctttggaatagcggatataaagaaattacccttttggggcagaatgtagattcttacctttggtatggagggggcccgaaaaaagattttgcaaaagcttctgaaatgcagaaagctacggccgttgattttgctcagctgcttggtttagtcgctcaagcggttccggaaatgagaataagattctctacttccaaccctcaggatatgagtcttgatgtattcagggtcatggctaagcatgagaacatttgtaaatatgtgcatcttccggtacaaagtggaagtaataatatgctggctgcaatgaacagacagcacaccagagaagaatatctggagcttatcagaaaagctaaggaaattgttcctgatatctctttttcccaggatatgatcattggtttttgtaatgaaactgaagaggatcaccaggataccctaagcctgatgagagaggtagagtatgactatggatatatgtttgcttactctgaaaggcctggtactccggcccataaaaagatggaagataatattcctgcagatgttaaacagagacgtttggcggaggttatcgctttacagggagagctttccaaaaaaagaatgaaatcctatgtaggaagagtgcatcagattcttattgaaaggagtttccaaaaagaataa

SEQ ID NO: 69947 - DNA, 141 bp, Glycine max
  Peptide Sequence Number=SeqID_186725
atggaagcaaaatttaaagaaagggaggcaaagtctgcaggatatggtgaaggcgacaaagaagtcgatgcggtttggggacaaatcgattctacaaacttcatcattgtcaaagtagagcatgcaatgaaagttagatga

SEQ ID NO: 69948 - DNA, 510 bp, Glycine max
  Peptide Sequence Number=SeqID_186726
atggctcctgaagacctggagcagctgacacaaaagattagggaccagctagaggagtcgatcacaaaaaaaatgcaatcacagggactcgcattgtctcctgagccaaaggtaggtccttcagttgcttgtgtcagcacaaaggagagttgtgatgatccctcagggaacgacccagacacaggtgactcagagaaatacgggttgtacgtcgaagaaaatcctcccagcctggttgccctaggaagactttatgaggggtccacaaccattcacaacatgcctttgcgccattatcaagtcaaggttggtgttgaggaagttagagatgtagatgctcccattcttgtacctactcaagagggagttgtgggaccggacaaacctgcagataggccggatcatgatgtcaatgatcccctatatctgatgacattgaccatcccacaactttttctaaagccgttgaaggttatgtgggatgctaccgtgtttgagctgtttaaatga

SEQ ID NO: 69949 - DNA, 317 bp, Glycine max
  Peptide Sequence Number=SeqID_186727
ccaacaagaacagtgtcaatgacactatatgcgaaaagtacaacattagcaaggagaagtggacccaattttgccaaagccgcagagacccttcatgggtggatgtgcgaaagaaggcacatgtcattcggaaacaaaacgctgtccctcacgtgttgtcccatgggggttatgagtttcttgaaaagaagttgatggatgagaagaaaaagaaacaattggaggaagcaaatgatgattcattggaggatcaggccttacaggattcctttatcgcccatggacgtcaggatgtactgactgctgccattggataa

SEQ ID NO: 69950 - DNA, 344 bp, Glycine max
  Peptide Sequence Number=SeqID_186728
tgtcagttggtttatgccatcctgacatagggattgcgcccacaagacacccagtggactcggagaagtccaacagggccctgggatttcttgttctgattacaggactctgcacagggctaggcaccatagtagccggaggagggccagtagcaggcagctatagacgcactgtcgtcacctccaaagtccacctctgctcacctgcggagtacaccctacgtcagcagagccaggatctcagcccttatgcatggcctactcttgaggagtttgaggccggcctgcagggaccttcggagatggagctgaagctcgggaagacgatgacatggccgatgtga

SEQ ID NO: 69951 - DNA, 276 bp, Glycine max
  Peptide Sequence Number=SeqID_186729
atgcgtcatttggctgatcaacagatagccaatcataggggccaaatgcagttgaatgacaacttctactactatacaccacaccagcattgccaggaccctaatccctacccttggcatactcccgagcaatttagagctactattgcatggcctggagataggtctatttttcaggaggaggcaggtcctgcagatgcccaaggagatggaggaatagcaaaggaagatgaagacatggtagatcctgctgattatttcattggaggagactaa

SEQ ID NO: 69952 - DNA, 628 bp, Glycine max
  Peptide Sequence Number=SeqID_186730
atggaacaacaaaacagcatcctatgcaaatacactgaacaccagaccgtcatgaaaaaacacatgaaatccaaagataacactttctgttcacctaaagtcatctccatatccttaatcgatccatacgccacagactcatccagcgacgaagagaatgttatgcgccggaggcgcgtgaagcgctacgtcaacagaatcgaacttcagccggcgttcaaacccgtcactacaagaaagagacacgccggagacgccgccactctccggaagccaccggcgaaggtgacaaattcctgcaggaaattccgcggcgtgaggcagcggccgtggggtaaatgggcggctgaaataagggatcccgtgcagcgagtgagaatctggctcggaaccttcaaaaccgccgaggaggccgccttgtgctatgacaatgcggcgatcacgctccgcggccccgacgcgctaacgaacttcgggaggtcgcggccggaggaaacgccggaaaaagaagagatggttgaaaaggaagaattcacatccgggaagccggaaatgaaagtcgtcgtgaaaccagagacccaagtttcagtttcggtctccggctgctacgactcgggcgacgagtgtt

SEQ ID NO: 69953 - DNA, 237 bp, Glycine max
  Peptide Sequence Number=SeqID_186731
cttggagggattgatggggacccggtgttgagaggaacgaggatgagggctacatgggagtacgtgagctcagttgaaggtgggcaactggggatgagtggtacctggagatatgtcgcgggggtcaagagaccttggggacgtcaggcgagctcctggcagtcaaccgataaaagaacaaagaccacaaagcaaggaggcttgtgtggtggctggccagctatggattttgagtga

SEQ ID NO: 69954 - DNA, 378 bp, Glycine max
  Peptide Sequence Number=SeqID_186732
atggggcctcatcaagaagagacagaactagtagacttaggaactggcagtggaaaaagggaagtaaagataggcacgggtatgactgcacccatccgtgaagaattaacagccctgctaagagactaccaagacatctttgcttggtcgtaccaagatatgcccggtttgagttctgacattgtacaacaccgattacccctaaatcccgagtgttccctggtaaaacaaaaactgaggaggatgaagcccgagacatccttgaaaataagagaagaggtaaagaaacaatttgacgctgggtttttggctgtcactcggtacccagaatgggttgccaacatcgtaccagtccctaagaaggatgggaaggtgtga

SEQ ID NO: 69955 - DNA, 582 bp, Glycine max
  Peptide Sequence Number=SeqID_186733
atgtcctgcccagcgatcataactccgacctccctctgccaaagtgtcagctggtgtatgccacctaccaggcaccctctagacccagataagtttaacagggccctggggtttccggcgttgatcacaggtctctgccagtcattcggggttcccatcacacctagtaaggtgattcgaccgccaatcacacgggccttcatcgagaagtattgcacgcctagacaggcgcagagtgatgcacttcaggctgcagacgcaccgccaccacctcatcaggctgatccagctgggtcatttggcacggagcggtatttacagcacttggttcgccagcaggcggctaaccatagggggcaggtgcagatacatgagtgtctctaccagctcagtctcagtcagcagagccagggttttgctccttttgcatgccctactctagaccagttcagggctgaggttgcatggcccagagattggcctgaggcgcctgcagaggctcccggcgatgcagaggaggcccgcatggatgaggagatgacaaatttacttggtttcttgggagggagcggagccacatga

SEQ ID NO: 69956 - DNA, 396 bp, Glycine max
  Peptide Sequence Number=SeqID_186734
atgaatccttacggatcatgtatttactccttttttagctttcgaagaagttacggaaactcacggattgtgcgacaacacctccttttggtttccgcctcattacggaatttcacggatcgcgtaaacctgcttccctttgatttccggcgtgtctcgggacttacatatcgtgcaacaaagggtgccaagtattttgaagcggccaatcaaaggttgcatatcatcaaagggtacatctacttggggattgttatactgagaacaagagagggtacatctcttgtggatcagttcaagtggagggtacatccacttgggttttcaaagagaacaagggagggtacatcccttgaaagaaatctcaagaaccacaggcgggctgccatggcgtag

SEQ ID NO: 69957 - DNA, 882 bp, Glycine max
  Peptide Sequence Number=SeqID_186735
aactcgctaagcgcgcttaccgtgctaagcgagttcatcctttgaggatgaacactcatcctcttgctgaactacttgtggctaagcaagctaagcgagcttcactcgctaagctcccaacacttagtgaaatttttgaagagttggtgctgctaagcgcagccttcaaggagcttagcacaaatccttgcggcacatgccagctaagcggaccatgtctcgctaagcggccgatgccttccaagaaaagaaagagtgtcgagttggatgaatttaaggttgaattggagaggcgtaactaccataagcgcctcaccaatttagctgatagtagcattgacctagcattggtgaaggagttctacgccaacctctacagtcctgaggggctttcaccaaaacaagtcagaatacggggccacttgataaaaattgatgcagacagccttaatgcctttctagaaacacatgtggtgcttgctgagggtgaatccttacccgcttactcaagatattgcaggatgcctactaacatcagggaaattgaggatgctctgtgcatacccggccgagggtttattttaaatgctgaaggtcaccctgggaagatcctcagaaaagatctaaccactcttgctcaggtctggagtgttctctcatactccaacctggctccgacttcccacacctcagatttgactgtggatagagctaggttaatctttggcttagttactcagctggacatgaatgttagagctctcatctctggacagatcacatcaatggcccaatctaactcctctagactcgggttccctgctcttatcacaactttatgtaggtccagaggagttgcttccgacagcttggtctttgaac

SEQ ID NO: 69958 - DNA, 177 bp, Glycine max
  Peptide Sequence Number=SeqID_186736
gctgagctagagagaaaaacaaatgaccaaagtgaacaaagagccattgctagggcaaatttgggtgttgaagagtcaaattttgattcggatttgatttgggcaagattggatgagaggaaggagttttctgcctttgctctgttttgcttggctgtgatagcttgtgctgtgtga

SEQ ID NO: 69959 - DNA, 789 bp, Glycine max
  Peptide Sequence Number=SeqID_186737
atggcttaccgtaccttctccttcagcaatgacatcatctggcgtgcgccgcttgcgcccgtcgagcatgcattggcgaatgcggtacgggaaaagatcgctgcggtacgcccgcatctactggatttcctgcgtctggatgaagaagcgcccccatttgctctaaccctcgcggaatggtcacgaccaacatcccttagttcattactgtccacctattccgaccatatttaccgtcaccaacccagccaaccgcgcgaacaaaaacccctgctttcactatgggcgcaatggtatatcggcttgctggtgccgccgctaatgctggcgttgcttacggaagaacaggcaattagccttgaaccggagcattttcgcgttgaattccatgaaagcgggcgcgcggcttgcttctggattgacgtgcatgccgaccatgatgcgttgatgcttcccgcgcaagcgcgtatggatatgttggtcaataaagccctgaaaccggtggtggaagcgctggaagctaccggcgacattaacggtaagcttatctggagcaataccggctatctgattaactggtatctcggtgaaatgaaaaatctgcttggcgacgagcaggtgaacgcgctacgccaacactgtttttttgcaaaacagcaggccagtggcgaggataacccgctgtggcgaacggtagtcctgcgcgaagggctgctggtacgtcgaacttgctgtcagcgttatcgcctgccggacgttcaacaatgcggcgactgcacgttaaagtaa

SEQ ID NO: 69960 - DNA, 237 bp, Glycine max
  Peptide Sequence Number=SeqID_186738
atggggctccgaataagatttgatggtggaggatgcacgaacagcgctaggaaatctattcgtggggttccagactcgatggcaatcaatttgtggggctccggactcgatggtggaggatgcatgaatggaaatcaattcatggggctccaaataagatttgatggtggaggatgcacgaacaacgttaggcaatcaattcgtggggctccggactcgatggtggaggatgcatga

SEQ ID NO: 69961 - DNA, 696 bp, Glycine max
  Peptide Sequence Number=SeqID_186739
atgggaaaaaaccaagcctacaaagctatgcagagagccaggctcggcggcgcctccgccggccccgacgaggttgaagacggcatggtggatggttcatttcattcaccagaatggcatgcagctcgtttggctagccttaacacctctcacaccattacctgggaggagtacaaaatgaagcaaaaggaagaagaattgagaaaaggggaattggaagcagatgcagataggatgatgagagagtacagagctcaactagatgctgaaagggctcgtaagctttcccaaggaagaaatcactctaatagtaagtctaaacatgtgaaaggtatgtctggtaaagttgccaaaacttggtttgttctgctagcacttttcctgatcccagcttctaatgagactgcatattctaacttgcagataagagggacaaaatttcaaagaagcacagcagcagaaagagaaagcattcaagaagatcttctgcatctagctcctcttcgtcatcctcagactcttccagtagcgatgaagaagaaagagggtcaagaagatccaagtccaggtccaagagatcaaagaaggaaaagaagtccaagtcaagaagcaaggatgctggaagcgctagtgaagacgagggtccagttcgcctttcaagattctttgggaacgtcaagagtgaatagtgcttga

SEQ ID NO: 69962 - DNA, 1266 bp, Glycine max
  Peptide Sequence Number=SeqID_186740
atggaaggaggaggagctgctccgccggccgacaccgtgatgtccgacgcggcgcctccgccgcagcaagcgatggctatggggatcgagaatattccggcgacgctgagccacggtggcaggttcatccaatacaacatattcggaaacatattcgaagtcaccgccaaatacaagccacccatcatgcccatcggaaaaggcgcatacggcatcgtttgctcggctttgaactcggagacgaatgagcacgttgccatcaagaagattgcgaatgcgtttgataacaagattgatgcaaagaggaccctccgtgaaatcaagctgcttcgtcacatggatcatgaaaacgttaatcctctgattttgtgtgtgaaggcttcaaattcaatggccatttgcgacaataagttgcaatcaaaggtgccaagttgcaggatggtggttgcaatcagggatatagtgccaccacctcaaagggagatattcaatgatgtttacattgcatatgagttgatggacactgaccttcaccaaattattcgttcaaaccaaggattatcagaggagcactgtcagtattttctgtatcaaatcctccgtgggttgaagtacatacattctgccaatgttctgcatagggacttaaaacctagcaaccttctcctgaatgccaactgtgacttaaaaatttgtgattttggactggctcgtgtcacgtctgaaactgattttatgactgaatatgttgttacaagatggtaccgtgcaccagagcttctgttgaactcttctgattacactgcagcaattgatgtatggtctgttggttgtattttcatggaactgatggatcgcaagcctttgtttcctggcagagatcatgtgcatcagttgcgtctacttatggagctgattggcaccccatcagaggctgatttggggttcctgaatgaaaatgctaagagatacattaggcaactacccctttaccgccgtcaatctttccaggaaaagtttccacatgtccatcctgaagctatagatcttgttgaaaaaatgttaacttttgatcctagaaaaaggattactgttgaagatgcactggcgcacccgtacttgacatctctgcatgacatcagtgatgaaccagtgtgcatgactcccttcaactttgactttgaacaacatgctttgacggaggaacagatgaaagaactgatataccgagaggctctagcatttaaccctgagtatcagcagtag

SEQ ID NO: 69963 - DNA, 1371 bp, Glycine max
  Peptide Sequence Number=SeqID_186741
atggggcttagcttcgagctggcgacgcagttgatggataagttgggggatgccgtaacggtcgtcgatgaagttcacggcttccgctatttcgaccgtcgggcgatgatcggtttcgttgacggtagcgaaaacccgcaggggcgcgcggcggcggatttcaccattatcggtgacgaagacccggatttcgccggtggtagctacgtgattgtgcagaaatatctgcacgatatggcgggctggaatgcgctaaccgtcgaacagcaggagcgtattatcgggcgtaaaaaaatgactaacatcgaactggatgccgacgtcaaacccagctgttcgcacagttcgctgaccacccttgaagagaacggcgaggagattaaaatcctgcgcgacaacatgccgttcggcaaacccggcatgggcgagtttggtacctattttatcggttatgcgcgcagcccggcgcccatcgaacagatgctggaaaacatgttcgtcggtcgcccggccggtaattacgatcgactgctagattatagccgcccggaaggcggcgacgcagggaatccccaggagcttactccagtagtgactggggtgagcgaggacaaattcgtcaggaacgaatttgaacgcagttcactgcgccccatcattgggtcttcaggaagtaatacaatgatcatccggccagaacaacactggttttttcgtctgtttgactggcacggttccgtgctgtcaaaaattgttttccgtctgttattgaacgttctgatgtcggtcatcgccatcatcagctatcaatggtatgaacaacttggcattcacttaaccgttgcgccatttagcctgttggggatcgcgattgcgatttttctcggctttcgtaatagcgcgagctacagccgtttcgttgaggcgcgtaatttatggggaaccgtgctgattgccgaacgaaccctggtcaggcaattgaaaaatatccttcccgctgaggaggaaacgcataaaacgttagtcagttatctggtggcgttcagctggagccttaagcatcagctgcgtaaaaccgacccggcggttgacctctatcgcttgttgccgaaagaaaaagtggcggaaattctcgccagctcaatgccgactaaccgaatattattattgattggtaatgagttaggtaagctgcgcgagcagggtaagctcagcgatattacctacggcttgatggataataaactcgatgagttagcccatgtcctggggggctgcgagcgtctggcgagcacgccggtgccgtttgcctacaccttgattttgcagcgtaccgtttatcttttctgcgcgttattgcccttcgcgctg

SEQ ID NO: 69964 - DNA, 261 bp, Glycine max
  Peptide Sequence Number=SeqID_186742
atggctccgaaaaagctttccgcgaagagatctaggagggacgtcgcagctgaagggaccaatgccgcccccgagtttaatagccaccgtttcaggagcgtcgagcaccagcagcgcttcgaggccatcaaaggatggtcgttccacagagagagacgcatccagctcaaggacgatgagaacgcgaattttcaggaagagatatttcaccgacgttggacgtcgctagtcactcccatggctaagtttgacccagatata

SEQ ID NO: 69965 - DNA, 117 bp, Glycine max
  Peptide Sequence Number=SeqID_186743
atggaggagacatcccaaccagctaagttcaacgagccattcgagaacaagggcttgaacaaagatgccgagtacaccaaggcatttgtgagggcttggattagctcacagaggtag

SEQ ID NO: 69966 - DNA, 927 bp, Glycine max
  Peptide Sequence Number=SeqID_186744
atgccattgcctacttatctcaacaagttgaaggacctttatcagaaggttacccatttggagacaagctcgcattcgttgacatcatccacaaccaatcacaatccacttcacccgccaccttcctttcttcatatgaagttggaagtgtcgccgtttgaaggctcagaccccttttgttggatcttcaagatcaaccaattctttgcttatcatgacacacccaaacccgatagcctcacgattgcttccttctatatgggaggactaaccttcgcatggttccaatggatgtcgcagaacgaccaactttcatcgtggactagttcgcctcttcctcgggcctcccctttgccactagcacgtagcctcttgctaacaccaccaaaaccttcttctatcccattcaaacaattgtcgctggaagaactcgcccttcaccgggagaagggtttgtgttttaattgcgacaagaaattcagccgcagtcagaagtgcgcctccagactctttctcctaattgccaaggacgatgaaaattctcctcaggatttgcttcgctctacaaaggtttgtgatgaaggacaagggatagaatctttcccggcccaaattagcctacacacgctttcaggccacatggctcctaagaccttacgtttattgggccacctaaatggtcagccggtgtggatattaattgatgtgggtagtacccacaattttatccaagaacgtttagttctggcattgggcctacccacccaacccactcaacctctgagggtcatggtgggcaatggccatgagctcgagtgccatcagtggtgtaggggcatcaatttccaagttcaggaccaacaattcttagtcaatttccatgtctttccgttatgtggtgctaatctcgtactaggcgtagaatga

SEQ ID NO: 69967 - DNA, 450 bp, Glycine max
  Peptide Sequence Number=SeqID_186745
atggaggctattctcaaaaaaacaatggcaatggagggaattaggattgaggctgactggagatggagaaggtgtgcaatggatcgagtcaatgtcgaacttgcccaaataggaccaaaaagtgtcattcattgtaacttggaacgaggggaacctatccttgatggtgatggcgttaagaactcgataatcgacacagaaacgccaagacccatcacgcttcttcaccagcaagaccaaagaggagaaaggactcgtgcttggtctgatgactccattcttcaacatagaatccacctggagttcaatttcctgatggaggtaatgatgttggaaactgaaacaaatggtggaattgctgaattaggatccctatttcgggtactggatgtggcaacttggaagtttgggttgaagggagctcaatgcggagatgaaagaactcgctag

SEQ ID NO: 69968 - DNA, 306 bp, Glycine max
  Peptide Sequence Number=SeqID_186746
atgggaatgacgacatatacagatacggggatggagacaaaaaatagtaaatctaaaaatctcaacatacaggtacggctagaaaacgtgaatagcataggatcactccaagcgagggaaactatggacaaagcgtttcttttttcttttctattgcttggagtaattaaggtttgggatttgttgatgattaagagaatgacagaggaaagcaaggaaccggtagaggaaagggagatcgtacctatttggttctctggttcgttagtgatggttgtccaaccaagactcgagaagacaaagtga

SEQ ID NO: 69969 - DNA, 1008 bp, Glycine max
  Peptide Sequence Number=SeqID_186747
atggatccaccctcaaaaaaaagtttagactcaaggaagacaacgactcttactacatttcccatgaatttctctaaggatcttcaagaggatatattctcagccagtcgcatgaccatcgaagagcaatccacggaatgtgttcaaaatgtcagacctgatttagaaagtaacctatccccgcttatctcacaagcaacaatggatgaaatgtatgtttttttcaacaattactccgtgccaatgagtgtctatgatgatttaatggcacgactatgtaatgacaatgatattttgcaactgggagagaactctttcaatgagcaaattcctttagatgatatttccttggaagtccttaaagcagtggagggactaaccaatgacacaaattcaactactcttttgacctcaaattcattagaggaagtggaaatttcaattccacctgcagctggggtagttgtatctgaagcattcactccatttcaatcaccaagcttcccattgcatcctaatggttatgctagtgctggtgctagtccaagtgttggtgttagtgctcttgttgctgctagtgcaggtgctaatgctagtgttggtggcattgcttgtgctagtgttaataccaatgctagtgttagcacaacagttaggttagcaacttttgatccacaacatcctcctcaaattggcacttcatttggaaattttgtgtttccaaatactatgggaaacccattcactcagtttcaatcatgttcatcatctgcaagcttcccaatgcttccctatgatagtagtagtagtagcagcagttaccaacaatctccaaggtatcttccgttcctaatgactgggattggtccacaaggtatacctgcaacgatgcctcagtttaatcagggaaatttttggcttcgcccaccacctctcacggattttccaaactttgtgcatgcatgggaggtgtacagtatgttaaaacatacaaagaaacagaggtaa

SEQ ID NO: 69970 - DNA, 196 bp, Glycine max
  Peptide Sequence Number=SeqID_186748
atgaaattcttggacaagtgtttaggacatccacttccacatcgggagaaggctcattgcctcaatgcatggtcaaatggagttggtgcttcttcatttggtttccctaatacactaggaaactccctcaatcaatttcaatcacttccaatgcatccttatgatagtactagtgatggtgttggtcttagtgcaa

SEQ ID NO: 69971 - DNA, 153 bp, Glycine max
  Peptide Sequence Number=SeqID_186749
atgaaccattttgttttgggtgctaagtatgacaaaacaggggttttgcttggggcacctgcagaattgctgacaagtggtggtatggcgatggctagtttgatcggcaatggaggtaaggtgtttgctacctgtgatgatgttctgcaatga

SEQ ID NO: 69972 - DNA, 210 bp, Glycine max
  Peptide Sequence Number=SeqID_186750
atggatcatgcgaatgaggaagtccatgaattgcctgaagaagtagcttgtgttgatgtgccaactaatgtcgagggttttctagtaggacccttgtcaaagaagagaaggcaaaagctgctgatgactcgcttagcgagacagattcgctcagcgagatgcatccacttagcgaggcatccagctcgcttagcggataggaaaccctaa

SEQ ID NO: 69973 - DNA, 287 bp, Glycine max
  Peptide Sequence Number=SeqID_186751
tgacttcctttggataccgtaaggatcggaatggtcaatggctgaagaaagatgcactccctcctcaagatgagcgtactccttcacctcctcctcagcgagatgattcagcactcatgaatgaagtcctttccgaattacggggtcttcgttcttatgttggtgaacgtttcgactcattggatacacgctttgtcagcatggatattcgcctcacacagcttgaagaggatgtgggttacattcgtcagagtttcgatcttccaccaccacctccaccttcttag

SEQ ID NO: 69974 - DNA, 165 bp, Glycine max
  Peptide Sequence Number=SeqID_186752
atgatgttttatggcatgaatgtcaatgtgtgggaaggcatggtcttcattggagtaaatgcagctatcaggattgggtacctaggggacttgttcaaaggatatcaaggaagcatccatactaaaatcaatccaacttcgcaggtccagagcaaaaagctttga

SEQ ID NO: 69975 - DNA, 336 bp, Glycine max
  Peptide Sequence Number=SeqID_186753
atggactcttcagaaggctcaaagatagtgtcaggcaaggctaagtctaaggatgacatcataccagatagtgatgtagctctatgtggagcttgtaggccttggatcttcttcatcaatgaagtcctttgcttcttgaattttgatggaagcggaatagagaaggaggaatatgattggagatgccactttaagaagaagatgagtctagaagaagctcaccaccataggaggtcatggataagagcttggaggaagaaggagatgaatgaaggaagaggaagagaagaacacaaatttttgtgctctaaaggagctctgaaatctgaagtttaa

SEQ ID NO: 69976 - DNA, 672 bp, Glycine max
  Peptide Sequence Number=SeqID_186754
atgacgtccaaatgcaaggacttacctagaaaagaaatatccaatgcatttttcactaacaagaaaagatccaaaaggatttgggtatctaagaacaaaattattcctattgcagatgtccttgacaatgagaaagacacacctatcatggtacttggacaatggcttctcatgacacatgataggaaaaaagggctaaaacacaattttttgaacataagtcaattatgtggcaatggatgtgatgtttcctttaacaaagatgagtgcattgtccaaaacaaagatgtgtctctacttttttttgttaagaggaaaggaaacctctacaagatcagacttggagagctatcaaatcaaaatgtatcttgcttattgcctgtaaaagaaaatcattggagtgatagcggaacattacttggatattctgagacatataaggtatacatagtttacaactccaaaacctttatggttgaggaagctatccatgtaaagtttaatgacattgagcctgataaagatttattagagctagatgagttccttgcaaaattaagactagaagagggcataagcagcaaagcattagtcaataccaacactaaagttgcaacatccactcaaccattagacagtcctcaagaagaagtaagggaacccactagatga

SEQ ID NO: 69977 - DNA, 513 bp, Glycine max
  Peptide Sequence Number=SeqID_186755
atggcagataacaacaacaacagtcaatttattattgagggaacatccctcacaaggccaccaggcttcacaggagaggactacccatactggaaggacaaaatggagatacctaaagtagaatggacagatgttgatctgaccactatggagctaaacataaaagccatatatacgctgacatgttgtggcatcaattgtcccgtggcagaggctgaggttggtcaagtcacaattgactcgtggtgcttgaatagagatcatctgcaaaagaaagatgttgatgacgtcaagtctagagaaattaactttagaagagaagaaaagaagagcttctctaaatctctcaaagtacaaatggttgaatctaatgaatcagataactctaaagggtccacagatgatgaggtgacttttatgtctaggaagttcaaacaaatgattaagaagaaaggaaattttcatcattcctccaaaagaaaggatacaagattcaaaaggaaatactgttag

SEQ ID NO: 69978 - DNA, 1398 bp, Glycine max
  Peptide Sequence Number=SeqID_186756
atggattcatcttcaaaaacaagtttagaatcaagcaagacaacgactcaagctacatttcccataacttttcctatcgatcttcaaggagacctattctcagacctattcccgactagtagcatgatcattagggaccaaatcatggaagatgttcaaaatgttagacctgactctcaaagtatcctatttccggttatccggcaacaagcagcaacaaatgagatggaagcctatgatgattttatgacaaagttatgtaatgacattgacaatgatattcttcaaatgggagaggacaatttcaaagaccttttatcagatgagccaattcctttagatggtgatatttcattggatgttcttaaagccatggaagctggactaggtcaagaactagcaaatactgatacaacaggaaactcactcaatcagtttcaatcaccagttattccagtgcatccttattatggtggtgctagtgcaagttctggtgctggtgttgatgctaatgcttttgttgctgctagtgctggtggtattaatgctagctttggtgttggtgttaatgctagtggtgggaacacatcagttagattagcaactaacccacaaaatcctctaccagtcggtgctacatttggtaacttcatgtttcctaatacaacaggaaacacactcactcattttcaatcatgttcatcaccaccaagcttccctgtgcttcctcatgctagtagtagcagcagtagtcaccaacaatttccaaggtttcaatcatgttcatcaccaccaagcttccctgtgcttcctcatgctagtagtagcagcagcagtcaccaacaatttccaaggtaccttccgcaacaaatgactgggatcaatccacaaggtatacttgcatcgatgcctcagtataatcagggacatttttggttgcgtccaccatctctcacggattttccaaactttgtgcatgcatgggagggaagtttggttggaaaaattcactcttattgcgaattccttaaccaagcaagggtcgtgaggaaaccaacatcacctgtcatgactcatgtgaaaaagacaaatcatcccaagcaaagcaagagaagaaagcttactgctgagtggtcggaaaggctcaagatcgttctcttcatacccacaaatgctatcaactatacaatgaagattattggtggacccattgattatgtgttttttcacataattcaattcaacaatcttaacttatacgactatatgatgagtaaaaatttgtgtgcaaaaattgagcttccttcacaaactcttatcttatctataacccaaagcaaatatcattatttaggagcaatttttccagaggatacgatatttgttgaacctgcctaa

SEQ ID NO: 69979 - DNA, 159 bp, Glycine max
  Peptide Sequence Number=SeqID_186757
atggaacccaagaatgagattgttgcaattccagcaatcaacaacaaagaagatgctgcaagaattaaacaagtaaataacacaagagaattgttaacccagttcggtgcaacctcacctacatctgggggctaccaagccagggaggaaatccactaa

SEQ ID NO: 69980 - DNA, 237 bp, Glycine max
  Peptide Sequence Number=SeqID_186758
atgacattttatatgagaggtatcctttatgtgagaatgagaatggtccttctcatgaccattgtcgtcaccatcaacatgagtgtcactatcattgttgtcatcgacgttgacgacgacaatagtgataatcatattagtggtgacaatgctgacgacgacgataatcataatggtggggttagtaacggtgacaatcatgttggtggttgtggtaatgattttgacataaattaa

SEQ ID NO: 69981 - DNA, 1008 bp, Glycine max
  Peptide Sequence Number=SeqID_186759
atggattcaccctcaaaaaggagtctagaatcaagcaagataatgactgaaactacatttcccatacctttccccatcgattttcaagaggacctaatctcgggtagtagcatgatcgttgaagagcaaacaatggagggtatccaaaatgttagacctgaggctgaaagtagcctatacccgcttatcccacaagcaacaatgaatgagatatatgttccttctcccaccaactctgagccaaagaatatctatgatgatttaatggcacggctatgtaatgacgatgatattttgaaattggaagagaacaatgagcaaattcctttagatgatatttccttggaagtccttaaagcagtggaggggctagcacatagtgtaaccaatgacagaaattcaactactctcttgacctcaaattcattagaggaagtgaacatttcaattccacctgcagctggggtagttgtatctgaagcattcactcaatttcaatcaccaagtttcccagtgcatccttatggttgtacaagtgttggtgctagtgctagtgttggtggtattggttgcactagtactgttaatgctagtgttgttgctggtgctagcacaacagttaggttagcaactactgatccacaagatcctcctcaaattggcactagtactgttaatgctagtgttgttgctggtgctagcacaacagttaggttagcaactactgatccacaagatcctcctcaaattggcacttcatttggtaattctgtgtttccaaatacaacaggaaacccattgactcagtttcaatcatgttcatcaaaatcaagcttcccaatgcttccctacgacagtagcagcaacagtagttaccaacaatttccaaggtacattccatacctaatgactgggattggtccacaaggtatacctgcaatgatgcctcagcataatcaaggaaaattttggcttcgcccaccacctctctcagactttccaaacttt

SEQ ID NO: 69982 - DNA, 132 bp, Glycine max
  Peptide Sequence Number=SeqID_186760
atgaatcaccgatcagagccagagaagaaagttagagtgggggcatataatcacttgtgcttactgctgaatgggggcctaggctggagattgtcctcttcttacccacaaatgcagttaactatacaatga

SEQ ID NO: 69983 - DNA, 900 bp, Glycine max
  Peptide Sequence Number=SeqID_186761
atgaacgatcttcaagaagacctattcccagacctattctcagctagtagcatgacgttcgaagagcaaaccacggagcagggtcggatgcaggagtctgaaattaccctatccccgcttatcccaccgacaacaaggtgtgagatgtatgatccttcccccagctactatctgccaacaaatgactatgaagattttatggcaaagctattcaatgagaatgagttttttcaactgagagagaacattttcaaataccctttacaaccatatgagccagttcccttagatgatattccattggaagtggttaaatcagtggagggactatctggttttggtgctagtgcaagtgttggtgttggtgatactgcaagggcaagtgttggtgttgatgatactgcaagtgcaagtgttggtgttggtgatactgcaagtgcatgtgttggtgctagtgtaggttataatgctagtgctggtggcattgcttttgctaattttaatgctgacattgattctagtgttgtttttggtgctaatgctagttctagcacaacacttacagtagcaactattgatccacaagttgctggtccttcatcatttggtaatcattccatgtttaacaatacaatgcacaacccactcactcaatttgaatcgtgttcatcaccaagcagcttctcagggcttactcatcatgctagtagtagcagcagcagtcaccaacaacttcaaaggtaccttccgaaccaaatgaatgggatcaatgcacaaggtatacctgcaatgacgcctcaacatatcagtagcaacagtaataatcagggacttttttggcttcgcccaccacctctcgtggattttccatacttcgtacctgcgtgggaggtaaactaa

SEQ ID NO: 69984 - DNA, 363 bp, Glycine max
  Peptide Sequence Number=SeqID_186762
atgaagaaagaatgtggtgtgaatgagccacatgttgattgttcggatgcgttcaatacttctttagctcgatccgttgctcatgaaaatggatttgtggctgtgattataaggtctgacacaaacacaagtagtagaggaaggacttcgtttgtgttaattggttgtgaaaggagtggcgagtataggtgtaggaagaaagaatttattagaagagatactgggactaggaaatatgggtgtcccttcgagcttcgtggcaagccagtggttggaggacaaggctggatggtgaagttgatgtgtgagattcataatcatgaattggccaagtcattagttggacatccatatgttgggtga

SEQ ID NO: 69985 - DNA, 294 bp, Glycine max
  Peptide Sequence Number=SeqID_186763
atggattggcaatggttgaagaaggatgcgcaacctccgcaagacaaacatattccctctccttcacctcaacgagatgactcctcagccctcatgcatgaagttctttcggagttacgaggcctccgcacctatgttggtgaatgctttgattccttggatggtcgtatcgatgccattgatgctcgctttgaaggaatggatacccgcatcactcagcttgaggaggatgaattaaattgtcatcatcaaaaagggggagattgtagaagcaaaggcattttgatgttttga

SEQ ID NO: 69986 - DNA, 443 bp, Glycine max
  Peptide Sequence Number=SeqID_186764
ggctcggatggcgattgacaaagggtgtagaagacgacgttagtctctgcatgctatcgtgctctgggtctcatggattgcaaaagaatgtttatagggataaccacttgggtatttccgcctgcgcccaacttcacgggttagtaatgacagagtttgattatgcggaagaggatgtacatctccggataaccacttgggtatttccgcctgccacctatcttcacgggttcgtaatgatagagattgactgcgtggaagacgtggtaaatttccgcgtttcaatgggctcagaccgcgattggcaaagggtgcagaagacgacgttagtctctacatgctatcgtgctctagagattgactctgcagaagacgatgtgaatctccgcatgtcaacagggtcgttggccgcgattgacaaatggtgcagaagacgacattag

SEQ ID NO: 69987 - DNA, 555 bp, Glycine max
  Peptide Sequence Number=SeqID_186765
atgagtacgaccgggcgtgggaggcactcggtcctccggattttcaagggccgccgggggcgcaccggacaccacgcgacgtgcggtgctcttccagccgctggaccctacctccggctgagccgtttccaggcgaccgccgcgccctcctactcatcggggcttggtccttgccccgacggccggtctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatga

SEQ ID NO: 69988 - DNA, 317 bp, Glycine max
  Peptide Sequence Number=SeqID_186766
atgaaccggaaagctgggttacggtgccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 69989 - DNA, 282 bp, Glycine max
  Peptide Sequence Number=SeqID_186767
atgcattatgaagctgaagcactagaacatatgaagaaaagacatataggccatcaaagtgtgtcattggagaataagacaggcgattcaactgtgctgaagataggagattcggctaaagttgtgataaaacaagacatgaagggaggagagcataaatatgggtttaacaacaataaacgtgagaagccagagaaggtaaggttggtggatgatgaaactggtgacaaacatgagctgtatgaagtcctaaggatgccatctagtacaaaaaaccaatga

SEQ ID NO: 69990 - DNA, 249 bp, Glycine max
  Peptide Sequence Number=SeqID_186768
atgttgaagtcaattgctgcctggatgcccagagcgcatgcttcgtattcagccatgttattggtgcagtcggaccccagcctggcagtgaaaggggttgatggggacccgatgctgagaggaacgaggataagggctacatgggggtacgtgagctcagttgaaggtgggcaactggggatggtgggttcatgtttgatttgtggatgtgggagagtttatttgcaccatcgcccgatcgccacctag

SEQ ID NO: 69991 - DNA, 492 bp, Glycine max
  Peptide Sequence Number=SeqID_186769
atgacgtctccgcatactatcaaacttgatcatttctgggacttcgatagtctttggataggaagggtgtgggcgaccatatgttgtctccgcgtgtcatcagacttgttgtctctagatgacgaaggtgcagataaccatgaggtatctctgcatgctatcggaccctcgagtcacaatagcagagttgtgtgtacagataaccataaggtatctccatatgctatcggaccctcgagtgaccatagcagaattgtgtgtacggataaccataaggtatctccgtatgatatcagaccctcgagtcacgatagcagatttgtgtgtatgaataaccataaggtatctccgtatgctaccagaccctcgagtcacgatagcaaaggtgagtcttttttgcggtctcggctggaagacgccgacatctctgggaagggtgcagatgaccacattggtatttgcgtgtcaacgggctcgcttgcctctagttga

SEQ ID NO: 69992 - DNA, 397 bp, Glycine max
  Peptide Sequence Number=SeqID_186770
atgattccgtgccttgctctgcttctattgaccgcctgcaacccggagaccgccatgaaccaggaacgtgccgctgctgaagccgatgtcgcccagggtgggcgtggcctcgccaagctcaaccccagcccgcgcaaggcctatgagctggtgctgcgcctgaaggacgccccgggcgatttcgcggtggtcgaaggcgtggcccagtacgacgtcaccaacgaagaccagtgcggccacatcgagccggccaccggtacggcggcacgcatcaccagccaggagccggtggagctgcgcaaggtcgctgatggtgagtaccgcggcacgctgtatgtggaccgcatgctggatgaagactactacggtcgtggcgtctgcaagtgggagttcaccg

SEQ ID NO: 69993 - DNA, 672 bp, Glycine max
  Peptide Sequence Number=SeqID_186771
atgcaggatgccgccatggatgtagccatgccgacacgcaagggacgccatctggtaccgatgggcctcttgctggcactgacggcatgctcgccttacgcggacgcagagcgtgacgttgccgcaggtggacgcggcctggccaagctcaacccgtcaccgcagcagggatacgagctggtgctgacactgaaggacgcgccgggcccgttcgcgattgttgagggctcggcccagtacgacgccagcaactacgcagactgtggacggatcgtgcctgcaacgggcactgcaggccgcatcaccagccaggagcccgtctccctgcacaaggtcggcgagcacgaataccgcggcacgttctacctggaccgcatgctggacgaggactactacgggcgtggcgtctgccattggtcgctgacaggtgtcggtgcgatgttgcgcgccacgaacggcaaggcggatacgcgattcctgacgttcatcgacaagaagcgcatggacgcggggagccaattgacacggtactacccacgcgccgactacccgcggatcgaagagatcaccggatacggagcgagcggcaaggaagatccttcagcgtacaaagaagagctgcgcaatgcgctgttctcaaccaccactactgtgcagaagcttgtgccatga

SEQ ID NO: 69994 - DNA, 378 bp, Glycine max
  Peptide Sequence Number=SeqID_186772
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 69995 - DNA, 327 bp, Glycine max
  Peptide Sequence Number=SeqID_186773
atggtggggtacgcatcttcaagctttgcggatttggtcttcaccggggaaaggatcgaagtgggtatgaaaagaggcaaatttgatcatcttgcttggacgaatgagaaaactggggcaaatgaagagggtgagaatgaaggagaaacccatgctgcgactgccgttccttcatggaaaatcctccaccagctcaacaacgtcattactcagccaatattagcccttctcattacccaccacccagtcatccacaaaagccatccccaaatcagccacaaggcctgcctgcttaccacacgcccaatgcccaaacactacctttag

SEQ ID NO: 69996 - DNA, 324 bp, Glycine max
  Peptide Sequence Number=SeqID_186774
atggaggatgagtactctgaggccactatcctagagccatttactgcagaggaggaggtaggcgacacaaagacgacgcaggtagctgctgccattcctgagagatcacttgaggccatttcattgcccccagcaccagcagtggatccatcttcacctcagcacacaacaaacccttccactcttgtcttagagatacttaagggccagaccacaccagtccttactttggacacttcttctccagctactccaatgcttcatctgacagatgaggaggatgtgcagacacaggacactcaggaccagtcacaggaattttga

SEQ ID NO: 69997 - DNA, 450 bp, Glycine max
  Peptide Sequence Number=SeqID_186775
atggaactccaacgtcttgatcaaaatgaagaaaccgaccaaaagaagagaagtatagcacttaaagcctcatcatcaatacaagaaaaaaatgaagaagaagattcagatgatgaagaagacttctcactctttgtgaagaagttccagaaatttgtcaagagaagaagaagagagagacgtcaaaactttaacaatggaagaagatcacaagaagactctcaagttcttagatgttacaaatgcaaccaacttggccacatcaaagcaaattgtccttcaaatgaagaatggcctgagaaaagtgataagaaaaggtatgatgaaagaagaaccaagaaggcctacattgcatgggatgacaatgattcatccgatggctcagaaaaggaaattaatcttctaaccaaggattatgagagtgatgagaaaatttctcaagaaggttaa

SEQ ID NO: 69998 - DNA, 273 bp, Glycine max
  Peptide Sequence Number=SeqID_186776
atgtttttgggtggtggtgacaacaatggtgatggtgacgattttagtagcaatgatgacgatagatatattaatggtgatcgcaatgacaatggttgtggcaatggtggtggtagtgacaatgtagcaacgacaatggtggtggtagaaatgttggtggtgttagaggcaatgacaatggtgtggtggtgcaacaacgctagtagtgatggtattgttagtgatggttttaaatttataaaaacttggagactaagggcccattttgggtga

SEQ ID NO: 69999 - DNA, 1230 bp, Glycine max
  Peptide Sequence Number=SeqID_186777
atgggagagtctgagtttgttccttcggtggctgtgagtgtgagagagtttgatccaactaaagacatagagaaagtggaagccgttgaaagaatatgtgaggttggacccagtggaaagctttccctcttcaccgacctccatggtgacccaatttgcagggtccgcaactcacctactttcctcatgctgatagccgaaattggccaagagacagtaggaatgataagaggttgcatcaaaaccgttacttgcggaaaaaagctccacaggcaaggaaaaaacaacaccgagccaaaacaagtccctatttacaccaaactagcctacatattaggccttcgtgtttctccacatcacaggagaatgggaatagggatgaagcttgtgaagaaaatggaggaatggttcagggataacggggcagagtatgcatacatggctacggagaaggacaacgttgcatccgtcaagttgttcaccgacaaatgtgggtactcaaagtttcgtaccccctgcattctcgcgaatcctgttttctcgcatcctgctagaatctctcacaaagtgactatcattgaactctctccgagcgatgccgaaatactctaccgcagcaagttttccacaacggagttcttcccgcgcgacgtagactccgttctccgtaataagctctccttaggcacttttcttgccgtccccaaaggcttgtaccgggctgacacgtggcccggctcaacccgctttcttgagggtccaccaccctgttcttgggccctagtcagtgtgtggaactgcaaggacgtgttcacactggaggtaaaaggtgcttcgcgcgtgaagaagacgctcgccaagaccactcgcgtcctcgatcgtgccttcccctggctgcgcttgccctccgttcctaatttctttgagcccttcgggtttcattttttgtatgggcttggaggagagggcccgcaggcccagaagatgatccgggctttgtgcgggtttgcccataacctcgcccgggatcgcggctgtgaggttgtggccaccgaagtttcaagccaagaaccgttacggtgcgctatcccgcactggaaaatgctctcatgcgaagaagatctgtggtgcattaagagattaggagaagattacagtgatggctctctgggtgattggactaaatcccctccaggcttctcaatttttgttgatcccagagaagtttga

SEQ ID NO: 70000 - DNA, 582 bp, Glycine max
  Peptide Sequence Number=SeqID_186778
atggtggcggcgtcggtggtgacaaagggtgatattaatggtgatagtgttgtgggtggtgataataagggtggcaatgtcactaatgatgatggtaatagtgatgtcggtggcgatggtgatggtagtggtgccgacaatgataatagtagtgacaggaatgttggtggtgatggaggttgtattaatggtggtggcgataacaatgacagtggtgtgatagtggtggtagtgatggtgacaataagtggtggcagtggtagtggttgccgtgacattagtggtggttatggtgaagacgacagacgtggtattgttggtagtggtgatggtggtggtgacaatgacactgataataacattgatgtgatgataataacgttggtaattgtggtgacaccaagtgatggtgataataacgatgacgatggtggtaacgagctggtgacaaccaattataatagtgacagcgatactggtgtggtggtaaccatgactacaatgatattggcgatggtgataatgacaatggtagtaatgataataacaatgatgatagtaaaaagtgtcattgtgagataa

SEQ ID NO: 70001 - DNA, 576 bp, Glycine max
  Peptide Sequence Number=SeqID_186779
atggaggtagagaaacttgatgtgaaaacaacttttctacatggaaagttggaggaagaaattatgatgatacaaccagaaggttttgaggtgcaaggaaaggaagattctatctttaggttgaaaaagtctctctatggattgaagcaatctctaagacaatgtaaggtagaggatggttcaaacatttatctgcttcttcatatggacgacatgcttattgcatctcgagacaaatctgaaattcagaaactaaagtcattactcaatagtgaatttgagatcaaacatatgggagcagctagaaagattttgggcatggaaatcaggagggatcatgctcagaataagcttttcttatgtcaaaagaaatatattcagaaagtactaaatcacttcgggatggcaacaacaaaatcaatgtgtactccttcgataacgtccattcatctctttgaattaaatgctactcaatcaaaatcaaaaaaggaatatatgtcctatgttccttatgctaatgtatggcatggtatgcacaaggctagatctagcacaagtagtcaatgcagtgagtag

SEQ ID NO: 70002 - DNA, 609 bp, Glycine max
  Peptide Sequence Number=SeqID_186780
atgaagcctctgccctggattattggtgaccaatgctacaaaaggatagaaaaagaagaaagaagctggttcgtgacctacgaggcaaaatctagtggtaatgatatgatgggaaacaatgccccttccaagacagttgggatagcttatatacaaatcaaaatgcatgatggaattgttagaactttaaccaatgtttatcatgttccagagcttaagtgggagccatgcattcaaaagggaaccaagcaaggaaatttgtatatccttcaaggttccactatgataggctcaatcttaattgtttcacaagttggaagtcatgcgtccaatgataattctttgtggcacatgcatcttggccagaagagtgaaagggaaatggaaattcttagtaagcaagggctacttggaaaccacaaggtggaacatcttcagttctctaagcactgcatctatgggaagcagtacaagatgaaattcctaaaggtagtgctcattacaaaggccacattggactatgtgcattctgattgctgggggtcttcaagagttccatttctaggaggagcaaggtatttactctcaatcattgatgattactcttga

SEQ ID NO: 70003 - DNA, 285 bp, Glycine max
  Peptide Sequence Number=SeqID_186781
atggagagttttgaacaaaagaggtgtttggacgacactgcttggattgtccagtctagttctcttttgtatggtcctctaatgtctatttggtggaactcatccagtcgtgctacaggaagaacacctaatcctcttagttatttgttagatggcctaggatcttcttcatcaatggattcctttgcttcttggaagatgaatggcagtggaatggagaaggaagagagagaggagatgccacttcaaggagaagatgagtctagaagaagctcaccaccatag

SEQ ID NO: 70004 - DNA, 3012 bp, Glycine max
  Peptide Sequence Number=SeqID_186782
atggcggatgctacacggaatcgtgttcttgagcgtgaaattgaagatcgcgtggagaatcgtctcagttccaagattgatgaaagattcatggagatggtagcttcgatgcaacaaactcttcacgattccctaacacagtcgttcgccttgtcgatatcgcagcaaatgcagaaccttctacacaataacactagaattgattttccgtgtttctttggtaatgatgttaaacaatggttaatccaatgtgatacgttcttctctattgataatacacctgaggagtttaagaacttaccaccttggtcagaatatacaaggattttaattgaaaggtttggcgaagtatgtgatgatcctatggctgaattgatgcaattgaggcagaagggattgatagtggagtaccatgaagcttttgatgctattgcttcttctaaaccaccattgttacctacacctcctaaaactatttccaagacacaagatatccccaaaagaaaacagcaagcctctaaaactttaacccctgcgtatatgagtgatagaagagcaaaagggttatgttatttttgtgatgaaccctttacgcctgagcatggtttgagtcataaaacactacagttgcatgtgatggaagtggatgagttacaggagggtgcagaggaagaagtgtcgcttgaaaactcaacggggtccagctctatagatcctcaaatttttgtccatgccctcatgggaattgccaatttccacaccatgcgtgtgacaggctaccaccaaaagaagcctctccatgtgttgattgacaatgggagtacccataattttctggacattgaggtggccaagagattgggttgcaaaagtaatgcttttgattccttgagtatggtggttgctgatggtacacagttaaacgtgtttgttgtcgttagaggattccaatggggaattcagcaaaccaaattcacttctgatatgttactcattccattgggatgctgtgatttggtcttgggagtggagtggctggttttcttgggtgatattgtatggaattttaataagttgcagatggagttctatgttaagggaaggagacatgtgttaagaggggcctctactggattaaaaacagttaagaggcaacaattggggaaggctatgtcaactggtgttcatttgtcaattttgcaagtatgtgatggacaaaggggttttttgaactcatttacaactcaagctgttgataaagaagtccctcctactcttgccaagttattggatgagttctctgatttatttcaagaacctagtgggttacctcctcgcagacctggtcatgaccatcgaattccactagttcaaggtgttggtcctatcagtaagagaccatacagtagtcctttggcaagcccagtagtcttggtgggtaaaaaagacgaatcatggaggttatgttctagcattttctccaaaatcgatttgcggtcaagatataatcaagtgagaatggatcctgctgatgtgtataagactgcttttaagactcatgctgggcattttgaatacttagtgatgccctttggtctcactaatgcacctgcaacatttgaagggcttatgaacttagtttttaaggagtttttgaggaagtttatgctagtgttctttgatgacattttggtttatagatgttcattggaagaccatttgctgcatttacacaaagttttggcaactatgagggcgaattccttgtttgctaagaggagtaagtgttattttggggtttctaaagtagagtaccttggccacttcatttctaaggagggggtatcaactgatccagctaaaggatatggtggcattgctaaaccattaactaacatgcttaaaaaatataactttatctggtccgatgcagcgaaactggcttttcagcaattgaagaagaagcttactgagactccagttttggctttacccgactgttcaaaaacctttgtggtagagggacatgataatgtagctgctgatgccttgtcacgagtggaaccagttgcttgtcaagctctcgcggttcatcaggtggtttctgaattggtgataaagattaaagcctcttgggattcagatcctgcaattcagaggttgatttcagaattacaagcaaactctggttctcacaaacattattcttggaaggatggggagttaatgaagaaaggaagactagttgtgggtagagatgatgctttaagacaggatattcttctgcattttcatgcttctgccgctgctggtcactcgggacgaaatgcaaccttacaaaggctcaaatctgtggtctattggaaagggatgagtaaagatgtgatttttgtagtagttgataggttgagcaaggcagcccactttatggctctttctcatccttattctgctgctgatgttgctcaatccttccttgatcatgaccttatggcttttcagggtgttcaggtccagctcttcacagcttatcaccctcagacagacggccaaacaaagattgttaacaagtgtttggaaacatatttgaggtgtatgtgtgcagattcaccctctcaatggtctaagtggttacccctagctgaatggtggtataacaccacctttaacagctctattcgagctactccttatgaagtgttgtatggacagccgcctcttgtgaatcttccttacttagcaggagcttctaagattgagttggtggatagaagcctcttgagcagggaggagatgctgaaactcattaaatttcacatgatggaagataaacatagatctgagaggcagttcagtgttagcgatatggtattggaacagattggggctgatgcaatcctccctagaaagggaccagtagctagagccatgagcaagaggctccaagaagattgggctggagctgctgaagaaggccctagggttctcatgaatctctgggtagatttctga

SEQ ID NO: 70005 - DNA, 344 bp, Glycine max
  Peptide Sequence Number=SeqID_186783
atgttttataataaagcagttgctagagctaagacaatggatatggggaatgtacacatgttgggagacgcccttcgtgcttgtgaagatcgcaacctccttcgactgcgtaagcctaagtgcaacattgttgatgtgtttgttcgtggtgggaggcacttcggccactgcaagctagagactatggtgttgctccgatgggggaagcgcttcaagcacagtcatcacaaggtttgttccaacacgaataaggctctcgactcgtttatgaaagtcatcgagagtggctttgccctaaacatggtagacgctggcctcatttactggaaaatggaaagaagaag

SEQ ID NO: 70006 - DNA, 324 bp, Glycine max
  Peptide Sequence Number=SeqID_186784
atggctctcacaattttttttggcctcactgacttttataggcactttgtgcgcaattacgcctctctcacttctcccatcatcgatcttttgaaaatagataattttacaaggtcattacaggtaggaacaatgatcatgacccgtactaatgttattgtccacgctcttcagctctcaaaagccctcaaggcgcattacgaatatgatgaatccaccacggtcattatcatagatggtgttgaagttttgggttgttatggattgaccacggccctattggtgaccacgatcatcttggttgaccacggtcctcttggttga

SEQ ID NO: 70007 - DNA, 366 bp, Glycine max
  Peptide Sequence Number=SeqID_186785
atggctctacatctaccatcatttatgaagcaattgggtcagcttcccgtttgggtggtttcctcagcaaacttagccagagaagttatgcaaacccacgacccagttttggcgagtaggccacatctcccagccacagaaatcttactctatgaatgcaaggacgttgggcattcatccaacggcgagacatggagagagaaaaggaaactctgtgtgaatgaattgctgagcatgaaaagggtaagatcggttcagttcattagagaagaggaagtggaggcattggttagttacatacgtaaagcttgctctgtgatcaaccttagtgagatgctagtaacagcctcgagaacttcgtgctga

SEQ ID NO: 70008 - DNA, 246 bp, Glycine max
  Peptide Sequence Number=SeqID_186786
atggttgaatattctaaggtgctgatagctgaacaatacagagtaggatcagaaacatattatgcaccctgtcttgggagtttttttttgtctccaatcatgggagatgagatgccattagaattagtcgtattggatttagcaagaagatttttattcagcatatttgtggagcttctgcagggttgcagggaaaaagatggcagtggtggtggtttgctcttacttactcgattggaagcatag

SEQ ID NO: 70009 - DNA, 219 bp, Glycine max
  Peptide Sequence Number=SeqID_186787
atggagaacattttatcacatgataaggatgataattatatagatgatgatgagagtgatgcagacttcctaatgccaacctttcttgatttggaaaaagtgtatggaagtggagaaagtgacatgggttgtgctttgctagtttctagtatcaccaactgtcatttcttgttccttctgtttggtgtcttgtgttgctgtatccaccactacggataa

SEQ ID NO: 70010 - DNA, 987 bp, Glycine max
  Peptide Sequence Number=SeqID_186788
atggcttttctatcatcagttcttaagcaattggcgtatgaaccaagttcaacccattaccttacagctttcttctgcttcgtaagcctcctgcttatgcttaagctaacaagaagaaacaagtccaattttcctccatcaccaccaaagttaccaataattggcaatcttcatcagctaggcacactgccacaccgctccttccaagcactctctcgcaagtatggccctctaatgatgctgcaattaggccaaactccaaccctagtggtctcatcagctgacgtggccagagaaataatcaagacgcatgatgttgttttctccaaccgaccacaacctacggctgctaaaatctttctctataattgcaaggatgttggttttgcgccctacggcgaagagtggagacagacgaagaagacatgtgtggttgagcttctgagccagagaaaggtgcggtcgtttcgttctatccgagaagaggttgtttcggagttggttgaagctgtacgtgaagcatgtggtggtagtgaaagagaaaatcgaccatgtgtgaatctgagtgagatgctgattgcagcttccaacaacattgtttcaagatgtgtaattggacggaagtgtgatgctacagtgggtgatagcgtgaattgcagctttggagaactgggaagaaagattatgagactattctcggctttctgcgtcggtgatttcttcccttcgttgggttgggttgactatctgactggccttattccggaaatgaaggccacgtttcttgcagttgatgctttccttgacgaggtaattgcagaacgcgagagcagtaacaggaagaatgatcactctttcatgggaattctccttcaacttcaagagtgtgggaggcttgactttcagctcagccgagataacctcaaagcaatcctaatggttttcctctttatctatctacctatctatattatgcaccggaaataa

SEQ ID NO: 70011 - DNA, 669 bp, Glycine max
  Peptide Sequence Number=SeqID_186789
atgtgcggttgttcctcacttctctcactcactgtcttcttgttgtcctctcttcaccttctcctggaaatgtccaccggaacagggaaaaccatcgcactcctctcattgatcataagctacgtcctttcgaagccccattccccgctcaagctcctctactgcacccgcaccgtccacgagatggagaagacgctcgtcgagcttcgatccatcttctccatgattaccagcttcgccacctcggccccgctgccaagatcctcgccctcggcctctcgtctaggaagaatctatgcgttaacccgcgggttctcgccgctgagaatcgtgactccgtggacgccgatgccggaagctgatcgcgtcgtgggttcgggtggtggccacggagaatcccagcgtgccgacgtatgcttctttgacgaggaagtcattgtagaacatgagagcaaaaacatgaaaaatgaccactccgatgttaaggatttcttggggatactgcttcaccttcaagagtgtagaagacttgatttcaaactcacccgagataacctcaaaggaatcttaatggacatgatagtaggcggaagtgacactacttcaacgaatctagaatgggcttttgtggacctctttaggaaaccaaataccatgaacaaagcttaa

SEQ ID NO: 70012 - DNA, 928 bp, Glycine max
  Peptide Sequence Number=SeqID_186790
tggcgtctacccagacttatcttcctttaccggaagtggcgtctaccccgacttatcttccttcaccggaagtggcgtctaccctgacttatcttccttaaccggaagtggcgtctaccctgacttatcttccttcaccggaagtggcgtcatccaaatcttcgtagcctgtatcaaacgatccgctcctactcagctccttaggaagccaaatactatgaagaaagctcaagaagagataagaagagtggtgggaatcaattctagagtagtattagatgaaaattgtgtgaatcaaatgaactacttgaaatgtgtagtcaaagaaactttgagattacattcacctgttcctcttttggttgctcgagagacatcatcaagtgtaaaactaagagggtacgatattcccgccaaaacaatggtatttatcaatgcatgggcaatccagagggatcctgaattatgggatgatcctgaagaatttattcctgaaagatttgaaactagccaaattgatcttaatggacaagattttcaattaattccatttggtagtgggagaaggggatgtcctgctatgtcatttgggcttgcttcaactgagtatgttcttgctaatcttttgtattggttcaattggaatatgtccgagtctggtatgttgatgcacaacattgacatgaatgagaccaatggactcactgtctccctcaaacctcgctctccctcaaacccatctctccctatcttaaacaccatacacctgaaactccctcgaaacctcgctctctcgacaacgtccattgtgtgcagtggagctcgtgccgtgagtatgcatagtgaggtcgcccgtgccgtgacctgtgtggcatctccaagaagtgtagttgctgtgactcgtttgcccgtggtctttgcgccttag

SEQ ID NO: 70013 - DNA, 1101 bp, Glycine max
  Peptide Sequence Number=SeqID_186791
atggcgctccgaaacgacggcagaaaaatttccttcgaggttctcagcgtcgagggccaatcggatccaacggaacgcaatcacaagaagcgcaggcaccgcgcttcgaagaagaagaagaaacttctcgatcgcgccggcgattcctttgatccgcattcggtgccgttggagaacggaggagcatgtaacggattcgagctcgacgctagcaggtactgctgcggcggcggcggaggaagcttcgtcgtgtgcgaggaggtgcgcgaggcggagagtgtgtgcgcggttgcggaggcgcgtgaggcggagagtgaggaagcgaccgccgtgcgcggtggcatggaggggtttaattttggggaattgaggcagaggaacgtgaattgtgggagttcggaggatatagcggcttacgtggtggtgcgcgatgagaaggaggatggcggtgtgaatgcgagtccggtggagaagccgacgaacgagcctgataggaatgtggttaagaaattggagactgtggaatcgttggactggaagcgtatcatggcggaagatccgaactttgtgtattcagtggagaagtcccctgtatcatactttttggaggaaatgcacaatggaaattctttacgcagcacaacaactcttgggaatgagaaagaacgagagagagtttacgacactatcttccgcctgccatggagatgtgaattgcttatagatgttggcttctttgtctgcttcgattcatttctttcgttgttaactgttatgccagcgaggatcatgatgactatttggaggcttctaaagacaaggcagttcaagaggctgtctacaatggaagtttcagattttggctgttttcttattttgagtagtggagttgttcttttgcagcaaacagctcaggcaatcactttatcaacctgtatagttgctcacaacaacgcattgttggctttgctggtgtcaaataattttgctgagatcaaaagcaatgtgtttaagcgatacagcgaggataatgttcacagtttagtttactttgtttcagcatctcttgcatctatcctagcatttgggcttaaggcctaa

SEQ ID NO: 70014 - DNA, 456 bp, Glycine max
  Peptide Sequence Number=SeqID_186792
atgtcagataagattgttcttggaatgtactactttgatgacttaataaaaattgaatgtatgacagaggcacaaagagagggagacatcatggtttcttctaatggactagctactacacaacctcttttttcttttggattgatttctgatgttcaatatgctgacattcctgatggtcgctcattccttggtgttccacggtattataagcatagtattcttgtgttgcggagagcggttaaagaatggaacactcatcagaagcataagtttgctattaattttggagatattgttgatgggttttgtcccaaagatcaatctcttggtactataaagaaactagtggacgaatttgagatgttcaggggaggacctgtgcatcatattattggcaatcattgcctatacaatcttcctcgcagcgagttacttccattattgaagatctaa

SEQ ID NO: 70015 - DNA, 900 bp, Glycine max
  Peptide Sequence Number=SeqID_186793
atgagttctgacaccatgtgggtgattggcaatgggcaaaatattgatttctggtcccataggagaacttcacaaactttggttttggcggtgcaaattccttctcattttcagttagctcctaacattgccaacgagattgaaaacagaatcattcctttatttgaggaagaagaccgttcagtgtggcaagtttggagtatatgggattattgcaataagagcaaattccaaaatcaaaagcctaatttcttaagagcatcaatggccatcgaagctagcacaaggctagtttgggatttgacttcaagttcaatgcccccttctatttatgaattttcaaagctcaaagcttttaatgtttgttgtcacccgaggaaattgcaggtcatcaagcaagtaaggtggcatccccctttagcagaatatatcaaatgtaatacgaacgaagctactaaaggatccctaggtgtagcaagttgtcctggtatctttcggaatcaccacacaagtatagtgggttgtttcacatcttttttaggcattaaacatgcattgtttggggaaatttctactgcgattacaacaataaaaattgttcatgagaagggttggagaaatctgtggttggaatgtgatttgctgatggtggtgcaagcttttaaaaaggtgaatcttgtgccatggtccttgagaaatagatggaggaatgctgtaattaggactagagatatgaacttcattgttgggcacatataccgggagggtaatacttgtgtagataagttagtctcttataggacggatatacaagatttttgttggtgggactttgttcctacctttatatttgagatttttttaaaaggacaaacaaggttttccttgctacagttttag

SEQ ID NO: 70016 - DNA, 207 bp, Glycine max
  Peptide Sequence Number=SeqID_186794
atggacttatccattgtattacttgttcgactgatgcattttccaaaatccaccaacaagggacgaggtccttcattcacttatgttgttaaagccaagggtgggttggtcttaggatcattcgccaattttccaccgtccgatatcgtgtgtagcagggtcccaccctcagtgaggattatgttgaggagtcagtcctcagggtag

SEQ ID NO: 70017 - DNA, 276 bp, Glycine max
  Peptide Sequence Number=SeqID_186795
atgaatttgatacacaaatataattgtgttaaggtatgtcttgctggacattatcatagaggtggatactccattgattctcatgggatacaccatagagttcttgaagctgctttggaatgtcctcctggtacggatgcatttggatacattgatgtctatgatgacaggatatcacttgttggaactgacagaatgaaaagaataaaccagtttgtgctcaacatgttccttccttttgagagagggaatgatgcaacatgcagcattacttaa

SEQ ID NO: 70018 - DNA, 288 bp, Glycine max
  Peptide Sequence Number=SeqID_186796
atggtggatgatttgcctcatcgcctatatctagaccagaatccccgatcagtgtacaaagtaacatatcgactcctccaccattgctggaagattcctttctgtgttgtcctaaatagtctacataccagtagagaagatggatccttaacaataaattggggagcaaggaacaaggaatcttacaaccacgaaaactggaaaagtatgtctagcatctactatggtcctaaatggccgcataagcataaagaagagaaagcttcaattaatctagaagatttatag

SEQ ID NO: 70019 - DNA, 309 bp, Glycine max
  Peptide Sequence Number=SeqID_186797
atgttccccttgcggcgaagccatgcctcatcacggaaggcgtccggcgaccatgaccgttgcttgaagagcggcgggcgttggagcaggaatggaggcggcgacgcatgggtgtcgagtttcgtcatgggtatggaagacggcgacaggcacaatccctgggtgttggggttgtgcggaggtcgagggacctcacacgatgggttagagaatgatatggcattgttaggtttctttctttcagcacttttgaatgccaagggacaccacaacctttatgaccaagagtggataagaccagtgagataa

SEQ ID NO: 70020 - DNA, 381 bp, Glycine max
  Peptide Sequence Number=SeqID_186798
atgagcctcgcctcgctcgcccgcaaaagggcatgttgcgacagctgttcatgtgtcctccaccatcgagtctggagccccgcgaattcattgcctagtgttgttcgccaattctccattctccattctccatcttttattcggagacccatgaattcattgcctagcgctgctcatgtgtcctccaccaacgagtctggagccccacgaattcattgcctagcgctgttcgccaattctccattctcaatattattcggagacccacgaattcattgcctagcgctgttcatgaatccttcgttatcaagcacggaacctccggtgactgggaaaaaaaaaagagaagaaggagtagagacgagagtcgtcatagactaa

SEQ ID NO: 70021 - DNA, 186 bp, Glycine max
  Peptide Sequence Number=SeqID_186799
atgggacaccttagtgatcaaggggttcccacggaccttaagagaataaaggtcattcttgattggcccactccaccaagtataagggaaatctggggctggcatgacttaacaaacttttacaaaagggatagagctgttaaagaaggccctagggttctcatgaacatcaaggaaactttctga

SEQ ID NO: 70022 - DNA, 814 bp, Glycine max
  Peptide Sequence Number=SeqID_186800
atggtcgcacactcctcgaacacctcgccccatgcgcgccctgatcctgcttgcccaccccgagccccgctccttcaatgcccacctcgccgcgcaggcggccgagcagctgaggcacgaccactcgcaggtggatgtggtcgacctgtatgcggaaggcttcgatccgctggaagcggcctggcaccatccacggcgcctgcagcccgagcgcttcgatgcccagcgcgaacaacgccacagcgccgaactggagcagttacccgccgatgtgcaacgtcacctgtacctgctgcgggtcgcagacctggtgatcctgcagttcccgctgtggtggttcgcggcgccagccatcctcaagggctggctggaccgcgtgctggtatatgggccgatgtacaacagccgtcagcgccacgaacatggcgtgatgcagggcaagcgtgcattgctgagcgtcaccaccggttcatcggcacgggcatgcgcggtggacggccgcgaaggcaacacccgattgctgctgtggccgttgatgtacagcctgcgctacgtcggcttcaagcggaacgcgtgcaggcccacgacgaagcactggttgcagccaccctctcctaccgcgagcgactgacgcactggcggcagtggccaatcgtgcccttcaacgacagcgatgacttcgaggatgggggtggtgctgcgcgcggacgcgactgcgcacagccccttcatccgccaccgcgacgcgggatgaatcttcgcctgcaggcgctaccggaaagcctcatacttcgcactcttccgaagcaccttg

SEQ ID NO: 70023 - DNA, 525 bp, Glycine max
  Peptide Sequence Number=SeqID_186801
atgaccgacgccctgggcgtgccggtgcacgacaccgatgaacactggatgcgccacgcgctggcgctggccgagcgcgcgcagcgcgagttcgacgaaattccggtcggagccgtgctggtgggtgccgatggccagctgctgggggagggctggaacctcaacatcgcctcgcacgaccccagcgcgcacgccgagatcgtggcgatgcgggccggcggaaagctgctggcgaaccaccgcctgctcggcagcacgctgtatgtgaccctggagccgtgcgcgatgtgcgcgatggcgatcgtgcatgcacgcgtcgcccgtctggtctacggcgccagtgaccccaagacgggcgcctgcggcagcgtgttcgacctcattggcgacgcccgccacaaccatcgcgtcgagattcacggcggggtgctggccaaggaagccagtacacgcctgaccaattatttccgcgccaaacgtggcaagccgccgctgctgctggaagaccacgtcggcgagggctga

SEQ ID NO: 70024 - DNA, 696 bp, Glycine max
  Peptide Sequence Number=SeqID_186802
atggacggagcaaaaagtggagtcttggtcagagcaagccgccctattctattaccagacataattgggagaagctcatccgaaactagagctggaaacgcctcatttcgtttcgttcccgttcttcatttccttcttctcgaatccaagggggacttctcatatttagaatctttctgcggtgtgctctgtttactattctttcgtactctcttctctttaccacgcgataggtcagcaaagcgtgagcgggcgcggagaaggaaacgccaaacacttcggcctaagcctaacgggaatgagcaacaacgaaatgacaagatggggtgctccgggcacccccatttagaaagaagggtcgaaggttttgggcctgtagctttccccgtccccccttcgtcgggtggtgcttgtgtggggggtgtgccacctgaacctgaaatcgggcttgaagctctcgccttaccaacgagccgacagctgatggctgttggtcacgactaccaccaaaaagctccaatgaagatgaatatttcacattttggagtgtgcatctgtatgttgggtgttcttctgtcgtgcgacccggcggcttatgtgcgacctgtggcccacgcctcctatttgttcagggcgggcggcgtgaactctgactcgatccgggtattcaatcccgccgctgagatgctcagttga

SEQ ID NO: 70025 - DNA, 435 bp, Glycine max
  Peptide Sequence Number=SeqID_186803
atggtcgtagagcaaggggcttgccttcttactccagatagggccaagttagtctacgggcttgtaatgaagatgagcatgaacttaggatcacttatttctagtcagatttcactcattgctcagtccaactcctcgcggcttggatttccagccttgattactaccttatgcaaggcccgaggagtcacctcagattctcttacctttgagtcactaagcccagccattaatttggcttatattaagaaggattgttggaacctggatgaaccttcagtcacttttccagggacccaaaaatccagggctagaagatctgaggccccatctacatcagttgcccctgctccccctacatcagctccatctacttctgtttttccttcaccaccaggagctccagttcttctaggtccctccactcagagctaa

SEQ ID NO: 70026 - DNA, 1396 bp, Glycine max
  Peptide Sequence Number=SeqID_186804
gggctgtatcaattataatctcgtccttgccataagacaacttggctaccccatgagaggagcgctgtcggaagaaagtatcatgcccttcatcgcacggggtttcagtgaccccaaagcaaggatatttcaaggggtccgaaaggcatggagcgtggtgaaaagaaaggataaggaacttaggggaagcagcaatgggatcatcggaagctatcacaagtggctgaaagctcggacgcaagagttagtttggctcccgaagctaaaggcatcaagtgaggaagaggctgaaacccctgaggagagtaaggaggtgcaagccttgaaggcagaacttgaaagggcgcaagcaatcaaggaaaagttcaagatgatagctatcaaggtctggaaagaatatgatgaactgagagacatcaatgtggccaccgctgaagcattggagcgggaaacaaagagggcacgaaaggaagaaccagtcaagagtcgaaggcatgatattggaggacaagttgaaggcttgccaaaggccatcatcgaccaatataaagagaagctaagtctagccgcaacccatgaacaaaggctacaggacgagtatgcaaagagaagcaatgacgtggatggatggttcgctttcaccttgaatgggagtcaagagcttccaagactactagccaaagctaaggtgatggtggatgtgtactcggccctcgaggaagcaataaacaccataactgaacacgctttaaggcacccctatcgaacccgttccaaaactagagtcatgggtgacatagaagaggtgcaagaacaaatgaaggccgatatggaggccatgaaggatcaagtggcttccatgatggaagccatgttaagcatgaagagaatgaaggaaagaaacacggccgcaattgtcgcctccagcaccgccactgaggcgaatcctacccatccctctgccataaaccaagcgaaccaacccgccccggacatggtgggacaaggaggggaagtgttgggtagtaccagtggtccacacatggggtataataggaatgcttatgcctatggcttacccccaaattatacgccgcccaccatgcacatgcctaacgagaacattaatcatgtcgttcccgttacctttgaagagcatgctcaaggggactttgactcatatcccactttcaccgctgagggactggcattggaagggagagagaaacttgatctcatcgaagagagactaagggttgtcgaagggttcggtgattaccctttcgctgacatgacagaattgtgtttggtacctgatgttgtcatccctccaaagttcaagtcatctgatataccaatttggaggccttttgtatctgctcatggaaggatttga

SEQ ID NO: 70027 - DNA, 849 bp, Glycine max
  Peptide Sequence Number=SeqID_186805
atgatccaaaggaactcagttgcttctttggtggatatcttctttctgccaaagtcttcctctcccttagcaaatctcccagccaggatctcctcatcaagaaccgagcttgccttatcgctttctttcgggctcacctttgcctttccttgtgtccttggactacaccaacgggccgggtgccacgaagatttgcccacaacgggttataccgctcgtgccagagatgttggtaaccttggcagaagacaggtaatctccgacagactcgtccttccttccgtcgggcttttgaggggcgtacctccatggggccaccttgtcactcttgtaagggaaagggacaggcttcttactcgggataggttggaagcctcggggcttttgtgtggcagcatctctggtgaagtggatcacaaattgtttgggcttgctcgggcttttgtcagctcactcttgcttgcgtcaccaatttcaaactggccttggtccattatcccttgtagcaagtcctctgccacagggcatgcctctacatcatgtgttgcccctgggtgtattaagcaggatgggagcgaattccacaagtttctttatcggaaaattccttcccggattgacgcttgcgctcggattagagctgccggcggggcgaggttgtgtaggaaccgagttttgagtgggggccctttgtggttgagcgggtgccttttgctggaggggcgctggactggagggggctttggccaagtaggagccgatgtcacggcatgggcatcccattccttcttctttgccccacttattctgaatcttctattactagtaccagcagggcgacataattga

SEQ ID NO: 70028 - DNA, 330 bp, Glycine max
  Peptide Sequence Number=SeqID_186806
atgggtgaagtagaggaagtgcaggaaaaaatgaagtccgacatgtcgactctgaaagatcaaatggcttccctgatggaagccatgctaagcatgaaaagattaatagaaagtaacgcagccatggttgtcgccgccagcactgtcgttgaggcagatccggctctttcatctgtagtaaatctagcacataagcttgccccgcatatgatgggacgaggaggagagatattggggaataccaacagcccgcgtcagaggtataatagacatgcttacccctacggcttgaaatcagtgaagggaacaaggaagaaggaagaaccgcac

SEQ ID NO: 70029 - DNA, 216 bp, Glycine max
  Peptide Sequence Number=SeqID_186807
atggatgataagcaagaaaatttgttaacgttgtccttgcctagccaattggtatcaattgatgaggaactatggcggatggctgaagacagggtgcaagagatactatggacaattgaaccaaatgttttatctgaagtgaacagaaaggatgttattgactatgttcagaggctgattaaaggttactatggagcaaaggttagaatactttga

SEQ ID NO: 70030 - DNA, 315 bp, Glycine max
  Peptide Sequence Number=SeqID_186808
atgcaatggcggttccaaaggcagaaaagatgcaaagacaagatgaaactaacaagaaacaagcatagaaccatggttacctcgaaagaaaacgaaagagatgctcggaagcttctagcacactccagaaatcttctaaaagatcccaacggtcagatcatggaaaattgtcttgtgaagtttaaaaccaaatttcgagaagatccaacggttaacgaaggctgggcagcattgttaccgagggagctgcatgtagttttctctagaagcttcattaagaggcttcctccagaagcttcattaagaggcttctag

SEQ ID NO: 70031 - DNA, 423 bp, Glycine max
  Peptide Sequence Number=SeqID_186809
atgaccttgctgactgttttgactagcaacatcaatgacgctttcaatcaaccaactctcttgttcgtcaaatggaatcctcctcctccttcagtgatcaagattaatgttgatgatagctcctttgggaatccagaagactcgggttttggcggcttgctcaaagatcatttgggtacctcaaacatgacgggagagctctttgatatttattatggcatcaaactagttagggagctcggttacccagtagttatttgtgaatctgattcaaagatgactcttcagtttatcaaagacggagttgcagatcatcaccctcatgcttctgcattcatgctattcgtgggttacaacagcttacttggtatgtgtcttttcagcacaccattagagaaggaaattacgttgttgatgctttag

SEQ ID NO: 70032 - DNA, 981 bp, Glycine max
  Peptide Sequence Number=SeqID_186810
atgcaagacgcaattgggattccagcatgcttctcttctgctctgaagtcaagtgatgatcacacaaccgtgactcgtttaggccagagcgtgcacatgtccctgtacagaacaaagattgctgaccagtgccgcttgatcaccatcacatggtgcaaaaacgtgatgctccatgggctttcagtatcagtggaaggcccagaaggagaggcccaatactgctgcaaggtggagctgaaaccatggtacttttggagaaaacaaggttccaagcactttatcgtacacggtgacaaagccgttgacgttttctgggaccttaaagccgcgaaattccacggcgagacagaaccaacctcggagtactacgttgccgtggtgtgcgacaaagaggtcgtgcttctgatcggtgatttgaaaaaagaagcttacagaagaaccgggtgcagaccagcgcttattgacccaattttggtttcgaaaaaagaacacatttttgggaagagaaagttctctacaagagccaggtttcacgaaaaaggtaggtgccatgagatctcaatagagtgcaagaacaagagcaacaacaacattggaggagatggagataagattcagccagagatggagataaaattagatgggcacgtggtgatccacgtgaagcgcttgcaatggaagtttagagggaacgagtcgattcatctcaacaagatgagagtggaggtgtattgggatgttcacgattggctctttagtcctggtttgaaacatgctttgtttatttttaagcctgttttgtcatcatccaatatttctctgtcatcatcgcattcaatttcatcatcttcaccaccgttgtcatcatcatccacaccgttatctactcaaacggggagttctgggtcgctggaagggttcagtgtcagcgagtcttcagagttttgcttgtttctatatgcttggaaggttgagcagtga

SEQ ID NO: 70033 - DNA, 1848 bp, Glycine max
  Peptide Sequence Number=SeqID_186811
atgttttacctctttgtggattacctacaggtcttgccattcggttctgttccactaaaaacctatcttcctgatggagatgttgatttgacaactctcattcatgaagatgcagaggaggatttggcacaagcaatatgcaatatacttaaaagtggagatgactctgaataccaagtccggctagtaaaatgtacagtgaaaaatatagcagttgatatctctttcaatcagatggctggaatctatactctacgctttttggagcaggttgaccaacttgttggaaagaaccatattttcaaacgcagtattatcttaatcaaagcttggtgctattacgatagccgactacttggcggacactatggcctgttatcaacatatgcagtagaaatattagtcttgtatattatcaatcgttttcattcagtagtgcgtggtcctctagaggtgctatacatatttttggactactacagctcatttgattgggaccataattatgttagtatatggggtccaaaatccttatcctctcttccagaaattgttgagacaccagagtgtgatcagggtgaattcttgctccaaaaagagtttcttacaaattacaagaatatgtgctcttatccaacaagggcatctgaaactttgacccatgaatttcctgttaagttcatgaacatcttggatcctttaagaaatgacaacaacctaggtcgtagtgtgagcatagccagtctacatcgattaagatttgcttttgcctacagcgctcaaaagcttaagcaaatcttcacacttcctggagaaaacatgggtgcagcactagagaagtttttcttcagcactttggaaaggaatggaaaaggagaaagggcagatgttggggttccggttgctccatttggtactggaagattcgaagagcctgtccttaatggagattgtgaaaattactgtggtggctcacaatatgttcagttgtatcataattatgccatgccagtaattgtagattccagttctctagctttgcctgatgatatccttgcatcatcaacgcagcaaaactggagtctgttttatcatggtggtaccgatgtatatatcccgagacatacactctatcatccaacttacaaccttgaaggaggagggaaatcacgtggaacaggcacatacatacctgacttgaattacaattcctactgggatatgagcaccaaggcacctaggccaaggagatttccttcttcaaagcacaatgcatttcccagatcacgtctgaaaaagaaacaagtggaagaggttcattctgagatagacataaatgctaattcagattcaaggttgtttgagttcttaaatgaagatttccccgttcttccatgcaattccaaggctataccgccaacacaagccgaagagtctacgccattagaaaagtttcattctgagacagacatggatggtacttctcggtcatttgagttctcaaatgaagatttcccccttcttccaaaggtttgttctgagacacacatggatggtaattcaaggtcatttgggctttcaaagaaagattccccccttcttcaaagcgctcgcaagaccatcctgtcagggtctgctaatttaactaagcaagccaagagtttcccattctctaaagtgtctaaactgaaaaatattgagtttggaactttcaagaaatcacaatcattgacagaaccaagtgtgtcaacaaaggatgagaaagaagattccgatatttcattatctaaaaaaaactgtgcttgtattttcgaaggtggcgatagagaggaaagattaatctcttga

SEQ ID NO: 70034 - DNA, 339 bp, Glycine max
  Peptide Sequence Number=SeqID_186812
atgcacaaaattcttatgactaaaattttcaatacactaacagagtgtttaataggattcaattttgatgcaaaagctgaaaatgctttggaagatgaagatgcaggttttccagataagcacactgcacttgaagttgaatccaaggttaaagattttgaacaaagcaaggaaaccactatcacacctcctaaagacctcccaaagcaagattgtttggaactggttataatgcaaggccatggggtcgctcagggttttgatggttgtttgttagatccagaaacaaagccacaagggagggaaaaatggtattttcataaaaatttctggccctaa

SEQ ID NO: 70035 - DNA, 126 bp, Glycine max
  Peptide Sequence Number=SeqID_186813
atgttgcttggaattgttttgtcctacattgcatcaagtctctctaggggagataagcaatggatgtttggtaggatatggaagaggtggctggagattattgatggacttcctttgaagccttag

SEQ ID NO: 70036 - DNA, 255 bp, Glycine max
  Peptide Sequence Number=SeqID_186814
atggaagtgttaaagttagattgcaataacttgatagtgttaaagttaaacttaagggcacaaaacactcttaatcaaagattacaaagtaaatgcatgcaagtaacaaagggagcaacatcaaacataaggaagcaaacaagttttgtgtttgtcacgcgaaggagacatggagaaggagaaagagaccaacttcacaaactccctctaccatctagtaccagctcttatgagtgcaaaggagacagtgcttaa

SEQ ID NO: 70037 - DNA, 1614 bp, Glycine max
  Peptide Sequence Number=SeqID_186815
atgccgccggattcctccgagcaagacctcgacgatcccgacatcgagttcgtcgagattgatcccaccggtcgctatggtcggtacaaggaggttttagggaaaggggctttcaagaaagtatatcgagcgtttgatgagttggaagggattgaagtggcttggaatcaggttaaggtggcggatctgttgcgtaactccgatgatttggagcgactttattcagaggttcatttgctcaagactttgaagcataaaaatataattaagttttacaattcatgggttgacaccaagaatgagaacatcaacttcattactgaaattttcacctcaggaacgttgcgtcaataccggaagaaacataagcatgttgatttgagagctgtgaagaaatggtctaggcagattttggaaggccttttatatcttcacagtcacaatccgccggttattcatcgagaccttaagtgtgataacatttttgtcaatggtaatcaaggggaggtgaaaattggtgatttaggattggcagctatccttcaacaagccaattcagctcacagtgtcataggtacccctgagttcatggccccagaactttatgaagaggaatacaatgagcttgttgacatctatgcttttggcatgtgcttgctagagttggtaaccgttgagtacccgtatattgaatgcaccaatgctgctcaaatatacaagaaagtgacatctggaataaagccagcatcattggcaaaggtggctgatcttgaagttaaagcatttatcgaaaagtgtattgctgatgtgtcggaacgattgtctgcgaaagacctcttgatcgatcccttccttcagtcagattatgataatgatagtgtaggtcgatcttcaagatctcaaacccatcattcaggaaataattctcataatcaagctattgctgaggataattctgttgagacaagtagggaattcacggtggaaggtaatattcgcaatatccactttccttttgatactgaagcagacacttcaatctctgttgctagtgaaatggttgaggagttggaactcactgatcaagatgttacaactattgctgggatgattgattctgaaattcgatatcacattcctagttggaatttcagtgaaactcctgttgactttaaccatcaagattcaagttatacctctgaaactaggccagaggcctctcctatgaaaattgattctgttgttgctcctggcagtcttgcattagaaattttaccttcaggtcgtgtgaactctgaggaagacaacccgactgcaaatggtggtatttcagctgatgattgtgttgacggtaccattgagcaggaatgtgatgagatagctgattctccttccagtgagaaatctgaaatggaatacatcaatcaaataacaacaaaattggagaatttgttggttaaacaaagagaggagttagatgaactaaagaggaaacacaaactagctgtctcagatcttttgatggaaattcctccagaaatgtgccagaaggtcctaaatatatgcaacctgcagatgcctgacagtgaaatggccaggcttgcccttcattaa

SEQ ID NO: 70038 - DNA, 102 bp, Glycine max
  Peptide Sequence Number=SeqID_186816
atgagttgcattgtgccacgaacaatgatggcgatggcggacacgatgatgacaatcgtcagtggtcgtgaggtaacgagcgcgagggagagaaagtcgtga

SEQ ID NO: 70039 - DNA, 210 bp, Glycine max
  Peptide Sequence Number=SeqID_186817
atggtgccgatgttcacgtggggcttcttgcgctcgaatttgccgcgggcggcgcggacggtgaaggtgcgacgcggggtggtggtggaagaaggggagcggaagggtgtggaattaagggaagaggatgatgatgcatgggggaatagtatgagtttggaggaagctgttgctgaagaaactgccatggctggtggagaatttggatag

SEQ ID NO: 70040 - DNA, 692 bp, Glycine max
  Peptide Sequence Number=SeqID_186818
tgatgacgaaggagtgtgattcaccaaaggaacagcagcctcgagttcttgccataaggaggaatctggagaaactgaagctagaattgcacaacatcaaccgaggaattgactcccatgtacaggggaagagagtgaatggaacttggggggcttcaagataccttattggagaggaagatgataccgaatctgatggagatgaggatgatgatgctcaatcccttcttcgatgtccttcctgtgattttgagattgatttttcttctctgcgtatccatttggaagagatgcactgctatgacccaaaaaatatgctatgtcctgtgtgtgatgaaacattaggggaggatgcaatcagggttgcacagaattcaagtgcacaaaagtctgacaaatctagcatctcgtcgggtgattcggtagtgcttgaaaagaaacttcctgacaggggaagcaaacacgaaccagttcctgatccacttttgtcaccgtttgtccgcaatgtgtctgttcgaaactcccatggtatccatcctggtgaaggttcctccaggaatgccgcatacattttcaatgcaaaaggctctaggacagatgcaccccaggattcagctgatgagcaggatattgaagagagaaggctgagggcatcttttgttcaggagttggtatcatcaactttaatctag

SEQ ID NO: 70041 - DNA, 162 bp, Glycine max
  Peptide Sequence Number=SeqID_186819
atgactcaatgtgatgttacatcatcattaatatctcctatcatttgtttgacaaacatgttctcttcagaatcgaatcttattcatcttgtggaatttgctctaggtcagatgcacccccgaataccggtgatgaacaggttatcgaaggcaaaagggtga

SEQ ID NO: 70042 - DNA, 195 bp, Glycine max
  Peptide Sequence Number=SeqID_186820
atggtgattttcaaccatggagttgcagcggaagataaaggaaaagagcacattggaaaggaatatgccgcaagaatatttcaaaagaatattccaagaatatgccaaaggcatcttagtatattccttgagaagctagagaggggaaactacacaccccttgatgcaatgctaccccccaagggcattggatag

SEQ ID NO: 70043 - DNA, 3454 bp, Glycine max
  Peptide Sequence Number=SeqID_186821
aaatgcattctttatgtttgaggatgcaactctcttaaaagattctgatttgaaagatgccctgtgccgtataattggagcctgctctaccaagtaccattacaccgcacagtcgtgtgcatccatcatgcacctgattcacaagtatgattttgtggtcacgcacatggcggatgcagttgctggtgctgagaagaagtatgcagatggaagccttgccatgtcacttgttagggagattggaaggactaatcccaaagattacgtgaaagacactgttggggctgaaaatgtgggtcgtttcctggttgagcttgctgaccgcataccaaaactgatttcgactaacattggcattcttgtccctcactttggtggagagtcctataagattcgaaatgcacttgttgcggtgctggggaagttaatagccaaggcatttaaagatgttgatggtggtgaagtgacttccaagtccattcgtttgcgtaccaagcaagctatgttggaaatcttgcttgagcgttgtagagatgtttctgcctacaccagaagtcgagttcttcaggtgtgggcagagttatgtgaggagcactctatttcaattggcctgtggaatgaggttgcagaagttgctgctggaaggttggaggacaagagtgcaattgtcagaaaatctgctttgaatctgttgatcatgatgctgcagcacaacccttttggtccacagcttcgaattgcttcattcgaagcaaccttagatcagtacaaaaagaagttgaaagagcttgagccttcagaaggagcagaaccctcctctgatactgatatttacaatggggatggagaagtggatgatttaaattgtgaaaatgttgtgaaggggcagcaactagacagtttaactgatagttgcctgtcccaatcagaagaagcgatccctctgcagaacagtagtgtgccagatgttgggaacttggaacagactagggcattggttgcatctcttgaggctggattgcggttctctaaatgcattggagccacaatgccaacacttgtccaattgatggcttcatcttctgctactgatgtagagaacacaattctcttattgatgagatgcaaacagtttcagattgatgactctgaggaatgtcttcgaaagatgttaccattggcaaatgtgattgcaactgtggttgcagattgcaatttaaaaccttgctgtgaaacaaggatattcaaggataaatccatctatgaagcagtggagagcgctttccatacaatatatatcaggaaaagtccaattgaaactgccaataatcttttgagtcttgccactgattccaatataggagatctagcagctcttgagtttatagttggtgccctggtctctaagggtgaaatatcttccagcacgatatcagcattatgggatttcttttgctttaatgttggtggaaccactgcagagcaaagccgtggtgctttatcagtcctttgcatggttgcaaagacgtcctctggtgtgcttggctcacattttcaggacatcattgatattgggtttggtcgttggtccaaagttgatcctttgcttgctaggacagcttgtcttgctatccagagactgtccgaagatgacaagaaaaaactgctggctagtagtagtgctcgaatatttggttttctagaaagtttaatcactggtttttggcttcccgcaaatatttggtttgctgctgctgacaaagccatagctgcaatctatgccattcaccctaccccagaaaccatagcagctgatatgataaagaaatctctcagttctgtctgtaatgatggcggtgttaatgtgcagagtgacattgacacaagtagtggcagtatgcctctcacagttcaaaagcagaaacttacaaaagagaaaaaggacaatgagaatcagaacctagacagcaatggcaccgtatcaactggtacacagaaggataatgatataaatgcagagttaggatttgctgcctctgaggatgcagcgcttgatgctttgtttgaaaaggcagaaaaagaaatagtatctggtggttcaaatgaaaagaatttgattggtatctgtgcaacctttttgtcaaagctttgtaaaaatttaggactaatgcagaagtatccagaattacaggcatctgcaatgcttgctctgtgtcgattgatgattatcgatgcagatttttgtgatgcaaatctccaactccttttcacggttgtggaaggtgcacattctgaaattgttcgttctaattgcacaattgcattgggagatttagcagtacggtttcccaacctcttagaaccatggacagaaaacatgtatgcgcgcctaaaagatccctgtgcatctgttaggaagaatgctgtgttggtgctttcacatctcatactaaatgacatgatgaaggtaaaaggatacattaatgaaatggctgtaagattagaagacgaagatgagagaatttcaaatctagctaagctattttttcttgaactttccaagaaaggaaacaatccaatatataacttacttccggatattctaagcaaattatcccagcaaaatctgagcaaagattctttctgcaacatcatgcaatttttaattgcttccatcaagaaggatagacaaatggaagctctcgtggaaaagctatgtcatcggtttagtggtgttacagatgttagacaatgggaatatatatcttattgtctctctcagttatcgtttactgaaaaagggatgaaaaaactaatagagttatttaagtcctatgaacatgtcttgtcagaggattctgttatggaccatttcaggaacatactgaacaagggaaagaagtttgcaaaacttgaacttaaagcttgcattgaagagtttgaggataagctgaataagtttcacacagataaaaaggaacaggaagttactgctcgaaatgctcaaatccatcaacagaagattggcagcagggaaggttttaccgtgactataaattctgaagatcacttgtcatctaattcttcttcagatgaaacagaaggtgaaataattgatgcttacactgaagaggcaactatgcctttaaatgagagatcagaatctaaacttgtgtcagaatcacattctggtgcttcaagtgagttgacagagtcggatcaaggggatattgaaacccgggatattgaaatccaatcaccccaggagttcaacggtccagaactaataaaagcaatgttaaaggtggaaccaaaagaactattcgatcaaagagttgatatgagatctccattatacctctcacgtcgtggactagacatcttgagcatgaagtttgcaggattgaacatttatgggtggtctgataagaacccaattgtagtgactcgatag

SEQ ID NO: 70044 - DNA, 486 bp, Glycine max
  Peptide Sequence Number=SeqID_186822
atgacgaaggagaagcctcaagcccttgccttaaggaggaaactggacaagcaattgaagttggaactgaccaacagtagtccaagaacttgggggtcttcaatatatggtattggggtggatgcagatgatctcaagtctgatggaggaaattattcagtgttcaattacactgatgaggatcaacatgctaaatctctttttcgttgtcctttctgcgattttgagtttgaattttcttcggcccatatctgcttggaagagctttgtcctatgtgtgacaaaaaattagggaaggatgcaatcagagttgcacataattcaagcccacaaaagagaactttgaagtctgacaaatctagcatcttgtccggggattcagtagcgattgacaagaaaattggcaaaggtttctccagcgttgcctcagacatttccaatgccatagggtatgatacttctttcggtctgtactttgtattggtg

SEQ ID NO: 70045 - DNA, 153 bp, Glycine max
  Peptide Sequence Number=SeqID_186823
atggggacatttggttatattgcaccagagtacgcgtgcactgaaatgctgactgaaaagagtgatgtgtatagttttggaatacttatcatggaattaattactggaagaagaagtcctgtggattatagtaaaccacaaggagaggcatag

SEQ ID NO: 70046 - DNA, 201 bp, Glycine max
  Peptide Sequence Number=SeqID_186824
atgatgtgtgagcatggaggtggtgcgagtgtgactagggagatgactatgcacgagcacgatggtggaaagagaaagtggtgcattggtgcgagtgctaccagggagcaaataatgtatgagcacaactgcacgacgaccaaaaaatgccgaggtggcacaaccagtgcagggcaaagaaggccgggaggtgcggcatga

SEQ ID NO: 70047 - DNA, 3264 bp, Glycine max
  Peptide Sequence Number=SeqID_186825
atgtcgtctacgaagtttgacgttgagaaatttactggcaaaaataacttcaacctatggcgggtaaagatgctcgctctcctcacgcaacaagaatgtgagttggcgttggaaggagaagaaatgctgtcagccgaactgacagctgcacagaaaagggaccaagctgttcttcttcttagttctttgccaagagcctatgataattttgtagacacaataatttttggtagaagctcactatctatggaagaggtgaaaacagccttacaatcttgggaattgaaaaggcgaatcacagattcatatggaggtactagctctggtgaaggtctaatggtaagaggaagaatggatgaaagaaaaagtttccaacgaagacgatctaaatcgcgcagcaagaataagaacaacaacaaatgtcataactgtcagaaggaagggcattggaaaaggaactgcccggagctcaagaaagataaagtgagtactttagagtttggtggagcagctgttgtctccgaagaatcagatggtggaaatgttctctttgtctcatctaatgttaatgatgatgactggattcttgattcagcatgtactttccacatgacgcctaatagagactggtttgccacattccaaaatgttgatggtggcaaagttctgatggggaatgatggtgcttgtagtatagctggcaaaggtacggtgcagatcaagatgaatgatggtattgtaagaacattaactgatgtgaggtatgctcccgaactcaagaagaacttaatatctttgagcactttagactctcttggttgtacatatcgagctggaggtggagacttaagagtttctagaggttccttgatagttatgaaaggaaaattaaagaatggactatatattctgcaaggcagcacggtggaaggtacaactgcagtttcttctatttctaatactgaccaatcccgtttgtggcatatgaggttgggtcatatgagtgagcgtggaatggatgagcttagcaagagaggcttgcttggtggacgtcgtattgaaaaacttgacttttgcgaacattatgtttatggtaaacaaagtagagtaaagttcagcactagtgttcacagaacgcgagggactcttgactatatccattcagacctatggggcccgtcaactgttccttctcatggtggagcaaaatacatgttaactttcattgatgattattcacgggaagtttggatttatgttttgaagcaaaagagcgatgtattccttaagttcaaacaatggaagtcactagtggaaaaacagacggagaaaaagcaaaatggcgtggcagaacggatgaacaggacattacttgagagagctcgatgcatgctctcaaatgcaggtttgccaaaacagttttgggcagaggcagttaatactgcatgttatttggtaaacagatctccttctacagctattgattgtaagactccagaagagatgtggtcaggctctacagcaaattattcaattctgcgtgtatttgagtgtccagcttatgctcatattaatgaaggaaagttggagccaagagccaagaaatgtatattattgggttatcaagatggtgtaaaaggatacaggctatgggacccaaaggaatctaagctcttaattagtagagacgtgacctttgatgagacagctatgcttaacccaagaccacataaagaccatgataataaagttgaagttcatggtgatatcaagaaggtggagtttgaagttgaagcacggaaaccagaggagatctatgatgaatctgaagtgacacctacagagtttgaacatacattggctagtgataggccaaggaggcaaactaggccacctcagaggtatgatgactttgttgctttcgccctcaacatggccgaaagcatcgatgatgaacaagaaccaagttcattccatgaagcagttacttgtgatgaagcatcccagtggattggtgccatgaaagaagagcttgaatccctccacaaaaatcatacttggaagcttgttgagaaaccagtcgatcaaaagattgtgggttgcaagtggatatacaagaagaaagatgggataaggttcaaagcaaggcttgtagaaaaaggctttacacaaaggaaaggtattgactttaatgaagttttttcccctgtggtaaagcatagttccattagagtgcttcttgctttagtgtctttgcttgacttggagttggagcaattagatgtaaagacggcttttctccatggtgatttggaagaaacaatttatatgcaacaaccagatgggttcattgttccaggaaaagaagaccatgtgtgtcttcttaagaagtcattgtatggattgaagcaatcacctagacaatggtacaaacgttttgactcatttatgattgatattgggtacataagaagtgaatatgatagttgtgtttatcataagaaactatttgacaacacatatatttacttgcttctttatgttgatgacatgctaattgcatgtatgcacccaaatgagatcaataaggtgaaaacacaattaagtggtgaatttgagatgaaagatttgggtccagctaaaagaatccttggtatggagattatacgagatcgaaaaattggaaggttgtgtttatctcaaaagagctatgttgagaaagttctacagagatttggaatgcacaatgcaaaagcagttagtacaccttttgcggcccattttaagttatctgcaaatatgtcaccacaaacaaaagaggaggaagagttcatgtctcgagttccttactcaaatgcagttgggagtctgatgtatgctatggtttttaccagaccagatataacacatgtagtgagtgtcgttagtcgttatatggctaatccaggaaagtctcactggcaagcagtaaaatggattctcagatatttaaggggttcaactaatctgggtctagtgtttggcaaagcaacaaatgaatgcaatggtcatgtcattggatattgtgactcggattatgctggtgatcttgatcgtagaaggtccttgagtggttatatttttacgcttggaggtagtgctataagttggcgtgcgactctacagtccactgttgccttgtcgactacagaagcagaatatatggcagcgactgaagcggtgaaagaagctttatggcttaaaggtcttgttcgtgatcttggt

SEQ ID NO: 70048 - DNA, 312 bp, Glycine max
  Peptide Sequence Number=SeqID_186826
atggaagacgcacccgtgagccctcgcgtcgccctcccgccgaagggtaggttgcgacaggaaccaaataggtttatgattggaacaatgcatggaagggcgcaagagaagcggggtttggattcggctttcgctaaggtcaacctgatcagaaatgacctgcgttggctagattgttttgttcctctgtcattgctaggttgcggtttcattgcttttattgatattaatgtggctccatgtagagcttgtaggccttggaacttcttcatcaatggagtcctttgcttcttgaagatcaagggcagttga

SEQ ID NO: 70049 - DNA, 330 bp, Glycine max
  Peptide Sequence Number=SeqID_186827
atgaagatggaaattgaggaagttggcaactgcgaagcacttcccctgctttcactcaaccacgtgtccctcttgtgcagatcggtgtgggtgtctatgaggttttatgaggatgtcttggggtttgttcccatcaaacgcccttcttctttcaagttcactggagcctggttttacaattatggtattggaatacacttgatcgagaatcccaacattgatgaatttgatacctgcgtgaatgaagaaaggcctataaatcccaaggacaaccatatctcattccaggtcaggccagactttgaaaggcctgagccaagcctacaatga

SEQ ID NO: 70050 - DNA, 660 bp, Glycine max
  Peptide Sequence Number=SeqID_186828
atgaggggagaaggttgcacagcagctcgccttcctctagaagtaacttgcttgcccaggcgagctggtgaaggatccagtgcagctccaccagcgaaaattgagtttaatggatatcgctttcgaagcgaggagcatcaacatcattttgaggtgattaagtattggttttttctcaaagaaagacgggtccaactagtggagggagagtatgcggaattccaagctgaagttgccaagaggcgttggacacagctgacagagcctatggcgaagtatgatcctaaacccactgaagaaggagtcgtgtacaagcgctcttgggtgtggggccaatggatcctatatgacacagatgctatcaaccaattcttggggcacccattgatcttagaagagggaaaacgatgcaaatacattgagagaagaagtcaattttcaggttttgatgaagaagccataggtcagctacttttctccccgggagatgattttgcatggagcatagcagggaggaggcttatctcagatgccatccaccagtttgtaggtattgcacctctgagacacccagtggacctagagaagtccaatagggcactagggttttcggcattgattacaggtctcttccaattctatgagtaccggttgcactga

SEQ ID NO: 70051 - DNA, 1254 bp, Glycine max
  Peptide Sequence Number=SeqID_186829
atgacatcttcgagggctgatggtgccatcgaagtcacacaggatgctccagtgcatgggcagtcacgcgcgggccagcacctgcagtattccggctgtctcttcacgggtctgccaggcgctgttgccaagggtcagcatgcgtgcggcgaagtcgcgtgcgttgggcatgtcgtcctgcggcacgatgccgcgcaggtacgcgtagtcgggcagggcatggatgaacatgcggctggcgccgagcccgcgtggccacaggtctttcaatacggcatcgcgggcgcgctggctgggcagcagcagcatcagcatcggccaggtgccaccgctaccggcaaggccgtcgaccacctcaacggctggcagctgtgccagctgcacgcgcagctgcaatgcacgcaggcgccctgcctgcaggaaggccggcaggcgccgcgcggcacgggcaccgatgttctgccgccactggctgacccggtgctgcggaatctgcagcgggaaaatgtcaccgaccgcttcttccaggtcgccacgctgcaacgcactgcgcagcggatagccgtacaccaacgacagcagcgatggccgatagcaggcggccaggccaagcagctgcagactgcgcagcagttcccagcgcaggctggaacgcacctgttcggcggcatgtccggccagcgcggcacgcagctcgtcatcgcggctgaccagcaggccgccttcgtgcaggctcaggcccttgccggcggccaggctgaagaatccgatatcgccacgcaggccgacactgctgctgccgacccgtgcaccgagcgcctgcgcggcatcctcgatcacccaggcgccagcgccgcgcgcaacctcgcaggccagctcgacatcggcgatgcgcccgcccaggtgggtgggcaggatcgccagcgtgcgtgcgtcggccaggcgcttgagctggccggggtcgaagtcgaaatggccgtggcgggtatcgcacagctgcacgcgcaggcccaggctgtcaactgcagcggcggtgtgccgagctggctggccaggatcgcgcgcaggtcgccaccaccgggcaggaaatcgctggcctgcatcggcaggccagccgtcggtggcagttcgcgcgcgaacaggctcatcgcagggggctcacgcggcgctttcggcggggctgtgcgggtcgtcggcttccgcgcggccgaggcagacgatgccggccacgatcaacaccgcaccgagcagatg

SEQ ID NO: 70052 - DNA, 757 bp, Glycine max
  Peptide Sequence Number=SeqID_186830
atggtgaagatgctcatggaacaaaaaggcatcacgtataatgacgccaagaatgcatctatggagcaaaacaatgggttggaggataaggagtccgcaatggaacctgagccttcatcaacatcagaggacgaagagaacaagcctgaggcagattcaatattgaattcatcacaccattattgggcgaaaggggtgaaaatgccaatgtttgaaggagaggatctgttaggctggattgtgcgtgcggaaaagttttttgtagtgcaacatgtccaacagagcacgaaagtgagattggcctttatcaacatggaaggaaatgccttgcactggttccagtattggaagcaaaagacgaagcggaaaagttggtttgttttcaaggcaacgctgattaagcgctatggtggaattcgaggtgctggtggctcaagtctcatgtacaaaggaagcgcaattgtgaggatattttttgagggacttcacaaggagatctatgcaaaaattcatccccacaaaccgaaggatctgtcaagtgccatggagttggcgacagattttgaggaagctgagaaagaagggaatccagaggtcgagttgcatagtcgtgggtttcattttcaacccaagggagaaatgtggatacacaatgttgaaggatccacaacgaatacctttcacaacaaccaacgtcagaatcaaactctaacaggggaggcacgtagctctgtgaacgtaatggctgcaaatcaaa

SEQ ID NO: 70053 - DNA, 537 bp, Glycine max
  Peptide Sequence Number=SeqID_186831
atggagctacatcaatatgttttggtgtatgtggactacatgtctaagtgggtggaagctatggcagttcccactagtgattctcgagtggttgtcaagttcttaaagaaaaatacttttacaaggtttggtacacctagagcaatcattaacgatggtggtactcggcaaaaactgtacaaggagaggactaaaagatggcatgatgcaaggattaaggaaagacaattccaagtagggaagaagatgcttgttcatgactcccacttccatctgtttcctgggaagcttcaatcaagatggggtagtccatttgaggtgaacaaggtattcccttctgtagtacttgagctaaaaaagttcgatggccacaccttcaaaataaatgcttatcaagccaaggcataccaggaaggactacaacaagtggctgatcatggcttggatcacttcatcacaactgtaaaccatggtggaatgatcaaggctttgatcattcaacctaaaaattttgtgaaaatcagcatgaggttgtga

SEQ ID NO: 70054 - DNA, 543 bp, Glycine max
  Peptide Sequence Number=SeqID_186832
atggactactacacccgcgtttcagaagttgagagggaacctatcatggagtattccacaccacgaccaatgatgggcaactaccaccaccctaatgctcaccgtgtcctcaacgagaagattgtttatgaggaggatgtgattggaggatcccgccacaaccacatgcatcaccaccaccctgagactcatgagagagtcaaggtggtggagtatgaacaagttcctgagaggcgcgttgtctatgaagagaaagttgcttatgacaacgatcgttactactctccaagatccggagactaccgcacccacgtttcagaagttgagagggagtctagtaccgttgaataccctaatgctcacgtttccctcaacaagaaggttgtttacgaggaaagtgagatagagggttcccaccaccaccaccaccacctcttccataggcaccaccacccagagactcgtgagagtgttaaggtggtagagtatgagcaagttcctgagaggcgcgtcgctgaagttgtctacgaagagaacaggaca

SEQ ID NO: 70055 - DNA, 207 bp, Glycine max
  Peptide Sequence Number=SeqID_186833
atggctatgattgattgtcaagattttgtggtaattagaataatagtctttataatgatgatgaggataaagttacttcctcccggtgactatcgaggtcataaggagaaacaagatgtatgtcaaccatggaagatattgttgctaagagttgttatgaataccttcaatgttgcagaagaagaggtttccaatgcagaaaattga

SEQ ID NO: 70056 - DNA, 1051 bp, Glycine max
  Peptide Sequence Number=SeqID_186834
atggctacctcaccaaaagaaactgcagcttctggttcaccatctgtcccgtcatctccacaccaggaacaacctgaattcaacatccaacccatccaaattattcctggtcaagcctctgtccctgagaaactggttcccagaagaccacagggagtgaagattgctgaaaaccctagccctgcaacgagtcctagggaagtagacacggagatggacaagaaaatacgcagcattgtgagtagcattttgaaagacgcctctgtgcctgaagctgatgaagatgtcccaacatcaaaggttacaaagcagaaagggaaaacccccattaagaggtctggacgaatcaaaactatggcccaaaagaagagtactccagtcactcctgccacatccagaagaagcaaggttgctatcccctccaagaagaggaaagaaatttcctcatccgattctgatgaggatgtcgaactagatgtctcgacatctaagagggccaagaaatctgggaagaaggtgcctgaaaaggttcctgatgcaccattggacaacatctctttccactccattggcaatgttgaaaagtggaaatatgtgtatcaacgcagacttgcggttgaaagagaactgggaagaactgccttggattgcaaggagatcatggacctcatcaaggctgctggactactgaagacagtcaccaagttgggagactgttatgaaggcctagtcagggaattcattgtcaacattccctctgacatatcaaacagaaaaagtgatgattatcaaagagtgtttgtcagaggaaagtgtattagattctcccctgctgtgatcaacaagtacctgggcagacctactgaaggaatggtggatattgatgtttctgagcatcagattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacag

SEQ ID NO: 70057 - DNA, 2919 bp, Glycine max
  Peptide Sequence Number=SeqID_186835
atgttgaggctttacgtgtgtgtattggaaaccaaggacctacccgtgaaggatacctacgtgacgctaaggctcggaaagttgaagtgcaagacaaggatactgaggaacacgtggaaccccgtttggaacgaggagtttggtttcaaggtgcatggtgctgaagacgtgcttgttgtctctgttgttgttaatcatgataataataataagtgcagatcagtgaccaatggttctgtagtggagtttgtgggtgaggtacggattccggttggttcggttgcttttgaggataagcaaacgttgctgcccacgtggttctctcttgaaagccccaagagtgggaggtttttcaataaatattgtgggaaaattctccttactgtgtctcttcatggtaaaggccgctcttttatgaatcataagcattctccaaattcaactattgcagttgagaactcaagagacttggaaggcaaacaattgttgaaggatattgctaatggtctgcataggattttcaaaaagaaagagggaaactcaaattttggggattcttcagaactatcctcttcattatctgattatgaagatagtgtacacgaaaatacgtttccttgtagctttgaagaatccattgcactgatggaatcaagagatgacaacaaaccagaaatgcctgaaaatttgcccgtcggtattctagtagatcagatttatttagtctctccgaatgaccttaatgtgtttctttttgcacccaattcacagtttagtaaagatatggctgaactgcagggaacaacaaatgtgcaagaggggccttggacatggaaaaatggagacacatcatgtttaacacgagttgttacctatatgaaagcggctacaaaattgattaaggcagttaatgccattgaggagcaaacctacattagagtgagtagaaaggaatttgctatactggttagtgtaagcacacctgaggtcccatatgggaattcctttaggattgaattactttacaagataatgccaggggaggtatcttctggagaggaatcctcccatctagttgtgtcttggggaattgtcttcctccaaagcacaatgatgaaaggcatgatagaaggtggggcaagacaaggattgaaggagagttttagccagttctcggaccaacttgcacggaattttaaggtgctagataaggcagatttaccagacaaggaacatttgttggcaactttgcaaacagaagaccagtggtgtggtccaaatctgcttcagggcttggaatttagtgggcttgaattgccagatagttttggagagctcattacaagtggaattttaatcatccagttgcagcgtgtttataatatggtgtctcactttgtgcaagctagatttcaaatgggaactgaccatggcctcaaagctcatggcgatggatgggttcttactgtggctttaattgagggggttgacctagcctccttggagtcagagggattgtcagatccctatgtagttttcacttgtaatggacaaacaaggtcaagctctgtgaagcttcaaacttctgatcctcaatggaatgagatattagagtttgatgctatggaagaaccaccatcagttctacatgtggaagtttttgattttgatggtccatttgaccaggatgtttcacttggacatgctgagatcaattttctaagacacacatcaactgagttggcagacatgtgggtcatgctagaaggaaagcttgcccaatcttctcagtcaaagttgcacttgagaattttcttggataacaataatggagttgaaacaattaaggaatatttggagaagatggaaaaggaagtcggcaaaaaattgaatcttagatcacctcaaaggaattctacattccagaaattgtttgccttgcctccggaagaatttctcatcaaagatttcacttgttacctcaagagaaaaatgcctttgcagggtcggctgtttctttcagcaaggattctggggtttcatgccaatttgttcggacacaaaaccaagtttttcttcctttgggaagatattgaagagatacaagtgcttcctccatcattggcaacattagggagccctacattggtcatagttctgcgaagaggccgaggtctcgacgcaaggcatggtgcaaagactcaagatgaagaagggagacttagatttcattttcaatcttttgtttcatttagtgctgcctccagagcaataaaggccttgtggagaacaagaatactgaacccctatcagaaagaacaaatttcagaagagcatgaagatcaagaaagatttgtaatcccggaagactctgcatctatcttagaggatgaagaaaaaatgtccagaattttctctgcagaactgccaatcaagatgaaatcagtgatgggaatttttgatggaggaaacctggagcataaaattatgcagagaacaggatgtacgaactatgaaacaacatcatgggaacaagtaaagcatgatgtcttcgagaggcgtgtttcttaccaattcaatcgacacgtgtcagcttttggtggtgaagtcacttgcacacaacaaaagtttccaaatgcaaacactggaggttggactgtgattgaagttatggatcttcacggtgtcccatttgctgatcacttccatattcattttaggtatgaaatagagaaatcctctcttggtgactgtgcttgcaagtgtgatgcttacattggtattatgtggcttaagagctcgaagtttcagcagaggatcaacaggaacataactgccaagtttaaccttcgattgaaggaaatatttgaactggttcagaaagagattttattaatgtctcagaactctcatggataa

SEQ ID NO: 70058 - DNA, 177 bp, Glycine max
  Peptide Sequence Number=SeqID_186836
atggatgattatgaagagcatataccaggaatttctgcagcacaattagttgatcttcgaacagtgctttgcgaaaacgacttgaggtttttgcagtttgagttggaatgcatttcagtagtgccaaaagcagattgtcttatagttaaccttaggccctccaaaaaaaggtcctga

SEQ ID NO: 70059 - DNA, 255 bp, Glycine max
  Peptide Sequence Number=SeqID_186837
atgtctgcattatacatttctctcggtagtttcctttctgtgtcatgtgcccaaatgaatgaaattgttacagctttgaacacgagtggtgtttgttacttgtgggtggttttgtcacatccttctgtgggcgggttttggagccattgtgggtggaattcaactctagaagctgtttttcctggtgttccaatgctgacattccctctttactttgaccaagtcccaaatagtaggcaaattttggaagagtag

SEQ ID NO: 70060 - DNA, 225 bp, Glycine max
  Peptide Sequence Number=SeqID_186838
atgagagataagactgaagggaagtggctactcgtggaatcgtggggatgcagtttgcagccaagccatgtccctaaaactgcaatacaatatgcacacaagcttactgtggctagccaagtatttgtcgggttggagataaccctgttagaaggggatcaagtggaagctgacaaggaaaaatttaacaaggcaaggaagggatcatcagtgcagttgaattag

SEQ ID NO: 70061 - DNA, 529 bp, Glycine max
  Peptide Sequence Number=SeqID_186839
atggctgaacggtactcgccctttgtatatgttgaagatcaagatgtgttgtatgaaatatgtggttatgtggtcgagagggtactcggtttggatgcatcagtgccagtcgaaggttcatcgtcagaggagtcggttggaagcgggtcgggagttcgagggtacaatgatgaagtttttgaagtttcatctgactcccactctttggggttgaatttttctagttcaattgacctcttagcaatcgaggggtctagtgacattttgccatttttgagccaattgcaaaaaaatatgggtaaaaaggtgggtgggagtgttgtagctctgatggtggccactattgccgagacggggacctccacaggagctttccctcaacctaagaagcgttcggtgcttaaggaaaagtgcttgcctccccctatcacgcttctcgggtacatgtgggttgacagggaggtatgcacgtacttctccattgctgtggtgtttgttctagtccttgttatttccatgaactctcaag

SEQ ID NO: 70062 - DNA, 345 bp, Glycine max
  Peptide Sequence Number=SeqID_186840
atgcatgatgggttccctgtcattgatgaatcacctttcatagatgcaccaaaattatgttggcttgaatcgaggatcaggaaagggatcacactagatgatattggtattgaagaggaagagatagatatgtatgtcgttctactcggattagactcaagttcatggatcgacttgtgggtctcgtggtctgtgcaagccatggaccatttttttaaatccatgactatgttggattttaggcttgcctcgcataacccgtgggctttgcagactcgtggaccagtctgtttggctcacgggattcgcaagacaggaggagaccaatgtattaaattcatgtaa

SEQ ID NO: 70063 - DNA, 891 bp, Glycine max
  Peptide Sequence Number=SeqID_186841
atggatgatgcaagaaaaaatgagattatggttatgaggttggctatgaaaatatcacaaagacaggttcctcaagtgaacgaggaaaagatagccaagagaagaaagaagcctatcaagactgtgacgaaaaggaaacatgagtctgcatctgcatccatcccctctggcaagcgttcaaggaccactcccacaaagagaagtccaaagaagcagactatggagacgaataccaacactagactcaaagatcctggtgaaataaaagatgaagaggttcctaaacttcaacaaaaaaggaagattgtagctccacaagcactttttgctcctaagaaaccaaaagttgtcaaggtagctccctctgtaaagaaaccaatcattatcgatgatgtttcttttgatgctactatctcaccacaagatcgtcgtccaccttcacctccaaggcagcgtccacccacatctcttgtcaacttgaacaagttcaagaacaacaaaaagatgaacactcctatgtcagaaaaagaaaggacgacaatgctgaagcagcatgatcttgttctatcatgtactgagtactccatgactggtggcattcttgcacgaatgtatgctttcaaccaagctatttcatatccaccaagtctacacatcagcaaaacaattgataacaagattgcacttgatttttgttgcccaaggcttcccgactctaaagatgacggattcatctccagactaaagcaacttcccatcagattcaacaacattgtctatgatcttatgaagatggatgagagggatttcaaggatcaaaagaatatgctaaggaaaaacttgaacagctcgcttagcgacacaagcttgctaagcgcaattccttggtag

SEQ ID NO: 70064 - DNA, 3174 bp, Glycine max
  Peptide Sequence Number=SeqID_186842
atgtcacaaaatgaaaaccaggatcattcatacttcattcctttcaggtatagacttggcaaaccagcaaagcagtatgctccttggtatgacacagtattgaaaactgcaaggcttgctataagcattatcaccttgctgaaggagcagagccgagtatcacgcctttcctttggagatgtcatcaggaaagtatctgagtttaatcagaaagatggttcttacatttcttctgatccattgactgttgagagatatgttgttgtccatggacagataattctgcaactgtttgcagaatttcctgatgataatatcagaaagtcttcatttgtgactggtcttacaaataaaatggaagagcgccaccataccaaatggttagtgaagaagaagaaagttgtgccaaggagtgaaccaaatttaaatcctagagcagcagtgggtcctgttgtatccaagaggaaagctatgcaagctacaacgacaaggctgatcaatagaatatggggagagtattactcaaaccacttgccagaagattcaaaagagggaattgctagtgagttaaaggatgaggatgaagtggaggaacaagaagaaaatgaagatgatgataatgaggaggaaacaatacttttggagggaactccaaaggcacattcagcttcaaagcaaaccaaaaaaatttctgctgacacagaaataagatgggaaggggaacctgaagggaagactagttctggatatcctgtttataaacaggcaattattcgtggtgaagttatttctgtaggaagatctgtgttggtggaagttgacgaaacagatgaatttccagatatatattatgttgaatatatgtttgaatcaaagattggaagaaaaatgttccatggtaggatgatgcaatgtggttgtcagactgttcttggcaatgctgctaatgagagagaggtgtttttgactaatgagtgcagggatttgggactgcatgatgtcaaacagacagttgttgtaaatatccaaaataggccttgggggcatcagcatcgaaaggataatatcattgcagatagagttgacaggactcaagcagaagaaaggaagaagaaaggactacctactgactattactgtaaaagcttgtactggcctgaaagaggtgctttcttcacccttccacatgatacattgggtctagggtctggtgtctgcccatcttgcaaaatacaggatgctgaaaaggagaaggatgttttcaaagtaaattcctccaagtctggtttcctatttaatggaactgagtattctcttgatgattatgtttatgtaagtccttttgaatttgaggaaaagatagagcaaggaactcataaaagtgggaggaatgtggggttgaaagcttatgttgtgtgccaagtgcttgagattgttgtcaaaaaggaaataaaacaagctgaaataaaatctacacaagtcaaaatcaggaggttcttccgaccagaagatttatcaaatgagaaggcatattgctctgatatacgagaggtgtattacagtgatgaaacatatataatctctgtagaatccatagaagggaaatgtcaagtcagaaaaaagaatgatattcccgaatgcagtgctcttggtggaatcttccaaaatgtttttttctgcgagctcttgtatgatcctgccactgggtcactgaagaagttgccggctcatataaaagtaaaatattcaagtggacaaacatctgatgctgcagctagaaagaggaaaggaaaatgtatagagggagatggtgtttcagagtccacaaaggaaggaaaaacattaaatgataaacgtttagcaaccttggacatttttgcaggctgtggtggcttatcagaggggttgcagcagtcaggagtttcatcaactaaatgggctattgagtatgaagaaccagccggggatgcatttaaagctaatcatcctgaggcattggtgttcattaacaattgcaatgttattcttagggctgtaatggagaagtgtggggacacagatgattgtatctcaacatctgaggctgcagaattggctgcaaagcttgatgagaaggaaataagtagtttaccaatgcctggacaagttgatttcattaatggtggtcctccatgccagggtttctctgggatgaataggtttaaccagagcagttggagtaaagtccagtgtgagatgatattggcattcttatcctttgctgattatttccggccaaggtatttcttgttggagaatgtgaggaactttgtgtctttcaataaaggacagacattccgtttaactttggcttcacttcttgagatgggttatcaggtgaggtttggtatccttgaggctggagcatttggggtttctcagtcaagaaaaagggcattcatatgggctgcttctcctgaggatgtgcttcctgaatggccagaaccagtgcacgtcttttcggcccctgagttgaagatcacattatcagaaaatgtccagtatgctgctgtccgcagtactgcaaatggtgctcctttacgtgcaataactgttcgagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaacgaattgaacttgattcgatgccagaaaattcccaagagaccaggtgctgattggcgtgaccttccagaagaaaagataaaactgtctagtggacaagttgttgatttgataccatggtgcttgccaaacacggctaagcggcacaatcaatggaagggactgtttggcaggttggattggcaaggaaatttcccaacttccgttacagaccctcagccaatggggaaggttggaatgtgcttccaccctgaccaagataggattcttactgttcgtgaatgtgctcggtctcaaggcttcccagatagctatgaatttgctggcaatatcatacacaagcaccggcagattggtaatgctgtgcctcctcctctagcatcagcattggggagaaagctcaaggaagcagtggacagtaagagctccacttag

SEQ ID NO: 70065 - DNA, 495 bp, Glycine max
  Peptide Sequence Number=SeqID_186843
atgggatcgaatcaagtaccctcttttaagaaaagattttatcatgtcaaaatcaaaagcctagaagttgtcgatttgcaagagctagggcagcaaatgggtcagctccaacttcaagctttctacaagacatatggaaagatctgggatttggctatgatagaagtgtccgttgaagccattgcatccctcgttcaatattacaaccagccactaaggtgcttcacatttggggactttcaattagtaccgaccattgaagaatttgaagagatcttgggatgcccactaggaggaagaaagcgatatctcttttctgggttacacccctccatggcaagaatggccaaagtggtcaaagtcttggcgcaagaattggaccgagtaaaacaaaataggaatggggtggtcagaataccaaggaagcacttggaggagaaagcgaaggctttggctgatcaagagccatcctctttccaaatatggatgggctag

SEQ ID NO: 70066 - DNA, 291 bp, Glycine max
  Peptide Sequence Number=SeqID_186844
atggaagatgaaggtcccacagcccaggtagcacaacatctggaggatgattcatccaaggccaccattccagagccattccttgtagaagaggaggcagagcctcctgcattagtggtggacctatcctcgcctcagtatgcagcagacccctccactcctatcctagagataccagaggacccgaccacaccagtcctaactctaagcacttctcttccagctactctagtacttcatctgacagatgaggaggatgttcagacacaagatactcaggaccagtcatag

SEQ ID NO: 70067 - DNA, 519 bp, Glycine max
  Peptide Sequence Number=SeqID_186845
atggcacgtagagacaaattatggtcatctgcaccctttttgctatccagagacaagcgagtccgctggcacgcagagacaaattatggtcatctgcaccctctttgctatctagagacaagtgagtccgatggcacgcggagacaaattatggtcatctataccctctttgttatccagagacaaagacaatcaagtccaatggcacgcgaagacaaattatggtcctccgcaccacctttgctatccagagacaatcaagtccgatggcacgcagagacaaattatggtcatttgcagcacctttgctatccagagacaatcaagtccgatggcacactgaagcagattatggtcatctgcacctcctttgtcatccagagacaatcaagtccgatggcacgcagagataattatggtcatctgcccctttgtcgaagactccaatgtttttcgaccgagactattaaagtctcctttgccatccaaagacaatcaagtctatcggtatacgtgtga

SEQ ID NO: 70068 - DNA, 690 bp, Glycine max
  Peptide Sequence Number=SeqID_186846
atgatcgaggcgcaggccgccgaaacggtggtgcatcggcggctggcggagccaagcggcaccgtgcggatcacggcatcggtgcccgttgcgcagtttcagctcgcggatcgcctgcccgtgctggcgcggcggtatccgaagctgcgcatccagttgcacgtcaccgaccgcttcgtcgatctggtgcaagagggcttcgacatcgccatccgcagccatttcgcggcgctgccggactcggacctggtgcagcggcgcatggccgaggagccgatcacgctggtggccgcgccgtcctacgtcgccgagcgcggcgcgccgcaagcgccgcaggccttgggcgatcacgacggactgatggccggcatggcgacgaagtcctggcgattgggcgacgcgagcggccacatcgtggaggtcgcgccgcgcccgcgcttgcatgccgacgaatccacggcattgatgcaggccgcgcaggcgggactcggcatcgtctgcctgccgcggacgatctcggcgcaggccgtgagcgagggaacattaatgcgggtcttgccggcctggaccgccggccgcgtgacgacaacgatcttgacgccgcacaaacgtggccagctacccgccgtgcgcgcggtgatcgatttcctgacgcaggcagagggtgccggcgatggcgcggtggcctga

SEQ ID NO: 70069 - DNA, 210 bp, Glycine max
  Peptide Sequence Number=SeqID_186847
atgccctggctcgacgtgctcgccgccggcctccaggcaatgctgcgacgcggtctgcaggcaggtccgatagcagtcgaggcaaaggcgcgtacacgcctcgatatccttgtcatgtccaggcatggtgtcctccttgtgtttgatcgggacgaacctgtccagcaaacgccatgccggggggcgagggcctgcctcgcgcgtatttag

SEQ ID NO: 70070 - DNA, 978 bp, Glycine max
  Peptide Sequence Number=SeqID_186848
gcccgtcagcgcgtcggtatgggcgtggcggcggtatttctctatggcgtcgtagctcgtcgcgatgaacaccgcgaaggtcagcgcgatgctcccgagcagcccggtgtactggatcaggatgccccacacggacgtgcgccattctcccgccgcgagcgcgggcgtcggcgcggcgaggtacaggatgcactggcccgtcagcaccagcgcgatgaagaggaaagcggcggtgagcaccctgtccgaggtgctcgcggcgtgcctggcgaaggacagcgtggcgcgccaggtcaccagcgcgcaacaggcctggacgaagaacgtttccagcttcgcgctggcgaacagcaccaccgagaccaccaccatcgccgccaggatgacaccgcccaggatgaaggcatcctcgaccacctgcttgtacggcgccagcccgccggcctgcaccagcatgatggcgtagcccgcgcccaggcaagccagggcgccgccccagcgcagcgtgttgaagccgatgaagcgcgcggcgcagaggccggctgcgcacatcaggatcgccgcgggcacggaccactcgagaagggttgcgggcatggcagggatagtcaaggattgtcaagcgtgatggcacaccgcttcgacgttgtagccgtcgggatccaggatgaaggcgccgtaatagtgcgggtggtattgcggacgcagcccggggccgccgttgtcgcgcccgccggccgccagcgccgcgcgatggaacgcatccacctcggcccggttgcgggcgcgaaacgctacatgcacgcgcggcgtgctgggcgtgccctggtggatccagaattcgccgcccgggtcgccggcgtcgtccgcctgacccacgccgaagcccatgccggtggacagctgcttgcgcggcacgtggcccaaggccgccagcgcttgcaggtagaaggcgcggctgcgttcgaagtcgctcac

SEQ ID NO: 70071 - DNA, 489 bp, Glycine max
  Peptide Sequence Number=SeqID_186849
atggctaggagactccaggaagattgggccagggatgtaggagaaggccctagggttctcatgagccttaggggataccctaaggaaacaaagggatactatttctacaattcctttgaggacaaagtgtttgtcgttaggactaaagtgttcctagagaaggaatacatctccaatccaatggagccagaggccattattgagcctgaatatgagaagtggcttacgggtataggatctaagatggaatccatgtacactaaccaggtttggaccttggttgatccacctaaagtggtttcaagaaagttcgagatggatgccaagactgtattccttaatgagactcttcttgaggatgtgtacatgacacaacctaagggttttaatgatctaaaggaagttgggaataacgaagatgaaccttgtgtctacaagaaggttagggggagtaggggtgttcatggtgtggtttggttcggtttttag

SEQ ID NO: 70072 - DNA, 171 bp, Glycine max
  Peptide Sequence Number=SeqID_186850
atggatcacaaggacttgagcatgggtacccgtttgactaggattctttctgaaaaaagtaatgtgcttgagagacatgcgagccaacataacaacgttgatggaagcagaggtcaaatggtacttccaccgagagtgatgaagaggatatgggtcctcaagactatatga

SEQ ID NO: 70073 - DNA, 327 bp, Glycine max
  Peptide Sequence Number=SeqID_186851
atggagaactatggtggttcgtggtggctgtgggtgaaggataagaatcttgggacgttggaaatgatttttggaagaaagaaggagaaagaaaatggcatttttccaaggttacacaaaatacaaaggctgaaacactcaagtgcttctgctctcgaaaaaggaagcttttcgcatacgcttgaagtcatatcagagattgcaacgacaaaatttcaaaaagatccaacggttaacaaagacaggatggcgcttttaccaagacagctccagacagcttccttgagaagtttcattaagaggcttcctcgagaagcatcctcgtga

SEQ ID NO: 70074 - DNA, 276 bp, Glycine max
  Peptide Sequence Number=SeqID_186852
atggtgttgaaacttttgtcatttaacgccaaagaggtttcgattacggttacgaagttttggtggctctcagagcggctcaaggccttgagatccaacataatttcctttgtttcagtgaaatttgttggaggaaactcgaattccacaaatgaggagaaggaattgaagatgctttgtcttgtttgtatggttttcagcaccgcaatggtgaccgtggcgaatgcgcacatagacgattgtctggtaatggcaataaagaagaatgagttgtga

SEQ ID NO: 70075 - DNA, 2262 bp, Glycine max
  Peptide Sequence Number=SeqID_186853
atggaagagccagaaaaccacaccttacattcccaacttattgtagataatcccaatgagatttggaaaagtgaaaacatcttacgattttttctaccccaatttaccctcctattgtttttcattgtctctatgactcgttttatacactacatcctcagacctttcaatcaaccacattttgttgctgaattttttgcaggtttactgctatgtccagaaatagttggaaaatcagaaattactgcatatgtgatacctccaaaagcactccttggtgtagagacagtggcacatgtgggtctcatctacaatgtcttcctaaccggcttggagatgaacctagacgctgtcctactagcgcgaaaaaaggcaaccaccattgctattgctgccaccatcattccaatggcgttagggactgccatatattctttaggtcaagctctctacccagatgataagtcatctttcaacacacctagtgcatatttattctgtgctttggttcttagtgtcacaaattatcctgttctagctcacattcttgctgatcttaagatcctctacacgggtcttggtagagtggctgtaaccgcagccacaattaatgacttctacaattgggcaatgtttgtgattctgattccttttgccactcatagtgaaaaaccctttgtgtcagtgatgttgaccatgatctttgtcctcttttgctactacatgttacgcccttcacttaaccgtttgatagagaaaataacggacaagaatgaatgggacaactacaagttgtcgtatgtgctcgtaggggttttgttttgtgcacatgttactgaaatgcttggcactcactccattgttggggcattggtgttcgggctgattcttcctaggggaaaattcgcggacatgttgatggaaaggtcagacgatcttgtctctatgtatctggcaccattgttcttcattggatgtggtataagattcaacttcgcaactttcgaaaagacaaagttgcgtaatgtgatgataatcacgctcttgtcatgctgcacaaagatagtaagcactgtgatagccactggcttctatcgtatgccttttcgagatggagtggcccttggagcgcttttgaacaccaaaggcctcttgcccttagtaatgctaaacattgcaagtgacagagagattttgagtagggatttctatacaattatgacgacggctaatgttctgatgactatactagtgtctccaaccatcaactacatatacaagccaagaaagcaatttgagaaggataagctaaggaccatacaaaacctgaaggctgatgcagatatccgagtagtagcttgtgtccacaacgcgcgccaagccgcgggaatgatcaccatccttgaagcatgcagcgccacaaacgcttcccgtctccgcgtgttttctcttcaactcatcgagctcaaaggccgcggcaccgcctttcttgtggatcataacagttctcatcaatcacaagctgacaccgaggccattgccaatatttttgccgaaatctcgccggagcaagggcacacaaacaccagcctggagactctcagcgccgtctcctcctacgagaccattcacaaggacatctacaacatcgccgacgagaaacgcgcctcgttgattctcatcccgtttcacaaacactccagcgcggaaggtaccctagaagtgaccaaccccgcattcaaggagataaaccaaaacgtgatgaactacgcgccatgttcagtgggaatcctggttgatcgtgggcacgggtcgttatcgaaggtaagcctgcgtgtctgcgtcgtcttcatcggtggccccgatgatcgtgaagccttggccatttcttggaggatggcgaagcaccccgggatccatctctccatggtgcatgttcttttgtacggaaaggctgctgaagtggacacaaatgcaacaacaaatgatgaatcgcatgggatattgtctacaataattgatagtgggaaggagaaggagttggatgaggagtatgtgagtttgttcaggctcatggcggtgaacaacgaggattcaatcacatattctgagaaggaagtgcacactggtgatgatattcctttggtgcttaatgagttggatagagggagctatgatttgtatattttagggcatggaaaaggaaggaactctttggtgttgtcgaatttgatggaatggactgattgccctgaacttggg

SEQ ID NO: 70076 - DNA, 999 bp, Glycine max
  Peptide Sequence Number=SeqID_186854
atggaggggaataggactttgaattttgataatttccttccgcatcagatagcagtagatgaaaaggattctatattggctagtatacctgcagaactgaaggaaaagggctctttggtacatgcatctctaatagagggaaaggggggcttgcaaactctccttcagtctataaaggaacaggatgcagataaagtatctgtgagccttacatctacactggatactgtagcagagctagagttgttacaggcaccgggattatcatttttgttgccagagcagtatgcacaacaatatccacggtcagtgactccaactgaaagtctgtcaatcactactttgatgctttcagggagaggaactgttgagttcaccattgagaaaggagatggttcaacattttctcctgttggtggagagcagaaaaatactgccaccgttcaggttgttatagatggatactcagctccattaactgcagggaattttgcaaaactgattagtaaattgtataacctagtggaaacaacactcagtcccataatccttcaggtgatggatggagcctataatggcgcaaagctcaattgtatcaaccaagctgttatttcagataatggagttgataagaacactggttatagtgttcccttggaaataatgccctctggacaatttgagcccctttacaaaacaacattaagtgtgcaggatggagaactgccggttcttccactatctgtttatggggcacttgctatggctcatagcgaagcctcggaggagtattcatccccttatcagtttttcttctatctctatgataaacgaagtgctggtttgggagggatatcatttgacgaaggacaattttcagtttttggatacacaaccaccgggagagacattctaccccagataaaaactggtgatgttattcgttctgcaaagcttattgaaggccaagatcgtcttgtattgcccaaggagagttga

SEQ ID NO: 70077 - DNA, 894 bp, Glycine max
  Peptide Sequence Number=SeqID_186855
atgtctaatgcatggacaggtagaaaacaaagatctatcattaacttcttggtgaattgtccaacaggcacaatgttctataaatcaattgatgcatccaattttgtgaaaacgggtgaaaagatatttgagttgttggactctattgtggaagagattgaggaggaaaaggttgtccaagttataacagacaatgaaagcaactatgttttggtgggtgatgcacttgtgaaggtgttgcgccttgttgataatgagaaaaaaccaaccatggcatatatttatgaggcaatggagaaggataaagaagctataatgaagtcatttgaatataatgaaagcaagtataagcaagtgtttgaaattattggtagtaggtggacttgccaacttcattgccccttgcatgcagctggtcactttctaaacccagatttattcttcaacaatccttctatggaatttgattttgaggtggtaaatggattgtatgtatgcattgaaaaattggtgcctgatcaaaaggtgagacaaaagattcttatagagctacccatttataaaatgggtggtgatgaaattgatccaatttcactcaatgacattgatgaatgcaacgagtggcttgtggggcaaatgtatggtgatgatggccttccttgggataaaggaacccttggtgttgaagatgttgcacctaagacaaaaagaggtcaagtgagaggattttcatcccttagaggaaaagagaaaatgatagaagttgaagataatgcaatcttggaagaatctgaaaaggagttacaaaacaattttggggactcacaagaagttgttgaagggcatcacccattactagacaatgaggattatgattatattggggaggggtag

SEQ ID NO: 70078 - DNA, 288 bp, Glycine max
  Peptide Sequence Number=SeqID_186856
atgcagcaaaggaaggagcgacaaaggttctccacttctgatgacagtgccatgaccaagcaagttcaggccactcatgcccctgatggtcgtgaaattgatgtcaaacccattctccaaattgtggatgaaatattggttcggttcatcgctcgcactgttgagggttacgaagtaaagcgagatcaagatgcattggagatgacagctgctctggctgaatttgacatgcttgactcgctggcttatatcataaacaaaatttcgtgcgaggttgttttcatatga

SEQ ID NO: 70079 - DNA, 135 bp, Glycine max
  Peptide Sequence Number=SeqID_186857
atgcctttctgcccgatgactcaaccaccaacatcgttgtccacgatctacggtgggttgccgtggatgaaggtgcgagtgtcaattcagtctgaagccaattcgagtcaagtcaattttgctgtcatgggttag

SEQ ID NO: 70080 - DNA, 543 bp, Glycine max
  Peptide Sequence Number=SeqID_186858
atggtggcgaagaagccgctaattgtgataattggagctggaatggcagggctcactgctgccaacaagcttcacagtgtgagtgcctcaaaggacttgtttgaggtgtgtgttgttgaaggtggaaacaggattggtgggagaatcaacacatcagagtttggtggtgaccgaattgagatgggtgctacttggatccatggaattggaggcagcccaattcacaaaattgctcaacaaatccatgcacttgactctgagcaaccttgggagtgcatggatgggaatgagaataaggccaccacaattgctgaaggtggctttgtgctaaacccttcttcccatgttgaccccatcacaaagcttttcaacaatctcatggatcatgctcagagaaagatgccaacaacaacaaagggtgactgtggaaaccttagtgttggctcttttcttaaacaaggccttgatggttattgtggttcatcaaaagaggaagaagagctcaaagggtttggaaaatggagcaaaaaagttactcaatga

SEQ ID NO: 70081 - DNA, 264 bp, Glycine max
  Peptide Sequence Number=SeqID_186859
atgcagcgtagacacttcaaagtagtagttgtgtccatgccatacctgggtcagacagatatagatggttgtcgtggcaacatgggtgaatttaccgtcctctgttgtctggctttgtgtaatctcgtgagacaaagttatgaagcaacatcttctaggaaaagtcgttcacttgttcaggagctgacaactggagcagtggcttcagtcttcttgggttttgggtccctgttcctcctacttgcttctggcgtttatgtctaa

SEQ ID NO: 70082 - DNA, 330 bp, Glycine max
  Peptide Sequence Number=SeqID_186860
atggtagaagtctccacagaggccattgcctccctcgcccagtattatgatcagccgttgaggtgcttcacctttggggacttccagctatcacccatggtggaagaatttgaagagatcctaggatgccctataggggggaggaaaccatacctcttcacagggttctatccctcattagctagaatttccaagattgtccaaatctcggcgcaggaattagaccacaggaaatattctcgcactgttgattttcgggggagtcctctttccgaatgtggatgggttggtggacctggcagcgatcgacacttttctcacctatcataa

SEQ ID NO: 70083 - DNA, 1848 bp, Glycine max
  Peptide Sequence Number=SeqID_186861
atggctagagaaattagccgattaaatgaatctcaggttgtagtgtatgctctcggccagatacccgggggatataagttgctatctttgttcagagtcaaaatctggtggatgataccacctgtagggagatctgcaagtgatgttccaatggaaactcaattgctgctcctgaagaaagagaagagtctgcgcttgaggatgagttttcttctgactctgaagagccaactacagagaacacttgctacattctccttttgcctgttttggatggacagtttcgcacaactttgcagggaactcaatcaaatgagctccagctctgcattgaaattatatgactttagatttttgaatgcttcaggagatgcttatgttcaagcttcccaatcactagaagcagcatttgtgaattcaggggacaatccatttgagttgatcagggactctatcaaaatattggagaaacacaaagggactttctgtcatcttgaaaacaagaggattcctgcacatcttgactggtttggatggagcacttgggatgctttttacactgaagtgagtccacaaggaataaaagagggccttcagagtttcttaaatgaaggttgttcgccaaagttcatcatcattgatgatggatggcaagagaccctcaacacgtttcgcaaagaaggtgaatcagtgattgagggaacccagtttgcaaccagactgatagacattaaagaaaacaaaaagttcaccaatgcaggctccgaaaattcttgtaacaatctccacgattttgttgattccatcaaacagaatatgaatgtaaaatacgtttacatgtggcatactttaactggttactggggaggtgtactcccatcatcagatgcattgaaaaaatataatccaaagattttatatccaattcagtcacctggaaccacagggaaccttagagatgtagccatggacagcttggaaaaatatggagtgggaatcattgacccagaaaaactatatgacttttacaatgattcccacagttaccttgcaagctgtggtgtagatggagtcaaattcaagaatagtgcagcagcaagagcatctgaggatttcatgccaagagaaccaacatttcaaaccttacacatcgcctctgtcgcatttaacagtcttcttcttctgggagagagcaagcacgagacagccgagtcccatgctgcagcaagatcaataggtggttgtgcagtatatgttagtgacaagcctggaaatcatgattttaaaatcctgaagaagctagtgctgcctgatggatcagtcttgagagcaagatatgccggccaccctactcgagattgtttatttgaagatcctgtaatggatggtaaaaggcgtcttcaattgccaaggagcaggaagctagtcactgaaatcattggaagccgcaccctcgtgcataaccatctcagggaaagcttgctttccaaggtgtcttgcagaggaaaacttgaagtatccctggaaactctccaatgtgaaatatatacagtatctccaataagggtgtttggtcatgatgtgcaatttgcaccaataggattgcttgacatgtacaattcaggaggagcaatagaagccttggactgcaccatggatgttgcacagtgcgtagtaaaaatcaaaggcagaggatgtggccgttttggagcctactccaacgttagaccgaaaagttgtgtagtggacatgaaggaggaggagttctcctacatccctgaagatggattattgactattacacttggttgtgaaggcaattcaagggacatggaatttgtatactga

SEQ ID NO: 70084 - DNA, 573 bp, Glycine max
  Peptide Sequence Number=SeqID_186862
atggccgagtcctgcctcctctcttctccctcctcactcttccacaccaaaaccaaaccctctctctttacacccccctccaaacccctcacactccaattttcatgcctcaactcctccgtctctctctccctcgccgcaccaactcaccgttctccccttgtaactttcgtggcccaaacttccgattgggctcaacaagaagaagaacagagcctcgctgaaaccgaagcgggcctggaaagttgggagcccaacggcgaagacgccggcgatgagagcttcgtcgaaccgccggaagaggccaagctcttcgttgggaacttgccttacgacgttgatagccagaaattggccatgcttttcgaacaggccggaaccgttgaaatcgctgaggttatttataacagggaaactgaccagagtcgcgggtttgggtttgtgacgatgagtactgttgaagaagctgaaagcgctgtggagaaattcaaccgctatggttgtcaaatgctgactcttaagttgcatgctggttgtacacacgacaaggatttggctaggatgcacatgtga

SEQ ID NO: 70085 - DNA, 507 bp, Glycine max
  Peptide Sequence Number=SeqID_186863
atggacacatatctttgtgtgattggtgattccattaatggagttcaacgggggtggggtcacaaatcactttttgaggattcacctagtaagtgtggtggtgggggcgccactgacactgcaggaactgatacaaccttcataactctagactggacaatgacagagctactaatgaatccacaggttatggaaaaagcacaaaaggaagtacgaagcatcttgggagaaagaagaattgtcacagagagtgatctacatcaattggagtacatgagagctgttatcaaagagatattttggttgcatcctcctgttccagtattagtcccaagagaatccatggaagatgttgtgatagaggggtatagagctccagctaaaacaagagtttttgtcaatgcttgggcaataggtagggacccagaaagttgggaagatccgaatgcatttaacccagaaagttgggaagatccaaaatttataattgattttttttttttataa

SEQ ID NO: 70086 - DNA, 717 bp, Glycine max
  Peptide Sequence Number=SeqID_186864
atggaagcactatcccttcccataaacactctcaccaattcctctgccaaacaacacatttatctgagtgcttcttccaattatgcctcagtctcttcttccttacaactcaatccttctctcccaaccagacccctcactctgaggaaaagcgcggttcgagtccaagccgagaatgaggattttgaattgaagcaaatgagggacatggctgctgccagaaagagatgggaagctctgataagagatggaaaaattaaagttcttactcctagggaagctgggtatgcagttcagctttcaaacaagccccttcttgatgtccgtccctcaaatgaacacaaaaaggcatgggtgagagcttcaacctggattccaatatttgatgttgataataagctagattttggaaccattcccagaaaagtcacaagctttgttatgggaggttggtggagtggcatgcctacactgtcttatgacagtcagttcttagccaaagttgaggagaagttccccaaagatgctgaattaattgttgtatgccagaagggactgagttggactgatcaacaaagagcagctgcagccaaggaaggttggggatatagattagtgttttctgcacgcctgattggactcattctcgttgttgatgcactatatattggtgctcagcaaattgggcgctatcttcaggatatcaggacccattga

SEQ ID NO: 70087 - DNA, 2031 bp, Glycine max
  Peptide Sequence Number=SeqID_186865
atggatcagtccagaaaggaaacggagtttgcactttctgccttgatggaaataccctcccagtacaaggcaacactagagcttaatatattgggtgcccgtagagggaaagatatagaccggactcctctaccaccgcctctatatggtgctgcatctttcaattcccccaaaacttcccgtcaaaacagttttcgtcccagtgcaccatctagcagacatgatgttagcacgaaccctcctgcaacttctgcttctgataatcaggttgtggtcactgctgttgcatgtttacttctccttggcattaccctcaatcctcgtattggaagtgtatttttgggttgtcccatttgcctcacggatcctaaggatatggccttttggttgcgggcatcagacatgctcaatggtgtgaatgtgagatcctctgaagggaggaaagggcagtggcaactgctcctcaacaacactggtgtggttggcatgcatgtggctttaacctacaaagacacagtcataatgtttgatcaaactggagctggccaatccggttaccgacttcgccgacgcttcaacggaagtcggtgcacaataaaccaccatgatttgttggactcaacatgttatgctcattctgtggagtatgacatcagtgccaacaaagtgagacctctgaggcttgacaccgatccttggtgctcctctgcctcattcctaagcaatggtacacttttgcaaacaggtggatttgaaaaaggtgccaaaagggtcagattctataggccttgtgggaatcaccaatgtgattggattcaatcaaagaaaacactatctgatgagaggtggtatgcttcaagtcagatactaccagagcataacagggtggtggttgttggtggaagaagagttttcacatatgaatttgtaccaaaaactagtcctggtgaaaaatcctttgaccttccattcttgcaccaaaccaatgacagggatggaggagggaacaacctctatcccttcctccacctctcatctgacggaaacttgttcgttttcgccaaccgtgattcgatcttactcaacctgagaaggaacagagtgatcaagaccttccctcggattccgggggaagggtcaagaaactacccaagctcaggttcatctgtgatgctcccattagaccacagagataacttccaaaaagtggaagttatggtgtgtggaggctcatccattggagcacttgaagctgctagaaaaggccgattcttagaaggtttaagatcatgtggaagaatggtgatcacagggaacaacaacaagtgggaaatggagtacatgcctaagccgcgtcttcttcatgacatgttgattctccctactggtaacattcttatcataaatggggctaaacatggttgtgcagggtatgaaaatgctagaaacgcttcacttgagccttacctttatagccccaacaaaaagctaggaaaaaggttcacaatgcttaaatccactaagatagctagaatgtatcactcatcggcaactcttctttctgatgggagggttttggttgcgggtggtaaccctcatgggaggtacatttttcacaatgtggcatacccaactgaattgagacttcaagcatttgttccacactacatggaaagtaggtaccataattggaggccaagtaacatgacgatatatggcggtggtggaagacatgcaattgggtatgggaaagagtttagagttgagttcttccttgagaagaggatgcaaaacaatgaggtggggttcagcgcctatgcgccgccgttcaccacgcattcgttcgccatgaatcagaggatgctgaagctgaggtgcaagagcttggatagaaaaggtggtgggtgggttgttgcagtgttggaagcaccaccatcgcccaatgttgcaccttctggttattacttgctcactgttgtgaatggtgggattccaagcatgtctcaatgggttcagtttgcacacgcctag

SEQ ID NO: 70088 - DNA, 528 bp, Glycine max
  Peptide Sequence Number=SeqID_186866
atggataaagatgctaattcagaaatccaactccctcctggatttagattccacccttttgatgaggagctaattgttcactatctgagaaacaaagtgacatcatcaccccttcctgcttcattcatagcagaaatagatctttacaactataatccatgggagctcccaagcaaagctttgtttggggaggatgagtggtatttctttactccaagagatatgaagtatcccaagggagtgaggcctaatagagcagctgcttctagttattggaaggctactgggactaacaaacccattttcacttcctgtgggatgaagagcattgctgtcaacaaggcactcgtgttctacaagggtcgtccaccaaagggatcgaaaaccgactggatcatgcatgagtatagattgcatgattccatgatctccaattcaaagcaaggagggtccatgagagtaggccaatttcatgagttcaatttttcaatttggtggtttttaatgaccaatagagtaaattattga

SEQ ID NO: 70089 - DNA, 492 bp, Glycine max
  Peptide Sequence Number=SeqID_186867
atgatttctatacaaaagaagacaaagattatgaagaagttctcggaggacaagagtgaagactttaagttcaaatctctaacttcctctggaaggattatccattggatttgcatgtactctatgctgcctcgagttggaacttttcaaaagataaataaccatgatcctctggttatttgctgccttttgaagaaggttcccttcagctcgcctcatttgatcattaattacatgatcaaggcaacccagcctatgaaatccacctttagtgttctttatggaatgctaatgaccctgggtgagaagaatgttgctacatcaaagttaattccacacccaggtttgaagaaggcttgtagatgctttgatgaagaggaagaacaaaacaaggagaagaagaggaataaaaagaatgaaaaggaagaaaaagaaagaaaagacacaaagaggtcaccacaactccttactaacttcatcaaaagtggctaa

SEQ ID NO: 70090 - DNA, 117 bp, Glycine max
  Peptide Sequence Number=SeqID_186868
atggcaaagcaatacctgggcaccaaaattcttgaaatagatagacataagaggagtatgccaaacctctctccctgcgaaggggttcatttgcatgtccacccgttgagacattaa

SEQ ID NO: 70091 - DNA, 612 bp, Glycine max
  Peptide Sequence Number=SeqID_186869
gcctttgtcagtcctacagggtgcccgttccccccagcaaggtcacgccatcaagacatagggattgtgcccacaagacacccagtggacccgaaggagcccaacagggccctagggtttccagctctggttacgggcctctctgtcagtactacagggtgctcgttccccccagcaaggtcacgccatcatgacataggggtagcgcccacaagacacccagtggacccggaggagcccaacagggccctagggtttccagctctggttacgggcctctttcaatcctacagggtgcccgtccccctagcaagttcatgtcatcgtgacattgggatcatgcccgcaagatactctatggacccgaagaagtccaacagggtcttggagttgccagctctgattatgggcctctgtcggttctacggggtgcctattgcccccagcaaggtcatcaggccccctactaatcgagctttcatcaagaagtactgcgcccccaggcaggtgcaaggcgaaacaccccagcagcctggggacggccggcagtgggcaacagacgcaccgccaccccctctagagttcacctcagctcatccacaaaaaggttag

SEQ ID NO: 70092 - DNA, 545 bp, Glycine max
  Peptide Sequence Number=SeqID_186870
atgcaaacatcaaaccgaaatgaacatcccatcgctaacgaagatcccattatacgatttcatgatgaaaacatggaggattttagtgaggatgagaatcaacagttctttgatcacatcaataaggatagcgatgaccaaagcgatgacgagggtgttggcagaccaacgacacctctgtcacctccattgcagtatctccaacctaggtgtccagtagacttgaacattgaccacctaccacattacattgatcgacaccattttgttcagcaacaacataatgtacaaccaccaataggtgcactcgagagcttaggcgcatgcaattcaaagaggcataacaaatggattatcaagagtatcagaggtcatcacatttgtctcgtgccaatgctcgaacaagatcattggcaactcgacaaacacatcatagcacaaatcatccaaccaattgtcaaaacaaacccaaccgtctccatcaagacgttgattgcagagatcaaaatattcatgaattataccccatcctacaagaagacatg

SEQ ID NO: 70093 - DNA, 1101 bp, Glycine max
  Peptide Sequence Number=SeqID_186871
atggtcaagcggtttcctaaacaaaaggtagccttaaaaatctgccaggacgacaagattcagaggcaattagccaaagaaaaagctcaaacaaagagggatttaggttccttctgtgaacaatttggcttgccagcctgtccaaaacaaaagaaaaaacaaacctccaggaaagaagcccaggatcataagccagccaatagaagaagattttcaaaacgaagatactctcaaaaaccctcaaccagtagagaaatggaaaatcctaaacaaaaaataaaattaaaaataacgtgctacaattgtggaaaacaaggccacattagcaaatattgtagactaaaaaagaagttaagaaaccttaacctagaaccctcaattgaagagcaaataaacaatttgctcatagaaacctcgaaggaggaaacagaaacagaaacttcatcctctgtgctttccgatgaaaacctaaatctaatccagcaagatgaccaactatcatcaacaaatgatgatgggcaaatcaatactctaacgagagaacaagagctcttgtttgaagcaatcaattccatacctgacccccaggaaaagaaggttttcctggaaaaactcaagaaaacattagaggtaaaacctagacaaaaggattttatcacgaacaacaaatttgataaattcatcagatcattctttccgggaaaaataaaatgggatgaagtaactcttcccgaaagatgggttatggataaggcaacaccgtctattccccgacccgctccaaccatagagcatattaagcaagataactccggaaaggtagagataaccttcaataggagaaattctttttcatcaaggatagaagcctctaggtctgaatatgagtcagccagaaggtctttttcggttagaacccgttcaattccagtaggactaaccagatctgagtcacataaccagttccctactgtaaacctccaaggattagacactacttctagcatacctagaacaacttacaaccaagaacaggaggatgaccaaaagtcgatccaatccccaacatactcttctatggaaccttatgatgttatttga

SEQ ID NO: 70094 - DNA, 888 bp, Glycine max
  Peptide Sequence Number=SeqID_186872
atggacaaaagcaaggaggttgcaactcctatgactactaattgctaccttagtgcaaatggaaagggaaagtcaatggatcaaataaagtttaaaggtgttgagatttctcttgtaggatactcagattcaaactttgtcggatgtaagctagataggaaaagcactaatggcactttccatttgttagaacacattccttttagatgtgaaaacactagtgctattagtctcactaagaatcctatcatgcattctaggataaagcatatagagattagggatcatattcgcaaagaacttcttgagtaccatgggttgaaaaagctagtggagatgaaaggcacattctatcttgaattggtaatatttttctacaccattggtcacattgatggtgagttttgttatctatgtgatgaagcgaaggggaagcagattgtaatgacccatgagatttgggaagacattgttggtttgtctttagaaaggatgatggtcaatgagaaaggtcttaaggatgctgggggaaattcaataaggcaagggaaaggaaagattttgcacatgctccttggaaaggtgaagcttaacttggtcaatgttatggtggacaacatgatgaaggccaagaggattggatccttcaagtgcccttatacagtgctgatatctaggatccttgatcatttaaagccagagtttgaggtgaagaccaaggttcttaagcagatgagctacactgaagttgataaagaaggaatggacaaactcatgaggatgcacaaggaagactatggagagctgaaggcattctttgagactatctcagagagactaggtgatggaagcttgcttgtggggcttctatggaggctggatctttga

SEQ ID NO: 70095 - DNA, 300 bp, Glycine max
  Peptide Sequence Number=SeqID_186873
atggatgtggttgagaggctaccaccaccaagggatgaaaaggcagttataagttttttagggcatgctagattttacaggaggttcatcaatgacttctcaaagattgctagaccccttatcaatttgttagccaaagatttccccttccatctcaatagtgactgcctaaaagcttttgagtttcttaaagggaagttgatgacatcccttatcatcttagctctaaactatggcaaagagtttgagttgattcatgatgccaaaggttatgcaatgagatttgtgttacgacagtag

SEQ ID NO: 70096 - DNA, 339 bp, Glycine max
  Peptide Sequence Number=SeqID_186874
atgaccacttccggaagaaggtcttccggaagttacgaaggccaattccgggcgtcttccggaagtggtgaaggccaattccggaagaagttcttccggaaactacttccggaagaccttcttccggaatgtgtagtaaatttttggatgtggttatatgataatttgaatgtacttgtgtatgatgcatatgtccttaagatggacgaagatcaatggaggtatgactttgcgatgtcacaagaagttcatatggattatgattatgataatcaagaagaatgtggagtgaatgaaccacatgtcgattgttcaaatgcttttaatacatctcagtaa

SEQ ID NO: 70097 - DNA, 334 bp, Glycine max
  Peptide Sequence Number=SeqID_186875
ccctatgctcggtctatgtgagccatagggagtggaggtcgatctatggtcatgctgggtctctgactcgcttgatgatagtgaagcctcatctaaagtttttctcttttggtgatgcattgtcgttggtagtccctatcgccgcagtgttgttacctaagaggatgatatctctagaggccgttggcaccaaccacagaggagttcaaggggatcttaggatgcccgataggaggaaggaagccatacctcttttatgggtactacctttctatggcaagagtggtgggagtagtcaagatcttggagcgagagttagatcaagtgaagcaga

SEQ ID NO: 70098 - DNA, 177 bp, Glycine max
  Peptide Sequence Number=SeqID_186876
atgacgccactggtgcagggcccatcgatgcaagaccgccacaggggcgacggtggcatggcggcatggaggaggcacggttgcgcaaacgaaacaagaaagaagaagcaaaggaacctcgccggcggccaagttgcccaccggcgagatagaaaggaacgaagcaacagatcatga

SEQ ID NO: 70099 - DNA, 303 bp, Glycine max
  Peptide Sequence Number=SeqID_186877
atgaagttagaagaattggttcaagaagattctcgaatagatcgctatccaaagttggtgaagggtgaatcaaaagtggtatgggaatggcaagtagaaggttctctgagcgcctcaaagatgaagaaaagaagagatgcaagcaaaacgatggtcaatgaaagcacggacctgaatcatcaacagcaccctgcaatgaaaacagtaaaattgttttgtcgtgccatcaatttgatgcagagcctacggtaccacttttttgatctggagactcctcccaacagtgactactttcccttgtaa

SEQ ID NO: 70100 - DNA, 747 bp, Glycine max
  Peptide Sequence Number=SeqID_186878
atgacctattctcttttccatgtctcttacctttgtatcgctaacttgagcattagagcatctttcgtaggtagcatcaccatgcatagaggaaacatgaagggatacataaaagcaatgtcttataacaagggttcgtcctattttgataagaacaagaataggacggcatgggtcctcctccatgcagctcacgccgtccaccaacaccacccgagccttcaacgaagcgacgcagtgctcgtcgtcgccgtagaagcagaggcagaggaagacgcagcgcacagagagctcgaaggcggcaccatcgaagaagaggttctgctagcggcattggcgtcagtgatacgcaacttgacttcgacctccattggggaagagacgagggagagtgcagttaggattttacgaggagagaccaatgcgatgggccttggaagagggatcttcgccatcgcgatccagctgacggaggagagcagcggtgccagcgggggcggtggtggtggtggcggaggcattgcagcggcgagcttcctcgagttcttctttgtcttcaatcttgactttgatttcaattggctttcttctcagcattttgtaactatgatgctcatttctctttctacgccaatttcgattttggatttggttggagatgttggttgttcaatctacattaaacgttactataatgctagaattaatcagtttgttatcagttatcagatgacaggacttcattaa

SEQ ID NO: 70101 - DNA, 1017 bp, Glycine max
  Peptide Sequence Number=SeqID_186879
atgaagcagaatgatcggccaagggagtgtttgtctaattcgaattctgaaggttgttctttgtcattgatgggaagagaaccccctcagaatttgttaccttccaaacacgacttccctagactggttctcgtgattgcactcgcatcgctagttgcttggacctgcaacttcctctttacctctctctttcatcccccttccaaacccttctgcgacacaaacctccactctcccgattactttctcgatatttgtcaaccttgtccaagtaatggagaatgcaatgatggcaagttggaatgtcatcagggttaccaaaggcatgggaacttgtgtgcagaagatggagatattaatgaatcagctcgaaaacttctggagagagtggaacatcacctctgtgaaaaatatgctcaatttttgtgcactggaactggaataatttgggttcatgaggatgatttatggaattattttgagccagtgggaaatgtcaaagtggacaatgctctttataattatacaaaacaaagggcagttgagacaatgggcaaattattggagacgaggttaaacagctctcatgggtatatcctcttctcttgctttttgatcaagatgaaggagttcaagtgtccagatcagctggcagagcattacaagccatatacctgctgcattcgtcagtggatctcacagcatattctagttgttttgcccatttgtgccatgcttgttggatgcacagctttgtgctggaatgtacgacagaagctaagcatgtcaagacgagttgaggagctttacgacaaggtctgtgaaatacttgaagacaatgcattgacgtcaaagagtgcaaatggtgaatgtgaaccctgggttgttgcttctaggttacgcgatcacctgcttttgccaagagagcggaagaaccctttattatggaaaaagttgactccatgcctcagttggacttctgctgaagttacccttgttcatgagctgattttataa

SEQ ID NO: 70102 - DNA, 390 bp, Glycine max
  Peptide Sequence Number=SeqID_186880
atgtcggcagcgcaggtagatccacatgacaaaatgagagccagagacgtgaacaaagtggctcggggtgaacaagctccaaggccagctcatgaatttggcaccgtttctccaccccctcctccctcttcaacccacagtattgataccaagaggaacaaaaaggatgaaaagccaagcatagctgaaaacggtgcagaattagcaaacagtactgattataaaacgcgtcaatgttatgtaaaatatgtggaatgcattcagcagaagggcgaaaaggcaaccgattgcgagaaacttggcacgcattttaggtccttctgtccaaccgaatggattgctgaatgggataaagaaagagaagaggggaaattccctgcagaaatatag

SEQ ID NO: 70103 - DNA, 513 bp, Glycine max
  Peptide Sequence Number=SeqID_186881
atgacgattctgtcagcagaaaacctccaaatgaatagaaaatccattagagggagtacatttgtgacggttcaatccgacgctagtagcgatgacacaagtgctgccacgaaagtggatttagagggtggaagttacccttcgtggaatgagaaagttgtgatggacgtgccattgcatgcaaggttcataaccgttgaagtgaagtgcaaaacgtcttcatcagggtctaacagtgttggcgtggcacaaataccggtttctgatttcattggaggctatatgcccgaaaatcaattgcatttcttgagctataggttgtgggacggtaaagttaggagaaatggggttataaacatttcggtgagggtgaaagtggcagaacattcttcttgtaatttgaattctatgtcattgtctgcggtaaccggggtgccggtggccggtgatggctcctctggagttgtcacagggattccagctgtttgggtaaactaccaaagaaatcattga

SEQ ID NO: 70104 - DNA, 1563 bp, Glycine max
  Peptide Sequence Number=SeqID_186882
atggcatcagtgttcttgggtgatcagtctgtgggaaaaccagcatcatcactcgcttcatgtatgacaaatttgacaacacttatcagggacacagctggacaggaaagatttagaagtcttattccaagctacattagggactcatctgttgctgtgcgcattgagagaggcagtgatgctattattgttcatgttgggaacaaaactgaccttgtcaataagaggcaagtctctacagaggaaggggaagctaagtctcgtgaactgaacgtcatgtttattgaagctagtgccaaagctgggtttaatataaaggacattttatgcgaaaattttttagaacacttaaacttaatcgtgccgcactgctccgccacgattgcagccgcgacaaccgctcccttaaactgctccgcaacaaggctagtcgtcgcgctggaggacaaggctactgtgattaaacatacggaagcttttactcagaggtgtatatctagatggtccgttacactctacgctcgttactctgatattcctcagaacaagtctaagcttgctcctttgcagagaagaatggtggaccagtgtaaaatgtttgcaaaagcaggtgatggaggtaatggttgttctatcttgcgcaagggaagatctgatgaaatgtggatgctgtgcaacggaggttatgacaatgctactttggtgtctgtgtttaacgtaggtggcaatggggggagaggtggtgatgtgattctgttaaccgcgtgtgtatcgattggcactgtacttcatctcgttaatggtgatattccatctgttgtcaaaactcaatcctcaacagatgtagacccttgggatattcccggagcacttgttgatgatgttcctgaccctagcaatggttctacctccagtgttacaaatgaagaaacagatgttaagaaatctgaaaaatcaagacaagttgcatcaacagatgtattttctcaactttccacttctaatggagctcctgaatttggaacagaggatataggagagaaacaagagatactatacaatgttgctgagttaacagaagaaggtcaacaaattgtcattgctcatggaggagagggtggtctgggcaatgtgtcttgttccaaagattcaaggaagcctgtgactgttcaggaccctgacactttgtcggctaatgctggtaaaagcactttacttggggctatatcaagggctaagcctgctgttggtgactatgccttcactactcttaggccaaatttggggaatctagactatgatgatctctcaataactgtggctgatattcctggacttataaaaggtgcacaccaaaatcatggactcggacatgcatttctgggcaacacaaaatgcacaaagggaattccaccatgggaacagctgagaaacttaattctagagctagagtaccatcaggacggtttatccaatcggccatccttgatagttgcaaataagactgatgaggaagggatagcagatcttaaagctggtcttaaagatgctcgtcaatgctga

SEQ ID NO: 70105 - DNA, 756 bp, Glycine max
  Peptide Sequence Number=SeqID_186883
atggcgctttatcttttctgtcgtctttttgctatcaccttaattttcatgcaaactctggcggatacttcatgcactgattgtttcattcattctcgggcagcatattatccaaattctgaagaacacggaacggatgtaggtgcatgtgggtttggttcctttggggctacagtcaatggtggagatgtctcagctgcatcttctctttatcgaaatggtgttggctgtggtgcctgttaccaggtgaggtgtaccaacagtgcctattgctcagaaaatggtgtaaatgcagttataaccgaccaaggttcaagtgataacactgatttcattcttagcaaacatgcctttagccggatggctcaaaccactgatgcagctgcttctctattagcccttggtgtggttgatattgaatatagacgcttcccagataaaaacataacaatcaagatagatgagagcagcaacaacccttattacttggcttttgtcatttggtatcaacaaggaaggagagacataactgctgtgcagctctgtgagactcaaaactttgtgtgcaagttactggataggagccatggagcggtgtggactactacctctccaccaagaggacctttgtctttaaggatgttgtttagtgatgaagaagaggaagaagaaacatggcttgttcctgttaataacatacccggagactggaaggctggtgaaacatacgattcagggatacaagtgaaccaatag

SEQ ID NO: 70106 - DNA, 1482 bp, Glycine max
  Peptide Sequence Number=SeqID_186884
atgacaatactactagctgttcgtgattttccggatggatgtggagcatttccgaaatttgttgaggatattaagaataagaatgatcaacatttagcaagaaggtatcttcctccacgaaaagcttcagctgtcagagacttccttcctttatttggagcatgcaatgacatggatgtgtgtcaagaagaggggaagaaagtgggtctacaaaacctcgctgtagatgacaacaatcaattgaaaaaagtatcagcagctgatgatgtaaaagaagaagttaagagtaacattcaagatgactatagtcgcaagagaaatattgtggacttctatcaaaatcaaactgattctgaaaggaatgttactgagggactgaaggagctgcgtgcatttgaagaaccatcttctcagatgaaaatggcgccggaaaaaaagaaattttatagattgcaggtctcatcatcagacatgaaagtggtacttggtttcatggttaaatcagaatgtccttggaggtctggtcaagtttcctcccactttaagttgggagatgctaaaaatgaagacaagagaaagaaagtggtttcttttgcattgcctgacaggtctagaagagctatcaagactaaatgtaattttgggcagaagcctttcaaaaagaaggcaaattctgcttctgaaggtatgggtgaattagaaatttggggaaaggagggctggcttgaccctgttgaaaatagtgaagaatcacatgagttcgatgtaaatgttactccctcttctcattctaatttcactggtggtgatgagagtgactcggatgtgacccgagaaaaagtgagggaagcattacggttgtttcaagttgtttgtagaagtcttttagaggaaggagaatcaaagtcaaatgaactagggaaaagaaagagggttgatttaattgctgcaaggattcttaaggacaatgggattcatgttaactcaggcaagaagatactgggccctgtacctggggttgaagttggtgatgagtttcaatatcgggtggagcttaatataattggccttcatcttcagattcagggtggcatagattatgtgaagcacaatggtaagatccttgcgactagtattgttgcttcaggtggctatgctgattatttggtcaattcggatgtcttggtatattcagggcagggtgggaatgtgatgagcaatgacaaaaaacctgaagatcagaagctcaagcggggcaatcttgctttgaagaacagtagtgaggaaaagaatcctgttagggtgattcgcggctctgaatcaatggatgataaatacaagacatatgtatatgatgggctgtatgtggtcgagtcatattggcaggacagaggatcacatgggaagctggtttataggtttcgccttaaaagaattcctggtcaaaagcttgctttgaaggaagtgaagaaatctaaatag

SEQ ID NO: 70107 - DNA, 846 bp, Glycine max
  Peptide Sequence Number=SeqID_186885
atggaacaggtggagcaagacccagatttcataatgttatctcgtcaatttaaagcaactgccatggagcttatttctgttctggagcagatatcaatgttggattcagttgaccctaaagtgaggctttcaaaagcaacagaattggttgataggcacttacagtcaatacgtgtagctgaaaaaattacacaaaaggttgaaagacaattgtcaaaatctcaaaaagaatttcttcttcgacagcagatgagaactataaaagaggaacttggtgataatgatgatgacgaggatgacctggctgccctggaaagaaagattcaaagtgcaggaatgccagagaatatctggaagcatgctcacagagaattaaggagactcaaaaaaatgcagcctcagcaaccagggtataacagttcacgggcttacctggatcttcttgctgatttgccatggcagaaggccagcagagagcttgaactggacttaagagctgcacaggagcgcctggacactgatcactatggtttagtgaaggtcaagcaacagataatcgaatacctggctgttcgcaaggttttcaacaccctgttactatgcctcccgcttaagtcagatgcaaggggtccagtattgtgctttgttggaccacctggtgttgggaagacatcactggcatcttctattgctgctgctttgggcagattgaagttttcaagagtagctgtttgcaatcctgtcatgttgcttgatgaaattgacaagacagggtctgatgttcgtagagatccagcttcttcattgctagaggttcttgatccagaacaaaaacaaaacatttga

SEQ ID NO: 70108 - DNA, 273 bp, Glycine max
  Peptide Sequence Number=SeqID_186886
atgacgttgaggggtcttgtactacctgttggcgggttagaaaatcaggaatcgcgatcttgtgcttcaacgacgtcgttgaggagagtctgcgcagccttggagatgcaagtgcgagccatgaaggctcacgctgaccttctcaccgccggtgcaccgccgcccactccaattggtcttctccgtcctcataagaactgtccatatcttcggcgcaacccaacacctccaccatcatcaaccctccgcgcgacccagaaccaaccttggtga

SEQ ID NO: 70109 - DNA, 7644 bp, Glycine max
  Peptide Sequence Number=SeqID_186887
acagggtttaatctcacagcagctagctcggaggctataatatacatgggaaatgggaagaagttgcaattcagaaatgttgttattaaggttggacagcatttggattcttgtgtttttcttggagcaaacagtagctattcagctttagaggatgatcatgtctacttggaagaattagttgaaagccctcagtctaggtctttgagaggaagtgtggatgaattaccatctcagaatagtgcagttaacaactccacagaattgatcattgagcttcaggctgttggcccagagcttaccttttataacacatcaaaagatgtaggagggttattaaacctgtctaataaacttctacttgcacagttggatgcattttgcaggcttgttttgaagggtagcaatactgagatgagtgcagatgtacttggtttgactatggagagtaatggaatcaggattttggagccatttgatacatccttgaagtactcgaatgcttcggggaggaccaatatacatttatctgtttccgatattttcatgaatttcactttcagtatcttgagactatttatggctgtggaagatgatattttagcatttttaaggatgacatcaaagaaaatgacaattgtttgttctcactttgacaaagttggaacaataaaaaattctcatactgatcaaacatatgccttttggaggcctcatgctcctcctggttttgctgtacttggtgactatctgaccccactagacaagccaccaacaaaaggagtgcttgccgtaaatatcaattctgtaacagttaagagacctattagtttcagattggtttggcaacttttaacttctgtgggcattgaaggtgaagaagtgaacaattctgacttgttatggaaaactgaggcagatgccatttgttccatttggttccctgaagctcccaaaggttatgttgcactaggctgtattgttactcatggaaagacacctcccccactatcttcttccttttgcatcccgtcttcttctgtatctccatgttctttaagggattgtatcacaattggctctactgatatatccccatccagtgtggcattctggcgagtggataattctgttggcactttcttgccagtagatcctgtttctcttagtttgatgggtaaagcatatgaattgcgttgcattaaatatgattttttgaagccatcctcagcagcattaagtagtctggattcccatgctccttctggtgggcatcaagccttgcaacctgaccagtctgttggtgcaaattctaatagacgctgtgagcctgttgctagctttgagttagtatggtggaatcagggatcaaactcgagaaagaggttatccatatggcgtccagttgtcccaatgggaatggtatattttggtgatatagctgttaaagggtttgaacctccaaacacctgcattgttgttcatgattccagagacgaaaatatttttaaaactccactagattttcagcttgttggacaaataaaaaagcagaggggaatggaaagtatgtcattctggcttccgcaagctcctcctggttttgtttccttgggttgtgttgtatgtaaagggaaacctaagcaaaatgattttagcacattaagatgcatgcgaagtgatttagtagcaggagataaatttttggaagaaagtgtgtgggatacatctgatgccaagcatgtaactgaaccatttagtatatgggctgttggcaatgagttggggacttttattgttcgtggtggtttcaaaagacccccaagaaggtttgctttgaagcttgcagattctaatgtgccaagtggctcagatgctactgtcattgatgcaggaattgggactttctcgatggctctttttgatgattacagtggattgcttttggaagagttagttgtttacaaggtattagagcctccatggaaggcgagccctggtgcagcggtaaagttgtgccttggtgacttgttggtcatgggttcgaatccggaaacagcctctttgcatatgcaaggaactgggtatctaaattgcactgttggtttctccttggctgccaggtcatataatgataagtatgaagcctgggagcctcttgttgagccagtagatggattcttaaggcaacccgcaaagaggccacaactacaacgggctagggggtctgcagttaaggaggcttaccaacacttattaagatgtgggaatattggagctgtaaggatgggaattgttccttggagtagtaagattggacctttagatcaattgttccttggcgtagatgaagggatttatatactatattttggtcatatcactagtcgatgtgggatctccaacacagttattcaactgcactctcaggatgcattttctccaacttatggtggaaactctatcattgacacactccacaagaaaaattattatataatccctcaaaacaaacttggtcaggatatttttattcgtgttactgaagctcggggtctccaaaatataattcggatgccatctggggatatgaaggctgtgaaagttcctgtgtcgaaaaatatgctagaatctcatttgaagggtaaactctgtagaaagattagaacaatggttacaatcatcatagcagaagcacagtttccccaagttgaaggttcagattcccagcaatatacagtggctgtccgcctttattctaatcagagcctccctagtgattcatcggtttatcaacagagtgcacgcacacgtggacgaagggcacatcatttattgccttcagatcttgagttagtcaagtggaatgaaatatttttcttcaaagttgattccctggatgctttttctaagaagccttgcaaattacaatgtgccatactagtgcataattctgaagtcgagactaacaatcaactatctaattatgatgcccataaatctgggtttattcaaattagtccaagcaaggaaggtccttggacaactgtgaggctgaactatgctgcccctgctgcttgctggcggttaggcaatgctgttgttgccagcgaagctagtgtgaaggatggaaatagatatgtgaatattcgatcactggtttctgttcgtaacaacacggattttgtgcttgatttatgccttacttcaaaaagtttgtcagaaaaggggaatttgctgaaaaattcaattaattctgaatctattcatacagagagctacagaattcagacagatgagttttttgaaactgaaaagttaactccacacattggttgggtacactgttcaggttattctgagaaccaaatgtcagacaggggaaaatctcatcaggtttttcctggaattgatctaccgccaggttgggaatggattgatgattggcatttggatacaaaatctcccaatacttctgatggatggatttatgctcctgatgtggagagtttgagatggcctgaatcctttgatccaaaggtatctcttaattctgccaggcaaagaagatggctaagaaacaggaagctaatagcagaggatcttaagcatgaaatatcagttgggcaactgcaaccaggagaaactgctccacttcctctatctggtttgacacaatctgtacaatatttcttgcagttaaggccctcagaaaactcttgtgagtactcatggagtagtgtagtggacagacctaggcagccagaagaaattggtaggggaggtcaatgctcaaatctgtgtgtttcagctctttcagagtcagaggaacttttgtgttgcagtgaggtgcatggaacctctggtggctcccacaagttgtggttttgtgtaagcatacaagcaactgagattgctaaagacatccattctgatgccattcaggattggtgtttggtggtcaaatcacctctaataataagcaattttcttccccttgctgctgaatattctgttcttgaaatgcaatcaagtggccattttcttgcatgctcaagaggagtatttttatctggaaaaactgtacatatatacagtgctgatattaggaatcctttgtttttatctttgcttccacaaaggggttggcttcccatacatgaagctgttcttatatctcatcctcatgagaatccatcaaaaacaattagtttgagaagttcaatatctggaagggtgatccaaataattcttgagcagaactataacaaagagcacaccttgctggctaaaacaattagagtctatgctccttattggttggaagtagctagatgtcctccacttacatttagacttcttgatatgtcaggaaaaagacatatgccaaaggttgctgctcaatttcagactaacaagaaaaatggattaatccttgaagaaataactgaagaggaaatatatggtggttacacaattgcatctgcttttaactttaatatcctagccctttcagtggctattgcccaatcaggaaatgagcattttggacctgttacagatcttgctcctcttggtgatatggatggctctttggatatatatgcatatgatggcgatggaaattgcttgcggcttattatttctacaaaaccatgcccctatcaatctgttccgacaaaggtaatttctgttcggccatttatgactttcactaatagacttggtcaagatatattcctcaaattgagcactgaagacgaaccaaaggttttgcgtgcttctgattcaagggtatactttgtgtgtcgtggaactggtggacctgaaaaactccaggtaagactagaaggtaccacttggtcatttcctcttcaaattgtaaaagaggatacaatctcccttgttttgaggatgaatgatggcactatcaaatttttgagaactgaaatccgtggatatgaagaaggatcccgttttatcgtggtattccgtcttggatcaactgatggtcctatcaggattgagaacagaacgacaaacaaggtgtttagcattcgacagtctggatttggtgaagatgtttggattcatttgcaaccactgtcgaccgccaacttttcttgggaagatccatatgggaataagtttttagatgctaaacttagtgatgatgatagcaacacaatttggaaacttgatttggaaaggactggattatcttctgcagaatttggattgcaattccatgtgatagatagaggagatataataattgcaaagtttaccaatgatgggatgccgagttcaagttcgtatgaagagattagaggcccaatgtcttctggaaaagggggagtttctggtgttcaggctgaaatgcagagcagtgttactccttttgagctcttaattgagttaggggtggttggaatttctatggcggaccatagatcaaaggagctctcatacttgtacttggaaagggttttcttaacatattcaactggctacgatggtggaaagacaagcaggttcaagctcatatttggttatttgcaactggacaaccagcttcctctaacattgatgcctgtgctcttggcgccagagcagacctctgatgtgcaacacccagttttcaagatgacaatcaccatgcagaatgagaataaagatggaattcaagtaactgacaaatgctggaggcttgagattcatgaacctattatttgggctatcatggacttctacaacaatctgcagctagatcgcttacctaaaagttcaactgtcacagaagttgatccagagatacgttttgacctaatagatgtttcagaagtaaggttgaagtttgcactggagacagctcctgggcaaagacctcatgggatcctgggcatatggagtcctatactttcagctgttggaaatgccttcaagatccaggtgcatctgaggagggtgatgcacagagacagattcatgcggaaaagttcaattgttccagccattggaaatcgtgtttggagagatttgattcataatcctttacatttaatattttcggttgatgtactaggtatgacaagttcaacattggcttctattagcagagggtttgctgagctatccacggatggacaatttctacaattacgtgcaaagcaggtaagatcaaggagaatcactggggttggggatgggttcattcaaggaacagaagctcttgcccaaggtgttgcctttggtgtctctggtgttgtgagaaagcccgttgagagtgcccgacagaatggtatcctaggattggctcatgggcttggacgtgcctttttaggtttcattgtgcaaccagtaagcggggcacttgattttttctcattgactgttgatggaattggtgcaagttgttccaaatgctttgaggttttcaacaacaagactgcattccacagaattagaaatcctcgggctgtacattctgatgggatactaagagaatattgtgagagagaagctattgggcagatggtgctttaccttggagaggcaagccaacaatttggctgtgctgagattttcaaggagccttcaaaatttgcgttgtctgattattatgaagagcattttactgtgcctcatcagagaattgttttagtaaccaataaacgagtcatgcttcttcagtgtcttgctcccgacaagatggataaaaaagcatgcaagattatttgggacgtaccttgggatgagttgatggcactggagttggcaaaagcaggcagttcccaaccttctttcttgatcctccatctgaaacatttccggagatctgaaaattttgtgcgagtgataaaatgcaatagtgtggaagtgtttgaaggaagagaaccccaagctattaagatatgttcagtggtgcgtagagcatggaagacatatcagtctaacatgaaaaacttgattctgaagagacaagtgcatttttcctggactgaagttgatagtagagaaccacgaatccccaataaggccattattagttctagggagatttcatcaaacagtactgcatctgatgatagacgatttgtgagacacatcattactttttcaaagatctggagcagcgaacaagaatacaacggtcgatgctcgttatgcagcagaaaacagatctcgcaagatggcagaatatgtagcatttggaggcctgtgtgtcctgttggatatatatatattggggatattgctcgtgttggtatccatcctccaaatgttgctgctgtctaccgcaagattgatggattttttgctctcccgatgggatatgacctggtgtggcgaaattgtccggaagattatgttactccattatcaatttggcacccacgggcaccagatggatttgtggctcccggatgtgttgccattgctggttatttggaaccagagcctgatcttgtttactgtatcgcggagtcacttgttgaggaaacagaatttgaagagttgaagtacagagtgatgctttgcattttgttgctctacgacaaagcaaggaagaatccgactggaagccaaagagggtcagctccaaagaatgtgcgtgtgccatctccgaaagaagacagtaat

SEQ ID NO: 70110 - DNA, 438 bp, Glycine max
  Peptide Sequence Number=SeqID_186888
atgattttggagttcacatcatttagcaacgatgatgaagactatgaaggttatgattttagtctttttggtgagctttcagaagtgcgcattgtctatttgaatcgatttgtgcaggaggttgttggttattttatgggtcttgttccagacagcccaaaaagtgtcgtaaaagtaacagatcaagtgacaaatacagagaagtggttttcagctagtgaaattgaaggatctcctgctgtaaagtttgatctttctctcaagaagcctataatattaatgccgcggaagacagatagtcttgattttttgaagcttgacattgttcatataactgtgaagaacacatttcagtggattggtggaagtaaaagtgaaatcaatgcagtgcacttggaaactttgacagtccaggtgaggttgaagacatcaacttaa

SEQ ID NO: 70111 - DNA, 463 bp, Glycine max
  Peptide Sequence Number=SeqID_186889
atgagtcttcattcttcatctagtgttaatggtgagggttctactcctaaggaccccttagggtgtcatagttcacatactaaacaccattcccatagaagagaaaaggatagaaggcctcaagaggttaacattagcctcgcattactagggaggattgcatcacaagggagtatgagtgttgaagaatatagacaacaaatggaactactccttttaagagctagacttagagaggaggaaagaacaagcatagctaggttccttagtgggcttaatatagaagtgagggacaaggttgaactctttccatatagggacctagatgagctagtccaattttgtataagagtggagcaacaacttaatagaaagccttcaaaatcttatggctttcactcttatccaaggaaggaccaagcccacgaaattttgggggatgcaccttcaaaacccaaggaag

SEQ ID NO: 70112 - DNA, 346 bp, Glycine max
  Peptide Sequence Number=SeqID_186890
atgggggagacacatgaagcaccccaccacaatctagttgacttcgagccttgtcacggacacgccactaaggggcaagcagttggtggtgtacccctgccaaacactttggagggccctcagtttcgcccacaacccttgtattttgcggtgagaagaatccctcctgttattgcggaaaagggaaaattggatcatatagaggaaaggcttagggccattgaaaatgtactatcggaagatgggggcgcgaggctcacgggtgcactttccaaaggaggaaagatgcgcggagtcgccaccaacgcttatttgtggaaatcgtcggaaaaaccaaaggaaaccg

SEQ ID NO: 70113 - DNA, 306 bp, Glycine max
  Peptide Sequence Number=SeqID_186891
atgtcttggatgaatattaaaagtgcccttccattaaacccaaaatgtcatttcctccaacactcatatgttcaggtggatggcataagggtaaagagatggcaatgttggtggttggctgtggtatggtccatatggcagatgcgcaacagaatcatattctctaatgctattttcaatggcaacaagctgatcgaggatgcaatgtttttaatcgggacttggctcagaaacttagagaaggacttctcactgcattttaatcactggtccagccatattagacagggttttttgtatcagtag

SEQ ID NO: 70114 - DNA, 276 bp, Glycine max
  Peptide Sequence Number=SeqID_186892
atgggtgaaactgagggccctccaaagtgtttggcaagggtacaccaccaactgcttgtgcctcagtggcgtatccgaggcaaggctcgaaggcggctagattttggtgaggtatttcatgtgcctccctcatgggttgagagacatgtcaatgatcagattgaggttattggctctcaatggacaaagaaatggtgtaactcaatccatctttcaccccaactttcgcaagttggttattcaacggccggcaagtgcaccggatcacacaagtag

SEQ ID NO: 70115 - DNA, 261 bp, Glycine max
  Peptide Sequence Number=SeqID_186893
atggagatggccttgagggcgtcggagaattcccttgcaaatggtgacttagggttcacgttgtgtagcagagagagagaacagagaaggttgcataagaatacagctcctatttctggtctatctgaaacctcatcagatcatgaggatactgaaccggaacaggataatcatggtatgattgatgtagggattgctgaaagattgtttgtaactggtgttcttgatgagttaaagatttgcttcagttatagttatcag

SEQ ID NO: 70116 - DNA, 864 bp, Glycine max
  Peptide Sequence Number=SeqID_186894
atgggtgccaaagaaagtgatggacaagctggtggggctacagaggcagttattgtagagcggaaactcagaccaaaagaagattgcttgggtgaattgggggatttggggaagtttaacttggctttactcgggaaatggcgctggaatttgttcaatcatcatggggagctgtgggcacaagttttggaatcaaagtttggggggtggaggaatttagatgcgacaagaaggtccatcagagaatctctttggtggcgagatcttggctatgcttgtaatctgtccgagaaagggagctggcttaaaaatgggacaaaatggaaagtaggatgtggatcaaaggtcttgttctgggaagatggatggatggaggatggggtctcgcttaaggagaagtatccaagactgtaccagatctctcaacaacaaaaccgacacatccagcaaatggggacaataacagatacaggttgggaatggaagcttcagtggaagaggttcttcttggaggctgaaatagacacggctgcaaaatttatgaaacacttacatcgtctgacgatacatgtgcagcaacaggacatgtgtagatgggagggagattcgagcgataagtatacaatggggagtgcttacgaattactcaataggaattttccgttggagagtctggatgaaatgtttaaagcactatgggagataaaagtcccaagtaaagcaacaattttcgcttggatattgatcagagaaagattgcctacaaagagtaacttaagaaggaggaatgtggaaactaatgacgtcacctgcgcattttgcagaagtcatgatgaggacaaggctcacttattcttcacttga

SEQ ID NO: 70117 - DNA, 978 bp, Glycine max
  Peptide Sequence Number=SeqID_186895
atgaggatggtgagaggtaaaggagaattttgggaatgttttatgaatcctgatattctgtcttgtagcaatccagggcacccatttgcagctggagttatgttggacaaactcttggctgtgacagtcgatgattctgggaaggagacttttattactggaggcgcactagatcgcattcaaaagtctgttgaacttgatcgacttgcagtttatttagattcagatattataccatggcatgttaacaaagcatgggaagatttgcttccttcagagtggtttcagatatttaaatttggcaccaaagatgggaagccagctgataatttgttaagaaagcactcgtaccttctgcaaccggtgactgggaaagcaaagtactccaagctgctgccaactgaagttgctgatagcaaacaacctttacagaaggctatggtgaatttggatgatgttacaattagcatatctaaggatggatatggtgatatcatgaaattagcagacaactttgctgcatttaatcaacgtctaaagtatgctcattatcgtccactggtgccagtaaaagctgattccaggtcttggtggaagtatgcgtacaaagctgtatctgaccagataaagaaggcaagcctaacagagttggttgtctatgtctcgaaaagggctatgtatgaaggggcttaccagaaagatcccactagatgggttctcatgcaatgggttgccctttacgatagggcaagccttgacacagtggtaaggttgctgtcttgtgacacggaggtcaagggttcaaatcggagaaacagcctctccacttgcaatggtgaagctgtgtatatctaccctccccagatcccactagatgggtcctcatgcaatgggttgccctttatgttgtgctgcagtcaaagcatgatgctcctttattctcttcgttgttttttcactaccaaatctcttatttag

SEQ ID NO: 70118 - DNA, 678 bp, Glycine max
  Peptide Sequence Number=SeqID_186896
atgcaggagaaaaagataaatgaaaagataagcatagacagtgcaataagagcgtacatagagactttaaatatagggaagctagtaaggttccaatctgctgaagcagctgggagaagggagtgttgcaagatttctgctttaaaccaattggcaggcgatgcaagactttctaacaagtgtgcaatgccagaggctgcctgtggctgcatgtacaagaaggtgaaagagagagaagatggtgggtggtggtgcaaggagaggagaagaaaggaaaaaataagagtacggggagcaccaccaccagaaatcgccggcggcagcgcacagcagccctcagtggaggttgaaaagggaggacttattgagaaagcacttcgagagagagcagagagtctcgtcgagcttgtcggcagcgagggcaacgcagcccacggtgtagacttcgttgattatgtgcagatctgcaatgtttcacctccggcagtggcgagatgccatggtgaagaggaatgcttggatgtgtggagagtgctggccacggaagtggatgcttgcttcaatgatgatgatgtttcaaccatagaagcggattcacagtggttgaagaaggaatttagcctaatgaaactgacgcaattaaatgtttccacggaactgacgcaattagatatataa

SEQ ID NO: 70119 - DNA, 906 bp, Glycine max
  Peptide Sequence Number=SeqID_186897
atgtcatgggagcaagttttaagatatgcaagcttgcggaagagatatatttctctctatgcttcactactcaaatcggaccccactcaggtgacaattagtggcaacaaagagattgaagatcttgatcgtgaacttgatattgaacttatactacaatggagaatgttgtctcacaagctgctggaaaaatcggcagagtcaaatcataacatgaggaaacagaaagcacagaaatcttggtggtcatttggatggaccagtcaatcttctaaagaggaaagtgaggaatttaatttcagtgaagaggactggaaccagttaaataaaataataggatataaggagggtgatgatgggcaattggctgtaaatagcaaggctgatgttattcatactttcctggaagttcacatgaatcataatgcttcaaagcttattggggaaaccaaagagtccgttgctgaattatcatgtgaagacctcagttgctcaataattctttatccagaaacaaaggtctttgacattaagttgggctcatataagttatcctcaccaaaaggtctccttgcagagagtgcaacttcctatgactcattagtcggtgtcttccattacaaaccttttgatgacaaggtggactggaggatggttgccaaagcttctccatgttacatgacttttactgatttgtctttggagtttggacagtacatgaaggacagcatagatcaaattgtgaaattctttgaaagtaatactgctgtaagtcagaccatagcactagaaactgcagctgctgtgcagaataagtgctctatagattctgaacttgaagagtacatcatgaaattgacgagttctctggtgcacccgattactcaaatgatggtggacctataa

SEQ ID NO: 70120 - DNA, 648 bp, Glycine max
  Peptide Sequence Number=SeqID_186898
atgacaattgatgaagtgaagcgcactgcacagcagcaaatgaacagagcattaaaggatcaggccaggttttcattagatttggatattgcagctcccaagattactattcctactgatttttgtccggacaatacccatgctacaaagcttttactggacctagggaacttgttgattcgtacacaggacaactatcaacaggaatcagctgaggataatatgtacctgcgatttgatttggtcttaagtgatgtatcagcatttttgtttgatggtgactatcactggagccaagtttctctgaataagtcggcccattctaccaacagtggtttcttcccaattattgacaagtgtggagtcatcttacaacttcaacaggttcgtttggagactccatattatccttcaacacgccttgctttgaagcttccatcattggcctttcatttttcacctgctcggtatcatcgactgatgcatgtaataaagatcttcgaggaggaggatggtgacagctctgagtttcttcgaccttggaatcaggccgaccttgaggggtggttttctcttctaacttggaaggtagtggtctctttcagaccctctaggttacctattgttgtccatgtagcgccatcataa

SEQ ID NO: 70121 - DNA, 381 bp, Glycine max
  Peptide Sequence Number=SeqID_186899
atggcgcacaaagaaccaaatacaaaatcaaaatcagatgaaaagacagaaatagaagatgactcagcgacaaagatgcttgagaccatgaaaatggtaaagaaaattaaggtaaaagacaaagcagcagtgattcgggacttcaacaatttggttccagcagagatgatggaagaagagaaacaaaaactagtcatgaagacggagcagtgggaagaggagtgtgtagtaacaacaatggagatccaggttgtacatagtgaacttgtattcctatcacaactgaaaccatcagacttgggcttcgtttggataatcatggacatagaaaggaaagaaataaaaaagaaagaaagaaagattggaattgacatgaattaa

SEQ ID NO: 70122 - DNA, 364 bp, Glycine max
  Peptide Sequence Number=SeqID_186900
atgccgtatccaaatgatgtcacatcaagcacatggaggagttgctgtagtacaaggagatcatgctctgagaatccgaagagaagcgaaacactgtttttgaaatcctcccatgttgccaagatgattaagtcctccaagcagaagagccccaggctctggcaaagctggttgaacaatgtcgtggaggccgaggtggtggagagcaacgacctcgtggccgacgccggtagagacatagatgatgcggcaggggtcaaagatgatgttcgtgagtgtgacactccctttcctattgaccttcttcctcacactctcccaagctcaatcacattccgatgctccactgctgccctcctccatc

SEQ ID NO: 70123 - DNA, 253 bp, Glycine max
  Peptide Sequence Number=SeqID_186901
atgggagggggaggaggtcaggctaggtggcgtcatcgtgtgtcactagcaagcggatatgtatatgagcaaaatatagtgacggttaaaaaccgtcactattccatcttgaggcggagtgatcatatacgccgcacgacgacgacgatcgcggcgattaagaaagacgaaaacgacgacgacggcgataagaagaaaaataaaaaagaggatacaaaaacttctcaaggaatgagtgattcggaacttgaag

SEQ ID NO: 70124 - DNA, 369 bp, Glycine max
  Peptide Sequence Number=SeqID_186902
atggtttcgtgtctaggactttgggttatggcactttctacaaccgaggtgttaggagccattcgattttctcgccgagatctgggagattttatgatgcaagattcgaagatcaccaaccccactttcttcaagcttgttctctttgcaagaagcgtctcggggataatagtgacatcttcatgggacacgcctttttgcagcgaagagtgtagacaagagcaaatggagagagacgaagccaaggagaagaataataacctttcttcttcgatgaaggctttgagaaaaaaagagcaaagaaattctgtctccccaaacaagacccaagattactcatttcgtgcagggacggttgctgctgcttag

SEQ ID NO: 70125 - DNA, 240 bp, Glycine max
  Peptide Sequence Number=SeqID_186903
atgtgttggtggggccaacgtgcttcgaggttagcgaaacgggacccgtttcgggcatgggtgacgttggggaactggagtgagaagcaaggttcagggaaaaagcggaaccgtgggtttcggtttcggagcgggaaaaaaagagtagcgatgcacgtacaattggacagttcgctggtttcacatttctcactcccactcaaggcgcgtgcgtcccaacacttctgtgtcttctcataa

SEQ ID NO: 70126 - DNA, 177 bp, Glycine max
  Peptide Sequence Number=SeqID_186904
atgaaggaaacgaacctaggccaggccaagcaaaagaaaacaactggtggtgttgaaccaatgtggcagacacgtagaaatgtggttccgggcaacaaccacatgaaatggcagtttcctattacatcactcgcacttgcagttccccaattcactcaagaaaacgaaggcctttaa

SEQ ID NO: 70127 - DNA, 192 bp, Glycine max
  Peptide Sequence Number=SeqID_186905
atggaaatggaacaaatggtgtttgtgtctgttgagaaagaagccaccggcaccaccatcatccttttctttgttttcaccaactttgccttaagagtagtgggtggtttctgccgccggaattgtttgtgtatggcccatgcgtctcgcgtcagctttgctttcttcacagcccttgttttgcctcaataa

SEQ ID NO: 70128 - DNA, 990 bp, Glycine max
  Peptide Sequence Number=SeqID_186906
atgggcgccgttcaagctcaatatccctccaatgtacttttcctaaacagcaaaaccgggcaagaagcacatgattattcattgcaatctccgccaggacaacaactccttgatcaatcccatatgctattcaacaacggaggtactaattctcgaaagagaggaagagaaacaacaacagcagcagctaccgggattgcgccaaacgttatcaactcattctctttacaatcccaatctccacaggcacaactcatagacctcactcaacttcataatcataatcaaaatgtagtctccaccgggttacgcttatcctttggcgaccaacaacaacaaagacagcaattacaacatcatcaacaacagcatgggtgtcactcctctcctttcatatctctattatccgaagaaggcttgtcttctcaaatcaaacaacagcgtgacgaaatagaccaattccttcaagcccatggggagcaattgcggcggacattagcggagaagaggcagagacattatcggacgctgctaagagcagcggaggaatcagtgttgcggaggctgagggagaaggaagcggaggtggagaaagccacgcgccgcaatgcggagttggaggcacgcgcggcgcagcttagcgtggaggcacagctttggcaggccaaggccaaggcgcaggaagcgacggcggcggcgttgcaggcgcagctgcaccaggctatgatgagcagcggcggcggtgaggacggtggtgggggagggctatcgtgcgccgggggcgaagcggaggatgctgagtcagcgtacgttgacccggagcgagtgggtcccactccgaaatgtagagggtgtgcgaaacgggtggcttcggtggtggtgttgccgtgtcgccacctatgcatctgcgccgaatgcgacgggcattttcgggcttgccctgtttgcctcaccgttaaaaattcaaccatccaagtctatctatcttag

SEQ ID NO: 70129 - DNA, 330 bp, Glycine max
  Peptide Sequence Number=SeqID_186907
atgagtgtcgcaacctacccttcgatgggaggacgaggcaaaaagccaaaggtgcatcttccaaagaggaaaatgcatggagtcaccaccaatgtttatttgagggaaaacgttagagaaactaaaaaaagaaggtttgcgaaacttgagaagaaaggttctggagttgtttatgcatggggaagagagaagaccggtagactctgtagtgaggatagtagaccagatggagagaaggaaaacaattcgaggcagaggaagacccaaaaagactataagagaggaattaatgaaacattgggcttaatccggattttggttgtggactga

SEQ ID NO: 70130 - DNA, 153 bp, Glycine max
  Peptide Sequence Number=SeqID_186908
atggccatgaccattgttgagcagagtggaggccagtaccatgttttggtgataatcgcagatggccaggtaacaaaaaatgttgacaccaaacatggaaaactaagttcacaggaacagaagactgtggatgccattgttgcagctaggtag

SEQ ID NO: 70131 - DNA, 642 bp, Glycine max
  Peptide Sequence Number=SeqID_186909
atgatggcttcaaggaaatgttgcactggacctggccaaccactgggagggtattccacctgggattccttctggttcgctttagagaccacatgggtccggctgcaagggcgaaccatccgattcaacactgaggcattgcatgagtttcttgggaccccagtcatcgtgctggagaaggagcatcttacctcctacccccagtacctccacacgtatcctaatcgtgaggccattgcagtcgagctatgcacaccaggggcgattcatgttgaacgccgagggagtttcatggaagattctgcggaaggacttcaccaccttggcctagacctagagcgtgttgtcctactccaacttcgctcagacctcccacacatttctagggccaaggtaggcccaggtctgagctactcaaggcgcaccaccaccatcggtcgtcctgccttctgccacatctacttctacctgcccttcttcttcctcctcttcctagtaggagcatctcttctagatgatgcagagcctcatggtcagcgcctcatcatccagaacctgcatcagttcttcctccaccattctatggagcctcccctaatgattgttcgggcttccggcaagtgcaccggatcgcacaagtag

SEQ ID NO: 70132 - DNA, 1525 bp, Glycine max
  Peptide Sequence Number=SeqID_186910
tgcttgggtaagtccattccaagtggtgcccaagaaaggaggaatgattgtggtctgcaatgaaaagaatgaccttattccgactcgtacggtcactggatggaggatgtgcatagactatcgcaacctcaatgatgctatgagaaaggatcactttcctttgctttttatggatcaaatgctggcgtggttagcggaagaatgtcgtttgacctatgtaatgctcaccatagtctatgccttagagaagttcagatcttatttaggggcctcccgagtcatcatctttattaatcatgtagctattaagtaccatttcacaaaggtagattcgaagccaagggtgatcagatgggtccttctgattcaagagtttgatgtcgtgattaaatacaaggagggctctgagaatgtaattgctggccatctctccaagttagtcaatgaagaggtatcattccaagttacttcaattagaatcagtggaagaagttcctccatgacgttcgtttctatgtttgtgatgatccccacttattcaagattggagcggataatctgtggagaagatgtgtcaccatggaagaagccagaagatggatttttttggccttctatcttcaaggatacccatgaccatgtgcttcattatgatcaatggaatcagtacatcttggttactattgattatgtgtctaagtggatagaagttgtagttgcctcaaacattgatgccaagactataattaagtttttcaagaagaatattttctcccattttggggttccagagtactcatcaatgacggagacaaacggcaaagcagagatttctaacaaagagctgaagaagattttagagaagactatggcttcctctagaaaagattgggccgcaaagttgaatgatgcattatgggcctacgagactgctttcaagactttcattggactatcaccctttcagatggtctatggaaaagcctgtcacttgctagtggagctggagcacaaggcctactgggccctcaagttccttaattttgatgaatccttgtccggtgagaagaggaagctgcaactgctggagttagaagagatgagactcaatgcctatgagtcttccaaaatttataaggagaagatgatggtgtaccatgatcaaaagctgatacagaagacctttaagcccaaccaacaagttctgttatataattcaaggttgagactcttcccaggtaaactcaaatctaaatggtctaggcctttcataatcaaagaagtaaggccttatggagtagtggagctgttggatcatgcctcaaattgtggggtgatgattcatgaaactttaatgattttcaagaagaagcttcaaacgccgagcgtgccatctcgcgctaagcgcaaccatgagataggcacgctaagcccagtcatctcgctaagcgcaagctgtgcactaagtgccaaactcgcgataagcaccagactcataactgttggaagttggaaaaccacctga

SEQ ID NO: 70133 - DNA, 294 bp, Glycine max
  Peptide Sequence Number=SeqID_186911
atggagggatttgcggctcaagtagcacccccaatgatggggagggagatgataacaatgatagtggacacgttaccagtgttctactatgagaagatggtgggttacatgccttcaagcttcgcagatttagtgtttactagcaagaggattgaaatgggtatgagaagaggcaaatttgattatgctgcttcgatgaaaaggaagcctggggaaaatggagagaataagaaggagggagaaacctatgttgtgattgtcgtttctacatggccaaatttcccactagcttga

SEQ ID NO: 70134 - DNA, 898 bp, Glycine max
  Peptide Sequence Number=SeqID_186912
taatccagatggatccattgcgcatcacaaagcacaacttgttgctaaaggcttttatcaacgaccaggtattgattataaagacactttcagtccagttgtcaaacctcaagcaatcaaaatagtcttgtgcattgctctctcaaaaggttggtctctaacacaaatggatgttaatgatgcattattgcatggatttgttgatcctacattccctcatcatgtgtgcaagctccataaatccctttatggtctaaagcgggcacctcaagcttggtaccatgaattaaaatccttcgtggttgcctatggatttttaaatagcaaatatgattcttcacttttcatttacaagcacgataatgccactacctattttttggtatatgttgatgatctccttcttacgggaaacaatgacaatttcataagtcaatttaaggctactatagttgccaaattttctctcaaagatctatggagaccgagtcattttcttggtgtcgaactcattcctacatccagtggatttttcttgtctcaacaatattatattaaagacataagacagaaagaaaatatgattaatgccaagccagtaggcactccaatgtctaccacttgctcacttggcactaatgatgatacacctagccatgacttatcttcctttcgcagtctcattggatccttgcactacttatccatcaccagactggatgtggctttttctgtcaataagttatccaaatacatgcaagcaccctcatcccaatatgggggcatattggtgtataggggaaaaagagatctccatatgagggatcgttctctcaccacaaacatcatttcgcatatccaaatggtaggaatgtgtgaaaatgagttccatacctag

SEQ ID NO: 70135 - DNA, 1092 bp, Glycine max
  Peptide Sequence Number=SeqID_186913
atgtttatcggtttcgtgctgtggtgcgtgttccacgtcctgttcctcgtcttcggcctcggtcgcgccaactacgccttaatcctgctgttttacggcatccgcggcctggcctatccgctgttcctctattcgtttatcgtcgccattatccataacgtccgcagcgacagctccagctcggccctgggctggttctgggcggtctactccgtcggcatcggcgtgttcggcagctatattccgagcttcaccattccgcacattggcgagatgggcaccctgtggctggcgctggcgttctgtgtcaccggcgggctgattgccgtggcggcgctgcgcaacaccgaaaccccgcgccatatgcagaatctcaccacccgcgagaagttctccgagctggggcgcgcggtgacccttatctacaccaaccgcagcattatgctctccagcatcgtgcgcattatcaacaccctgtcgctgttcggcttcgcggtggtcatgccgatgatgttcgtcgatgagcttggcttcaccacttccgaatggctgcaggtgtgggcggcgttcttcttcaccaccatcttctccaacgtcttctggggtatcgtggcggagaaactgggctggatgaaagtggtgcgctggttcggctgcatcggcatggcgctgtcgagcctggcgttttactacctgccgcagcacttcggccataacttcgccatggcgctggtgccggcaattgcgctggggatttttgtcgcggcgttcgtgccgatggcggcggtgttcccggcgctggagccggagcataaaggggcggcgatttcggtctacaacctgtcggccggactgtcgaacttcctcgcaccggcgattgcggtggtgctgctgccgcacttcagcaccatcggcgtggtggtggcctataccgcactctatctgctggcgttttgtctgtgcccgtttattcgcgtcgatcagccgggctttgccctaacatacagtccggcggcagacggcagcgtagcgcctcgccgaggatttccatacggaaagatttgccgctcagcggttcgccatccaggttga

SEQ ID NO: 70136 - DNA, 1343 bp, Glycine max
  Peptide Sequence Number=SeqID_186914
atgaccatcatcgaaggtaaagaaggcattaccgtcgtggatccgctggtgtcggcagaaaccgccaaagtgggcatggatctgtattacaaaaaccgcggtaagaaaccggtcgtcgccgttatctatacccacagccacgttgaccactacggcggggtgcgcggcgtagtagatgaagcggatgtgaaatccggcaaagtgaaaatttacgcgccgtccggctttatggaagcggcggtggctgaaaacatcatggccggtaacgtcatgagccgccgcgccagctacatgtacggcaacctgctgaaaccatcggccaccggacaggtcggcgccggtctgggcaccaccacctcggcgggtaccgttaccctgattgccccaactaatatcattgaaaaagacggtcagaaagaagttattgacggtctgacctatgactttatgctggcgccaggttcagaagcgccatcggaaatgctgtggttcatcgaagagaaaaaactgattgaatccgcggaagacgtaacacacaccctgcacaacacctattcgctgcgcggcgcgaaaatccgcgaaccgctgccgtggtcgaagtacatcaacgaagcgattgtacgctggggcgacaaggctgagattattatggctcagcaccactggccgacctggggcaacgaaaacgtggtcaacctgcttaagagccagcgtgacctgtaccgttacattaacgaccagaccctgcgtatggctaacgaagggctgactcgcgatgaaattgccgccaaattcaaactgccggatagccttgccaacacctgggctaaccgcggttactacggctctgttagccacgacgtgaaagccacctacgtgctgtatctcggctggttcgacggcaacccggccaccctcgacgaactgccgccggaagaagcggcgaagaaattcgtcgattacatgggcggcgccgatgccatcatgaagaaagcgaaagaggattatgaccagggtaactaccgctgggtagcccaggtggtcagcaaaatcgtcttcgccgatccgaaaaaccaggatgcgcgtaatctggaagccgatgcccttgaacagttaggctaccaggcggaatccggcccgtggcgtaatttctacctcaccggcgcgcaggaactgcgtaacggcgtggtgaaaggtcctaccccgaacaccgccagcccggataccgtgcgcgcaatgacaccagaaatgttcttcgactatctggcggtgcacatcaacggcgagaaagcgggtaacgcgaaatcgatctttaatatcgttctcggcagcgacggcggcaa

SEQ ID NO: 70137 - DNA, 510 bp, Glycine max
  Peptide Sequence Number=SeqID_186915
atgggtcgaagattaatcttttggagcttacaggttcacatgtgcaacaagctagctagtaggcatgtgagggttggtcttgctagtccaagtgatgtaccacggtgtgacatatgtgagaatgcacctgctttcttctattgcgagacagatggaagttccctttgtttgcagtgtgatatgattgttcatgttggaggtaaaagaacgcatggaagatatcttctgttcaggcaaagagttgagtttccaggagataaatctagtcatgctgaaaatccggcttcacaaccattggaaccaggtgaggctaaaagaggacaaaatccacttcccaaactaaaaatgggagagaagcaacaaaatcacaagatgcctatggttccaacgccaggacctgatgctgatgggcatgccaagatggaaagtaaaatgattgatttgaacatgaagcctaatagaatacatgaacaagcatcaaataatcaggttcgagttcatgagaagtaa

SEQ ID NO: 70138 - DNA, 384 bp, Glycine max
  Peptide Sequence Number=SeqID_186916
atggcaacatacgtgagccatgacgacatcgtacctagtagctctgatatgataataatcttagagatatatgctgttacaatggttatattatgtcgtctatgcacacgttcattctttaacccatcactcactaccttaccttcttcttcttcacttcctggcttttgtttcctcgctaagccaagaacgaccctttccaatcccctaacgaaaaatcatcgtcataatcatctacgtacgttgttttcgcgaaacaacactttcacaataccgaaaaacaacacaaaaacaagcgcaaattgtccaatacagttttttctaagagatcgacaaaagcaaggacgcgttgaaatggcaaatacgtttgcgtgtcgcttttag

SEQ ID NO: 70139 - DNA, 3924 bp, Glycine max
  Peptide Sequence Number=SeqID_186917
atggagcaaccgcttcaaccgcagccggagaccgccgcggtcggcgctagggatttggagcagtcgcggctggtcggagttcccgtggcggagagagcgggaaacagttgcgcagcgaatttgcaggtgaccgtcgtggacggtggtgccgtttttaaacggaagcgcggtcggccggccaagggagcgccgaaagtggcgcctcctgtgaggcaacagcaggacgaggaggacgtttgttttatttgcttcgacggtggcagcctcgttctctgtgatcgccggggatgtccaaaagcgtatcatctcgcgtgtattaagcgagacgaagagttttttcgatcaaaggccaagtggaattgcgcgtttgtcagaagtcgtcacattatatgtgctatacttgcccgtactctttgtgtaagggatgcacaaaagatgctgattttgtttgtgtcagagagaataaagtgtgaagtggattttgatgacaaaagcagctgggagtatcttttcaaggtgtattggatgtatttgaaagggaagctatctttaacatttgatgagctccttcaagctaaaaatccatggaaaggtgctgctcctatgagttataagattcaaagtccccatgaactttatcatcttagagatgacaaaggttctggctcagagaactcctgtatagacatagaatcaaataatttgaagaacaagaagcccaagagacagccaaagcttcttgataagggtgattgcttggataggataacttctggtggtgacagtggtgtgtctttgcctgaatgcacaaaatgggcatcaaaggagcttctagagtttgttgcacatatgaaaaatggtgatacatctctcctgtctcaatttgatgtccagactctcttgctggagtatgcaaataaaaataatctccgtgatcctcaacagaagtcacaaattgtttgtgactctagacttttaaatttgtttggaaaaacacgtgttggccacattgaaatgctaaagctccttgagccccactttcttttaaaagacaatggccctgcagaaaatacttttggagcgggaattattaatgctgttgctagtgaaggggaggccattgacaattacaataaacagttgatgttggttgatgacaagagatgtaagacacataatccagatgcatatgctgctatagatgttcacaacattaacttgatctacatgcggcgaagtctgatggagaatctaactgaagatactgaaaagattcatgagaaggttgttggttcatttgtgcggataagaatatctagcaatgatcaaaaacaagatatgtatagacttgtccaagttgtaggtacaagcaaggttgccgaaccttacaaaattggcacaagaacaacagatattaagcttgaaattttaaacttaaacaggaaggaggtcatatccattgctgaaatttctaatcaggagttctctgaggatgaatgcaagcggttgcgtcagagtataaaatatgggctctcaaagagattgactgtgggagagattctaaacaaagcagtgacacttcaagcaattagagttaatgatctactaaactctccggaggaacgtcaacgcaggcagcatgaaattccagatgtacactccgaccccaatttggattcaatgtttgagtctgatgaagatgatggagagtcagatgaaaggaagcaagatagcaatatattttcaaaatatcttgggtttgatagaaaagagaggggttctatttttccaagaatttcaaatggcgcctccaacgacatgggaggtaaaacacaagacttgcctgctacccgagaaccggttgggaatacatgcacagtgaagaataatatcaactgtgatgatacagctattgatgatagcactaatgcagttgtgaaatcagaagtgtccagtgttgcaccggacatttcatcaccgcttctctttactgggatgcagcagtcactgaatgattttttgaatgatagatcatggcattatcaggatccaactgggaagattcaaggacctttttctatgttgcagctatacaagtggaatgcaagtggatgtttccctccagatctccgaatatggagggtaggtgagaaacaagataactctatactgttaaccgatgcactaagtgggaagtgttccaaaaatgtgtcattgccattcaacagccaattgctctctttaggggtcagtgttacattggataataaagataatagtcaggatgctgggaagaatggaaagaatgaaatttctgcagatggccaaattatagaacagagcaaggaacaaaagccacaggtggataatacctctacccagtctgatggcaaagacgaacctgttaggagcaatggagggcatggccaactgcatgtatacccttcactactgccaactgccattcctgagaaattgaatgaggatccttctgataaattaaggaaaggccatgggattgtgggaaattccgaaaatagaaataatggctcgatcaggacatctgatgggcagagtaatagtgggcatagttatcagaagcaatcagatagtgaagagaattcagggaaatcttctggacagacctggagacaccctaatgtaaatagttcttccgattgcttggttaccatgtcagctcatgtttctggtacaaaaacatcaccgcataagctgggatttgatttgcataatcctccttcccctccggcagcatgtaatacatcttctggacagacctggagtcaccctaacgtaaatagttcttccaattgcttggttaacacatcagcccatgtttctgatacaaaatcatcaccacataagctgggatttgatttgcataatcctccttcccctccagcttgtaatacatcttctggacagacctggagacaccctgatataaatagttcttccaattgcttagttaccacaccagctcatgtttcagctacaaaaacatcaccacataagctgggatttgatttgcataatcctccttcccctccagcatgtaatacatctacatggcaggcaatcattggtgagcccaatgattttgatgaatccgtttcagatctgttggcagaagtggaagcaatggagtcacttggtggcttggaatctcccacttcaatcatgaaatgtggcgaggatttaactgaaggttctaaaaatgattgtctcagttttgttgcagagcttagcccaatgcttgatgcgggtaaaggtgatgcactgagctctactggtgatttaaacttaccatctcagccgacagcagcagaggaaccattacggcaagcagatgtacatcaccatcatcatcaaagaatttctgcggagcatccttcaagaagttctaaagttgaggtgggtacaaagaacggtgtttcaggtaatcaatgggattcaggctcagaaaattcacccattgttccatcccctggaaccttgggcctggctatagacaccacttggagacttgggttagagaatacacacttgggatggagtggaatagatcaaggaaatgcaaatgtgggttggggagtaggacagacggcagtgcaggaaaacaggagttctagttcatacacttctgcagtaactccaggctttggggatagccaaacaaaatatggcagtgatcgattttctgtgtccagagatcggggttttcaaggtcatagtagggaatcaggtttgagtagaagcagaattccatataacaggcaaccgtcatatggtgttggaaatggagcatcatataagcctctgcccaaagggcagcgagtttgtaaattttatgaaagtgggtattgtaagaagggagcatcctgtgattactggcacccatga

SEQ ID NO: 70140 - DNA, 429 bp, Glycine max
  Peptide Sequence Number=SeqID_186918
atggatgagatcgttgacacaccccttggtgttcaactcaacgtttttgaatgcggtggaatagccattggtgcatgcatgtcccacaagatagctgatgctatgtcctattttatgttcatccaaacttgggctgctattgcacgtggagaagcacatggccttaaagcaaaatatgcagaaaagatggctctgcagaaacccccttcacgagttgaggctctaacaactttcatatggacccgctttatatcatccactcaggttgcagttgcagcatctgatcagagatctaggttctacgtggtggctcacacggtgaacctgcgttcgagaatggaccttccactaccagcacttgcttttgggaattactatcgggctgttaaagcgtttccatcacttgatcataaaggggaatgcctatag

SEQ ID NO: 70141 - DNA, 585 bp, Glycine max
  Peptide Sequence Number=SeqID_186919
atggcggcggcgacgtcgtatctgacggggacgcagaggtacgctgccggagcgttgtttgggctggctctgcaccaggcccaacttcaccagacccaccctctgggcctatcaaccgacgacttcccttctgattctgaaactagttccactctcgctgtttccgaacaccccaacctttgggtccatcacaactccggtttgctccgccccgttttaaagtacctagatattaattccgcagcatggtctggactcgaggaaactgctggcttttcttcggcttcacgtcacgtcggtccgttcttgagactattatcagaagattttgatgatgatgatgatgattcttcccaaaggttggatcaagaacttgctttgtcagaagctgttgatgctatggtacatagcctggaaaagaattctgagtctctcgtgtctagaagggagaagttacgtgaatatgagaatcaatgtcgtgaaaagttttcgactgctgatgttcaaccgaattctgagaagctatccgaggaaagtgacagtgctctacgagcttctctctgcctgcctatcagatttaggtga

SEQ ID NO: 70142 - DNA, 309 bp, Glycine max
  Peptide Sequence Number=SeqID_186920
atgtctttcattaaagagcaagaggcaagtaaagaagaaactcaatcaaaagaagacaagtgggctaaatggaagaggggtggtatcattggtgctgctgccttaactgggggaactttgatggctgttactggtggattagctgccccagcaattgctgcagggcttggtgctttggctccaaccttgggtactctgatccccgtaattggagcaagtggatttgctgcagctgctagtgctgctggaactgttgctggttctgttgctgttgctgcatcatttggagtaattgcttcaatgaaataa

SEQ ID NO: 70143 - DNA, 156 bp, Glycine max
  Peptide Sequence Number=SeqID_186921
atggagaatgcagtggggaagaacgtgggcgtggcaatggcttccattccagcaactcatgccacgcagctgttgccaaccgtttggtatttgacgcgctcattaaacaacaatgttaccatcaaaagcgtcgtcgtattgaatgcacgtatttaa

SEQ ID NO: 70144 - DNA, 192 bp, Glycine max
  Peptide Sequence Number=SeqID_186922
atgacgatcttgaaactaagccaaactaaacccatgagatggaaaaggtccaggaatctccttcataaaacacattcaaaatcaatccaaatcaggcaatattccatacttacagttggagttcaatgtgaagcactcaacatgcaggaacaaagcctaccaaacgtgctacttattccgaagattaactaa

SEQ ID NO: 70145 - DNA, 1073 bp, Glycine max
  Peptide Sequence Number=SeqID_186923
tgacgctttcgccccttattcaatgctttaccaaactccctatcctcaaccctttcaatttcatcatcctttgccttcttccttctcccctctccttgcagttccaaccacaccacctcctctctatctccctttccctcaggccgaaaaagaaatggagtgcgtggaggcagcgttgaagagcaattataggaaagaaatgaccttaaaactgagcccacaaaccttcacggaagaggttagtgtccaaaacggcacaacctgcgacgactttttcgttaacgacctccttgacttctctcacgtcgaagaagaacccgaacaacaagaagacactccttgtgtctcccttcagcatgaaaacccaagccacgagccctgtactttcaaagacgattatgcctctgtgcccactagcgagcttagcgtcttggcggatgacttggcggacttggagtggctgtctcatttcgtggaggattccttctcggaattctctgcggccttccccaccgtaacggagaacccaacagcatgccttaaagaggcagagcctgaaccggaaatcccggttttctctttcaaaaccccggttcagaccaaagcaagaagcaagcgaaccagaaacggtcttcgtgtttggccattcggttcaccttccttcaccgattcttcctcaagctccaccacctcttcctcttcctcttcttcaccctctagccccttgctaatttacacccaaagcctcgaccacctgtgctccgagccaaataccaaaaaaatgaagaaaaaaccctcttccgataccctggcgccgcgaaggtgcagtcattgcggcgtgcagaaaacccctcagtggagaactgggccgctaggcccaaaaacactatgcaacgcgtgtggggtccgcttcaagtcgggccggctcttacccgaatacaggcctgcttgtagcccaacattttcaagtgaattacactcgaaccatcatcgtaaagtgctcgagatgcggcaaaagaaggagacagtttctgtggatgagactggttttgcccctgctcatgttgttccca

SEQ ID NO: 70146 - DNA, 171 bp, Glycine max
  Peptide Sequence Number=SeqID_186924
atggccgaccaatatgcgaccaagtccaaagacaaaggtagcaagatacctgggacacgcatgtatatagcaaaatacttcacaaaaacatacgtatgtttaggtagcaaaatacctcatggaaaaaaagagagcgagcaagaaaagaataagaaggaagaaaaaaaatag

SEQ ID NO: 70147 - DNA, 213 bp, Glycine max
  Peptide Sequence Number=SeqID_186925
atgattgacttggtgttggtttttggtgatatattgtatgattcatggtcccctgcgatgacagttagttctatctgcatcagtattctctcaatgctttcaagctcaaccacaaagcaacgccctgaagataatgaccgctatgtaaagaactgcagaaatggcagatcacccaaggagacaaggtggtggttccatgatgacaaagtataa

SEQ ID NO: 70148 - DNA, 1176 bp, Glycine max
  Peptide Sequence Number=SeqID_186926
atggcaatttgggggctattgttaggagcagaatcaaaaacacatgtcggagatgcagaggttctgaaggagctgaagcaaggtttggagcctggttcggtgaagccaggctcgtgcgtgagctcctgggacttcaccttggacccatgcgacaaccttttcggcgacaagttcacgtgtggcttcagatgcgacgtcgtcgtttcggggctgagtcgagtcacggaactcgccttagaccaagctggttactctggctccctctccttcacttggaaccttccttatctacaaactctcgatctctccaacaactacttctccggtcaaattccatattccttctcaaatctcactcgtctgagccgactcagtctctcgtccaactcgttctccggcgagataccctcttctctcggcacactctccaacctccaagagctttacctcgacaacaacaacctgcgaggaacaatcccacaaagtttcgacaacctggccaaccttaaaagactcgaactccagtcaaacaaactcaacacccgccttccaaacctggggtccctaagaaaccttaaatttctctacctaagcgacaactccgtcactggaacattgccggcttctctccctgtttccttggttcagatttcactcaggaacaacaacttaagcggtgtcttagttggtgaaagtttcaagagcttgacgaggttgcaggtggtggatttcagctccaaccaattgagtagtgctgttccctctgttttcttccagcttccgtcgttgcagcagttgacactgtccttcaacgaattcacgaatctcgaagcgccttataagggaacggaatctcagagcgggcttgtagcggttgatctgagcaacaacaggcttaaggggtttttgccgtcgttcatggcggtgatgccgaagctttcgtcgttatcgttggagaacaacgagttcacggggagaataccgacccagtttggggtgaaaacggtgtttcccgaaaagggggtgtcttcgttcgggaggcttctgttaggtgggaattacttgctgggagggatacctcgacccttgttagcgctgaaacgcgattctgcgaacggtggccaacagaagtccttggcacagtgtaatagatttagccctgcctccactccttaa

SEQ ID NO: 70149 - DNA, 264 bp, Glycine max
  Peptide Sequence Number=SeqID_186927
atgccaccactgtcgctcaatctagtgtcaccactgttgaccatgccgtcgacttttcccttggcactgatctcagcctccgcctcccctcctccttcggatttgaagtttctattaacggaaacgactaagaagtcgcaaggagtgcgtgggcctaaacctgctgcagtcgagtcgagtcaacatgcacatccacttttcggtgtgcaatttgtttcgttcaaggtgctggcaagtagctacctcagtgtgagggttggatga

SEQ ID NO: 70150 - DNA, 192 bp, Glycine max
  Peptide Sequence Number=SeqID_186928
atggaagaaaaagctgggctagccgttatgtatgattctccttctggccccgcttcttatccaacgttgatagtttgtccttggaaatgtcatatacttaagaaaagaatggggcaatgtggcatcttgtgcgatagcggtggttgcaattgcaaagtggattgggcatcggatcccaatgctaaagcatag

SEQ ID NO: 70151 - DNA, 342 bp, Glycine max
  Peptide Sequence Number=SeqID_186929
atgacgagttcctctgctgccgctcgcaagaatctgagtaagattgcctgcaataggctccagaaagagctcgtggagtggcaggtcaatcccccaactggtttcaagcacaaagtcaccgacaatctccagaggtgggtggttgaagtcactggagctcctgggacactttacgctaacgagacctaccagcttcaggtcgattttcctgagaattacccgatggaagctcctcaggtgatattcttgcatccggctccgctgcatccccatatctacagtaacggccatatttgtttagattctgacttttgttgtaatctgcttcggacttttctttga

SEQ ID NO: 70152 - DNA, 1251 bp, Glycine max
  Peptide Sequence Number=SeqID_186930
atgaaggtggccttggaacaaagctcaaaggaggctccagaagtggacgtggaagccatcaatgaaagaaaacaaaagagattggccaagtccattgctgatgaagacctagaaaaggtggagtttttggccaaggagaacaagaccaaaagaatgcatgagtctgcctcatccgctcttgcgtgtccacccaaagtgaacctagtcgcacaaaggtcggaagacttgagtgagaatgatgatgatgatgaaaggctggtgcgagtggctcttcaaaaaaggaaaattgttgctcttgatgcccttgctctcgagaaggcaaagaaagctcaacctgttgctgaaccaagagcaaacaaaaaaaatccagcctcatccttattagatggtgagtccattaatgacattccaatcacgcctctctgcaagtctacaccaaccactcaatcgcctccacctccctttcctttgcaattggaaaggttcaaaagggaggctacaagggaaaccatatttgttgaaacacccacttggacacattatgactatgagcacactccatcggatgctatagtccattttccacctccaacatggacttgtccggtgatcccttctcatgcttggtgcaatataaagaagcagaaggacaagaagagcttccaaggcaatatctctcaggactatttggaaagcaaagaagggaccctttgcaagaagtggaacttcctaaggcatatttcgagaagaagggcaactgatatcaagatggttgttgatagagtctgtctaagactacctgtatgggacattgccaagaataaaggtgataatgttgtgcactgtgatgttgttcaagtgttatactttcttggaagtatcactttaatgatgcttgcattggctttaccagagatgaggacaactactccttcatccaatgctcaacaaaagaaaaaagctgaagatgttgttgctgccgctattgtcgagaaagaagctattgctattgctgagagagaagctgctaccaccatccaagttgaagcatatgctaaagttgtggaagacaccattgtgcatggggtcatcattgattttacaaacaccagtttcatggatgagattgaagcatccaagcgtccaatgcaactatggctgatgaagttgaaccacccattccagatcctgcgtccaagcagcgtacaacttcaaatgaggccacctctccagataagggtgatcgaggcc

SEQ ID NO: 70153 - DNA, 171 bp, Glycine max
  Peptide Sequence Number=SeqID_186931
atgggtttgaatatagaaaaattgaagaacatcatcgtcagtcttgagatggcggtggtagtggaggttgggaaggtggtagagaggacggaggaggtggtggtggtatcggagccaagggttgtggtggaggttcaagaaaggcaggaattaatgaagcattgggcttga

SEQ ID NO: 70154 - DNA, 1401 bp, Glycine max
  Peptide Sequence Number=SeqID_186932
atgtggaagggaatgaataacgtacagtctctatgcatgtacgggaatgtgtttaagacatgcattttgggaagcaatgtgatagtttccactgacccggacgtgaacaaggtggttctgcagaaccaagccaacaacttcgtccccgcttatccaaaatcaattagagaattaatgggggaacaatccatactcaaaatgaacgggaccatgcataagaaagtgcacacactcatcgcagggttcctacgatccccacaactcaaagctcgaatcaccagagacattgagcacgctgtcaaacaatgcttcgcttcttggacgccccaccaaccaatctatgttcaagatcaagtcaaaaagattacatttcctgttttgatcaaagttctgatgagcgttggtcctggtgaagatttggacttcctgtatagagaatttgcagaattcatcaaagggttgatttgcttaccactcaaatttccaggaacaagactatataaatccttgaaggctaaagataggatggtgaagatggtgaggaagatagtagaggagaggaagaagcaactgaaagattataatgcagatgatcatggtgatgcagcagtgaatgatgtggtggacgtactattaagggataaggttgactcgaactctagctcacgtttgactccagaaatgataagccaaaacataatagagatgatgataccgggggaggaaactcttcctacggccatgaccatggcccttaagttcctcagtgactcccctctcgctgtatccaaacttcagagcacccatcactttttcgagggtgctgagaacgaaccgacaatgaaaattgatagccaatgttttcatgaggagaacatggaactgaagaggctgaagactaattgctcagatgattatgcatggactgattacatgtcactgccatttactcaaaatgtaatcagtgaaactcttagaatggccaatattgtcaatggcatttggaggaaatccgtcaatgacatagaaattaaagagaaaatacttatgcagtttcactattctgcatatccagggtacctaattccgaaacactggtgtgttatggcatctcttacttctgttcacatggatgggaagaactatgaaaacccttttaactttgatccatggagatgggagaaaattggaattgtggctggtaacaattgttttaccccatttggcggtggacatagactatgccctggattagaactctccaggctagagctatctattttccttcaccaccttgttacaacttacagatggatcgctgagaaggatgaaattatctactttccaactgtcaagatgaagaggaagctcccaattagtgtgcaacccattatcgcatga

SEQ ID NO: 70155 - DNA, 357 bp, Glycine max
  Peptide Sequence Number=SeqID_186933
atgtgggttttgcagtacacttggtcccatgtcaggacaccagctcgtgctccactacccgctgttattatctcatcaattagtggactcgtagtacaactctactgcgactcaacaaatctcaattgtggcaaaaccctctgtcgcaccaccttcattccgtcacaacacctctatgtcgtagccgctaaaaccacctcagtgctaccatcactccaccttctcatgagaacaagagcgaaagccaccatggccactagtgagaacgagagccagcaagagcataggcagggaagagagcaaaaagaggcagctcgtagagaggaagaggatgaaaacgttgacataattaagtga

SEQ ID NO: 70156 - DNA, 1836 bp, Glycine max
  Peptide Sequence Number=SeqID_186934
atggcttcctcactgtcttccgttgtcaaccaacctcacttagctcagcgcctcaagcttcaccgtccatcttctcttaccactctcacaattttcttccacaaacacaaacaccaacaccaacacaatgcttcatttccacacccatatacgtcatcgcctcgctcacgccctctcaatctcatcatggcatccagaacccactctccttcctacactctccgccgtcacttcatccctcaagctacactcactgcttccgaagctcaaccccgccttgtaccagatactgaagttcctcccactggtcgaatatatcatgagacttatggatgtcaaatgaatgttaatgatatggagattgttctgtctataatgaaaaatgctggttatggtgaaattgtgagtgttcccgagagtgcagaaataatattcatcaatacctgtgccattagagacaatgcagagcagaaggtatggcagaggcttaattacttttggtttcttaagaggcattggaagagcaacgttgctactggaaggtcgcaatccatgcgccctccaaaagtggtggttttgggatgtatggctgagaggttaaaggagaagatacttgattcagacaaaatggttgatgtggtttgtgggcctgatgcttacagggatttgccgcgattactggaggaggttgattatggtcagagagggatcaatactctcctttcactcgaggagacttatgctgatattaatccagttcgaatctccaagaactcagttactgcatttgtctcagtgatgaggggttgcaacaatatgtgttcgttttgtattgtaccttttactagaggcagagagcgatcacgccctgtggagtcaattgtgagagaggtagcagagctttggaaagagggtgttaaggaagtaatgcttcttggccagaatgtgaacagctacaatgatgcatctggaattgagagagaggttgaatcagggtccaattggaaacttagtgaaggattttccagcatggctaaggtcaagaatatgggtttaaggttctctgatctactggatcgattgtcctcagaatttcctgagatgcgattcagattcacgtctccacaccctaaagattttcctgatgatttgctttatctaatgcgagaaagacataatatatgcaaattgatacatttacctgctcaaactggaagtagcacagtgcttgagagaatgagaagaggatatacacgagaggcttacttggatcttgtgcaaaaaattcggagtattattccagatgtggctttgagcagtgatttcatttgtggattttgtggagaaacagaggaggagcattctgagacgttgactctaataaaagctgttggttatgatatggcattcttgtttgcttatagcatgagggagaaaactcatgcccacagaaattatgttgatgatgttccggaggaaataaagcagagaaggctagctgaacttattgagactttccgtgagagcacaggacagtgttttgactctcagattggaactacacagcttgtattagtcgaaggacccaataaaagagctccagatactgagcttatgggcaagagcgacaagggccatcgagtgttgtttgtcaatatgccaatcccagacagggaagacattaatacaaagcgaaatcctgtggttggtgattatgttgaagtccacataacaagatctacgagggcgtcactctttggtgaagcacttgctataactaaactgacttcgtttgacaataatctggataaagaagctgctgcatgcagcatgtaa

SEQ ID NO: 70157 - DNA, 1473 bp, Glycine max
  Peptide Sequence Number=SeqID_186935
atggcgaatcacaatagcagattcctcttacgctccttcatccccttcttccatcgccgaatgaactcacctcttcttccttcagcaacgtcatgtcctcggttaacttcggggacagcttttgatgaaaaattcacgcagttaccgagcaatattgttcgcggggatcatcgtcaagttttgtcttttttcaatccttcaagaaatttcgcggaaaccaaacaatggggtgttggaattcggcacaaatgctttggttctatggctgggtcggttcaaaggaaccccagattctcaaagttgaatgatgatgatgttcgatacttagagggtatattgggttccaaaaatgttgttcaagatgaggacaagcttgtcacttcaaacactgattggatgcataaatacaaaggctctagtaagctcctgttacaacctaggaccgctgatcaggtttctcagattcttaaatattgtaactccagaaacttggctgttgttccccaaggtggaaatactggtcttgtaggaggaagtgtgcctgtctttgatgaagtgattgttagtcttagttctatgaataagatcatatctttcgacaagattggtggaaatgtttcaactaatgctggtggtttgcgtcttgttcgctatggatcgcttcatggaagtgtacttggtgttgaagctgttctggcaaatggtactgtacttgacatgcttaagacattgcgcaaagataatactggctatgatttgaaacatctatttataggttccttgggaattgttactaaggtttcaatacttaccccaccaaagttatcttcagtgaatgtggcttttcttgcttgtaaagactatagcagctgccagtctgaattaatgtgttacacggaaaaaggagtagcattgatggtgaggcaaaagcttgaagcatttctacttggctccatggagaatgaattgatatccgatggtgttcttgcacaagacataaaccaagcatcatctttttggcttctacgtgagggtataccagaggcattgatgagagcaggagctgtttacaagtatgatttatcaatacctcttgaacacatgtacaatcttgttgaagaaatgcgctctagactagatgagaaagtagcagacgtaatggatgtagcaagtaacacagctaatgtaataggatatggtcaccttggagatggtaatttgcatttaaacatttctacttctcattacgatgacaagattttgtcacatattgaaccttatgtatatgaatggacatctaagcaccgaggtagcattagcgcggagcatggcctgggactaatgaaagccaacgaaattttctacagcaaatcacatgaaactgtacaagtgatggcttcaatcaagaatttgctggaccccaatcacatactcaacccatataaagttcttcctcagtctctcatttcataa

SEQ ID NO: 70158 - DNA, 126 bp, Glycine max
  Peptide Sequence Number=SeqID_186936
atgatatttgtcctagaagttgaagcacgtagcacatgggcatgtttgctttcatcaacgtttgacggcgaaaggaacggatggagattcgaattttggaacccaaaggcagtggggcttttctag

SEQ ID NO: 70159 - DNA, 369 bp, Glycine max
  Peptide Sequence Number=SeqID_186937
atggagtcagagcttctcctcaagcttcaatgtgggattgggagatggttcatgtacgtggcacatggcattgaccactttattaggtacatgaggttgatagtggcgtccctgttttactttgaggaggcaccaaagttcgtggagtactttatatggtggggccacttgatgccgatgaggaatttgagcatgaggtgtcagcctcgctcgccccaacacccattgaggaggatacagaaagagatcgaagaggacccaaagattttagaggatgacctatccaaggcaacaaaggagcctcttgatcttattatggaggatggtgcaatggcagtcagtggggagcttccctatgaagtagggtag

SEQ ID NO: 70160 - DNA, 183 bp, Glycine max
  Peptide Sequence Number=SeqID_186938
atgatttcttgcaaagtggatgctccaagttcctggtgtagcaatgcaaattacatgggtggcataggaaaggataaatttggggaagagatgaagaagaactcaaggcttgctagtgtaaatgtagtttacaacttggttacacgtgtacttcctatctgcatgaagggtctcttgcgatga

SEQ ID NO: 70161 - DNA, 390 bp, Glycine max
  Peptide Sequence Number=SeqID_186939
atgttgagaagttacagagggatttacatgaaatcactgatgacgatcgaccagatctggggctttagcggccagatctacaactttgaaggcgagatcgacggctttagaggccagatccgtgactttagcgggacaaaaagagaaaatgagaaggggtatgagaaaagggttcttaccaaggggggcatgacaaagtggaagggaaatttgtggagagagacaatgagagtgcaatggagcttcaactggcatgatagagcagtgtggtggcagaacgagagtgagagcttgagaatgaaaactgcaaagttacactgtgagagtgcgagagtgatagtgaaaaagccttatacccttatcaatgacgattttaaaaaatgttgttga

SEQ ID NO: 70162 - DNA, 159 bp, Glycine max
  Peptide Sequence Number=SeqID_186940
atgcctgatcaattaaggagaaagttggatgacaaggatgttgtgattgatgcatcaaagagttgggactggaacatagaaactaagaagggttcaactagaatgctgatagatcttaacaacgtgatgaagttgaaacagcacaaatgcaactactag

SEQ ID NO: 70163 - DNA, 1530 bp, Glycine max
  Peptide Sequence Number=SeqID_186941
atgaatcaggcttctgaaaactccggaactgtggatttacgacattttgcattttatgcatttgctggtcgatctggtgttgaacgatggagcagaaaaaatgaggtgctgtgctctattctttggtcttcaaacattgaagtgcattcttcagatgcatcacagttacttccgcaacataactacaagcttgatgttcatgctctgaatacccgccaacctggagagggaattcagagaatcaatcctgggagttatgcctcaccaatgggtacatttatcaaccttgattatccttctgtactaaggcttaatcttaattactgtccgttcttgaataaatatgtttatcaggctaggagagaagatactttattgaagcttgcccacttcaggcggcacaagaggaaaacattgaagaaaacacccggaaaggctatgagttacccttttcacaagcctgaggaaaaccatcctccagggaaggactcaaccaaaaaaatttcaaacataattggaaaagcagcaaattatgctggttccgcaaaatctaagaagcaccttccttacgttcccaccataaccaactacactcaagtttggtgggttcctaatgttgttgtggctcatcagaaggagggcatagaagctcttcatttggcatctggtcgaacaatatgcaagcttcatctccaggaaggtggtctacatgctgatattaatggtgatggagttctagatcatgtgcaggctgttggaggaaatggtgctgagcagactgtagttagtgggtccatggaagtgctacgtccttgttgggctattgcaacgtctggtgtaccaatacgtgaacaactcttcaatgtatctatttgtcattatacccattttaacttattccagcatggagaactatatagaagctacagtcaaggttcagatattgcttctttagaggtagcaacacctattctaattcctagaagtgacggtcataggcatcggaagggaagccatggtgatgttatcttcttgacaaatcgtggagagattacatcatactcccctggcttgcatggtcatgatgctatttggcagtggcaacaatcaactggtgttacatggtcaaatctaccttccccatcaggagtgatggaaggtggtggtctggtgattcccacactaaagcctctttccttgcggttgcatgataatcaggaaatgatccttgcagccggggaacaagaagcggtgataatatcacctggaggtagtttattggccacaattgaactacctggtccaccaacacacgtcttaattgctgaggacttttcaaatgatgggctcactgaccttattcttgtcacctctaatggagtgtatggctttgttcagaccaggcaaccgggtgctctcttcttcagcatgttggttggctgtctcatagtcgtgatgggggttatatttgtcacccagcacttgaattccacaaaggggaagcctcgcccctcatccggttcacggtaa

SEQ ID NO: 70164 - DNA, 246 bp, Glycine max
  Peptide Sequence Number=SeqID_186942
atggcagacatgcagaacaaaaaaaagaagaaagaaagacatggcagagtcatccctaaccaaccagcagaagaagttttggtgggaccaccaccactgctatgccacagagctgagaccaccattccattatggtgcacactaggctcctacacacgtcaggttcaccctatggtactgctatctatgctgctgctgaagcagtacgaaaattatcacctcccattattctgcaagaagccctag

SEQ ID NO: 70165 - DNA, 619 bp, Glycine max
  Peptide Sequence Number=SeqID_186943
atgttgggttcaagtggtgttttctcaagaaatttaccagtgtttgatggaaagaaattcaacaattggtgtttgaagatgaatgcaatcttcgacttccaagaggtggaagaagtcttcaagaatgggtttcaagaaataggaagaaatgcaacaaaggaacaaaaggcagagtataaagaattaaaaaagcttaattctaaagcaggtttccagattcatcagggtgttaatgttgtaatctttggaaaaatgtccaaagctacaacaacaaaacaagtccgggatattctaaataaagcgtatggaggggctgacaagacaaagaagacctgcaaagaagagctgattgatcaacaacttgttgacaaggtgctaagaaccttgacacctcggtttgatcatgttgtagtggtaattgaagaatcaaaggatcttgattcaatgaaggtggaggagttgcagaactctcttgaagcacatgatgtaaaagaaggaaagggaaaattgaataatgaagtgaatcttgctcatgatgatgggttagattctgatccagtgttgttgatggtcacaagtactgagattcataactcctcatcttggtacttggatactg

SEQ ID NO: 70166 - DNA, 477 bp, Glycine max
  Peptide Sequence Number=SeqID_186944
atggtggatcttcaaaccgtttgctgcatgtgcggcgacgttggtttcccagacaagctttttcgctgcaacaaatgccgcaatcgcttccagcactcgtattgtagcaactactacggagaattaccggatatagaactgtgcgattggtgccatagcgaggagaagaacttgagacatattggctccaattcgaagaaaccggtgtcggccggaaacgaggccggagccacccaccgttcggagtattccggcgagaaaatgatcaagcagcatgatcatcatcgtgaagagagtggttctgagaagggtaagagtcccacaccatcgccacgacccggcacacgcaggtacaagcttctcaaggatcgtgtagtaagcaagtgtttcttgagggcgagccctggtgcagcgataaagttgtgccttggtgacttgttggtcatgtgttcgaatctgaaaacagcctctgggtaa

SEQ ID NO: 70167 - DNA, 1308 bp, Glycine max
  Peptide Sequence Number=SeqID_186945
atgggagatcgcttagacgaaatgagcgaaatgatttgtgatgttggacaagaatattttcagcaagaacatacccttatgtatgatacattgcaaagtgatttgaagaagcctttgtatccagggtgcaagaagtgtttgacgttgttgtcaatagtgttaagtctggatatgcatccagaggaaaacacgcttccaaaaagttactatcaggcgaagaaaatattgtgtcccatgggtatagagtgccagaagattcatgcacgccctaatgattgcatactatacaaaaatgagtttgaagaaatgcacaactgccctaggtgtggggtatcacggtacagagtgaaggatgatgatgatgtagcaatgacgaaagcactaagaaaggccccccatgcatcgataccgttaactggtgaacaagttcttgagtgggttgatggcatcaatactgtatttgaaaagacacaaaagaaggaaaataataaaacttccatatggaagaagagtgtcattggcatgcttcttgacattcaaggcaagacaaagaatggtttgaatactcgccaagatctagttgagatggatatacgagaccagttacatccaagccttgtgcagttgaaggatctcaagttagtaggcataaagtctcatgattgccacatcttgaagcaacaactcaaagtcgttgatcctctcaaattacatgagctggaaagtaaggctgctattatcttgtgtcagttggagatgtattttcctcctttgtttttcaacatcatggttcacttaattgttcatctgaatctacaccgtcctgaagcatctattgttgaaaggtacattgtgaaagaagctattgagctttgttccgagtacatggaaaaggaaaaacttgctggggttttagagtctcagcatgatgagagagtgggagataagggttcaaaaggaatgcatgaagttaaatgtgggttgtatgtcgatgacagtcctcctcgactggttgctcttggaagagtttatgaggggtccacgagtgtccacaatgttcctttgggcaatgatcaagtgaaggtcggtgttgaggaagtcctagaagctgatgctcgcattcctatacccactcaagaggttcagttagtggggaaggcacttaacaccttccttgcttggtcgacacatcttgataaacaggtaggtgagggacaggcgaaacctatagatatgtcagatccagacgttgatcccctctacctgatgacattgaccatcccacagcttttcctcaagccgttgtag

SEQ ID NO: 70168 - DNA, 258 bp, Glycine max
  Peptide Sequence Number=SeqID_186946
atgaggatcaaaagatcttttaaggttgtaatggggccaaggacaaggcttgtagtgagcttcaaaacaaggaaagggaaacaaggctcaaaaggggtatcaaaggaattaattcaaggtaagtccatttggctagaagcttatgagaacaaaattgcctcaatcatttccaaatatgcatgtgaattaggaagcatcaacaagaatcaagccaaggctattgtgcaagcaatcaatggggcaaaacacaccaaatga

SEQ ID NO: 70169 - DNA, 293 bp, Glycine max
  Peptide Sequence Number=SeqID_186947
gattctttgaggatcctaacaacgacggtttgacaatcgatttcgatcgagatataagccaaacgataaacgaggaagaggaagaggacgtcctatcaccagagttggagaggttggttgctcaagaagaacgtgaaatgaagcctcaccaagaagaaaccgaattggtaaacttggggaccacggaggaaaagaaagaagtaaaggattacatgaatcatatgcttctcaaagatttactcaagacaaagcaattagagttaatcaagatggatgatcaagacagtctatag

SEQ ID NO: 70170 - DNA, 216 bp, Glycine max
  Peptide Sequence Number=SeqID_186948
atggctcttcatatgatctatacgagacctatatccgaccaagtcaccatgagtggaaaagttgtttcgggtcgtgggactcttggtgcaataaaaggcatgtggtaccaagcccatgactacaatagtatggcacaaccacccatagctttaccaacccccgatgatgctcgacatagttctctatacaggcaatggtgcacgcaacatgcttag

SEQ ID NO: 70171 - DNA, 237 bp, Glycine max
  Peptide Sequence Number=SeqID_186949
atgggggatttcatcagcagactctccttccccgcatgtttgcattttagtggagaaaacaccgagactttttcaagtctcacaagttatccagaactacgtaggtctgagttcctcattggaggatacgtaggagcaagagcctcgcttttgtcgaccacaccgccttttgttgccatgacccaagagctggtagcccgcggagacaccttacggttatccgcacctcgagtgtga

SEQ ID NO: 70172 - DNA, 951 bp, Glycine max
  Peptide Sequence Number=SeqID_186950
atggcgggtttattctcactagggggtggtagtagtagtagagggaacacccaacaagaggaaattcctcctccggataccttattctggtataacaacaaaaatgatgacgtttcctcttaccaccgaggtggcgggtttgagttatggaaccagcaacaactcatgggccagggccctccttctcaacagcggcctctctttcaccaagatctctactccgcgctgggcgttgggcccagcaggcccatctcagacgatcagtcgtcgtcgagatccgggttcatgcttggaagcacaggaggaggaggagggattagctgtcaggactgcgggaaccaagccaagaaagattgccctcacatgcggtgcaggacgtgctgcaagagccgcggcttcgattgccaaacccacgtcaagagtacttgggtccccgcttcacgccgccgcgaacgattacaacaattctccgctttgcaacaaaccctcgaaccaccttcttctggaggaggtgaccttcccaaaaggcacagagagagagaccatcattatcattctcctctcgcctgcactcgcttcccttcaaaccccttgtcctcagggttagaggaggtgaatttcccggctttggtgaggtccgatgcggagttcagatgcgtacgtgtgagctccatggacgaggaggcggaggaggagtacgcatactcaacggctgtaaacattgcaggacatgttttcaaaggaattttatatgactatggtccagaaggtaacactaattacatggctggtgctggggaaagctcttctactggtgttggtgccttgaacctaaccactggtgccattgtttctgagccaattgttgatccttcttccttgtatacggctcctcttaacaccttcatccctggtagcggtacgcaattcttccctcacccacgatcttga

SEQ ID NO: 70173 - DNA, 210 bp, Glycine max
  Peptide Sequence Number=SeqID_186951
atgtggctctttgtgaggtctacgaacaagacctcaactatcgcacatggttgggtcgagcaggcaaagacttttccattcaacatatacaattggactagggaagatgagcattgcaaagaggggtctaacggtaggcgaaaattttggctcgtaaggggttgcgacgaagatgaaagcaggggaggggcaatgatctttttggattga

SEQ ID NO: 70174 - DNA, 780 bp, Glycine max
  Peptide Sequence Number=SeqID_186952
atggaccgaagcactgatgttgcaatcattaaggagttctatgctaacctctatgatccaaaggataactcacctaagcaggtgagggtcagaggtcacttgatcaaatttgatgcagatgctttgaatacttttctgaagacccctatgatcatagaggagggggaagagctatcttcatactcaagattttgtcatctaaggccagatccatcggaactgccagcccaattatgcatccctgggaggggatttgagctaaatgcagatgggctgcccttgaagatcttgaggaagaatctgaccactcttgctcagacatggagcattctttcattctccaacttggcccttacttctcacacttctaacatcacactggatagggccaggttgatctacggcatcatccagaagatggacatgaacttggggtatattatctcaagtcagatttctatgattgcacagcatgattcctcgagtctagccattaatttggcttatgtgaagaaaaactgctggaacctcgatgacccctcagtctctttcagagggcctcacaaggccagggggaagaggtcagagactctcccatcttttgagattcccccattagcagctccctccactacagttccaacttcttctgccccatctgcatctgcacccttaccagctcctattatagctccttctataggatcatcttcctttactttagagattttatttgctatgttgcagagcttgcacagaggccatattattatcatgtag

SEQ ID NO: 70175 - DNA, 2787 bp, Glycine max
  Peptide Sequence Number=SeqID_186953
atggccgaggttgctgtgtcaacggtcgttaccaagctgacggagctgctggtggaacaagcagcagtggcggcggtgtcggtttcacagctggcaggggtgagagagcaagtggagaacctgaagaacgaattggggtggatgcagagctttctgagggacgcagatgcaaaacaagaaggcaacgaccgcgttcgcatgtgggtgtcggaaatccgagacgtggctttcgaagcagaggagctcatagaaacctacgtgtacaagaccaccatgcagagcagcttagacaaggtgttcagaccctttcatctctacaaggtgaggaccagaatcgacaagatcctgtccaagatcaagagcatatccgaccggcgcgaaacatacggcgtcgttgtaatgacccgtgatgatggcaacaacagtaacgaaaggttgaggcactggagacagccttctccttattctgaagaggagtatgttattgagcttgaggatgacatgcggctgctttttacccagttgcttgcagtggagccaacgcctcatgtggtttctattgttggtatgggtggtttggggaaaaccactttggctaagaagctctacaatcacaccagaatcaccaaccattttgagtgcaaagcgtgggtgtatgtatctaaggagtataggaggagggatgtgttgcaagggattctcagggatgtggatgctctcaccagagatgaaatggagaaaatacccgaggaagagttggtcaacaagctccgcaatgtgttgagtgagaaacggtatttggtggtgcttgatgacatatggggcatggaggtttgggatggtttaaaatctgcatttcccagagggaagatgggaagtaagatattgctcaccacaaggaatggggatgttgctttacatgctgatgcttgtagcaatcctcatcagttgaggactttgacagaagatgagagtttcagattgctctgcaacaaagcgttccccggagcgaacggcatcccgttagagttggttcagttgaagagtcttgcaaaggagattgtggttaaatgtggaggtttgcctttggctgtggtagtggttggtggtttgctgtctaggaaactcaagtcaagtggggaatggaagcgggtgctgcaaaatatcagctggcacttgctagaagagcaagagaagatagctagaattttggcccttagctacaatgatctgcctcctcatttgaagtcttgctttctatatttgggtcttttcccagagggtgtgaacattcagacgaaaaaattgatcagactatgggtggcggagggatttctactgcaagaaggagaagaaactgcagaaggtgttgctcagaaatacttgaatgaattgattggtaggtgcatgattcaagtgggaacagtaagctcattaggaagagtcaaaacaattcgcatccaccatcttcttagagatctttcactctctaaaggaaaagaagaatattttctcaaaatatttcagggtgatgtggcaggtcaatcgactaaagcccggcgccattccatgcattcttgccatgacaggtatgactccttaaaacacaatgctggtcattcacgttccctgctgttcttcaacagagaatataatgatatagtgaggaaactctggcatcctttgaattttcagcaagaaaagaaattgaatttcatctacaggaaatttaagctgctcagggtattagaattagatggtgttcgggtagttagcctgccaagtttgataggggacttgattcaattgaggtatctaggattgaggaagactaatctagaagaagaacttccaccttccattggaaacttgcaaaacctacagacacttgatttaaggtattgttgttttttgatgaaaataccaaacgtaatttggaagatggtgaacttgagacatctcctcctgtacactccatttgattctccagatagcagccatctacggatggatacattaaccaatctacaaaccctaccgcacattgaggctggaaactggatagtagatggtggtttagcgaatatgatcaacctcaggcaattggggatttgtgaattatcaggacaaatggtgaattctgttctttctactgtacaaggattacacaacctccattcactgtcactatcacttcaatctgaagaggatgaatttccaatctttatgcagctgtctcagtgcactcatcttcagaaactctctttaaatggaaagatcaagaagctacctgatccacacgaattcccaccaaacctcttaaaactaactctgcataactcccacctacagaaggagtctattgccaaactggagagattgccaaaccttaaagtgctcattttgggtaaaggggcatacaattggccggaactgaacttcaatggtgaagggtttccacaactgcatattttgcgacttgttcttttgaaagaattggaggagtggacagttgaggaaaatgcaatgccaaggcttgagaacatggttattgaccgctgtgagaagctgaaaaagattccagaaggactgaaagctatcacttctctgaagaaattaaaaattataggaatgccagtagaatttgaacataaacttcggactaaagatttgttcgacttcacaaatactccagtaattgaatcaactacagacattttggcaattgctatggaatggaagcattttcaagtattggcactccaattttcagcatgcctgctttag

SEQ ID NO: 70176 - DNA, 4866 bp, Glycine max
  Peptide Sequence Number=SeqID_186954
atgacttatattaggcattttctcctgtccctccttgttgcactcactttactggttcacccgagtatcttatatcatatatgtgttggtcatgtccatatccacaagtcactccatgtttccaattggataacttgcaatagggttactgataatcgtgtaaagggagagtgtatgaaactaccggattacaggcacagaggaagcagaaatcgcaaaaacaaagaaaagcaacaggatagcagaaacaggggtacaagcattcttcgttctaggaggcactggccctcgaagccagtattcccttttgattccctttctgtatcaacttttggtgctctcgttgccctaatgcctgattctgagaagaatccaggcccctctgaccgcttggaggatgccctgcttcgccttactacccagaatatgtatttgggcgaatctgttcatgccctgacccttcaactcaaggagcttcttcagcgtacgaacaccacaccacaatcgagtccgattccgattcctctttctcctacgtcacctacacctgcgtcacaacatcatatgaagttagatattccacggttcgatggttcagagcctcagggttggatctttaagatcaaccaattttttgagtaccatagtactccagaacaagataaactcaccgtggcttcgttttatatggaaggtcgcgcattggcttggtatcaatggatgaaggcgaacaaccatttcacctcttggtcatccttcattcaggccttgcgtgctcgtttcgctccgaccccgtacgatgaccctactggtgttttgttcaagcttacgcagaaggggacagtggcccaatatctgactgagtttgaggatcttgcgactcgtgtggtgggcatatcccctccgcttttattgagttgctttatctcgggcctttcccctgagattcgccgagaagttcaagcgcatcatcccctttctatggtgcaagctgctgggcttgcgcgtttacaggcagagaaggtccttgaccaacgtccgtctccgcggtcacgaccacccaacccaactccctttccgcctcagcttggccctcctccttccctccccgcgcctaccctacctccgttattgaacccacccccaccccctcgtcctccaaccactcccatgtccaccccaaccctcaaacgggtctcccccgatgaaatggctctccgccgcgagaaagggctttgtttcaactgtgatgagaagtatcacaggggacacaaatgctcctctcgatttttcattctcatttcagatgacctagaacccataccctctcatatacccattccagacctaacccatcacccaccacccgacccgcccgataacttggatttatacccgacccaaatctcccttaactctttagcaggccatattgccccggagaccctccgttttgtaggccagctttccggccagcccatgctcattttagttgatggggttagtacccacaacttcattcaactgcagatggtcacgaaattgggcctcttgtgccacgaaacaaagccattacaggtgctagtaggaaatggtcagcatctgacctgcaactatgtttgcgaagcaattcctgttgaaatacaaggccttaccttccccattgatttgtatgtcttggcgatttcgggcgccaacatagtcttgggcgttcaatggctcagaaccttagggcccgttcttacggattataccaagctctgtatgcaattcttttttcaagatcagttggtgacattacaaggcgacacagaggataccctggggatgttatcttcctcacaattctggcgtcttctccggcgacaaagtcctggtttatatttccacattaccgtcgcaccatctgatacgaacctgatttctagtgctgattttccggaggacattcgttccttacttactaagtttgattctctgtttcatccccttcaggacatgcctccggcgagggaaaccgatcatcatatacacttgttaccccaagctactcccgtaaatgtgagaccatatcgatacccatacttccaaaaacaggaaatagaagcgcaagtggcctcaatgctgcaaaaggggttgatccaacccagcactagtccgttttcgtcccccgtcttacttgtgaagaagcacgatggttcatggcgcttctgtgtcgattatagagccttaaatgcgatcacaattaaggatcgatttccgatacccacgattgacgaacttctcgatgaattgggcagtgctcagtgcttctccaagctcgacttgttgcagggctaccaccaaatacgcatgcattccggcgacattccgaagacagcttttcggacacatcacggccactttgagttcaaagtgatgccgttcgggctttgcaatgcctcgtcttcctttcaggctactatgaatctcattttccggccctacctccgccgctttgtcatcgtcttcttcgacgatatcctgatttacagcccttctttctctgaccatctgaaacatctggaacttacttttcaggtactccttgacaacaattttattctcaagctgtctaagtgctcctttgcacagtcgcaggtggaatatttggggcatttagtttcctcacggggggtagaacctgtcgcgtccaaagttgccgacgtggtccagtggccaatccctcagtcaccacgagctctacacagctttctaggtttagctggattctacagacgttttatcaaaggttatgctatgatcgccgaccccctggtcaaggctacaacaatggagcccttccaatggtcttctcaggcacaaatggcatttgatcaacttaagcatgcgttgtccacggctccggtccttgcattaccagacttccacctaccattcacggtggagacggatgcttctggtattggaatgggggcagtgttgtcccaacaggggcatcccattgcatacttcagtaagcccttcacggccaagcttcttcgatcttcaacctatgtacgggagttgtttgcaatcacagcagcagtgaaaaagtggaggcaatacttgttaggccatccatttacaattgtcaccgaccataggagccttaaggaattgcttacacaggtcatacagaccccagaacagcatacctatttggctcgtttaatggggtacaattacacaattcaatatcgttcgggctcacataatcaagctgctgacgcgctgtctcgactaccagagcacatgccacacactgccacgatgtccctgctcctttcagtcccatgtttgacttttttagatgaattgcacaagaaattacgccaaaatccccaatatattcagcagttccaggaggttgctaacagctctgagtcacatcctgatttcactattgcaaaggacctgttattatataaaggtcgtatctggttgccacgtaatattccactaattcactcttttctcacagagtatcatgctattccaaccggaggacacatgggagtcgcgaaaactgttgctcgtttatctgagaattttcaatggcagggactccgacaagatgtcgctgaatttgtggctcgatgtatggagtgccagcaaactaaatgcgagaccaaacgtgttgcgggattactgtgtccgttaccggtaccggcgcggccatgggaggatctatccttagatttcattacagggctgccgccgtgtcaaggaaagaccgttattcttgtggtggttgacagattttcaaagggaatccatttaggttcattaccaacgacacatacggcacatatggtggcatcattatttgtcgacatcgtcgttaagctgcatggtattccaaggagtctcgtttccgacagagatcctttatttgtcagtcatttttggcaaaatcttttccacctgagtggcacgaagctgcggatgagttccgcgtatcaccctcagagtgatggacaaactgagggcaaattgcttccgtgggttgaatggtcccacaatacttcgtggaacgtgggcacgggatcgactccatatgaggtgacatttgggcggaagccctttaattttcctgattaccttgccggatcttcccaaatagctgccgtcgatgacatattgacgaaccgtgatgaagtatttcagagcattcgaaagaaactgttaaaggcacaggagtcaatgaaacgacaagcagatgctaaacgaagagagttatccttccaaatcggggattgggtccttctgaaactcaggccgtaccggcagcgatctgcgaggggaacacagtcaacttctggcaagttggctaaaagatattacggcccatttcagataattgacaaggtgggagcagtggcctatcgtttgaggttaccggagggaactcggattcactcagtttttcactgttccctacttaaaccatttcgcggtgaacctgatgtagttcgtatagctgactttccagaacaattcctcaatgaccaacctttaataactccattggctattttggattatcggaaagctgcagataaccagaatgctccgtgggaagtattggttcaatggcaggggttatccccagatgagacatcctgggaaaattgggatcaacttaaacaggagtatcaccttgaggacaaggtgattctccaagggcctcgggaagttgatagcacagaggaagcagaaatcacaaaaacaaagaaaagcaataggatagcagaaacaggggtacaagcagtaagtggtaaaaggaaaattagtaagcctgcataccttgatgagtatgtgtga

SEQ ID NO: 70177 - DNA, 1569 bp, Glycine max
  Peptide Sequence Number=SeqID_186955
atggcactgtttcagacacggaagaagtcttcttcaccttcttacgtatcaaccttgacaatattagtattcatcgcactatgtgtttttggcgtgtggatgctaacctccaactcagtagtgccacctcaaacacagagcgatgaagacacctcaactcgaacagctatagatacctctgcaaccaccaatgatgaactctcttcctccgaagattctcatgaaaccacctcgaaaagcggagaaaaagaaaaggacaatcctactgctgtgtatggagacaaccctggtcatcttcctgatgatgccattaaagccgatgataataattccaacaatgagccacaaaagcaacaagttgacattagtgactcacagctttctgaggaaagctcgttaactcaaaaagatcaagtcacagctgtgatacatgaagctggttcagacagtgatgtgaaaatttctgagcctgagaaacaggatgaagagaatcaagagcaacaagatgtccaaagttttggcactcgaggagggtctaaaacggaggaagatgaagcaaataaggaacaactgagggaggacaaaggtgtggttgaagtggcaaagaaatatgaaaaggtaccagcagacacgtcacaacaggattctgatgcggcttcaaagggcacaagctctcaggaagaggaaactcaaaacccaaaagcagagaagaaaggtggaaagtcaaagaagccgtggtcaacacaagttgatcaatcgcaacaagagaacaagagacagacggttgaatccaacagcgatgagaaacttgaagatcacacgtggtatctctgcaatgtcactgcaggtgctgattatataccgtgtttggacaacgaaaaggctttgaaacagttgcgtagcacaaaacactatgaacacagggaaaggcattgtcctgaggaccctcctacttgccttgtgccgattcctaaaggttacaaaacacccatcgagtggcctagcagcagagataagatatggtaccacaacgtaccacacaagctgctagcagaggtgaagggacaccagaactgggtgaaagtggctggagagttcttgacattccctggaggtggcactcagtttattcatggagctctccactatattgattttgttcaacaggctgaacctaatattgcatggggaaagcgcactcgggtgatcttggatgttgggtgtggggttggtagttttggaggttttctatttgaaagagatgttattgcaatgtcttttgcacctaaagatgaacatgaagcacaagtgcaatttgctcttgaaagagggattcctgccatatctgctgtcatgggttctcaaaggctaccatttcccagcagtgtctttgatcttgtacattgtgcacgttgtagagtaccttggcatctagatggtggcatgttgcttttggaattgaatcgagttttgcgtccaggaggttattttgtttggtctgctactcctgtgtaccagaagcttgaggaagatgtagagatatggaagggtaggattacatatctttga

SEQ ID NO: 70178 - DNA, 774 bp, Glycine max
  Peptide Sequence Number=SeqID_186956
atggcaacccatgttgatgaaggaaaaactgagaagaaggtggaggagcataaacaacagctggcaactgagccgacacttgaactcgtttctgacttagttgaacttgaggaagttatggaagatgaagatgaccaacaggagagagaaacaccaataaaagagagtgaaatagaaataaagatgaaggaagacaaagaaaaagaaaaagaaaaagaaaaagaagaaaaggttgaggaaagaaaaaagagtaagagaggatatgaaagagagaagaagagagaactctctccagctgaaggcaaggaagtggcatatccattggtaccttccaagaaggataaagagcgacacttagccagatttcttgacatcttcaagaagttggagatcacattgccttttggagaagctctccaacagatgtcactctatgccaaatttttaaaagacatgctgatgaagaagaaccggtatatccacagtgacacgataattgtggaaggaaattgtagtgttgtcattcgacgcatccttccaccgaagcataaagatcctggaagtgtcaccatcccgtgttctattggtgaggtcgctgtgggtaaggctctcattgatttgggagcttgtatcaacttgatgcctttctccatgtgccggcgacttagagagttagagataatgcctactcgcatgaccttacaattggttgatcgctccatcacaagaccctatagagtgattgaagacttttggttagggtcaaacatttga

SEQ ID NO: 70179 - DNA, 1026 bp, Glycine max
  Peptide Sequence Number=SeqID_186957
gtggacgaattgaaggcccaaatcacttggaagctggatgaagggtccaaagaggactctaataatcacaacaagaagtatagctttgaattaaccttcaatgagaagcatagagagaaagcattggatctgtatattccacatgtgcttaaaacatatgaagccataaaagctgagaggaggatcgtaaggatctattccaggttagatgggtattggaacgatagcgagttatcgcatcctgccacattcgactcactggccctgagtcccgagttgaagaaagatatcattgatgatttggaacggttccagaggaggaaggaacattacaagaaagtggggaagccttggaaacgtggctacttgttgtatggacctcctggaactggaaaatccagccttattgcggcgatggcgaactacttgaaattcgatgtgtatgatttggagcttacttctatttattctaactcggacctcatgcgatccatgaaggaagcatctaaccgttccatcgttgtgattgaagacatagactgcaacaaagaggtgcaggctagatcaagtggtctttcagacgatcaagattcagtccctgacaatgaggctgccaaggttaagacaaataggtttactctgtcgggtctgcttaactacatggatggtttgtggtcaagtggtggagaggagcgaattataatattcactactaaccacaaagaaaaaatagaccctgcgttgttgcgccctggtcgtatggacatgcacattcacttgtccttcctcaaaggcaaggcctttcgagtcttggctaccaattatttgaatattgaaggagatcatccactctttgaagaaattgatggactattggagaaattagaagtcacccctgcagtagtagcagagcaactgatgagaaatgaggatcctgatgatgctttggaaacatttgttacatttctcaaagaaatggacaaggatagtaattgccacttagagttaagagggactagtgagtag

SEQ ID NO: 70180 - DNA, 180 bp, Glycine max
  Peptide Sequence Number=SeqID_186958
atgagggatcggaattgctggggaatgaggtcatggaatgctgttctgaggagcatcatgaatgtggagaaggcagcgtacacctcgaaccatgatgaagctgaggtgaaagaagaaaaaagttgtgctgaaacttcctctgcacactctcggaaagtcagagttgtttgggacaactga

SEQ ID NO: 70181 - DNA, 453 bp, Glycine max
  Peptide Sequence Number=SeqID_186959
atgccgtttttaaaagcacgccctgaattgttgaccttgtctggattactgaacttcatagacgggttatggtctagttgtggagacgagagaatcatcatattcaccaccaaccacaaggagaggctagacccagcactgttgaggccaggaagaatggacatgcacattcacatgtcctattgctcctaccaaggcttcaagattttggcctcaaactacttagaaactccctctgatcaccccctctttggtgaggtagaggggctaatagaggacatacaaataacccctgcgcaagtggcagaggagctgatgaagaacgaagaccctgaggccacacttgaaggattcgtgaagctacttaagaggaagaagatggaaggtgatgtgtgtgagaactctactcctgataaagcagaacctactcatcagcaatctaagaggcgcaag

SEQ ID NO: 70182 - DNA, 249 bp, Glycine max
  Peptide Sequence Number=SeqID_186960
atggtagacattctcacagtaatctttgcaattgcacaaagtgttcgagatgctctcattataaactggaatcctacctatgattactatgagaaactgaatgttaagcaggcatattaccttttgatggaatttttgcaggctagagcactattaaatgcaataggaaatctagagttaattggtccctatgctgaggctttgagcaagctcgggcataaattagaaaatgtggcataccaagtgtga

SEQ ID NO: 70183 - DNA, 351 bp, Glycine max
  Peptide Sequence Number=SeqID_186961
atggttaagaagacagtgttgaaggttgacatcagttgtctcaaatgcaaaacgaagctcctcaaaattgtctcttcccttcaaggggtggataaaattgaagctgatgaaggaaagggtacgttgaccgtgacaggggatgcagacccatatgaaataatagttcgcataaggaaagctggcaaacatgctgaagttgtgagtgttgggcctccccgggaccctccagtatggcatagtttgggcctcatactgattgatgaatcgattcaccaatccgtgtcagctttaccgaaggataaaaaagaaattttgctgttttctgggtgtaccagcaattatgctgggtga

SEQ ID NO: 70184 - DNA, 469 bp, Glycine max
  Peptide Sequence Number=SeqID_186962
gttattggtcctcctgaagctgccattcctgttcgtgttcgagttggagttcgcaccagttcccattcgagttggtgttcgagttcgagtacgtgttggagttcgagttcgagttcgcagctgttcccattcgagttcgtgttcgtcactgtcgcatttagtgaccctggacctcagcagcactatgcctttgtgggtttgtgtttacaatgaccctggagctcacttatcagtgaagtttccatcaaagctgccattcctgttcgtgttcgagttggagttcgcaccagttcccattcgagttggtgttcgagttcgagtacgtgttggagttcgagttcgagttcgcagctgttcccattcgagttcgtgttcgtcactgtcgcatttaggtacgtgggcaaacctgcttctttctgtgctttgtggtcataattcgtgtcgtcatttcccacattgtagagtgtga

SEQ ID NO: 70185 - DNA, 240 bp, Glycine max
  Peptide Sequence Number=SeqID_186963
atgagagatgagaattccaagaaaagcaaggggaatgaaattcaacattttgagtgtgttggtgtttgcatattgcaagctgttgactgtttgtctttctgttgcttgatgaagctctcatggtcaaagaaaatggtcagaaagttctttaatatcaaaagcaagactgaggattcccaagaaaatggtgttgcttatggaggttggtatcttggttttctccaaagctctttctactag

SEQ ID NO: 70186 - DNA, 411 bp, Glycine max
  Peptide Sequence Number=SeqID_186964
atgtcctggacattgtatccgacatcgtggatcctgcattgtgcattgtgcagcaactccagtattttcgggcaggatgtcctagacattgtatccgacatcgtggatcttgcagcttcaattcttcacttgacattttatcttgccttgattgtggaatcaagaaatgtcaagtttcttgaaaatgacttgattagtgggagtgatcaattaaggggcctaggttctgaaattgatcatataaagtctcagccttccatattaagtcaaagattggttgtaattcatacccctcaagttcaaagggatgatgaacaaccaatgactgacattccacaacctgttgctgataatccagtagatcaaattgatcatcaaattcttgaaaatgatgaacaactagctaaataa

SEQ ID NO: 70187 - DNA, 475 bp, Glycine max
  Peptide Sequence Number=SeqID_186965
atactacatcattctcaatgatccaaagtatcttaactctgatgataacaaccaagttaacccaccattaccctcccttgatgaagctgcaaagggtaaaagtgtagtagcaacagaacccaccaccatttctaagtcattatttgtccttcccccaatttgcaagaaaactatggatgaaatttggtctcagatccacaaaagccaaccacactacaatgaagctaacaatagccttgctaggaatgagccactactcaaagggcaacaagcacttggggaaatgactttggaggatttcctagtaaaagctggggtggatgtcactacaaatgacgttttggagaaatgtccaagcttaggaaaatgcacttcattcaccaggactaacacggcagcgatgacgaggactagcacaacagcgatgacgaggaccaccacgacgcgagtagctcaacacccaaaccaaacttga

SEQ ID NO: 70188 - DNA, 510 bp, Glycine max
  Peptide Sequence Number=SeqID_186966
atggctccgatgagttccacgccgtatttttcgagggtgccgctcttggcgagggcgaagacgaggttgaggggtctggccgcccatggtggggaggagcgcgtcgggacgctcccattcgaggacgcgctcgacgaggtccggcgtcatgggggtgatgtaggtgcggtcgacggtttcgggaccggtcatgatagtggcggggttggagttgatgaggacaacctcgttcccttcttcgcggagggccttgcacgcttgggtgccggagtagtcgaactcgcacgctttcccgatgacgatggggcccgcgccgaggatcaggatcttctttatgtcggtccacttgcccaatttgggggcgggtggttccgcgacggcgacgttggagcatctgacacgcgcggggttgaggcacgtggtgggaggaggacatgggcggagggtggtggccggaacggcgttgttttgggagagaggtttagaggaacggaacgggaaggggagtga

SEQ ID NO: 70189 - DNA, 2421 bp, Glycine max
  Peptide Sequence Number=SeqID_186967
atgaagaatattgggattaaaacccctccctccggcattggcaccactctcgatgagtgcctcagcattgccaatgatatcggcgaatatccgttaattgtgcgcccggcgttcacgcttggcggcaccggcggcggaatttcgtatagcatagaaggtttgttggaaatttgcgaggctgggattgctgctagtttgaccaaccaggttttgattgagaagtctctgatggggtggaaggagtatgagcttgaggttatgagggatttaactaacaatgttgttatcatctgctccattgagaatattgatcctatgggggtgcataccggggattcaattaccgttgcaccggcgcagattttgatggataaggagtaccagaggctgagggattattcaattgctataattagagagattggtgtggagtgtggagggtctaatgtgcagtttgcagttaatcctgagaatggcgaggtcatggtgattgagatgaactcctgggtttccaggtcttcggctctggtgtctaaggctaccgggtttcccattgcgaagatgacagctattccacggtttgcttttgaaaactttcctgggtctctgccaatattgacgacacagatgaaatctgttggtgaggcgatggctgtaggtatagcctccaagttcctaacccagagcatttatgccatctatcctgcaatgaaaagagggatgcagattgatgaaatctttgagctgagttacattgacaaatggtttctcacgcagttcaaggagctggttgatgtggaaagtttcttgctgtctaataatttttctgatttgacaaatattgatttctatgaggtgaagaaaagagggtttagtgataaacagatagtatttgcaactaaatccattgagaaagaagttcacaataagcgattgtctctgggtgttactccagcatataagcgagttgatacctgtgcagcggaattggaagctaatactccttatatatattcttcttatgattttgagtgtgaatctgctcccactacaagaaagaaggttttgattttgggtggaggaccaaatagaattggtcaagggattgagtttgactactgttgttgtcatgcatcctttgctcttctgttagatagttatgctgagttttgtgcagttgctactcttactatatgtaacccttgtcactctccacagattatgacactagtggaccgtctatactttaaaccattgactgttgaagatgttttgaacattattgatttggaaaggcttcatggtatcattgtacaattgggaggtcaaacaccattgaagttatctttccccttacaacaatacctagatgaacacaagccagcatgtgctagtggggttggtcatattgaacacccaaaaggaggaattgctaggagtgaaactgatgcacctgccactgcagcagatattggatacccagttgttgttcgtccttcttatgttttgggtgttgaggttgatccagagcaccctgtattaattgacaagtatttatctgatgcctgtgacattgatgttgatgcactggctgactcacaaggtaatgttgtcattggtgggataatggagcacattgaacaggctgggatacattctggtgactctgcctgctctattcccaccagaactgttccttcttcttgcttggagacaatcaggtcgtggacacaaaacttggttaaacaattgaatgtccgtgggctcatgaattgtcagtatgcaataactccatcaggggatgtatttttactagaggccaaccctcgagcttctcgtacagttccatttgtatcaaaagcaattggccatcccttggctaaatatgcttcccttgtcatgtctggaaagatcctctatcatttacagtttacaaaagaagttatccctaattatgtgtcagtcaaggaagcagttcttcctttttcaaagttcccaggctgtgacgtgtttttaattcctgagatgcgaagtactggtgaggtcatgggtattgacccttcatataatattgcatttgctaaggctcaaattgctgctggccagaagttaccacttgttggtactgtgttccttagcttgagcgacttaacaaagccacatcttgagaagatagcaatagcttttgttgagaatggcttcaagattgttgctaccagtggaacagctcatttgcatgaagggaggcctcatgctggtgacattatagccaatgggaacattcagctgatggtggtaaccagttcagatgatgcacttgatcggatagatggtctggcatcgagaaggatggctttggcttacaaggttcctatcgtgacaacagttaatggagagctctggcaactgctgaagcaataa

SEQ ID NO: 70190 - DNA, 150 bp, Glycine max
  Peptide Sequence Number=SeqID_186968
atggtcattgagcatataagcaccgagctgatgattgttgatcctttggttaagggcatgccaccgtttaagttcaaggatcattggtctgaacgttttggacttggaaggtcatctttggctaaagtgctccatcagttttggagttga

SEQ ID NO: 70191 - DNA, 600 bp, Glycine max
  Peptide Sequence Number=SeqID_186969
atgcacaattgccctaagtttggggtatcatggtacaaagtgaaggatgacaatgagtgtagcagtgatgaaagcaccatgaaaggccccccaacaaaggttttatggtatcttttgatcattccaatgttcaagcatttgtttgctaatgcagattacgcaaaataccttacatggcatgcagataggagaaattgcgatggaatgctccggcatccggctgattcctctcagtggaagaagattaatagtctatatccagaagttggcaaagaggcaaggaatcttagtttaagcactcaacacagttcatggcctgtttttctacaaaaatacatggtgttttttatgttgatatcgggcccaagacaaccaaaaaatgtcattgatgtttatctaagtcccttgattgaagagttgacaaagttgtgggatgagggggttactgtgtttgatgggtatcgaaatgagacatttaagtggcgtgcaatgctattttgtaccattaatgactttcctgcatacgggaatttgagtggatacaatgttaagggccaacatgcatgtcctatctgtgaagaagacacaacctatgcataa

SEQ ID NO: 70192 - DNA, 150 bp, Glycine max
  Peptide Sequence Number=SeqID_186970
catttacgaccagagattccaagaagttgtccaagtgccttatcaaacatcatgcgaaaatgctgggatgctaaaccagagaagcgtccagaaatgcatgaggtggtggaaatgttagaagcaattgatacaagcaaaggagatgaatag

SEQ ID NO: 70193 - DNA, 222 bp, Glycine max
  Peptide Sequence Number=SeqID_186971
atggtaaagtgtcttgtgaagttgcaaaccaaatttcgagaagatccaacggttaacgaaggctgggcagcgtttctaccgaggcagcttcataccaaatttcgagaagatccaacggttaatgaaggctgggaagcgtttttaccgaggcagcttcatgtagctttctctagaagcttcattaagagacttcctctagaagcttcctcgtggcttctttga

SEQ ID NO: 70194 - DNA, 273 bp, Glycine max
  Peptide Sequence Number=SeqID_186972
atggatcaacatgacttttttgggagtggtgtttttgggcgaaatagtcattggcgcaaaggattttggttgctaataaaaaaggggaccgcttcatgtgtcatcccttcgttccttcttccgagggtaagggtagcaattcccatcctaggtcaaggtttatggccgatgagtgctcaacaggcttgtagagggctaggcatgatgtatgtcagggatgtttgtttggcaagcggttcagggataagggaatgccccacattatttccatga

SEQ ID NO: 70195 - DNA, 966 bp, Glycine max
  Peptide Sequence Number=SeqID_186973
atgcattcagaaggtggggttacaccgaagatgggattggaagctgtaccttcgaattcaaagatgatatgtagtgaaaaccttagcagcaaaaatatgaattttagagccgataaaattgatctgatgaatttggatgtcatgctagaaaaacacgtcaacaggattttttccaaaagcattgaggcaaaaaggcataaagagtcatgggagattgatttgaccaaattggatttacaatattgtgtagctaatggggcctatggcactgtctacaggggtacttatgacaatcaagatgttgcagtgaaagtcttggactggggtgaggatggtgttgccactgctgttgaaattgctgctttacgagcatcattttggcaggaggttactgtatggcaaaaacttgatcatccaaatgtcacaaaattcattggggcttcaatgggcacttcaaatcttaagattcccttaccaagctgtggtcaaaattctgttccttccaaggcatgttgtgttattgctgagtttcttcctggtggaacattgaaacaatacttgtttaaaaataggcagaacaaacttccatataaggttgtgattcagctggctttagacctctctagaagtcttagttatctacattcaaagaaaattgttcatcgcgatgtaaaaactgacaatatgctgttagatgccaaacaaaatttgaaaatagctgattttggagttgctcgtgtagaagctataaatcaaagtgagatgacaggtgaaactggaacctatggatatatggcaccggaggttttaaatggcaagccttacaacagaaaatgtgatgtctatagctttggcatttgcttgtgggaaatttattactgtaataggccttattcaaagctaagccttgctgctgtgtcacgtgcagttattaatcagcttcaattctttcctggttctgtgtga

SEQ ID NO: 70196 - DNA, 414 bp, Glycine max
  Peptide Sequence Number=SeqID_186974
atgagtttaaatgttgatggagcttggtttgtccatgatcccaaagctgcatgcggagggattctgagagatcatgtgaaggacaatttcaaggagcttttgcatgcggattggaagtatatatgctctgttgtgcaatctgaattatgggtcatttttcatgggattaatttggctagggagcacgggttttcatccttggaaatccactcagattcaaaagatgttattcgtatggttaaaggcttaaaggatttgcatgtcagagataagtgtactgtggatgcaactaaggcatgcattgtgcctcttatgaatgtccattttgttcatgtgtttagagtccgtaataaggtggctgaccatttgttaagtatgtatttgctatccgagctgagtttcaaagcttggtga

SEQ ID NO: 70197 - DNA, 306 bp, Glycine max
  Peptide Sequence Number=SeqID_186975
atgcattatctttacacagtacttgcttcctcggatcttccacaccattatctcaagtccaacaatgttctcgttggaccagacaatgaaccaatgcttgtagattacgggaaggcaccagaggcaacacaacaaggccaggtttcacgcagttgcattgttcactgtcttggtgttgtcataattgagatattgacagcgaggtttcgttctcagtatgttagcaatggaaagggtggggctgatgtggtgcaatgggtggaaactgcaatctctgagggacatgcagatatattttcagtttaa

SEQ ID NO: 70198 - DNA, 747 bp, Glycine max
  Peptide Sequence Number=SeqID_186976
atggaagtgacacaagtactgcacatgaatggaggctcgggagaaacaagctatgcaaacaattccttagttcagcaaaaggtgatttgtttgacaaagggtatgagagaggaagccataagcagcctctaccgcagcatgctcccaagaagccttgcagttgcggacttgggttgctcttctggaccaaacactttcttcgtgatatctgaagctataaaatcggtggagaagctttgtcgagaactgaatcatcagtcaccagaataccagatctacatgaacgatcttcccgggaatgatttcaacaacatcttcaagtcccttgacagcttcaaagagaaactgtgtaatgaaataatagaagctgggcatggaattggttcatgttttttcaatggggttccagccttatgtggctatccaagtgaatattatgttaactatacaatagcaccagattattattacaagtcctataggagtgacaaagttcctgatggtgtagagaacaataagggcaacatttacatggccagcacaagttccttaaatgtccttaaggcttattacgagcaatatcaaaaggatttctcgttgtttttgaagtgtcgagcggaagaaatcgtggaagggggtcgtatggttctgacatttttgggaagaagaagcgacgatcgatctagcaaagagtgttgctatatatgggaacttttggctatggctcttaatgatatggtctcgaag

SEQ ID NO: 70199 - DNA, 295 bp, Glycine max
  Peptide Sequence Number=SeqID_186977
atggcgtcatatttggtgaatggcaatgcaacaaatgaattcagtatggagtataggtcaaagcttaacgcatatgtacaatttatggatgatactcttataactggtgatataatgcaccaaaatgtgtgtacaattaaggtgattctacaattatttaaagtggtgttaggcttgaaggtggttttgattccttttgtgttctttgccctacctatagaagcttaccacatgaagttgtctattttgtatgcgctttcgatttacttcctttctcttttcaaggcgcctaaag

SEQ ID NO: 70200 - DNA, 327 bp, Glycine max
  Peptide Sequence Number=SeqID_186978
atggccagaaatttcaacatgatctcgatttgcggttgctactacggcggtggattcggattttttcttactgttgttgtggaaacaatccaacttcgttatgagagtgtctctacggtttctaagtttaattttttctttccatcaaggagaagagaaggtggcagcttgggtggaggaggtgacgtacgttgcaccttggtgacttgttggtcatgggttcgaatacggaaacagcctctttgcatatgcaagggtaaggctgcgtacaatatccctcccccataccttcgcatagcgaagagcctctgggcaatggggtactaa

SEQ ID NO: 70201 - DNA, 2393 bp, Glycine max
  Peptide Sequence Number=SeqID_186979
gtgccgtgtcgtctgagactaacgacaaacaagagataagatgcagagcaatatccaaaccacgaacacaagaatgttcagacatatttcagggtagtctagcaacgttaaagtttcgtgagattaatgtggaagatgacatagaagaggagcaagacattggggctttggtggcaaatgagatcaagaagagagtggacactatcaaatcaatattgggttccatggaagatggagagataacagtatctgcttatgacactgcttgggttgctctgatagaagatgttcatggaactggtgtccctcaatttccatcgagtctagaatggatagcgaaaaatcaacaccccgatggttcatggggtgataaggaattattctcagcccatgatcggattattaacacgttggcttgtgttattgcattaaaaacatggaatatgcaccctgaaaagtgtgagaaagtaataagttccatcctgttaagcaaggtttcaagtttaagttttgtgattgaaaagaaaggcttcatcaaagatgataaatcaagttccagaatggcattttttagagagaatcttggcaagcttcagaacgagaatgtagagcatatgccaattggttttgaagtagcctttccatcacttcttgacatggctcgtggcttggacattgaagtgccgaacaattccccaatccttaataaaatcttcgcaatgagaaacgtaaaactcacaagaataccaagagctatgaggcataaagtgcccacaagtctccttcatagcttggaagggatgtcaggccttgactggaaagaacttctaaaactgcagtctcaagacgggtctttcttgttttctccgtcatccacagcctttgctctcatgcaaactaaggaccaaaattgccacaattacttgaataaagtggtcaagaggttcaatgggggagttccaaacgtgtatccagtggatttgttcgaacatatttgggtggttgataggcttgaacgtctaggaatatctcagtattttcagcaagagatcaaggactgtttgagttatgtttacagaaattcaaatgttcaagacattgatgacacggcaatgggtttcagactattaagattacacggttaccaagtttcagccgatgtgttcaagaactttgagagaaatggtgaatttttctgctttacggggcagaccacacaagcagtgacaggaatgtttaatctgtatagggccacacaaatcatgttcccgggagagagaattcttgagcacgggaagcacttctctgccaaatttttgaaggagaagagagcagcaaatgagcttgtagataaatggatcataatgaagaacctggcagaagaggttgcgtatgctttggacgtaccatggtatgcaagcctacctcgagtggagacaagattctacattgatcaatacggcggtgagagtgacgtgtggataggcaaaaccctttataggatggcatatgtgaacaacaataactatctcgagcttgctaaattagattacaacaattgccaggcactgcatctaatagagtgggggagaattcaaaagtggtactcagaatctagattggaggagtttggaatgaacagaagaacgcttctattggcctattttgtggcagcagcaagcatatttgagcctgaaaagtctcgtgtgagactagcgtgggcacaaaccagtatcttacttgagaccataacatcctatgttagtgatgcagaaatgaggaaagctttcatgaaaaaattcagtgactgtcttaacaggcgagactactccattggctggaggttgaacaggaacagaacaggacatggactcgctgagactttggttgccaccatagatcaaatctcgtgggatatactcgtgtctcacggtcatgaaattggatatgacatgcatcgcaattgggaaaagtggctttcgagttggcatcgggaaggagacaaatgtaaaggacaagccgagcttttggcgcagacaataaacctatgtggcgggcattggatttccgaggatcaagtgtcggatccactgtatcagagtctccttcaactcactaacaatctctgcaataaacttcgttgccaccaaaaggacaaggaacttgagagcagcaacagcggcacgaatgtaaacagcatgatcacccaagaagaagagtcaaaaatgcaagaactcgtgcaattggtgcaccaaaaatctccaactggcattgatttcaatatcaagaatactttcctcacagtggccaagagtttttactatacagctttttgtgattcaaggaccgtcaacttccatattgccaaagttctgtttgatgaagtcgtttaa

SEQ ID NO: 70202 - DNA, 297 bp, Glycine max
  Peptide Sequence Number=SeqID_186980
atggcgaaaaattgctgtagtactttttttcttgccatggatgctattcgtcattggacaccacattattgggacgttaaaaatgcatttcttcatggagaactagaagaatattatatggaacaaccacttgactttgttgttcatggggagtttggactgtggttcaatcaaaggatggaatcactgtttaacagaaggaaattagacgtgcttaaagaatcaagtatgttagattgtagacccattgatagttccaaggatccaaatcataaattttttccttatcaaggataa

SEQ ID NO: 70203 - DNA, 231 bp, Glycine max
  Peptide Sequence Number=SeqID_186981
atgggccccatctattccatcagaaccggtgcttccactctcattgttctcaactctccccaccttgccaaggagcttattatatcggatcaggccatggtgaccagattttcatcaatctcaacaaggaagctatcaaatgcactcaagattctcacttctgataaatgtatggttcccactagtgattacaatgaatttcacaaaacagtcaaaagacattcttactaa

SEQ ID NO: 70204 - DNA, 2688 bp, Glycine max
  Peptide Sequence Number=SeqID_186982
atggctgctatgaatgccatacctggaaatctccctgtgtttgacaggaaaggttatgaagattggtgcgcgaagatggatgctattcttggattccaagaacttgatgagatcgttgcaaccttgaagcaagcatgggatattttgcaacaagtctatggaaatactgggagaacaaagaaggtggtgacaaactcaatgaaagcctgtgatgaagcaatggttgattcaaagattgtggagaaggtgctcagaacattaacacccaactttgatcacattgtagtagccattgaagaatcgaaagatattgagaatatgaaagtggaagaattgcaaaactccctggaggcacacgagcaaaggccaaaaccaaccacaagtctagaggtcatggtggctggaccaaaagaggaagaggaagacaaagaggaggcagaagtggtgatcgaaatgcagaaacacaaagttcaacttcccgagagcatattcttagaagcaattcaaatgagcaacgtgataattccaattctagaggagacaactctttcaaaagtcgagatgattggcaacaacaatgcccattgcaaatgcaagaagaatgatcaggcacacttggcacatgaagaagatggatctgattcagaccaagttttgcttatggtaaccatgagcagtaaagaagactgttcttcttggtttgcagataatagcaccattcttgcagaaggtattgggaaggtgatgatcacacgaaagaatggagagacaacagccaaacaacctcttggaatagttcattcagacgtgtgtggatccttcgatactccatcccttggtggtaacagacaatctgaattaaagctaaagatccttagaacaaatgaaggggatgaatataactctaaggagttcaaagaattttgtgaagctaaaggaattgaacatgaggtaatagctccctatacacctcaacacaaaggcttggcagaaaggacaaacagaaccctattggatatggctaggtgtatgcttaaagggaaaggactaccaaattgttactgggtagaagctgtcaccaaaacaacttatgttttgaacagatgtcccaccaagagacttcaatctataacacctgaagaagcttggaccggagacaagcctatagtgaatcatttaaggatctttaggtctcttagctacaaaaacatcccagacgaaaggaggaagaagctggatgataagagtgaagctcttatcctagttggatatcatccaactggtgcatacaaactttactgccctttgaagcagcaggtggtgattagtagagatgtcgtgatagacgaaactgcaacctggaagtgggaaaatgattctaaaattcacaactcatatattctcgaggatagcccaagagccaaggatgttaaccctgctagctcaatgcaacctcttataagaaggtcacaaagaacaagatttccctccacaagacttgcagattatgagttgtatagtaacagttcaatctctgatgctggtgaaatggtacattttgctgttatgattgacacagaacctgtacattggaagcaggccttggacatcagagaatggaatgttgttatgaaagaagagttggatgccatagagaaaaatagaacctgggagttggttgatttgccacataataaacatccaattgatgtgaggtgggtgtttaaagtaaagctcaaaccagatggcttaattgcaaaacacaaagccaggctcgttgcaaaaggattccttcagaaacaaggaattgattatacaaaagtatatgccccagttgcaagaatggaaacaatcagattagttattgttattgccagttctagaaattggaccatatgtcagcttgacatcaaatctacttttttgaatggtccattagaagaagaagtatacatcttgcaaccaccaggatttgaaataaaagggaaggaacacaaagtatacaaattacttaaagctctttatggcctcaagcaggcccctcgagcttggaacagggtgattgaaaatttccttagcaaacaaggatttgtgaaatgcacactagagtttggtgtgtatgtaaaggaaactcaacacaagaacttgctatttgtatgcctgcatgtggatgatttgatcattacaagagatgtggatgaagaaatcgagcaattcaaagaaaagatgaagtcagagtttgacatgacagatcttggaatcctgcattattttcttggttttgaatttatgcatacacagaagggaatcttcctacaccaaaaaaaatacactagtgaggttctaaaacgctttaatatggagaattgcaacacagtcccagtacccgtgatgccaaacttaaaattaacagaagaactggatgaaaagccagttgatgcaacattgttcaagcaaattattggctcactcatattcctatgcaacagcagacctgacatttgttatggagtgggattgcttagaagattcatgggtaatcctcgagctcctcacatgactgcaactaagcatatcttgaggtatctcaagggaacaagtgattttggtttattgtttccaatagggaatgatcaaaacaaatcatgcattaaagcctactctgatttagattggtgtggtgataag

SEQ ID NO: 70205 - DNA, 1152 bp, Glycine max
  Peptide Sequence Number=SeqID_186983
atgccgacttttactgccatggcactggataggttgatagagcccggagcttctaagccagttgataaatctgctccaacttcaatgcctgtgccaaactcgcagaagctggagaggagtactagtgcgcccgccaagaaaagtaaggttcctcagcctccattgaagccggcactttataccactcctgaagtgacaccacttccagatgcgccttcttcgttccctccttcaccatacatcatcaaccacaaacgccgtggtccacgcctcctcaagagttcctctgaggccagtgcactgtctgaggtgaatattcgttgtgatgatgataatgataagagcgtagatgctgttgttacaagttcagctggtgacctccaagttacttctacaaagcctgaacttgttaaagaagagaaggtgaatggtgtttatgacggccaacttgatagaagcaatgatgttgaccatgcaaatggacacagagaaactggaagtggtagcttaaccaatggattactcaaggaaaagccaccggcattgaatttggacagagttagcgaggttgaagactttttttatccattagactcaatgagtttctctagtaacacagatggggaagagaatgcagggacagaattgtctatgaaactcagcagtcccagtacggagttttatgatgcctgggaagaattatcttctgaaggcatgtctcaaaattctacatacgacattgaagctgaattgcgtgaagtaaggttaagtctgttggtggagatagagaagcggaagcaagctgaagaatccatcaacaacatgagaagccaatgggaaagcattaggcaagggttatatcaagcaggaattattttgcctgcatatcttaatgccactgctgaggatgagcagctgacttctgatcccgtggaagatctatgtcaacaagtttatattgctaggttcatatcaaatgccattggaaaaggaattgccagggcagagttggagacagagatggaagctcaactagaggcaaagaactttgagattgctcgacttttggatcgtctccactgttatgagaccatgaatagggagatgtctcagaggaaccaggaagcagtaggtgagacttatgtcatttaa

SEQ ID NO: 70206 - DNA, 219 bp, Glycine max
  Peptide Sequence Number=SeqID_186984
atgagagatgaaaatactgacaagggaagtcatgtactagttgtgcaacagtctaaagagaaagtcatgcaattagtgtgtcttgaaaagtgggaggactttaaaaaattgagagttatgaagacaaatgatgacaagtttaaggctaatgtggtccaaaactttgaagatgaagacatgtatttagcaagtgctgaggaagttgctaaatcaaaatga

SEQ ID NO: 70207 - DNA, 474 bp, Glycine max
  Peptide Sequence Number=SeqID_186985
atgggttccccaaatatgggtggttctagaaccgctaagcctacgttacaggcaatggttcttccggatgacattcgacaggcgttattgttgatggttgaatgctgtatgaggcgagattatctggctgcaatggaccattatatcaagctggctatcgggaatgcaccctggcctattggtgtcactatggttggtattcacgaaagatctgcccgtgaaaagatctacaccaacagtgttgctcacatcatgaatgatgagaccactcgcaaatacttgcaatctgtgaagagattaatgacattttgccaacgccgttatccgacattgccttctaaagccgttgagttcaatagtttggcaaatggcagtgatttgcattcacttctagcagaagagagatttagtgggggcaatcaggcggcatctgaagagaggcttaggataatgcctgctccaagagacagctag

SEQ ID NO: 70208 - DNA, 1698 bp, Glycine max
  Peptide Sequence Number=SeqID_186986
atggcggcgaagcgtccgtgtccgtcgcaaaaccctagagcggagaacaacctgggcgaggtggagcgccgacttgaggcgttcctctcactctcccacgtggcttctctctccctcgatctctccttcgagaggctcctccaatcgctcccctccgactccgactccgatctcatcgatcgcgccctcaaaatggcctctctcctcctagacgccgccaaacactcatcccgcaaacgcgcttccaaccacaattccctctcctggcccctcccccccgacctcaccatcaaggtgttctcgatgcttgatacccagagcctgtgctatgcttcggctacttgtttactgtttagcaaatgtgctaaggatcctatgtgctatgcaaatcttgatttgacgacactggttccgaaggttaacaatgcagtagttgccacgatgattcagcgagctggaaagggactaaggtctcttaagcttggtgttgtccctagcgctgctacttcacttggatcttgtccaccattcgtttgtaccatcagaaatgctattgtagaagtacctaatttttcatggaatgacaagagatctcgacaagggagagagtcatccattctcacaagatgctgtttaagccctttaagtggggatggcggtgccccaggggctcttttgagaaagttgcacttgtacaatatcgagagaatggataatgcatcccttggtgcagcattgtcagcatgcccttctctccttgatttggaaattgttgggctgatgaactatagccaaaaaatgggcatatttgggcagtctatgctccatgccgaggtgttatccttcctcttggctgtggatagaccattgatgaaatccatggagatgtcactccaactttggatcagaataggcaatggctgcaggagactggtgagccatgttgagctgaggcaaacattaatgtcagtaagtgcaaactgccacttgatagagcgtttgttttttgagtcttctaaaacaggtagagatgacagcttgaaagcgcaaacctgttttgagctagtaaacaattgtcctcatctaacttctttatcccttagagggtttaagctacacgattgcaaagttcgtgtactggttaagggatttaggaaactgaaatatgttgacttttcaacatcctattcaatcactggtaacttcttaagaaaccttggaagctgcaatggtgggaatttacttgaggtcttaattttaagggattgcatgcatctcaaagagatggaagttgctaggctgttgactgcaattcttgcaggagatttcaaattgcttgtacatcttgacatatccaatagggaaggcttagcatctgaggctgactggtatcacaggtgctataactctagtattatgcctacgaaacaggttttggaagcaaggcctgatatgtgtctggtggctgaatatccgtcagccgaaggaagttacattgagacatttgatgctgatatgaatagtgagataagtcttccatcacaattgagcagccacacgtcagatggatcaatttttatgagtacatctgaaagcagctacaatagtgatcagggaagtggcaatgaggatggtcaagatgccaactatgtgatatatgaggaaagctcagatgagattgactttttgtccctctag

SEQ ID NO: 70209 - DNA, 378 bp, Glycine max
  Peptide Sequence Number=SeqID_186987
atgccctatacggtaatctgcacacacaattctgctatcgtgactcgagggtccggtagcatgtggagataccttatggttatccatacctttcatcaactagaggcaagcgagcccgttgacacgcagagaccaatgtggtcatttgcacccttcccggagatgtcagcgtcttccgcccgagaccgcaaaaaagcaagcgagcctgttgacatgcagagaccaatgtggtcatctgcacccttcctagagatgtcgacgtcttccgaccgagaccgcgaaaaagtctcacctttgagaagatatctggagtgtgctagaagcttcgttcccgagagcatctcttatttaagcatttcagcctttgctttcgtgtag

SEQ ID NO: 70210 - DNA, 1565 bp, Glycine max
  Peptide Sequence Number=SeqID_186988
agataccttatggttatccgcaccttgacactggacaacagttcattaaggaagaaactgttgtggatgatcatcacttgtcacttaatgcattagaaagagccatagtgctgatagatggtggtagttctgacaattttatgcaacctcgcattgctaagtttttgaagcttcctgttgagccagctccctcttttaaggtgatggtagggaatggtaattacatggaaactaaaggtctagtgcagaatttgattattcaggcgcaaggcaatgtgtttcaattaccagtatatgctctccctatttccgaagctgatcttattttgggtgctaattggttgaagaccattgggcctcatatagctgattatgccttattgaatctgagatttttacatgggaataaatttattacaatacaaggtgaagtggatcatgttccagtacaagctcatttacatcacattcgtcgtatggttaacacctattctattgttgaagtatatacagtgaagatggtggatcctattgctcaagctattccattatcagagttgctagatgacatggaacccaaattggctcttttattgcataactatgcttcggtgttcgataccccaacttcattgctgccccaccgcactcaagatcattatattccattaattaaaggctcaggccctgtcaaagtgatgccatatcattatccccacagccaaaaagaggaaatagaaaagttagtggctgatatgcttatagaggggattattcaaccaagcaagagtccttttttgtctcccataatccttgtgaagaagaaggatggttcttggcgtgtatgtactaattatcgagctcttaacgccactacgataaaggatagttttccaaaacccaccgtggatgtattgctcgatgagttatttggtgcttcctttttctcgaagctggatttgagttccggttatcctcaagttctattaacacctgaggacatacataaaaccgcttttcgcacgcatcatggccatttcgagtggttggtcatgccctttggattgactaacgcaccgactatgtttcaaggtttgatgaatgatatctttaaggacgtcttacgaaagtttgttcttgtctttttcgatgatatcctcatatatagttctttatggaataatcatctctaccatttggaggtagtcctgaaaacacttcaacaacatcagttgtatgcacgtttttctaaatgctcctttggagtaacaaaaattgagtatttaggtcatacgttttcaggtcggggagtggctatggatacaacaaagctggatgctattcgaacttggccattgccaaccaatttaaatcaattgtgtgggttccttggattatcggggtattgtcattgttttgtgaagagttatgcgcaactggcagcacctttgattgatttactaaaaaaggattcatttaaatggactgtcgcaactacaatagccttgtatcatatatgtgaagggtacaagtcgactagaaaaatgggtttgggatgtggatga

SEQ ID NO: 70211 - DNA, 552 bp, Glycine max
  Peptide Sequence Number=SeqID_186989
atggcggctagcaactatatttgcataataagtaggccaaagctcaaagcttcttcccaagcaacatactctatcttgatggagggagctgctatatgttctacagcagacgccagagaagagggtgttgatttgacccaaatctctcttcgacccattagtcttgatgatcttgatgatctcatgttgtggaccactgatgaaaaagttgcaaagcattgcacttgggaaccttacactagcaaagagggtggcatcaacttcatccataatatagcaagcaaagctccatggttcagagcaatttgcatcaataatcagccagggattgcaacacatgctgtgaaacaagtggttaaagctgcattcagcgagtttccacacttggagaggcttcaggctttagtcgatgtggaaaatgtggcttctcagagggtgctggagaaggctggttttcaaagggagggtgttctcaggaagtatgtggtgattaaaggaaaaagtagagatatgattacgttcagtgttcttcccaacgatcctctaagttga

SEQ ID NO: 70212 - DNA, 5331 bp, Glycine max
  Peptide Sequence Number=SeqID_186990
atggatgccaaagtaaaagcaatgatcaagcttattgaagaggatgcagactcatttgcaaggagggcagagatgtactataagaagcggccagaactcatgaaattagttgaggaattctaccgagcatatcgtgcattagcagagaggtatgatcatgcgacaggggagctacgccaggcccataaaaccatggcagaagcatttcccaacttgctgactgatgattcaccatgtagttcttcaggcactggacctgagccacacacaccagaaatgccacatggctcacatccaattcgtgcattattggactcagttgacctacagaaagatgcctttgggttttcttcaatccaaaatactttaaaaatgaatggagagagtttagaagaatctgcaaatggtctaagtcgaaagggtctaaagcagctaaatgaaatttttgggttctctcaattatcagctgaaaaacagaatgcgaaggcccagattcatgctgattctgagcatgcacagaaagctgaaagtgaagttcaaaccttaaagaaagcactggaagatatacagtctgacaaggattctatctttcttcaatatcagaagagtttggagaagttatgtgaaatagaaagagagctaaatgaggcccaaaaagatgctggaggccttgatgaacgagcaagcaaagctgaaatcgaaatcaaagtactgaaagaagccttagcagagcttaaatatgagaaggatgccggtctacttcagtacaagcagtgtgtggaaaggatagctagtctggagactacgttgtctctggcccagatggatgcaaagggaaatgatgaaagggctgctaaagcggaaactgaagctaaaaatctcagaaaagaacttgccacattggaggctgagaaggatgctgctcatcttcaatataaacaatgtcttgaaaagatatctgttttggaggctaagatcacccatgctgaggagaattccaggaaattaaatgagcaaattgaaagaacagagctagaagttaaatcattgaagaaaaatattgctgagctgaatggagagaaagaatctgtaactgtcttgtacaagcagtgcttgcagaaaatatctactttggagagtgaaattttgcttgcccaagaaatttctgaacgactaaatagagaaattgagattggggctgaaaaactaaagactgctgaaaaacattctgatatgttggagacatcaaatcgatctcttcagctagaggctgatgttctattgcagaagatttctttgaaagatgaaaagcttttagagaagcataccgagttagagagactgcagactgtgatgcatgaggagcagtctcgttttcttcaaatcgagtctactctgcatactctacagaagtcatactctcaatcacaagaggagcaaagatctcttgctttggaacttaaacatggccttcagctattggaggacttacagctttccaaacaaggttttagggaagaaatgcaacagattgtggaagaaaacaggactttgcatgaacttaacttctcttccactaggttattaaaaaatcagcaaacggaaatttcagagctgaagatgatcaaagagaaacttgaacgagagtttgctgtaaaagttgaagaaagtaatctcctccaacgggaatctcatcaaataaaggatgaaatccagggcttgaataatagatatcaggctatactggaagaactaggttctgtaggtttgaatcctaaatcttttgcactatctgtgaaggatttacagaaggagaacacaacgctaaaggaggcatgcaaaatggagcgagatgagaaagaagctctgcgtgaaaagtcgaaggatatagataagcttttgagcgaaaatgcctttatgggatcttccctgtcaaatttgaataatgagctgggtggattaagggatacagtgaagaaatttcaagaatcctgtggtgttctgcaggaagaaaaatccattcttgtcactgaaaaatcatctttactttctcagttacaaattatcactgaaagtatgcagaatctattggaaaagaataccttgctggagaagtccctttctgatgcaaaaattgagcttgaaggtttaagggctaaatcaagtagcttggaagaattttgcaatttactgaataatgaaaagcacaatcttctgaatgaaagaagtgtcctggtatctcaattggagagtgttgaagcaaaactaggtaatctggaaaaaaggtttacaaagttagaagaaaaatattctgatatggagaaagacaaagaaagccgagtcagtcaagtagaagaactccattctttgcttttgacccaaaaagaaaagcatgctaatcaaaaacattcaagtgaagcccggatggccaatttggagaatattgttcttcggttacaggaagaacgccggttggggaagatagaatttgaagaagaacttgataaagctgttaatgctcaggttgagatgtttattttgcaaaagtgtgttgaagacttggagcagaagaacatgggcttattaattgaatgtcaaaaacacgtggaggcatcaaaattttctgatgaagttatctctgagttggagagtgaaaaccttatgcaacagatggagctagagttcttgttagacgaaatcagaaagtttaaaatggggattcatcaagtgcttgcagctcttcaggttgattcaggtggggggcatggcaaagggatcaagcaagaggaaatgcctatatcgcatattttgaataatattgagggcttgaaaggctctcttgtgaaaacccaagaggagaagctgcaactacttgtagaaaattctgtcctcctaactgtactttcgcaacaagaatttgagggagaagaactggtgtcagagaaaaggatcctagagcaagagtttgaaaatacaagagagcagcatgcaatgttgcagaaggttaagcttgaacttctggagatgaacaggcaacttaggtctgaagtgaccaagggagaagaaaaggagagtgaattacggtccaaattggaagcccttcatgtggagttgatagatttgcaaagaaccaatctagtgtttgaggaagaaaactgtaagttagttgaggagaaaaatttactacttgggagtgttttggagctcaaagatgcaaagtctgctgctgaacaagagaatagtgtaatcctccatgaggcactggctctaaaaaaccttagtttggtttatgagtgctttttcactgagaaggtcttggaacaacgtgcacttgctgaacatctcagtggtcttcactctgtgaacaatgaccttaaacgggagcttggtctgttaagggagaagtttgaagtgaaagaagctcagaatgtttattggaaggagtcagttgagaggatggacaaagatctgcatgaagccaaatctgaaaataaccatttaaattgtcaggttgaaagttcagagcatcttcttgtgaagaagaatgcagaactgttagaaatggaggaaaggctaaaggctgcagaaatgttgagtgcagagttttgcagagatattgagaaattgaagatgggaaaacaacaatcaagattgatcaatgaaaatcttgaaaggcagattcttgaactatcagaaggttgcatgagtcacaaaaaagaaattgagcatcttaacgaagcaaacagaagtttactgtcagagatgagatccttacgtcaagaagttgaacaacagagggctagggaggaaacattgagttcagagcttctggataaaacaaacgaatttgaactttgggaggctgaggctgctacattctattttgatcttcagatttcgtccattagtgaagcattattggaaaacaaggtcaccgagcttactggagtatgcatgagacttgaagatgaaagtgatgcaaaaagcttggagattaaacagatgacagaaagagtctgtctactggaaagtgaaattggaggactgaaagggcagttatctgcatataatccagtcattagttcattgaaagaggattttgcttctttagaacacactgccctagttcggataaacaaaatgcctgttgaatgcaatcaagaacaaaaggatgcagtaattgaaacttgtctccatgaaaatggctatcaaagttcaagagataacaaaagcactttgataccagatggggtttcagatttgctgagtgtgaaggcaaggattagagcggttgaaaaatcaatggtggaagaaatcaagaagcttgtgaaggaagacaatttaaccactaaagctaatccaggagctctgacaaaggcaacaaatgtggaagtttcaccctatgtggagaattgcaacagaaaagaagacaaggtacccaaggatgagagcacacatgatgtcaactcgtggagaacaaaaactgaaaatgggtcattgatgaaagatattccacttgatcacatctcagacaattcagcctccaaaagttgcaggagagaaaatagtggtactgatgatcagatgcttgaattatgggaaactgccgagcaagattgctttgctagttccatgattagtgaagcaatgaaacaaagttctgttccaacagaggatgttattgcataccatcagtcagatcattcaggtaaattccaaaatacctcttcagaattggatgtggaaaaggaattgggtgttgacaggcttcagttgtcgagaagtataaaagagagaactcaagatggcaagaggagaaagatactggagaggctttcttctgatgcgcagaaactgaccattctcaagacagctgtgcaagatttgaaacagaaaatggagacgaagagaagcaagaagggagtcgagactgaatatgaaacagtcaaaagacaaatagacgaagttgagggagctgttgtcaaattagtagatactaatgatcaactgacaaaggatcttgaagagagcgccccatctctaaacaggcagacttcagccgagttggaaaagagtagacacatccagagaaaaagagtaaccgagcaggcgcgaaaaggttctgaacagataggaaggttgcagtttgaggtgcagaacatccaatacactttgctgaaattggctgatgaaaagagcaaagggaagagcagattcactggaaaaacagtggtcttgcttaaggactttattcacagtggcaagagaagtagcaaaaagcgcaacaaggggttctgtggatgctcaaggccttcaactaatgaggactaa

SEQ ID NO: 70213 - DNA, 291 bp, Glycine max
  Peptide Sequence Number=SeqID_186991
atggagagagagaaaaaagaggctacagacacggaaaagcaacaaacagtgagtgacatcaaaaggaagcaaagacattgcacgctccaaaattacagaaacacctacgagatcaagaacttgccaagtgaaacgaacttgatgaactaccccaactccaccgaccacacaaatgagacgaaaacacaaaactatgcaaatgggcacccagaaaactacaaaaagcaccgaactttaatccatttcacatccctcacaccccaaaaacatggaatctggcaatgggagtga

SEQ ID NO: 70214 - DNA, 147 bp, Glycine max
  Peptide Sequence Number=SeqID_186992
atgtacaaaggagtggaagggtcagctgcaggctgtggtgaggagaggtctaccactggtgcaggaggctttgatgtgccctcaagagatctctcaggggtagcagcagtctctggtctctcctattcttcccctgcctcaggatga

SEQ ID NO: 70215 - DNA, 699 bp, Glycine max
  Peptide Sequence Number=SeqID_186993
atggcctctaggaagcgtaagagcattggggcaaggccaactggtctgtatgacactagacggttccattcgcttgatgcttggaaccgttatacagataacgtcttaggaaggagcattttgccagagaggaaggttgagatataccacacagagtttgatgacttcaagacaaagtttgagagctctaaggatccttcaccaaagctagccagagttagaggccacttggtgaagatagacgccgacagtctcaacacatttctagagactcctatagtcctagaggagggggagacattacccacctactctagacttgggtttcctgctttgattactgccttatgccaagcccgaggggttgtctctgacagcctcacatttgagcacctgagcctggccattaacttggcctacatcaggaagaactgttggaatgatgatgatctaacaattactttccggggggctaggagggcgagggcaaagccagctgatattccttttacttctatagctctgacacctactccaacatctacttctgcagctccttcagtcctagctcatgttgactctcagcgctttgaagccatgcttcaaaagtctataggtggtagctccttcaggattcatcctatcagtgtagcagttcttagagagggtagcctggcctggggcccaaccttctcttga

SEQ ID NO: 70216 - DNA, 294 bp, Glycine max
  Peptide Sequence Number=SeqID_186994
atgactaaagcatgtcaaaagggggtacggaaaggaaaagagggagaagcttgccacccagctcgcccaggcgagctaggttgcttcctccaaaaggcacctcctagaaggcccaaatgggtctggtttctatttgcacccccctataacttcacagatcgtgcaacaatgctcttttttgacttctggcacgttatggaacttcacgtattgtgcaacaatgggtgccaagtacctcgaagcggtcaagcaaaggttgcatgccatcaaacaatggtccccggacgaaattag

SEQ ID NO: 70217 - DNA, 390 bp, Glycine max
  Peptide Sequence Number=SeqID_186995
atgcaattaaggggcactttgaccgaggaaacaaagcttggatctaacatgtttagatccactagcactagaggacctgccaagtatgagagattagaaaaagaacatgctgacaatggaacttcaaatgaggagtttaagaggagcacaagtttgccttctcgggctatgggttcaacctttggagacatcaatctacacagaaaccccacaaaaaaagccaatagtaaacccaaggagaagaagagtcacccactcttcagcttctttgatcttcgccggaagaagaaaacaacagctaggcctgaatttgcgaggtatcttgagtatgtgaaagaaggaggcatgtgggatttgaattccaataaacctgtcatgtattacaagtga

SEQ ID NO: 70218 - DNA, 871 bp, Glycine max
  Peptide Sequence Number=SeqID_186996
atgaaggagtttccttcttgttttggagaaaatggtgttcgggttgtagattcctcctattcaagcaccacaaggggagcacaaaatgctgttacttgtgtctatcagtgcaagttaggaggtcgttcatgcttgatcactgtctcttggaccaaaaatttgatgggacaaggcttgagtgtgggaatagatgaattaggcaatcattgcctctgcaaagttgacataaagccatggttgttctcaaaaaggaaagggtcaaagaatttggaggttgagtctaataaaattgatatactttgggacttgagctgtgctaaatttggttctgggccagaaccattggagggtttttacttagttgttgtgttcaatcaagagatggtgttactcctaggggatctgaaaaaggaggcatgcaagaagattgatagtgactatgcttgtgctgatcactctgaagccgtttttattgcaaagagagagcacatttttggcaagaagttttatggtgcaaaggctcagttttgtgacaagggtcaggtgcatgatgtgaggattgagtgtgacacactagggcttaatgatccatgtcttgtgattagaattgatagcaagacagtgatgcaggtgaagcaactcaagtggaagtttaggggaaatcacaccattttggtggatggaatacccgtggaagtgttttgggatgtacataattggctatttggaaatgctatgggagatgcagtttttatgttccaaacttgcatttcaactgagaagctgtggtcaagtagccaatcatctgtttctgatccttctgttctcacatgggcttattctcagcagttcagggattcacagttgcaag

SEQ ID NO: 70219 - DNA, 3796 bp, Glycine max
  Peptide Sequence Number=SeqID_186997
tcttgcagaaacggactcattctctggagaatcagatcaatctgcaaataaccaaagcatgtcgaaaggagatcttttccattctgttgacggtaatgcagggttcgatgttttgtatcataataaggtcaatggtacaagcaataaacgtaagtcaaaggggaaaactcacatgactcagctacatgctgttcctggtttcggtcgagtatatgatgaaaccacacaattgcatcagactgatccatcctttcagattgctgatgatattgatcttgatatggaatttaaagcagacaaagtggagggaaaccacccaaggaaaacaatggcacatttgcgcaattttgcctttggggatcagacttttgatagtgatctaaatattcaaaatggaggcagcagaaaggattctgattccagggagatgttcataactgtgtcagacatcaacctcagaagtttgccctctcaagtgcctcccccgtctcgtccaccgcctgcactggatgtaaaaaaggggagtatgcctggatttcattcaaacagcaggctggttgcttctgaagagacaccaggtgctggttcaccacctttctttgatgtggaggatcatatgaattcatctgctacagcttctgttgatgctataaaagaagcaatgcttagagcggaagcaaaacttaggagtgccaaagaattaaaagagagaaagaaacgagattgtgaaagccatttaaaatcaagttatgatgcgaaaattaatgaagcaaagatgtgtaaggatatcaaaagattaagtagtttgaacgatcagacaacgcagggaagtcatgatcagagacattcaaaaacaaagttatctgtcacagatgacaggcagaaacttaagaaagcttccccagaaactctggacaatttagaagggaaaagagttttaaacacgttcgaggaaaaggacaagatggaatccaggtcatctcaagaatctgatagaagttcaggagttgggacatggaaagatgaatgtgaattttttgaattggcgggaatggaagaatcgagaagggtaactcaaccaacaaagcagagtaaggatttggtgcaaggtactgaagcccaaaaacatgaccagatggaaagagaagcatctaatgtgcaagaaaagcataaacaagtaaaagcaactgcagaaaattatcagggggaggagtacgagaaaaaatataaagcagcaaaagaggcttgtgaacatcatgaaaacattatgaaatctgaagcatctaatggtaaacataggcaacgagagcaaatgaaaaaagaaaaaatggccaaagtatttgaggtggaagacaatgagaaggctataaaaatagcccaccagcatggaaaaaccgagaagaaagtaactgaagctgaccaatctagaatcgtagaagatgtgtgtgagatggaacacagagagcataaacaagtggaaatccagaaacccaaagaagtaaatagacaaacaccaaatgaagttcagctgaccatggggcttagggaaaatgagaagaaactcaaagaggttgaaaagcaacagcagagtatgaaaaggcacaagcaatatgagaaaatcaaagaaaatggaaaaacagaaagagaagcttttgccctaggacagactgagcatgaggaaaaactgaaaggttctgtggagccagaagatatggatgaaagatcaaatgtggcttttgaaccgtattacacagaggaaaaagaggtctccaaaagagaaaatgaaatgaaactaaaactaggtgaacagattcaggtcaaaaagagactgaaagaagctcatgaaagagtagaaattgagaaaagcctcaaaagctcttctgaaaatgaagaaagtgatgacggcctaacacgtgctttcaggttggatgggaatggaaagcaacttaaagaagactttgaactggaagtaaatgagataagactgaaagaggcttccaagcagagggaaaatgaggcatatgaaaaagatcaaaatagaaagaaatttaaagatgtttatggagaaggaaatagacttcaagaagcaggtgacaacaaagggattcagaaagttatgaatcaaactccaatgcaacagattaatgggatgttgaatgaggctcaaaggaaaaaagtcactgagagcacatcaagccaaacatttgcaatggaaggaagtgtagctgtatcaaatgagaatagtcacctggagcaatctgagaatatggagcaagatgtaggtgaaatggaaaaagataagggactgaacaaagcttttgacatggagaggaatggagaagggggaaacataaagaatgctaaagcaactaatgagacaagggaaatagagagtgacgaagatcttgcagctcaatcagccttcgttcatgaagaatttattggaaaacagaatgtatctaaagaatctgttgctgaccaagatattggactgatgagaacagaatgcaaagttggagaaaagaaattgaaagagataggggtggaaaatcaacaggctaatgaaaaaatcagagcacctgaaatgactgcaggagatgcagagcattcaggaacccagacaaaaaaggagggagacacagtgacaaaggctgattacagaggcacagaagcagctggacctgctgcagtacaggagactttaaatgtccagaaagctgcccagtggttccatgttgatcaatccacagaaagcaaagcaaagagtactaatgaaacttcttctatagtgaaagatgcagaaaggatgggaagagaaagagagtcggaaaaggatcatcttacacagacagaagaggagggggatagagaaagagaacgagaaaaagacatcgagaaagcaatgctggaggctgagagggaaagggaaagagaaaaggataggatggctgttgatagagcaactttagaggctcgtgatagggcatatgctgaatcttgtgaaagggctgcatttgaaagagcaactgtggaagcacggtacaaggcactggctgaggccagggaaagacttgagaaggcatgtgctgaggccagggataagtcaaacattgataaagaaactatagaggcaagactgaaagcagaacgcgctgctgtagaaagagcaactgcagaggctcaagaccgagctatggaaaaattaaagaatgaaaggactgcatttgagtccagagaatggttagcgagatctgtatctgacaatttttgcggaagaccagactcttcatcctccgatatgctggatcctgagtttcagaacttaagctctaccacaggttccagacatccatattcactttatggtgctgcctctttttctgagagatcagataaagaaggtgaatcagctcagaggtgtagagctagactggagaggtatcgccgaacagctgagcgtgcagctaaagctttggcagaaaagaacatgcgtgaccttctagctcagaaggagcaagctgaaagaaatagactgtcagagactctggatgctgaagtaaggaggtggtcaggtggaaaagaaggaaacttgcgtgccttactttctaccttgcaatatatccttgtgcctgattctggatggcaagcaatcccattgaccgaggtcattacttctgctgctgtgaaaaaagcttacaggaaggccaccctgtgtgttcatcctgacaaattacagcaacgtggagcaagtattcaacacaaatacatatgtgaaaaggttttcgatcttttgaag

SEQ ID NO: 70220 - DNA, 312 bp, Glycine max
  Peptide Sequence Number=SeqID_186998
atgacgcttaatgatgagctggtaggggagggaggaggcgcggaggagggggaggaagtccgggaggaggtggaggaggagggcctcattgtaggcgacgatggcggcggcaaaggcggtgaagaagaggacgggagggacgagggagaggatgacgcgggaggagaggctggagaagacgtggcggaggtggcggagggagctgcagtggtcgcgccagttctggtgggtgtagagggcgcgcttcttctgcatgtcgcactcctgcacggcgttggcccaatccgggatggagcggaggagcgagattag

SEQ ID NO: 70221 - DNA, 384 bp, Glycine max
  Peptide Sequence Number=SeqID_186999
atggcgcattctcggcaacagaacaaggctggcttcacgctctccagcaagatcaacaacaatgggagcttctcttccggtactggtagtaagagcatatacgacgacgtttacggaggtccactgaagttcggcgtttcgagcctctcccctcgtttcgaagactacggcgagattttcggaagcttccacaccgtacgcgcctcttccattcctgtcctcgatcttcccgccgtccaccactccgaggccttcttcgatccccgaaaccacgctttcaactacaccgaagttttcggtgctttagattttgcggttccatacgagaatttgtttcacccccacactgctcttgacggtgcctccgaagaagaagcctggtaa

SEQ ID NO: 70222 - DNA, 1257 bp, Glycine max
  Peptide Sequence Number=SeqID_187000
atgtctgattattactttgacgaggaggagatactagagttgctgaaggaggatgattggccagtctttgatgacttatttaacaattttgccactcaagattcttcccctccagctgatgagattcttcccgccaatgaggattcttctcctctagcggatgatgagattcttcctgcccatgaggttcttgatgctcctgcccctcttcctgttcctcctcctgcacctgcacctaacagggttcatacttctgccactgctctggatcctgctcctcagatggttcttgcctctcaggatcctaccaagccatctgaggagacattgtcgagcagccacccacaccacttgctgcagcataatatggaccctagtcatgtcattttgtccggtgactcatcccattcagttcatcacaagaaatacgaacattggacaatagaagaacacaagtcatttctctttgggcttgagataaagaaagagaaaggatggaaacagatttcagataaatatgttccatccaaaactgcatctcaagttgccagtcatgctcaaaaatacatcaaacgaaagaatacccctatgaaagagagaaagagaagaagcatccacgacacaattttagaagacattgatataatccgcattgatcaacataattgggttccaccaacttcaaattttatagtgcagccacatactctcggcagtaattgggttccatcaacttcaaatcttatggtgcagtcacatactcccgttactgatcaacataattggattcctccttgtccttcgaattttgcagtgccacaatgtattcctcatgttgatcaagataattgggtttcacctccttcaaatcttgcagcacaatcatgtactgcccatattgatcaatatacttgggatccacctcctccaaattttgcagtgcagccacctactcctcatattgatcaacataactgggttccatcacctccaaatttttcaccacatacttcccttattgatcaagataattgggttccaactcctccagattttgcagtgcagccacatgaaatgcaacgagcacaacatatgcagatgcagcagctcaacttacatagttcatctcctcaaatggatgaatatagaaattttaatagtggccatccccagaatgagttggatcttattgcacaacagatccttgaatataagaacaagttcaaccacaaaaacaatgagggatcaactagatag

SEQ ID NO: 70223 - DNA, 312 bp, Glycine max
  Peptide Sequence Number=SeqID_187001
atggctgttaatggaaatgattatttgcagatatgtgtagtggctgccaagcatatcataagtgcgatgatgatacatttgtcagtaaattctatcatctacattgaacaaaggttgtgtgataaaatgaaaggtagagtgaaagagaaaaatagaagaaaaaagagagagaggaaaaatgctcaaatggaaatttgccatgctactaagacaccagttggtggaacagtagtcaatctctatctggcatctcctatgcaacaaccagtaagtaagacaagtggaagaatcccacactcactctcactttaa

SEQ ID NO: 70224 - DNA, 438 bp, Glycine max
  Peptide Sequence Number=SeqID_187002
atggtggttgaaattggcaaaggcagtaaggttaagtatgagctggacaagacaagtggacttataaaggttgatcgtattctttactcatcagttgtctacccacacaactatggttttatcccaagaaccatttgtgaagacagtgatcctatggacgtgctggttctaatgcaggaacccgtgcttcctggttccttccttcgtgctcgtgctattggactaatgcctatgattgaccagggtgagagggatgacaagatcatagcagtttgtgctgatgaccctgagttccgccattacactgacatcaatgagcttcctccacatcggcttgctgaaatcagaagattctttgaggactgtatcctgttatttgcacgtacaaataaaccacatgcatctctgttcgtagttattgacaattatgctcattaa

SEQ ID NO: 70225 - DNA, 310 bp, Glycine max
  Peptide Sequence Number=SeqID_187003
atgagtgtaaaccgtgaagtgatttctgagattggatgcgagagttctgagaagaaaagagaagatcgagttttctacgccgtcggattttggatccgcgagaccggccaagccatcgatcgcctcggctctcgtctccaaggcaactacctctttcaagaacagctgtctaggcatcgacctctgatgaatctgttcgacaaagctccctcggttcacagggatgcatttgtggcccctagtgcctccctcctcggcgatgtccacgttggccccgcttcctccatttggtatggatgcgttctcagag

SEQ ID NO: 70226 - DNA, 531 bp, Glycine max
  Peptide Sequence Number=SeqID_187004
atggattggctttggtcacttgggacctacagatcacacaatcacgaatttattgctgctctaattttgaagtttggttccattccatggcagagaaaagcaggacaccccacgtttgccttggtcagggaaagcaccattgctcatccttcaaaatcaaactttattgagagcttcaaaagttcaggaattactatactctatagtttggttaaggcaatcaagcaagttgatgttgtaatctccacattaagtgaacatcagatagatgaccaagcaatcattctgggagatggaaacatcaaaggagtttatgtcaccgaggaatacattgggacaaataccatcaaagcagtggatgacccaagaaccttgaacaaaattctgtacctgaaaccccctgccaatgttttgaccttcaacgagctcatctccttgtgggagagcaagattcagaaggcactagagaaaacttatgttcctgaggatcaaattatcaagagcatccagggtcaatatgaactcctttga

SEQ ID NO: 70227 - DNA, 162 bp, Glycine max
  Peptide Sequence Number=SeqID_187005
atgaactcgctatgcgagcatgctgcgccaagcgagttcatcaatactcattgtatacaagcattatctgaagaactcgctaagcacccttaccgagctaagcaatcacacgctaagacgagcattcctgagccaagcacaattggttgcggcatccgttga

SEQ ID NO: 70228 - DNA, 453 bp, Glycine max
  Peptide Sequence Number=SeqID_187006
atggacatgaacattggcggtttgatctctggacaaatgaccatgatggctcagtctaactcttctcgcttaggctttccagctttagtcacaaccttgtgtagatcgaggggagtgggatctgatgcccttacctcctatgaaaacttaaggccaaccatttacttagcttatatcataaggaactgttggaatgcgaatgaccaaacagttaattatccagaggcaaggaagaccaagctcagagcaattgatgttccctcttcctttgcaccaatagctggcatccctgcatcctctacttcagccccacttccagctttagcagacttatctgcccaaagctctcagacttcagatgccaaattgcaaagcttgtttgaaggacagattctcattatacaaagcttgcatgaactagctcagcaaaggccaattatgagtgtagagtag

SEQ ID NO: 70229 - DNA, 2097 bp, Glycine max
  Peptide Sequence Number=SeqID_187007
atgccagaaaactgcatagcacccaaatctgaacacagcaacactactcaccctgaggaaggaccacctgagatgactcagactgtccttcccatacaaacaaataagcaatctttcccaaaactggctatgtaccccataactttaaagtttgaggaattggtgtacaaagttaaaatagagcagaagggtgtgtgttgggggagcacaaggagttgcaaagagaagaccatactgaaaggagtaacaggcatggtttgtccaggagaaataatggccatgttggggccatctggcagtggcaaaaccacacttctcacagcacttggaggaaggctcagtggcaaactatcaggaaaagtcacatacaacaaccagcctttttcaggtgccatgaaaagaagaacaggctttgtggcacaggatgatgtgttataccctcatctcactgtcactgaaacccttcttttcactgcacttctgaggctccccaacaccttaaccaaggaagagaaagtgcagcatgtggagcatgtgatcagtgagctagggttgagtaggtgcaggggtagcatgattggaggcccatttttcagagggatttcaggaggggagagaaagagggtcagcataggccaggaaatgctcatcaatccaagcctgttgctgcttgatgagcctacctcagggttggactctacaacagcacaaaggatcataaccacaatcaaaggcttggctagtggaggaagaactgttgttacaaccattcatcaaccctctagtcgcctctatcacatgtttgataaagtggtcttgctttctgaagggtgccccatctattatggccatgcttcatctgcaatggactacttttcttctgttggtttttcaacatccatgattgtcaatcctgctgatttaatgcttgatcttgccaatggaattgctccagacccctccaagcttgcaacggaacacagtgagagccaggaagcagaaaagaagttggtgagggaagctttaatctctgcgtatgacaagaacatagccactaggctgaaagatgagctatgtagctttgaagttaataactacaaagtcattaaggattcttccacaagaaatcacataaaaccggagcaatggtgcacaagttggtggcatcagttcaaagtgctgttgcaaagggggctgagggagagaaggtttgaagccttcaacaggctgagaatattccaagtcataagtgtcgctttccttggtggactcctgtggtggcacaccccagaatcacacattggagatcggatagccctgctctttttcttctctgttttctggggattctaccctctctacaatgctgttttcacatttccacaagagagaagaatgctgatcaaggaacgttcgtccggaatgtaccgtctttcttcctactttctggccagaacagtaggagacttgccaatagagcttgcacttccaactgcatttgtcatcataatctattggatgggagggctcaagcctcatccagttaccttcctcctttccctccttgtagttctctacagtgtccttgtctctcaaagccttggcttagcatttggcgccattttgatggaggtcaaacaggccacaactttagcttctgtgacaacccttgtgttcctcattgctggagggtactacatacaacagatccctcccttcatagagtggctcaagtacttgagctatagctactattgttacaagcttcttgtgggtgtgcagttcaatgatgatgattattatgagtgctcaaagggggtgttgtgcaaagttggagagtttcctcaaatcaaatcagtgggtttgaatcacttgtgggttgatgtgactattatggccatgatgttgaacaagatcagaggcagaaaacattggggttacatctctggaacaaaggctgcaccagaaaacaagaaatgtgatgaatatgaagcatgggaagatgaaagttgcctagtcaagtcttggcttctggactctatgacgaaagaaatcatatccctctttattcgcttagctacggcaaaggacatctag

SEQ ID NO: 70230 - DNA, 219 bp, Glycine max
  Peptide Sequence Number=SeqID_187008
atgtcaccactgtcataccctaatttcgtttggggactatcgttcgttgatcttttgatccttgctagtcgacttacggtgttgaacaccaattatagtgcaaagcaaggaaccattcagtgccccagctcgcccaggccaacatttggcttgcttgggacaccaaataacttcaaggctaaaggactagctcacttgggcgagttgcaactgccctag

SEQ ID NO: 70231 - DNA, 324 bp, Glycine max
  Peptide Sequence Number=SeqID_187009
atggggacaaggggttgcatcaattacaatcatgtcctagctataagacaagttggctaccctatgagaggggcaccactagaggaagacctcacacctattattgcacgaggtttcaatagcaccaacgcggaggcacttcagaaggtccgcaaggcatgggagatggtgcaaaagaaggacaaggaattcagaggcagtagcaacgggcccattggtggctaccataggtggttgaaagcctacatgcaaggtctggattggctcccgaatttgagaaccactaagggggtggaagttgaagctccggaggaggacgaagag

SEQ ID NO: 70232 - DNA, 1068 bp, Glycine max
  Peptide Sequence Number=SeqID_187010
atgtctgatcattactttgacgaggaggagatactagagttgctgaaggagaatgattggccagtctttgatgacttatttaacaattttgccactcaagattcttcccctccagctgatgagattattcccggcaatgacgattcttctcctccagcggatgatgagattcttgctgcccatgaggttcttgatactcctgcccctcttcctgttcctcctcctgcacctgcacctaacagggttcatacttctgccactgctctggatcctgctcctcagatggttcttgcctctcaggaccctagtcatgtcattttgtccggtgactcatcccattcagttcatcacaagaaatacgaacattggacaatagaagaacacaagtcatttctctttgggcttgagataaagaaagagaaaggatggaaacagatttcagataaatatgttccatcaaaaactgcatctcaagttgccagtcatgctcaaaaatacatcaaacgaaagaatacccctatgaatgagagaaagagaagaagcatccacgacacaattttagaagacattgatataatccgcattgatcaacataattgggttccaccaacttcaaattttatagtgcagccacatactctcggcagtaattgggttccatcaacttcaaatcttatggtgcagtcacatactcccgttactgatcaacataattggattcctccttgtcctccaaattttgcagtgccaccacgtattcctcatgttgatcaagatacttgggttccacctcctccaaattttgcagtgcagccacctactcctcatattgatcaacataactgggttccatcacctccaaatcttgcaccacatacttcccttattgatcaagataattgggttccaactcctccagattttgcagtgcagccacatgaaatgcaacgagcacaacataagcagatgcagcagctcaacttacatagttcatctcctcaaatggacgaatatagaaattttaattgtggccatccccagaatgagttggatcttattgcacaatag

SEQ ID NO: 70233 - DNA, 1738 bp, Glycine max
  Peptide Sequence Number=SeqID_187011
tgcagatgctgatgttcgtttggcaagaagaattaggcgtgacactagcgagaagggtcgggatattggagcagttcttgaccagtattcaaaatttgtgaagccagcttttgatgactttattcttcccacaaagaagtatgctgatataattataccccgtggaggagataatcatgtggccattggtttgactgtacaacatatccgtacaaagcttggtgtaagagctggtgtctcgctaagtaaggtcagtgcgcttagcgagtatcatccgttaagcgaggcatcagctcgcttagcaagtcaaaggtatcttgaaggaaatttggcacgcattcaccctcccagtgatttggttcaattggacttggatattgaagccacttgtagaaggaacaacgtagagcgaagaagaaaaatcttgcaggacaggacaacaccaattccggaagatcatccatcatctaagccgtcttctaattttccattgacaagggaatctgatacaggggaacctgaagcaaacataatggccgatgatcaacctaggaggatcacccttgaagactactctagctctactgtgcctcaattccttaccagtatagcacggccaaaggttcaagcgcataatatttcttatcctcattctttaatacaactcatacagggaaatctattccatggtttgccaaatgaggacccctacacacaactggccacatacattgagatttgcaatacagtcaagattgttggtgtgtcggagaacgcagttaggctgagtttgttttcattttcactgtctggagaagccaagagatggcttgggatgaacgaagcattggaaagatttcgtagcttgctgcgaaaaactccgactcatggattttcagagccgattcagcttaatatctttattgacggtgatcatgctatcttgcgtgatcagactcatattcctaccaagaggagtctactggagctttcatctcaagatgcacttttggcacaaaataagttgttgtctaagcagcttgagacattaacagaaaccttgagtaagttgccaaatcaatttcatgttaatcaaccttcacattccgctgtcttacaggtggatattcaggttttcaacatgatccaaattataaccaacaacaaggacagtggaggtctcacccaggaaatcaatttaacaaggaccagggtttctatgtcgaatcataagagcacggagtcggctatcagaaaccttgaaatccaggtgggacagttggccaaacagttagctgacaattcttccagcacctttggagcaaacacagagaaaaatctgaaggaagaatacaagtctatactgacccacaacagaaaagcagtcatgtttgaagatgaggagaagataggtgatgataaacagcaaccagtaattgaacaaggagaggaagaaaaggaagaggaagaggaccagctgaaggaaaaacaaataactgataaaggcaaagaaataaatatgtcactctactcaaagtttttgaaggatatgctaactaaaaagagcaagcacattcatagtgacactattattcacaaagatcccaggaatgttaccattccttactctattggtgcaatttctgttggtaaagctctcattgatttgggagccaacattaacttgatgccactctccatgtctacgaggataggagagttggaaattcggtcgtga

SEQ ID NO: 70234 - DNA, 482 bp, Glycine max
  Peptide Sequence Number=SeqID_187012
atgtgctgggaagatggggcaagaaggccgcagaggctactaagaaggctgagagtctcgctggaaacgcgtggcagcactgagttttcgctaggatcgtgtcctcctagcttggctttgcaagggatgttgtggtcaactattggtgatcagcttcttgcctcaccaattctagatggaaaagcacttctgtattctttcgtatcaactcctgaagtgagaataggagttgcctttggaagcgatggaagccaatcacttcctgccactgaatggcctggtgtttcttcttggctgttggttcctggggatgcaggggaattgaagaaaatgttaacagaacctacaggattgcacgttcaggatcggaaattgatttacaagaaaaaagagagggattcaaagtcatatcttgatgttgagagggtcaaagatggatcaaaattggtgctgcttgtggacattgagagtagagaaagaag

SEQ ID NO: 70235 - DNA, 300 bp, Glycine max
  Peptide Sequence Number=SeqID_187013
atgaacgttgtgggagcacgattcgcgaggggaagaggtgaaggtggattcggtaaccaattcggggctctagtgcaccgatatttgtgtgctgtcagacgacgatgcgacacgttccttcgggaccttgcgcaagagggtgatgcgcttggccttcatggaggcggactcatcgagcgccttagggccaataggagtagcatcggatggaggtggaagcggcggcagaactttggggacggggacctaaacggtggcgtcgtccttgcacgtgtgggtgaggaagttgcggagcgctga

SEQ ID NO: 70236 - DNA, 654 bp, Glycine max
  Peptide Sequence Number=SeqID_187014
atggtggttgttgattctaatggagatgaaatccatgttgtttgcaagcaggatcagctgaagtctcgcaaggctgttttgaaagagaattttatttatgtgatgcataattttaaagttatcaagaatgatgggaaatttagagtttgtgatcatgaatataaattatgttttactggagttactgttgttaggcaatgtgatatggagcagttaccttttaggaaattcatatttgtttctttttccagtgtcattgctggtgattttaaaattggactcttggttgatgttattggcgtggttgatgaagtggtattccgatatgtgtcatccaaaaatacgaggtggccagatgaaaggccgatcgttattctcttaactcattctaggattaaggaaacacagggatcatatccggcatcggtcagtaattctttcaaggcgtccaaactcatgatcaatgacctcgtgctagaaattcaagaatttagagagagtcttttagatttagggatcgaggttagatcaattttgacgcctattggacaagggagttcacaggtttcaggctcatctcaattatcatcaaaagatgtgtttctgtcaaagactgaagtaaaaaatatctctgagattaatgtcagttcagag

SEQ ID NO: 70237 - DNA, 252 bp, Glycine max
  Peptide Sequence Number=SeqID_187015
atgcctaaatcatctcccaacatgcatgtgaagcaagaagtatcgacaagagtcaagccaaggctattgttcaaccaatcaatggggcaaaacacaccgaataaaatagatgatgatggctcaaattctcaccaaggagaaaaacaaggatttcaattcacaaaatgccaagaaactcctatttcaaaaacaattacccattacctgtacataacctataattcaaagagaaacatgcaatgttgtacataa

SEQ ID NO: 70238 - DNA, 501 bp, Glycine max
  Peptide Sequence Number=SeqID_187016
atgggtgaatcaaacaaatttgggttgtatgttgatgacaatcctccccacttggttgtccttggaagagttaatgaggggtcaaaaactatccacaatgtccctttgggaaatgatcaagtgaaggtcagtgttgagaaagttagagatgctaatgctcatgtccctgtacccactcacgagggagctagggaaccatcaaaacctatagataggctggaacctgatgacgataccctataccagatgacattgacaatcttgcagcttttcctcaagcatatgttggtgtcgtgggattcaactatgttttgggtgtataatgatggcgtccccttgtacataaagaatgaagagctttctaaaatagcacacggctcaaaagacctgtctgtcctcctcactcaagctgccattgaggttttagacatagtcttggctcctagttggtgggttcatgagttggtgggttcacgagctggtgagttcgttgtttcttag

SEQ ID NO: 70239 - DNA, 312 bp, Glycine max
  Peptide Sequence Number=SeqID_187017
atggcgatatgcccacgggttgaggcacagggcaaatgttttagaagggatcaattgaatgttcaagtgacctcaaagctcaccctaaggctaatgggtgaacgactgatcactgacaacagatggcatcgtttcaatctagaattgcctcttctttctgattatgacaccgacagtgtgactgccaagtttgagggtgctaagatatcaattaaatttggagaactttcacagactaagcgtaaggaaacattaataactcctccatcacaaaaaattgaacatcaaaagccaacccaagaagatgtgtga

SEQ ID NO: 70240 - DNA, 132 bp, Glycine max
  Peptide Sequence Number=SeqID_187018
atgaagaattggatgcagaattcaaaacgaggtgtctacctaggagtctacctgaatggtgaaatggtgaggacttatatgctcgtacttcttcgtaatagcgttatgcctattatacccgttgtgatttaa

SEQ ID NO: 70241 - DNA, 183 bp, Glycine max
  Peptide Sequence Number=SeqID_187019
atggatgaaaatcacaagatgattctcaagtccttaggtgttacaaatgcaaccaaattggtcacatcaaagccaattgtccttcaaatgaagagtggcctaagaaaagtgaaaagaaaagaaaaagagattaatcttctaaccaaggattatgaaagtgatgagaacatctctcaagaatga

SEQ ID NO: 70242 - DNA, 153 bp, Glycine max
  Peptide Sequence Number=SeqID_187020
atggcggaaccatcgaagaagcgaaagggcacttcgagccggagtcaacagtattccgggtcacaagaaacaccaattccttcctccattcccttggggatcattgttttcatcagaggaacagcgtatacgaaatccatgaaggcaccctaa

SEQ ID NO: 70243 - DNA, 177 bp, Glycine max
  Peptide Sequence Number=SeqID_187021
atgactaaagcacgtcaaaagggggtacggaaagtaaatgaaatgaaaataaaagcacgcgaaacaagtgaggaccagaacttaccggttgaagaccgaagaacgacgaagaacaaacgaataacggttgaaaatcttcacgaaatcacctcacggaagcgttacggaagtgcctcg

SEQ ID NO: 70244 - DNA, 234 bp, Glycine max
  Peptide Sequence Number=SeqID_187022
atggtagccataacccctgctaggtttcctcaacctccatttttccgagggtatgactcgaacacaatgtgtgcttatcatggaggagccccagggcattccattgagcattgtatgaccctgaagcgtaaggatttccatgtttatgccattattgtaaaccacagttacaatgctaaaatggatgaatttgacatccttgtctctctcatcctttcacagacacatctttga

SEQ ID NO: 70245 - DNA, 297 bp, Glycine max
  Peptide Sequence Number=SeqID_187023
tcgccgcagattacgacgccgaaaagtgatccccagggcgaatggcacatctatgctgtgacctcgggccagacgctggcacaggtgcttcgggacaacaatgtgccggtcaatgaggtgtttgccatgggggatgaggatggggatgggcagccgttgagcgcgttgcagagtggtcagcaggtgaagattcgtcagaacgcgcagggcgtggtgaccggcttaacggtcgagagcagtaacggcccggtgctgtttacccgccagccggacggcagctttatccgcgtgcagtaa

SEQ ID NO: 70246 - DNA, 249 bp, Glycine max
  Peptide Sequence Number=SeqID_187024
atgtggatgctcaaacttggagagggccaagcatgggggtttgtgtgggatatgatgttgggtgattatacatcggcaaaaggagatgatggaagtgggggaggttggtggatgaaggtgttgtttgcggctgataggaggagaatagaggtgctcggtagtgatgggcggccgcaggccaatgcaggggtcattggaaacggtggagaggaagggagagtaaaatttggtggaaaaggtgtacaatag

SEQ ID NO: 70247 - DNA, 1506 bp, Glycine max
  Peptide Sequence Number=SeqID_187025
atggaagctcaaagctacttgttgcttattggcttgttctttgtattgcattggcttgcaaaatgttacaaaagtagtgtctctcagaaacttccaccaggaccaaagaaactacccatcatagggaacctgcatcaactagcagaagcaggttcacttccacaccatgctctgagagatcttgccaaaaaatatggacccctcatgcacctccaacttggtgaaatttcagcagtggttgcatcctccccaaagatggccaaggaaatagtgaaaacacatgatgtttcttttctccagagaccccatcttgtttttggtcaaatgatatcctacgggggattgggcattgcttttgctccatatggtgatcactggagacaaatgaggaaaatgtgtgccacggagcttctgagcaccaaaagagttcagtcttttgcttccattagagaagacgaggcagcaaagtttatcgactccattcgcgaatctgctggttcgcctatcaatctcaccagtagaattttctcattgatatgtgcctcaatttccagggtatcattcggtggcatatacaaggagcaagatgagtttgttgtgtctttgatccgaaaaatcgtagaatccgggggaggattcgaccttgctgatgtctttccttcaattccattcttatatttcctaactggaaagatgaccagattgaagaagttgcacaagcaggttgacaaggtcctggaaaacatcatcagagagcatcaagaaaagaacaaaattgcaaaagaagatggagctgaattagaggaccaagattttattgatcttcttctcagaatccaacaagatgacactctcgacatccaaatgacaactaacaacatcaaagctttgatattggacatatttgctgctggaactgatacttcagcatcaacactagagtgggctatggcagaaatgatgagaaatccaagagtgagggagaaagcacaagctgaattgagacaagcttttcgagaaaaggaaataattcatgaaagtgatctagagcaacttacttatttgaagttggtgatcaaagagacattcagggtacacccacctactcctttattgctccctagagaatgctctcaaccaaccatcattgatggctatgaaatacctgccaaaactaaagtcatggtaaatgcatacgcaatttgtaaggattcccaatattggattgatgctgataggtttgtccctgaaaggttccagggtagttctatcgatttcaaagggaataactttaactatctcccttttgggggaggacgaagaatatgcccaggcatgacattgggtttagctagcattatgcttccactagctctactactgtatcacttcaactgggaactcccaaacaagatgaaacctgaggaaatgaatatggatgaacacttcggattggctattgggaggaaaaatgaattgcatttgattcccaatgttaatttatga

SEQ ID NO: 70248 - DNA, 390 bp, Glycine max
  Peptide Sequence Number=SeqID_187026
atgaagaaaaagtttcgggttccctcttcccttgaaggggcaacagtcctggactctgggataaatgctgcagaatttgtttgcccattctggttttctgcagacacaaagtcattcatacaaaaaattctggatcctaatcctaaaacagcacaacagtcagcagaattcacatcatcttggtctggaattcaacgacggtcaacaaaagacccgtcgttatctactgagttgaccaatacaacgacggtcacaagtacatccgtcgtgaacgcattacaacgacggtctaggcagcccgacgttgacaccaacaaactcaacgacggtgggacgtacacaacgtcgttgaaaatgatgaaaacaacgacagcctatgttaatggctga

SEQ ID NO: 70249 - DNA, 604 bp, Glycine max
  Peptide Sequence Number=SeqID_187027
gccttgtgtctacatttgttgtagcgaacactacgctcgctatattgatcctatcaagcttcttaagtttgatcctaagtttgggggtcaatttcgctacagcgaagctagccttctccaaagcaaaatgacttccaggggctacattagctccatgggtcaaattcgcaatggtaaatccacctccataagcttcaatgagcttcaggggtcaattttgccatggcaagacctagtcacacttgcccttgtgcatcattattttatgcatcaagccaccttcctccaagaaaaggaagcaactcaaggagggctaggtattatgccaatctcaagaggcagatttacactaaaagaaaaggtggacttgaagctaggagagttccctgaaaagcaagaagtttttgagaccaaggggtggaataggctgaaggatcttggtgtttgcaatgaacccctagttagggagttctatgcaaacacaatacttaaagatgggtatatggagaggaaatcttgggtttcttatgccttcctgccataccctaatttcgtccggggaccattgtttggtggcatgcaacctttgcttgaccacctcgag

SEQ ID NO: 70250 - DNA, 294 bp, Glycine max
  Peptide Sequence Number=SeqID_187028
atgaaagccaaaaaaacaagaaatgaattgaaagtctcagatttggaaacttacccattgaagaatgaagaacggatgaagaacggtgaagaacggaggaaaaccttcacggatttgcttacggaaacatctcggaagcgttacggaagcacctcgaaaaatggggagcaggttgccgcccagctcgcccaggcgagctgggttgcttcctccagaagcaattcagcttcgaaaaatagtctggaggcccaattcaaaatttcaaaatcgctatttgcaccgcccccattttga

SEQ ID NO: 70251 - DNA, 657 bp, Glycine max
  Peptide Sequence Number=SeqID_187029
gttgcaggatgtaccatctgtggaggagctcatgaatctggatgttgtattcctgttgaagaacaccccgctcgtgaagtcaattacatgggaaatcagcccagaaacaattttaatgcaggagaattttctggattccaacatggccaacaatataatcaacagcagggacaatggaggaaccaccctgaaaatcaattcaatagagatcaaggtggaacatccataaggccacaacaactagggcctagtctctatgatcgcacaacgaagctggaagagactctagctcagtttatgcaagtttctatgtccaatcagaagagcacaaagtccgccgtaaagaatcttgagatccaagtgggacagcttgcaaagcaattggtggatagatcatcaagcaattttatagctaatacagagaaaaatcccaaggaggaatgtaaagctgtgatgactagaagtagaatggaaatccaaggagatgatagtgaagctggaaagaagatggagggacataaacaacagctgccacctaagccagcacttgaacctatttctaattttgtagaacttgaagagattaatgaagagactgaagatgataaggaagaagagacaccaataaaagaaaaagaaaaagaaaaaaaaagttga

SEQ ID NO: 70252 - DNA, 432 bp, Glycine max
  Peptide Sequence Number=SeqID_187030
atgggtgccaagttgaatcccgcaaagtgcactttcctggtcaagttgggaaagttgctcggttttgttgtaagccagaaagggatagaggtggacccggacaaggtgaaagccatccttcaaatgcccgagccacgcaccaagaagcaggacatgctgtgctttggtgtgagcagcccaccgtctaaggcagtacatgctgagctacaccacttggttggtgtccaaaatggacctagtcaagttctgctgtcagaattcgacattgtttatgtcactcgaaaggcggtaaagggaagcgccttggcaaattacctgactcaacatgatgtagctccatgtggagcttgtaggccttggatcttgttcattaatggattccttttcttcttgaggtctaattgcaacggaatggagaaggagaaagattaa

SEQ ID NO: 70253 - DNA, 1542 bp, Glycine max
  Peptide Sequence Number=SeqID_187031
atggctcaaagctcgttgagtgtctttctgccgattaaggaaaagtatgatgtgtctgcgtcaaccagtagatatttgatggatatcaacggaattgccctggatgatgaggaccctggacaccatgaaattcactatgatgatggaaacaaccacggggtcatcttggttgacgggattgatgcccttggagtgccattttttggactggctggactatccttcataggaaaagcctccatcgatggtgttgattacacctctgatgtgttgggcaggttcctgctgtggtggaggttgtcgctcatgtcgttgttgctagtgcctttgtctgcctcaatcttctgctcttcttctgtttgcttccttcctagcctagtagtctttggtgttatcaccaataccacggtgatatctatagtatttggtttgtttgaacctggcctgggagctttcgtctggggtagccagatggagaagctggctcttgtctggcttgtgccttttatccgacttgtgcaagttggctttagtgtttgctttatgcatgtcacgcttctactatatacaaacttgttagggtgtaaggcgaggagcatagagtgcaacgctacctcgaggcagctaaggtcctacagtgagacctatggtggcgtactgcacactgaatcgttcgatgagggtgtcgaagctgtctatagacctaggtttgcctgtgtcaagaaggcgtctagatgtttgtctggatctattgtcccatcgtaccgctcgaggttgagtggcttccaccctaagggtatatctgctttcataatgggtgttcaggcaaggcgtgggcggattgctcgtcactgtggggaggtctggcacaagcctttagctggtcatggtaagcctttagctttatcaactcgtcctcttggcgtcgctccatctccttgttgcggttttggagttactaggtttgcctgtgtcaagaaggcgtctagatgtttgtctggatctattgtcccatcgtaccgttggaggttgagtggcttccaccccaagggtatatctgctttcataatgtggtcgacaaaaggatgccgatggataatccgtgctggacggtgcatgtgtatgagactcagatcatttgcagtgttgctgtgcatcgggggcgttcaggcaaggcgtgggcggattgctcgtcgctgtggggaggtctggcacgagcctttagctggtcatggtcagcctttagctttatcaactcttcctcttggcgtcgctccatctccttgttgcggttttggagttactgccgcgggggtggatgtggctgagtggggccccaaactttacacgttggctaggaaaggtgcctttgacaagagggaggacttgcaaaacaaaggactccgacgctcaacctttgcagataattcccgagttgtagataatagctatgagcttatagataatgttaaagacaaacatttgcttatagataaaaggactgacgtggagggttggcacgtgtctttgagtgccatgtag

SEQ ID NO: 70254 - DNA, 411 bp, Glycine max
  Peptide Sequence Number=SeqID_187032
atgccttaccccacagtggctgaaggcactcaagtcatgaaacgggatgaagggtctcaaattcgagccctaaccgtctaccaatccagcctgggcagtgaatttgacacagatctgcaagacgacacctctgacaaagacccaaaactcatcgaagagcttgtccagctacaacctggacctaaaccgaggaagatgggagaagagcagcttaaagctgtcaaagaagaagtcgaccaactcctccatgcaaacttcatcaaagaggttcggctttccacctggctcgccaacgtcgttatggtcaaaaaggccaatgacaaatggagaatgtgcaccgattacactgatctgaacaggacatgccccaaagatgcataccatttacctagcatcaacaggctggtgtag

SEQ ID NO: 70255 - DNA, 447 bp, Glycine max
  Peptide Sequence Number=SeqID_187033
atgtcataccctaatttcgtttggggaccttcatttgctaacttttttattcttgctagccgaattgagctgtttaacgccagttgccgcattatctataagacccctggctcacccaggctagcctctggcttgcctaggccaccaatttacttcatggtaaaatcactagctcgcctaggcgagcaaggtgtgatggggctgaaggaatggggtcctaaggtccagaggtccagaattaagaagaaagaagagaaaaggagaagaaagaagagaaaaaagaaactaaaatgccatctaatcgcgattgcaatcgatttatacatcgttctccggtcgttcttcgttcttcgtctgcttaaaggaattccatgggaggaggaaggaaaggaaataaggagagaagaagaagaagaagaagaagaagaagaagaattgcgaaaatga

SEQ ID NO: 70256 - DNA, 255 bp, Glycine max
  Peptide Sequence Number=SeqID_187034
atgactaaagcacgtcaaaagggggtacggaaagggaaaagagggaggtggttgccgcccagctcgcctatgcgagctgggttacttccaccagaaggcaccgccttctgttggaacatcctagaaggcccaagtggaattacggattgtgcattaatgcttcctttcgactcccgacatgtcgcggatcttcacggattgcctaaggcaactggtcaagcgaaggtcgcatcccaacaaatagatggtccctag

SEQ ID NO: 70257 - DNA, 288 bp, Glycine max
  Peptide Sequence Number=SeqID_187035
atgaggattattttttataggccaaggttcaaaaaaggtctaaggttgtgtcaatggggtcttttattgtggaaacccgatcttgatatctggggcaaaacaaatttgggtgtcaaggtgtcggtctcgggccgaacttccatattattccacaaggcacgcgcgacaatgatgatttggaaacaacgtgcaaaattagtcatggccacagccaggacgacattcctaaatgaaaaactctacacggttccgaaatttcaacaaacactattgacaacaacgaagtaa

SEQ ID NO: 70258 - DNA, 684 bp, Glycine max
  Peptide Sequence Number=SeqID_187036
atgactctgaaattgccttattgccctatatttgttcaagtcttttataacaacttggaaattcatgatggagtcatattttctaaagtacacaaaatacccattggtgttgatcaatccttgttttactccctaaccaaactgagcagtcaaggtgtgccttttgaaggaaccttagttgatgattattctagtcatgatgctcgtaaaattgtttgtgttgaaaatgctgataagactggtcgcttacttgctggttcctttacctttgaatgccgtgttatgcattttattctctgtcatgtgttgcttcatcgttctactaacctttctcaagcctctgagaaagacttaattttgttgtgggcactgcaaactggcattacgggcaaatgcccctctaccatatcccgatctggttactctattctgcagcacttcaaagtccctcttactaatgaaccatttgtcaaggattacctggctagtgctctcaaggaacgcactccatctccaccacctagggatccctcctctactttactaaatgatgttctcaacgagattcaagatcttcgtgcatttgtcggagaaaggtttgattccatggattctcgcatcactcctcttgaggatgacatgggatttatccgtcgttgctttgatcctccaaccaatcattag

SEQ ID NO: 70259 - DNA, 1236 bp, Glycine max
  Peptide Sequence Number=SeqID_187037
atggccaaggaaatagtgaaaacacatgatgtttcttttcttcagagaccccatcttgtttttggtcaaatgatatcctacgggggattgggcattgcttttgctccatatggtgatcactggagacaaatgaggaaaatgtgtgccacggagcttctgagcaccaaaagagttcagtcttttgcttccattagagaagacgaggcagcaaagtttatcgactccattcgcgaatctgctggttcgcctatcaatctcaccagtagaattttctcattgatatgtgcctctatttccagggtagcattcggtggcatatacaaggagcaagatgagtttgttgtgtctttgatccgaaaaatcgtagaatccgggggaggattcgaccttgctgatgtctttccttcaattccattcttatatttcctaactggaaagatgaccagattgaagaagttgcacaagcaggttgacaaggtcctggaaaacatcatcagagagcatcaagaaaagaacaaaattgcaaaagaagatggagctgaattagaggaccaagattttattgatcttctcagaatccaacaagatgacactctcgacatccaaatgacgactaacaacatcaaagctttgatattggacatatttgctgctggaactgatacttcagcatcaacactagagtgggctatggcagaaatgatgagaaatccaagagtgagggagaaagcacaagctgaattgagacaagcttttcgagaaaaggaaataattcatgaaagtgatcaagagcaacttacttatttgaagttggtgatcaaagagacattcaaggtacacccacctactcctttattgctccctagagaatgctctcaaccaaccatcattgatggctatgaaatacctgccaaaactaaagtcatggtaaatgcatacgcaatttgtaaggattcccaatattggattgatgctgataggtttgtccctgaaaggttcgagggtagttctatcgatttcaaagggaataaatttaactatctcccttttgggggaggacgaagaatatgcccaggcatgacattgggtttagctagcattatgcttccactagctctactactgtatcacttcaactgggaactcccaaacaagatgaaacctgaggaaatgaatatggatgaacacttcggattggctattgggaggaaaaatgaattgcatttgattcccaat

SEQ ID NO: 70260 - DNA, 324 bp, Glycine max
  Peptide Sequence Number=SeqID_187038
atggtaaatgcatacgcaatttgtaaggattcccaatattggattgatgctgataggtttgtccctgaaaggttcgaggttagttctatcgatttcaaagggaataactttaattatctcctttttgggggaggaagaagaatatgcccaggcatgacatttggtttagctagcattatgcttccactagctctactactgtatcacttcaactgggaactcccaaacaagatgaaacctgaggaaatgaatatggatgaacacttcggattggctattgggaggaaaaatgaattgcatttgattcccaatgttaatttatga

SEQ ID NO: 70261 - DNA, 409 bp, Glycine max
  Peptide Sequence Number=SeqID_187039
atggcaaggattcttgacaagattaagtctattgatgggtcaagagagatgcttaagcttgctgtgagagtcacgaatctttggttcgttgggactcccaacaagtctgagcaagcggaaatgattattgttgattctgagggtgatcaaattcatgttgtttgtaaagcggaccaactaaagtcttggaaagctgatttgaaggaaaattccacttatgttatgcataatttcaaagtggtgaagaatgatagtcaatttagagtgtgtgaacatgagtacaagttagtttttattagagtgactgttgttagagaagctgatttgcatgaactgtcttttaaggaatttaaatttgttgaatttggaaatgtcgttgctgggaattttgtggctagcttgttggttg

SEQ ID NO: 70262 - DNA, 102 bp, Glycine max
  Peptide Sequence Number=SeqID_187040
atgaaggatttaaagtatgaattgggaggtttgaatgatgaagagcagcacaagagggaatggatggcagaattttggaaagtatcaaaatggtatatatga

SEQ ID NO: 70263 - DNA, 2133 bp, Glycine max
  Peptide Sequence Number=SeqID_187041
atggagttaaaaggggaggataatggtgttttaggacaagtagcattgcaaagtttgtttggaaaatcattccaagtggttgatgggctgttggtgtgcacggagttgcaggatcctcgaggattgccacctaacagaggtaaggaacacaccatcacactattagaaggccaaggtccagttaacgtaagactgtattgctatccccaccatcagaagaatgaaattgagaagcaagtgaaagagttggttgatacaggtatgatttgccccagccatagtgcttcttcaagtcttgtaatcttggtgaaaaagaaggatgcgacgcggaggatgtgtgtggattataggaccctaaacaaatttacggtaccagataagtttcccattcctgtgatagatgagttattggatgaattacatggagctcaatttttttctaaactggatttgaagttgggatatcaccaaggtcattacgaatacttagtaatgccttttggcttgatgaacgccccctctacgtttcaggcattgatgaatgaggctttcagagggatgctgagaaaatatgtgctggttttctttgaggatatattgatgtatagcctggattggatgactcatacgcaacatttaactgcagttttggatggtgtagctatggatccttccaaaatccaaagtttgcttcaatggccaaatccaaagaatgtgaaaggtgtgcaaggtttcttaggattgacgggctattactgtaagttcatcaaagactacggtacaatagcacatccccttactgatcttactaagaaggaggggttcaagtggggcattccagagcaggcagcatttgaggctctcaaggggcagatgactacaggcctggttttggcactaccagatttcagccaggaatttatcattgaaagtgtcgcttcaggtcaaggtttgggggctatcttaattcaaattgggcgtccagtagcgcacttcagcaaaacattgaaggacaggaatttgacaaaatcggcttatgaaaaggaactcattgctgcaacttcttcagcgcataacaacaatgaaccgacaaaactgggctgccaaattgttgggatatcgggcaaagaggagattgaagaagtcctccaagacgagagtcttaaggaggcagactggtcatctcagctaagtcatcctggattcctattttactcaaggaatatcattcaactcctcaaggcggtcattccgggttctaccgaggcttattacagccctttaacattcctagctgagctctatggtggtcatggactgaaattattcaagctgcaggggacacatttgaagatgagcaccgcttatcatccacaaacggaggtgattaataggtttcttgagacttttcttcgatgttttattgctgttcaacctaagtcttgggtgttgtggctaccttgggctgaatattggtacaacaccacatttcatgtatccacgggcactttgccttttgaaatggtttatggatgcaaacctccagtgctaactggcttttcaataggggagacaatggaggctgctcaacgggaactgttagatcacaacgaggacctcatgggcaacaaacagttaagacctcaacagataggagcaattgcttataagctgaaattaccggattctgctcgtattcgcccggtatttcatgtgtcattattaaagaaagctattgccaactacagagttgaagaggagcttcccgcagatttgggcagtgacacaccacaggtttgtgaacctgctgctgttttggcagcagacaattattggtgcattggaaaggacaagtctgttcttgaagaaggggacaatgttagaaccccagtgatggatactaggccaatagccaggcccactatatggagagtgtactccaggagaaagggaacaaagaagagcatttgtgcctctgaaggagctgagctctgggtagtaggaatcgtgattcctctatcagatattgcttggaaagatgccaaatatgctcagatatgggaatatctcagggatgaatttgaattaactcagagatttgctagtcttgatttcaagttgaaatttgtggag

SEQ ID NO: 70264 - DNA, 750 bp, Glycine max
  Peptide Sequence Number=SeqID_187042
atggtggtttttcagtatggttccattgtattgtttaatgtccctgagcatgaggttgatgcttatttgaaaattgttaagaagcatgcatctggtctgcttcctgaaatgagaaaggatgatttcttttctttagtgcttgggaagaaactttccagatctagttcagaagtgctcaactcaattctgatcttctacctttccttctttaagattccaaagaaggtcatagagatattggtaaggctgcaaaggaggtttctatggggtgtgggagtggatgagttcaagactgcgtgggtgaaatgggaaacggtatgtctaccaaactaccatggaggtttgggagttagggatttagaattgattaatatggcactgctaggaaagtggaaatggagcatgcttcaggaggatgataccatttggaatagaattctggtttctaagtatgggggatggagagtgttagatttggagagggtcaaccagccggaatcactatggtggagggatttaaagaagtcatgtggcgcctcggcggttggggaatggttcaataaaggcatgaaactaaaaattggatgttggagtagggtaaatttctggactgataaatggatggggggaccggagttgctaggatgtgggaggtcgggagcaaaaatctacactgttagtggggcttatgcatggttgtatgagacggtagttggatcttcagaagaggagatattcaaaagggtgtga

SEQ ID NO: 70265 - DNA, 348 bp, Glycine max
  Peptide Sequence Number=SeqID_187043
atggataagttcaaaccgaactacaatgcagctatgagttataatggtaaaacaacttgtggcagagctcttagggaccattgtggtggaaccattttcaccttctttgttcggattggcaattcatctattaatcttgcggagctatgggcaattgtctttggtatcaagctagcaacttccaggggctattatgatccaaaagttgtgcaacaacgcatgaatatgctcaacttgttgaatctatcttggagatggcgacctcttcagatattagttcctgaaatcacactcccaagggaagccaatcaagtgaggactgttttgccaagcatggctttggcttag

SEQ ID NO: 70266 - DNA, 285 bp, Glycine max
  Peptide Sequence Number=SeqID_187044
atgattgtatttcgttctgacggatgtggatttgtccgaaacttcagtcatataactcctgatattccactacatgatcagttttcttgtgcaaatgactatgccttgaaggtaaggaaaccatatactatcacaaaacaaagaaagaggaggacagataaagaacataagaagatccttgaagccttaaagctatatggcagggcctggcgacgaattgaagaacatgttggtacaaagattgttgttcagattcaaagtcatgttcagaagtttttttcctaa

SEQ ID NO: 70267 - DNA, 1494 bp, Glycine max
  Peptide Sequence Number=SeqID_187045
atgaccgttacttttttcatctttcttctctacttcttttttcatcccgccgtttctctctcctccgacggcatcgcgcttctcactctgaagtccgccgtggacgcccccggcgctgccgcgttctccgactggaacgacgccgacgccacgccgtgccggtggtccggcgtcacgtgcgcgaacatctccgggctcccggagccgcgtgtcgtcggcctggcgctctccggcaagggcctccgcggctacctcccgtcggagctcggcaccctcctctacctccgccgcctcaacctccacaccaacgccctccgcggcgccatcccggcgcagctcttcaatgccaccgcgctccacagcgtcttcctccacggcaacaacctctccggcaacctccctccctccgtctgcaccctcccccgcctcgaaaacctcgacctctccgacaacgccctctccggtgccatccccgatacgctccgaaaatgctccaacctccagcggctaatcctcgcccggaacaaattctccggcgagattccggcgagtccgtggccggagctgaaaagcctagtccagctcgatctatcatcgaaccttctagaaggttcgatcccggacaagctcggtgagctcaaaaccctaaccggaaccctcaacctctctttcaaccacttgtctggtaaaatccctaaatctctagggaacttgcctgttgccgtgagcttcgatcttcggaacaatgatttgagcggtgagattccccaaatggggtctttttcgaaccagggccccaccgctttcctcaacaacccgaacctgtgcgggtttcctctgcagaaaccctgcacaggttcggcgccgagcgaaccggggctcagccctggttcacgaaggccggcgcaccggtctgcgaagggacttagccctggtttgattattttgatctcggtggcggatgccgccggggtggccttgattgggcttgtggtggtttatgtttattggaagaggaagggcaagtccaatgggtgtagttgcagtttgaagaggaagtttggtggggagagtgagaagttgagtttgtgttgttggtgtaatggggtgaagagtgatgattctgaggtggaggagggggagaaggaagagggagagggtgggaggggggaaggagacttggtggccattgataagggtttcaactttgagcttgatgagttgttgagggcttctgcttatgtgttggggaagagtgggttggggattgtgtataaggtggtgctggggaatggggtgcctgtggctgtgaggagattgggggaaggtggagaacagaggtataaggagtttgctgctgaggttcaagccattggcaaagtgaagcatcccaacattgtgaagttgagagcatattattgggctcctgatgagaagcttttgatcagtgatttcatctccaatggcaatttggccactgcccttagaggttag

SEQ ID NO: 70268 - DNA, 228 bp, Glycine max
  Peptide Sequence Number=SeqID_187046
atggcggtggtaaggaaggaggtaaagttgctagttgggataaacgatcacacatggcctcaactttgctggctaggtcagagtgtttatcggaaagggaagaaatggcttcttttaacctatcagtggtggtgcggcgggtcgcatggtcgaccatggcagagtcgtagcggcagctccgccgttggtccaccgcctcctcctcctcgcgccgccgcacttctgtga

SEQ ID NO: 70269 - DNA, 465 bp, Glycine max
  Peptide Sequence Number=SeqID_187047
atgctcgatgaagctattgaataccttaaacagcttcagctccaagtacagatgctgtcaatgagaaatgggttgagtttgcatcctatgtgctttcctgatggcttgcagcctctgcagttgtctcagatgggtatggaattaagtgaaagaaacaggtctacccctttaaaaatgtcagctactctgcctctgcatcaagacaacaaccccttgcactatgcatccaatcagccatgtgtgccctatcctccatacattaacaacccagaaacttctttcggtctggaaccccgaatccaaccggatacgaaacctcttcaacacaaagaaggatcttctgagccaatacgcggggaagacattctgcagtaccagcaatcaagtgctatccattcagataccaatacattaggtggttctcaaggtgcgcatgtttcttcttgtataattaattcaatgtaa

SEQ ID NO: 70270 - DNA, 1680 bp, Glycine max
  Peptide Sequence Number=SeqID_187048
atggcagtgaatgggtccaagaagaaaaaatcgggtcagggcatacccgggcccacgaacccgatggtgacgcctatgctgacggatcaatatcaattcaccatggcttatgcgtactggaaagctggcaagcatcaagagcgtgctgtgtttgatttgtattttcggaagaacccctttggaggtgagtacactgtttttgctggtttggaagaatgcgtgaggttcgtcgctaattacaagctcaacgaggaagacattgattatatcaaaaataatttgtctgtttcatgtgaggatggcttccttgactatcttagaagaattgactgttctgatgttgaggtgtatgctattcccgaaggatcagttgtttttcctaaggtgcccctactgagaattgaaggtccaattgccgttgttcaattgctggaaacaccttttgtcaatctaattaattttgcatcattagtttctactaatgctgcaaggcatcgttttgttgctggaaaaacaaaaactctacttgagtttggactacgaagggcacaggggcctgatggtggagtgggtgcatcaaagtacagttacattgggggatttgatgcaacaagtggttaccctatgagtttgtactttgtaattaggcaaagtgtatatatatgtcctggaattgtggttcaaaaattctgcaacgttgcagcaggaatgttattcgggattccccttcgtggaactcattctcatgcattcgttagctcatttatgaaccttgacgagattaaagacaaatcgcttcgtaaaaaagatggttcaagtacatgtaaagattttaggtcgaattcactacatggaaattttgctgagaccaatcaaagtgagctggcagcattcacatcatatgcattggcatttcctcataactttttagccctagtagacacttatgatgtcatgagaagtggaatccctaacttttgtgcagttgcattggctctcagtgatttaggatacaaagcaattggcattagactggattctggtgaccttgcatatttgtcttgtgaggtcaggaagttgttttgctccattgagaaggaatttggattgcccggtttcgggaagatgagtatcacagctagtaatgaccttaatgaggaaacattagatgctttaaacaaacagggtcacgagattgatgcgtacggaattgggacatacctggttacgtgttatgctcaagctgctttaggtgttgttttcaagctggttgagataaacaataaacctcgtatcaaaatttctgaagctgtctcaaaggtcactattccatgtaagaagcgaatatatagattgtatgggaaagatgaaaatgcaatggtgggagaaagaatcctgtgccgccatccctttgaagaatctaagagagcatatgtggtgcctcgaaaagttgaggagcttttaaggtgttactgcgccgggagttcagataaaaaggaagaaattctacctcctttgaaggacataagagagcgatgcatcaagcaacttgagcaaatgcgatctgaccacatgaggagacttaatccaactccatataaggttagcgtaagtgcaaaactatatgacttcattcatttcttgtggctcaatgaggcgcctgttggggagctacggtga

SEQ ID NO: 70271 - DNA, 327 bp, Glycine max
  Peptide Sequence Number=SeqID_187049
atggcgctgcggtccaggacttccggccacggccgccggttcgagagcctctgccggagggaatccgaggctagtgagaggaggaagcggaatgcggattgcggttgttgcgtttcggtgggtatgaaatcacaatcagttacgaagttgccgtggaacaaaaccgctgcccccacgaatgttcagaacaacagcaacaatgactggagggtggcgacggtggagatgacttgggagagtatcgaagagatgtctaaaccattaaggctaacattagttgaaagggtgatgaccggaatcttcagttcaccgttcaccgttgcttaa

SEQ ID NO: 70272 - DNA, 2556 bp, Glycine max
  Peptide Sequence Number=SeqID_187050
atggcttgcaaagtagcaagcagcatgtggtctaaattaggccgcctcaaccgttctacaatgcctaaacttagaagaagcaaggtttttggttctggagcagatcctggtatcatgtcctgcattgctggccgacttctttgtgatacatacttgtgttcccgtgacctattaaaggaggttagttattctttaactcaccttgcaaaatcacatctaaacaagattcggacggaagttgctccacatgaagttccaaaaatgttccaaacagcagaatccctaatgaagcttattgaatacggtgaaacagatgcatggctgtctatggaactcatgttttatttaagtgttcttccgctcacacgtcagctgactaatataagtggcaatctgtgggggaaaactcttcagggtgctcgagcacagagagtggaatatcttttgctgcatactttccacgcaatgaaatttatggtgccagacaagttctcataccatgcaaaagaaacaaaagaaacaaaattgatgaaacgcaggttaactcatgatgtggaggataacaactttgatgcatatattgatgatgcaaaccatgacaatgatgcttctgaagctgataataagaaaagcaaaaagggtccttcttacgctgggggactggttttggagccaaagaagggtctatatgacaaatatatattgcttctggacttcaacagtctttacccttctattattcaggaatacaatatctgcttcacaactgttgagagatctttggatgaatcttttcctcgtctaccatctagtaaaacaaccggagttttgccagaggtgctgaaaaatctggttgatcggaggaaaatggttaagtcgtggataaagaatgaaaaaaataagaatgaaaagactgatcctattagagttcagcaactggatattcagcagcaagcactcaagcttactgcaaacagtatgtatgggtgcctgggattttcgaattcaagattttatgctaagccattagctgagcttataacttcacaaggaagggagatactacagagtactgttgatcttgttcagaataacttgaatttagaggtgatctatggcgatactgattcaataatgatttacagtgggctagatgaaattgaggaagctaataaaattgctgtaagagttattcaagaggtcaataagaagtataaatgcttggaaattgatcttgatggtttatataaaaggatgctgctgcttaagaaaaagaagtatgcagctgtaaagttgctgtataaggatggcaccccatatgaggctattgaacgtaaaggtcttgacattgttcgtcgtgactggagcatattagctaaagaactaggagatttttgcttgactcaaattttatcgggagggtcatgcgaagatgttgtggagtcaatccacaactcactaatgaaggtacaagaagaaatgagaaacggacaggtagcattagagaaatatgtcattacaaagacattgactaaacctcctgaagcttatcctgatgccaagaaccagccacatgttcttgtggcacaaagattgaagcaacaaggctactcttctggttgctctgttggtgatacaatcccttatataatttgctatgagcagggtggtagtccaggcagtgcagctggcattgctcaacgtgccagacatcctgatgaacttaaacgagatcaagggacctggctgattgacattgattactatttatcacaacagatccatcctgtggtatcacgtctttgtgcaccaattcagggcacaagcccagaaagactagctgattgtttagggcttgactcatcaaagtttcatcataaatcaagtgaagctttaaatgatgattctgcaagcccactctcgtttgttgctgatgatgaggagaggtatcggggatgtgagccgttggtcttgtcatgccctagctgctctggtacatttgactgcccacctgtttttaaatctatttgtttgttgggaagtgaaaggcaaaggccaaccagtgtagccccagaggaagctgagtacaatttctggcgtaagctgtgctgtcctaaatgcccagatgttaaaatttctcctgtaatgatagctaatcaggtcaaaaggcaagcagagaggtttattttaatgtactacagaggtttactagtgtgtgatgatgaaacgtgtaagcatacaacgcgaagtatcagccttcggttggttggtgattctgagagaggaactgtttgtccaaattatcctcgctgcaatgggcgtctagttagaaagtacacagaagcagacttgtacaagcagctctcgtatttttgccatgtgttcgatactgtttcttgtatagaaaagatggaggcaaaatctagaataccgatagagaaagagttgataaaaattagggcggtgattaaatcggcagcatcaacagcacaggagatcagggaccgttgtgcctttgggtgggtgaaattggagaatctggtcatttcagtttaa

SEQ ID NO: 70273 - DNA, 318 bp, Glycine max
  Peptide Sequence Number=SeqID_187051
atgaagactaataacaacgtttctggagagaggaaatcgcggaagagacgcagtggtgaaagtgattctgtggaggacacacttgaaaagtggaaggagtacaacaggcagcaacaacttggctctagagaaaatggggtggaagtgattcacaaagttcctgccttagggtcgagaaaaggatgcatgataggaaagggagggcctcataactccgattgcaagttcagaggtgtgaggcagaggatttgggttaaatgggttgccgagattctagaacctatcaatggcaagcttgttggtgagaaaacaaaatag

SEQ ID NO: 70274 - DNA, 1971 bp, Glycine max
  Peptide Sequence Number=SeqID_187052
atggcggatgatgagccagtaagcggaaggcgaaggccgaggggaccggaggccaccgaacgcagcaaagccttggagcgtctcaaggcccgcatccacggcggtcgtcgatccgacgccaccgggccccaaatcaggttagaaaaccctgtctacgacaccgtccctgaggacgagtacaacgccctcgtcgccaagcgccgcgaacaggctcggtccttcatcgtcgacgatgaaggactcggctacggcgacgagggcgaggaagaggactggtcgcaggccggattcaacctctcctccggcgaatccgaagacgaatcggagaggccgaagcggaagaaggtcgagaagaaggatcctcagccgaaacgaccttcttcctcgctctccgccgccgccgccatgatgggaggccagaggctgtcgtcgatgttcacttcgtctgttttcaagaagagcagagacgacaaggcctccgagagcatcgtcgatgatgttatcgcggagtttgcggcggacgagaccgatagactgaggcgtaaaagggctaatgtgaattcctcctcctcttcggttacaaatgatgctttgcggattaacaacacggttagggataagccttctgttgatttgattggagcttcttcgctgccggcaaatggtaatgctgtgtctgttaaggttgttgacagtgatggttctgactcggggtttgagcaaaagagtgaggcggttagtgaaattgaagatttggcgtgtgtaagttctgagaatggacaggcgccagtggtggaatctgatgattgtaaaattaatgagggtatagttgaggagaaagagatgaagaaagctgaaattgaagtaatatcgggtgggaaaaaggaggtgttcactttgaatgcgaaggttaaagaggaggacgaggaggacccgtcattgtctgcaactgctggttggaaggaagtgatgagtggtgccggtggtgttgatgctgattcaaaggatgctttgcagaaccaacaacactcagagttagatttggagaaagatggatcattttttttctatatactagatgcatatgaggagttttatggagaaaataggggcaccctttatctgtttgggaaggtcaaaactggggatttgtatcagagttgctgtattattgtgaagaacatgcagaggtgcatctatgcagttccaagcctatctctgcatcgcacagaagagatgatgagtcttgagagagatgtccaagagtctcgaatttcttctgcagatttctttaaaaagctgcaagatgcagtatctgatgttaagaatgagatagcacagcatctggtgaatttggaagtttctaactttagcatggctcctgttaagaggaaatacgcatttgaacggtctgaaattcctgcaggtgaaaattatgtggtgaaaatcaattattcattcaaggatccagtactccctgtagatctcaaaggagaaagtttctgtgctctcttaggaactggttgcagtgcgcttgagctttttttgattaaaagaaagataaagggtccttcatggctacaggtttcaaacttttctccaagctcagcttctcgaagggttagctggtgcaaatttgaagtgactgttgactctcctaaacaaataaattcagctccaaagatcacttctaagattcctcctgtggttgttgcagcaataaacttgaaaaccatcataaatgaaaaacagaacataaatgagattgtatcagcatctgttgtctgttgcaacatggttaagattgacactcctatgatggcttcagagtggaggagacctgaaaggctgacccgttttactgttgttcgtaaacttgatgggagtatatttccgatggggttcaacaaggaggttacggacagaaacttacaagtgggttcaaatattctgtgtgctgagagcaggtag

SEQ ID NO: 70275 - DNA, 979 bp, Glycine max
  Peptide Sequence Number=SeqID_187053
gtgcaggtattgttgtcggcggtggacagcggcgtgctgagcattaccgactatgccacccccgatccgtggaacggcttctttggccgcaagcgctacaacgccgatcaatatgacgtattcgggcagttgattgagggcggtggcaaactggcggcgctgcgttttggcggtgacggggatgatgccgatgcgctgtcgcgcggcggtaaaaagccggtcaccgaggcgcagattgtggcgcagcagctgcaaccggtgacgctggatgccagcggcgagggcacgctggaactgccggtaccagccttcaacggcgagctgcggctgatggcgcaggtgtggagcgaagacagtttcggcgcggcagatcgtaaactggtggtcgccgcaccgctggtaagcgaactggcgacgccgcgctttcttgccagcggcgatcaatcaacactggcgctggatttgaccaacctcaccgatcaacctcaaacgttgaacgtcacggttaatgccagcggcttgattgcactcaacgggcaaatcccggccagggtgcagctggcgaaaggggcgcgaaccacgctggcgatcccggttaaagcgcaggacggttttggtgagggcgacgtgcaggtgaccgtttcggggctgagtctgccgaacgagacgctggcaccgagcgtgcgccgctggaagattggcgtgcgtccggcttatccggcgcaaaccctgagtttcgataacgtaatgaacagcgggcagcgctggcaggtgatggcaagcgctttcaacggcctgcaggctggcacgctgagcggccagctgtcgctgagttctcagccgccgctgaatatcgccagctacatcagccagctttacgcttatccctatggctgtctggagcagaccgccagcggcatctggccttcactcttcaccaatcacgcccagctcagcgcgatgggcatcaaaaccagca

SEQ ID NO: 70276 - DNA, 776 bp, Glycine max
  Peptide Sequence Number=SeqID_187054
ctgagaaggagttcaaggttgaagtggaagctataggacgtgttcgccacaagaatttagtcaggttgcttggttattgtgctgaaggagctcatagaatgcttgtttatgagtacgttgacaatggtaatttagagcagtggctgcatggggatgttgggccttgcagtcctctaacttgggaaattcgaatgaacattattctgggaacggctaaagggttaacttatcttcatgaggggttggaaccaaaagttgttcaccgtgatattaaatcaagcaacattttgcttagtaagcagtggaatgcgaaggtgtcagactttggactcgccaaactccttggctccgacaacagctatattacaacccgtgtcatgggtacatttggatatgttgctcctgaatacgcaagtactggcatgttgaatgaacggagtgatgtttatagttttggaattctaattatggaactaattacaggaaggaatccagttgattatagtcggcctccagaagaggtgaatttagtagactggctcaagaagatggttagcaacagaaatccagagggggtgctggatcccaagcttcctgagaaaccaacctcaagggcactaaaacgagcccttcttgtagccttacgctgcactgatcctaatgcacaaaaacgacctaaaatggggcatgtgatacacatgcttgaagccgaagattccccttacaaagaggtaacaatcatttctgctgaaattaattcaacctcagtgcggtag

SEQ ID NO: 70277 - DNA, 1389 bp, Glycine max
  Peptide Sequence Number=SeqID_187055
atgcatatagagaagtgtcagtgcacaaagacatacagaacagaacctgagaaacagaccctctcaaaccggaaagcgcaaatgaagcccattccatgcctaagcattcgcatacttctgctaatcgctatctgtctcttcacctcttcctccgcttccaagcagatcggagaaacttgcgggtcagacaacaaatgcgacgctggactcagctgccaagcatgtcctgccaatgggaatacccgaaccagatgttcgcggatacaaccattgagccccacctctagggtgaaaggcttaccgtttaaccgctattcatggctcacgactcacaactcttatgctctggccggagccagatccgccaccggatctgtccttgtagcccctatgaaccaggaagacacagttgctgaacaactcaagagtctattgagaacgacccctttacgctttattttgtattggatacacttacagaacggagttagaggatttatgttggatatgtatgattttcaaaaggacatctggttgtgccactccttccaaagcaaatgtttcaacttcactgcatttcaacccgccataaacgtgcttaaagacatgcggacatttctagatggaaatccatcagaaattatcacgatcttcattgaggactatgtcacagctcctcagggcctaacaaaggtgttcaaagattcagggctgagcaagtacatattcccggtgtctcgcatgcccaagaatggtggagattggccaaccgtcgatgacatggttcagaagaatcagcgcctagtcgtcttcacctccaaatctgccaaggaagcttctgagaacattgcttatcagtggacatacgttgtagaaaaccaatatggagatgatggcatgaaagctggttcttgtccaagccgtgcagaatcacccgcaatgaacacagagtctagatcattggttctggtcaactactttcattctgctccaaatcgatctcaggcctgcgctgacaattcggctccactacttgatatgacgaagacttgtcatgaagcagccggcaatcgttgggccaatttcattgctgttgattattaccaaaggagtgatggcggaggagcaccactagccgttgatgaagccaacggtcatctcacttgtgggtgcgacaacatagcctattgcaaggaaaacgctaagtttggcacttgtgatgtccctcccatttctccacctccacctgctacagaaaccctctccaccggaaaccagcagacccaaaatgataatcacacaaacaatgcttatattggtagaacggccaagctgatgcaatcggttgttggaattttggctacgacaactttcttggcatggttatag

SEQ ID NO: 70278 - DNA, 201 bp, Glycine max
  Peptide Sequence Number=SeqID_187056
atggatgccgccagcagtactggcgaggaacgcgtgccgccattgtcaatggcgagaagcttggtgacgtggagggtgccgccattatcaatggcgagacagctgacatggacgctatctcgctggtcccactggcgagaagcatgttgtctcactgctcccaatggcgagaagccttccacgctagggctgaaaggctag

SEQ ID NO: 70279 - DNA, 2208 bp, Glycine max
  Peptide Sequence Number=SeqID_187057
atgataaaatcagatatctcagtgtgtgtcatcagatgttgtgttaaggtggcttcatggggtctgatgttggcagcttctaactcagacatgaaagcctattggtccaacgacatatttgccaagctatgctccatggcaagagatatgaacatgaaggtcagggttgaagcatttagtggcctcagaaagatggaaatggtatcggaggatcttctgttgcaaagtttatcaaagagagtttcagggcatggaaagcaaaaggaaactctgggtcagcgcacatctgaacaatttgtcatgttggcaactaatgttgctggtgcactagttcatggacttgaggatgagttctttgaggtgaggaagtctgtatgtgagtccttatgcacgctgacaagcctatcttctgagtttgcgcgtaaagccttagactcgttaatggatgttttgaacgatgaatcggaggtggttcggttccaatctttagaaaccttgcatcatatggcaattaatggccgtttaaagcttcttgaaaaacatttgcacatgtttcttggtgctttggtagataacagttgggatgtaagatatactgataggaaaatacttaaagtagtgaagctaaattatctggcattgttcaaatcatctgttgacagtcttctgggaagtttagacagttatccacaggatgaagctgatgtattttctactttttctcatctgggccgaaatcacaagaaatttgtaagcttgattatcaaggacatgtttgaagaggtagaaactgctttggaaggaaatgtagaatttaatagtgcaaggatagctgcactgttaattctttctatatctgctgcactcttgaatgctgatgtaggcagaataccaccagtaatgttttcttatgcagttacattcctaggtagaatttataatgcttttagtgatatcatggatagggatgcccttttggcctgcctatgtgagaaaagcagatctacagagtattctgcaacaaatattaaccctggggaaggggagcaacagtttcctttatttgaaggtgatgctccaaattttgctagcaatgaggtgattggttccaaaattgattcacatatcacaagggagcaaaaagaggtagcaaatgatcaggtagaacaacagcaatcggtgtataatgaagttacaaacttgataaattacatccttgcaaagctccctgatatgtggccgaggatacagtcaggtcacacaaatgaagtgctaaggtccttgaggtgtttgaaggagttaaccactatgaaatttgattctttgggatctggtgatgctgatgctttggcatttactttactgtatctccggataatagagctacttgcagaagtatggaacaatttgcttccagcaaaagggttgtgttatcagggaataggaaaattggaattcaaactgggaaagcttgataggagggttaaagaattgatgagtaggtttataggtttctctgcagaagaggaattgaatgtcttggagctaatgttattgacttataccctcaggatatctaaagaagaaatcagctgtattaatcatacattaaagaggttgagtagtctatatttacgtgttgaatctatccttaaagaaagttcagctttgccatccaatttcctagttgaacttgggaaagtattaagtagcacctccatcaatggagcttcctgcagtccacttcagtttgaagcatgtctcaagttcttctccctaaagcagtttgtgtttcatggaccaatcaaacatgtaaaggcagaactaagtgttcccaatattgactttgaacatcctcttccctttgtttcaggactacccgttggtatacaatgtgaaatcactctccataatattttaagtgagagtcggttgtggctaaggatgactttggatgatggtttcatacaatatttctttttagatttggactgttctgaaggctctgaagaggtaagaaaatgtacatttgttgcgccgttctacagaacagcagaagctgattgtcttatattgaaggtttgcattggttcagaatgtttgtttgaaaatgttagtccagtccaaaagtttgggggaccgaaacgtgaactagtacttctttgtaatgaaaaacaagtttatctttccaaggttagtaaagcttaa

SEQ ID NO: 70280 - DNA, 783 bp, Glycine max
  Peptide Sequence Number=SeqID_187058
atggaaattctgtttgagaaactgatgatggaagttctttcatggcttccagtgaaatctcttgttcgattcacgtgcgcgagcaagtggtttcagtcattgatctccgattcaagtttcgtgaaactgcaccttcaaagatcacccaaaagcgaggactttctattgatttgctcagtcgacgacactctgaatcgtttcttcattctttcatgtcctgccattcctttagtatcagacgacccactgtcccttattgccgatgatcatagcctcggattggagctgaatgacacgtacgagattgccggagcctgcaatggcttaagaaaaacatttgaagacgcacaatgtgttttagcccttcctggaatagatcacgctgctggcacctttggctttggctacgaggtggtcgtatcaatagtttccactcttaacaatgatggttcgctcaaattgtgtgaggaacgagacatacacacaattgttgctgcctctcttgatggggtttacttacatgatttttactctgatggagatgatgaggatttcatctccgatcaatgttttggggtattgaaggactgtttgagcctttttcttcacagtcgcaagacaaaacatttagcgatatggcaaatgaaggagtttgggaatcaaaattcttggactctgtcgcagagcattgctattcaggatctagaaattgattgcatgccatgtcatgacttactgccattgatcatgtatgaggaattgaggatggcggtgtcctcatga

SEQ ID NO: 70281 - DNA, 480 bp, Glycine max
  Peptide Sequence Number=SeqID_187059
atgggtggtctttttgaggctataactggttatggtcttggtgggtcttctatggctttgtttggaagagttggtggaggtatctatactaaggctgctgatgttggtgctgatcttgtcggaaaggttgaaagaaaaatccccgaagatgatccaagaaatccagctttacaatcagaccccttccaattgttctactttgaacaagatgcaaatagaggctatggtttagcattgcaggaagatagtgagaagactggcaaggtgacatctgcaggaatgtatttcttacattttcaagtgtatagaatggattcgacggtgaatgcgttagcaatggccaaggatcctgaaggggccttctttaaaaggttggaaggtcttcagccttgtgaagtctcggaactaaagcctggcactcatatatttgctgtttatggtctgaataatttatcttatattgttcttttgccagtttag

SEQ ID NO: 70282 - DNA, 546 bp, Glycine max
  Peptide Sequence Number=SeqID_187060
atatatgagcactttcctagtgttcatgactgcgtcactgacgatgtatacgatgagacatccacacgtgcctgccggtggcttacgacgaaggcttatatcaagggattacgagcagcggcgtaccagacacgtttggatgctttgacgatcactaacgtgtcctggatgccctatggtgaccaccaaggagttaggaggtttgagctcatttcgtgcttccagggtcagaccattcctccaccgcctgttagtgcctccttgtcatatgaggatatcgacgacaagtatcagcaaattacatggagtggttcttccggatatctcatctgtgcgccacaacataaggaatacatcgagccaggtatcccagaggttccagtgggagcagacgttggaccatcacaggcacctgcagtggatggttgtgaagcgatcgcagaaaggttagagcatgtgctcaacctaaggatggtcactgaaggcacagagttacatgagatcgtggaagattgcctcaggatcgctaggggggtgacaacttaa

SEQ ID NO: 70283 - DNA, 150 bp, Glycine max
  Peptide Sequence Number=SeqID_187061
atgaggaagaggaaatggaagaaggaatctgcgtttcctaagtctcggcatgtcgttggcttcgactcgaaaatccctttcgcttctttgatggtttcgccattagaaggggagcagggacgcgttgtaatcgattacagcatttggtaa

SEQ ID NO: 70284 - DNA, 231 bp, Glycine max
  Peptide Sequence Number=SeqID_187062
atgtatgtcctaggaaaacccgcgcgtcaatgtgaaatggctccgaagaaactctccacgaagaggtctagaagggacgccactggagaaggctccagtgccgcctcagaggtttatagtcaccgtttccagagtgccaagcaccagcagtgcttcgaggccatcaagggatggtcattccacagggagaggcgtgtccaactcagggaagacgagtaccctgacttctag

SEQ ID NO: 70285 - DNA, 237 bp, Glycine max
  Peptide Sequence Number=SeqID_187063
atggggaaagacaagttagaactgggtgtggaggatcagaaagtctcattcaacttatttgaagcaatgaagcatccaaatgataagaaagcttgctttgatctagacaaggtaaaaaagaggctaagtcatgaagtgcaaaaagtgacagttgagcttagctcagcaattgggctaagcgtgcatccaccgctaagcgcaacttcaacgcacttagcgcaaaggagaaactggtag

SEQ ID NO: 70286 - DNA, 165 bp, Glycine max
  Peptide Sequence Number=SeqID_187064
atgggggggttgtttgttgaaaaactgccaggaagccacattataaacagaacctcgaagagagttaagcttcgtcatcaaaaggaaacaacaccagaaaatttagccttccataatttcaaccaaaaacagaaaatgcaattgaagctaaaggcagaaatgtaa

SEQ ID NO: 70287 - DNA, 822 bp, Glycine max
  Peptide Sequence Number=SeqID_187065
gattttaaccgtcgcttcccggcgctgggcgatacgctggcggcagaactggctggctcgctgacccagagtgaatatgaaaacaaacgactgattcgcgacgccatcgatcgtcactaccgcgaccgcatcgccaaaagcgaactggaggcccagcgcttcaccctgatgcgcatggccagccaggcagacctgatgattgacctgcactgcgactgggatgccttgccgcatctttacaccacaccgcacgcctggccggagattgagccgctggcgcgctggcttggcagtgaagtgcagctactggcgcagatctccggtggagagccgtttgatgaggcctgctgcgaaccctggctgacgctggctgagcgttttggcaaggactaccccatgccgcgcggcctgctgccggtgacgctggaactgcgcggcgtagccgatgtgtcgccggaacaggcggagaaagatgcagatgcgattatcaatgcgctgattgaagggggatatattaccggcgaaaccggagactcccctgccctgctccatgcaccaacccagctggcaggctgtgagtacatccacgcgccacactccggactgctgctgaaccgcagaaaattaggcgagtggattaaagcgggcgaagtagtggcggaggttgtcgacccgatcaatgactacgtgacaccgctggtggctgagtttggcggcgtgctgtatgcacgaaacctgaccaagtttgtcacggccgggatgctggtggtgaggctggcgggggagaatgcgggacgtaagggggagttgctggttgtttag

SEQ ID NO: 70288 - DNA, 501 bp, Glycine max
  Peptide Sequence Number=SeqID_187066
atgataaattctcaactagcaagaggtttatgtcaacaaaagtcggaaggagttgataggccgcaatggtccacatttagtcatgttaactactcaggttctctttcatccacatttggtagcaaggctactcactgtaaggtcgattctagaagaaacatgctactcactgtgtcatgcaatgcagaagacatgttgcttccacgtggtaattttacattttctgtattgacagaatccggcatccaaatattgttgagcttattgggtactgtgcatagcatggccaaaggcttcttatttatgagtattgcagtaatgggtcgttgcaggatgcactccattcagatgatgaattcaaaacaagattgtcatggaatagtaggtaaagcctatagtgacagactattagttgtcactgtataccctctcaaagttgacgcaaaaaagtctgtaggacaaagtcctttatacatctacctacggattttggacttctag

SEQ ID NO: 70289 - DNA, 321 bp, Glycine max
  Peptide Sequence Number=SeqID_187067
atgacagagctacgaccgtgtaggcatggcagtggaacccgaccatgtgaaaaccgaattgaacccgccctgactttgatagataaaaatcgcgttgaccgtgttcagggtcgggttcgggttttccccgataacccaaaacgggggcaggggcgactctcaatcctcactcctcacattgctaaacctcttgctgggaagaagctttgcaagcgaaccctaaaacttattcgtagaggccttcaaggagaacgtgaggccgctcaagagaggacacaacgtcaacctcttgaaccacgccctcaactcccacaccgataa

SEQ ID NO: 70290 - DNA, 165 bp, Glycine max
  Peptide Sequence Number=SeqID_187068
atgttgaaacctgatttggcttcagatatgagaaagaagcttgatggttttaccatattcatcaatggggaaactgaggatatgaaggaagcaaacatggggaaaagggacctgaattctagaagtagaggagttgttcaacacttcagattcatggcacagtga

SEQ ID NO: 70291 - DNA, 2255 bp, Glycine max
  Peptide Sequence Number=SeqID_187069
tttggcgaatcggttctctcagggtgatatttttcgcgttgctgatattcaagaggaagtagctcgtcttcaacaaggaactcttgacatctcttcgtatttcaccaaattgatgacgccttgggaagaaattgagaatttttgtccaattcgtgattgtacttgtgctataccgtgttcttgtggtgctgctacagatttacgcaaattcaaggagcaagataaggtaatcaagttcttgaaaggtattggtgatcaatattctcatgttcgctcgcagattatgctgatgtctccacttccaaccctagacaatgcgttcaatttgattcttcaacaagaacgccagttcaatcttccttcaaccactgattcttcaattgagaatcaatcgtctgtgaatcacttctctcaaacgccttctcgtccttctaataatttcggtcgtggttgtggtcgtggatattcctctggtggccgtggcaaccggctatgcactcactgtaatcgcaccaatcacactgttgagacttgcttcatcaagcacgggtatcctcctggttttcaacatcgtaagtccaattcctctggaaatgcctctgtggtgaactctgttcaagatgctggttctgctcacatttcctcatcatcatctgcttccacatcaacaaatggatcaagtgcttctttgtccacgattcaagagcaatatactcagattttacagctactccaacaatccaacttgcaatctacttcaccttcttcagttaattctgtttttgctacaaattttgtctctcatacctctccctctccttcatctggtaagaatctctcaaataataccagtcactggtggattgttgacaccggtgccactgatcatattactcatatctttgacagtttttcttccacatatcacattgcacccaaaactatgaccatgcctaatggtgacactgtcactaccacaatagttggttcagttttgttatatgactcccttgttcttcataatgtttactactttccttcgtttcatgtcaatattatctctgttactactctatttgattccaccttatatgatgtgaaactctaccctaatagttgtaaaattgtgcagctacttcatcccaagatgactggatttacagctaggaggattggcaaactgtatgtgcttgacaccacctcacctctggttttctctcccacacctggttctgtcaacacctccatctctcatgatcctgccaccatttggcattttagactaggacatttaagttctcatatacacaaatgtatttcatcttactttccctttgtcactttcaatgacaatcataaaccttgtaatacttgccatttggctaaacaaagaaatttaccttttgctcatagtactactaaatctgttgccatttttgatttaattcatgctgatatatggggacctctttccaccccttccatatctggccataagtattttctaacacttgtagatgattacaacagggaaggcaccaaaggctaccttctttatgatcctatcatccatgagttctatgtttcaaggaatgtaatcttccatgaaattgtctttccttttgcctcacctccacttgccaataatcctgtcagtgtcaaccccgatattactaccttagacacatctgacattctcctagatcttccactatccttacctccaccaaatgaacctacctcccctcctgcaccaaccagaaaatcacatagactaacaaaacctcctgcttatctctttgaataccactgcaatttgctatcctcaatattgtcagcatctaatccagaacccaaaacttataaacaagcttgtaagtttgattgctggaatcttgctatgaaatctgagttagatgctcttgcatccacaaacacttggtctgttgttgatctgcatgaaggtaagcaaccaattggttgcaaatgggtttacaagatcaagcatcatgctgatggatccattgaacgatacaaggcccgtttggtggcaaaaggatacactcaactagagggtgtggattattttgacactttttcaccagttgctaagcttaccacaattcgcacccttctatctgtggctggtattaaggactggcacttagaacaacttgacatcaacaatgctttccttcacggtgatctggatgaggaagtatatatggatctgcctcctgggttcttgccacctg

SEQ ID NO: 70292 - DNA, 138 bp, Glycine max
  Peptide Sequence Number=SeqID_187070
atggttgactttcaaggttttggaaagggctacctacaaaagattctgaccggtggaggaatgcgagctgctgagaagttgaaaatcagggatgttacaaatggtattagagcaagcatttctcctggtatgatgtga

SEQ ID NO: 70293 - DNA, 618 bp, Glycine max
  Peptide Sequence Number=SeqID_187071
acattacaagttcatcactcagcagcaattagagtcctcaaatatctcaaaagtgctcctgccaagggattgttctattcttcctcctccacactcaaactctctggttttgcagactcagattgggcaagttgtcctgctactcgcagatcagtgactggttactgtgtctttcttggcacatctatgcagtcttggaaatccaaaaagcagtccacagtagccaggtcaagttcagaagcagaatatagagctttggctagcttaacttgtgaattacaatggctgcagtatttgttcaaggatcttcacatctctcttgatcaacctatctcagtctactgtgataataagagtgctatctatcttgctcacaaccccatcttccatgagaggacaaaacatattgaaattgactgtcatgtcattcgtgagaaaatacaaactggcctcattcatctcctgccagtttcttctgctgcacaattggcagatgtacttaccaagccattgcctgctccctccttcaattcattgatttccaagcttgacctattagacattcatagtccagcttgtggggggctattacatgatgtaaatagcaactctagttag

SEQ ID NO: 70294 - DNA, 1227 bp, Glycine max
  Peptide Sequence Number=SeqID_187072
atggaggacaatgatatccacaagactgcatttaagacacatagaggccactttgagtacttagtcatgccatttggcctaaccaatgcactagccatattccaaggtctcatgaatagtatttttcaaggctacaagagaaagaattccttgtatgctaagaaatctaaatgttactttggtgtagaaagagttgagtatttaggtcattttatcacaaaagatgggtactatagaaggtttgttgaagggtttggtgggattgcaaggcccttaaccaacatgttgaagaaaaataattttcactggtttgacgaagcaaaagtggcatttcaatcccttaaggatagtctgattcaatcaccagtatttgcattacctgaattctctaaggtgtttagggtggaggtggatgcttcaagttatggcattggtgtagtgctgatgcaaaatcaccatccaattgcttttatcggcctaccaaattacaaaggaaaacaagtgatctatgtggtagtggacatattaagtaagacggcctactttatgtccctaacacacccctacactgctactgaggttgctcaatccttcttggacaatgtgttcaaggaacatgcttatcatccacaaacggatggtcaatccgaggtggtgaatagatgcttagagagattcttgagatgtatgtgttgtgatgttcctcatgagtggtctaaatggcttctgctggtaggatggtggtacaataccaaccatcacacttccatacaatgcaatccttatgaggttatgtttggccagcctcagtttgccttccatatttgccaggaaagaatgaagcaattagcagataacaagagaagtgacaaatcctatgagattggtgattttgtgtatgttaagctccatccatacaagcagattttagtagcattcaaacctaatgcaaagctagcacctaaaaactttggaccatttcagatcgaagataagattgggcttaaaaggcatgttggtgaaccagtttcaaatttccttcctacagattatgatggtgttatgagaggcaaagaacctgaactaattttggatagagcaattatcaagagaggtaacaaggttgtcaccaaggtgttggtcaagtggaaacaccaattaatcgaagatgctacttgggagttcttctatgatttgaagaggacgtatccaacttttaatccttga

SEQ ID NO: 70295 - DNA, 3519 bp, Glycine max
  Peptide Sequence Number=SeqID_187073
atgatgttgcaggttgttgtttctgctcaagaccatattatgtgcattcagactgagagggaagcactcctccaattcaaggctgcacttctggatgactatggcatgctctcttcttggaccacttctgattgctgccaatggcaagggattcgctgctccaacctcaccgcccatgttctaatgctcgaccttcatggagatgataatgaagaacgttatatcagaggagagatccacaagtcgttgatggagttgcaacaattaaactatttaaacctcagttggaatgattttcaaggcagaggaatcccagagtttcttggttctctcaccaacttgagataccttgatctgtcacattcttattttggcggaaaaattccaactcagtttggctctctttctcatttgaaatacttaaatcttgctcggaattattatctggagggttcaatcccacgtcaacttggaaatctctcccagttgcagcatcttgatctcagcatcaatcaatttgaaggaaatataccctctcaaattggaaatctctcccagttgctgcatcttgatctcagctacaattcttttgaaggaagtataccgtcccaacttgggaacctttcaaatttgcagaagctttatcttggaggatcattttatgatgatggtgctctcaaaattgacgatggagatcattgggtgtctaatctcatttctttaacccatctttccttggccttcgtatctaatctcaacacttctcatagcttcctccaaatgattgccaagctaccaaaacttagagaactgagtttaaaacagcttcacgtcatcaatgatactccagtggctgtccaacgtcaccttagttataacctcttggagggttccacatcaaaccattttggccgtgtaatgaattctcttgagcacctcgacctctcagataatatactcaagggtgaggatttcaaatccttcgcgaatatatgcaccttacattctttatacatgccagcaaaccttttgactgaagaccttccatcaatccttcataatttgtctagtggttgtgttagacactcattacaagatttggatttgtcacataatcaaatcaccggctcttttcctgatctttcagtattctcgtctctaaaaacattgattcttgatggaaataaattaagtggaaagatacctgaaggcatcctcttaccatttcatttggaatttctgtcaatcggatcaaactctttagaaggtggaatttccaaatcatttgggaattcatgtgctttgagatcactggatatgtctggtaacaatttgaataaagagctttcggtgataattcatcaattgtctgggtgtgccagattctcgctgcaagaattgaacataagaggaaatcaaatcaatggtacgctttctgacctttcaatattttcttccttgaaaacattggatctttcagaaaatcaattaaacggcaaaattccagagagtaacaaattgccatctctgttggagtctttgtcaattggatcaaactctttagaaggtggaattccaaaatcatttggggatgcatgtgctttgcgctcgttggacatgtccaataatagcttgagtgaagagtttccaatgataatccatcacttgtctggatgtgctagatattcattggaacaattatctctaagcatgaatcaaatcaacggcacactacccgacctctcaatattctcatctttaaaaaaattatatctttatggaaacaagctaaatggagagattcctaaagatattaaatttccacctcaactggagcaactagatctgcaatcaaattccttaaagggtgtgttcactgactatcatttcgctaatatgtctaagttatacttcttggagttatctgacaactctttattggccttggcatttagccaaaattgggtcccaccatttcagttgcgcagcataggattgcgatcttgcaagctaggtccagtatttcccaaatggttggagacacaaaatcaatttcagggtattgacatttcaaatgctggaatagcagatatggttccaaagtggttttgggctaatttagcattccgagaatttatttcaatgaatatttcatacaataatctccatggtataattcctaattttccaacaaagaatattcaatattccctaattcttggaccaaatcaatttgatggccctgttccaccatttctgcgaggttccgtatttcttgatttatccaaaaatcaattctcagattctctttcatttttatgtgctaatggtacagttgaaactttgtacgaattagacctttcaaataatcatttctctggaaaaattccggactgttggagccatttcaagtcattaacttatttggacttaagtcacaataatttttcaggaaggatacccacatccatgggatctcttcttcatcttcaagcattgctattgagaaacaacaacttaacagatgagatacctttctccttgaggagttgcacaaatctagtaatgttagatattgcagaaaacagattatcagggcttatccctgcttggattgggagcgaattacaagagttgcaatttttaattttgggaagaaataatttccatggaagtttaccattgcaaatttgctacctaagtgacattcaactcttggatgtctcactaaacaacatgtctgggcaaattcctaaatgcataaaaaattttacttcaatgactcaaaagacatcttcaagagattatcaaggtcattcatatcttgtctataccattggcatttctggtaattatacatatgatttgaatgcactcttgatgtggaaaggttcagaacaaatgttcaaaaataatgtgttactacttttaaaaagcattgatctctcaagcaatcacttttctggagaaattccactggaaatagaggatttatttggattggtttcattgaatttatcaagaaaccatttgaccggaaagattccttcaaatattggaaagttaacattacttgactttcttgatttgtcaagaaaccatctagttggttcaattcctttgagtcttactcaaattgatcgactgggcatgttagatttgtcacataacaatctatctggagaaattccaactggtacacaattacagagtttcaatgcctcatgttatgaagataatcttgatctttgtggaccgccactagagaaattgtgtattgatgggaagcctgcacaggaaccaattgttaaacttcctgaagatgaaaatttgcttttcacccgtgaattttacatgagtatggcaattggatttgttataagcttttggggcgtttttggctcaatcttaatgaatcgttcttggagacatgcttatttcaagttcataagcaatttctcagatgctatttatgtcatggcagccgtgaaagttttcaagttgcatcacagaggatag

SEQ ID NO: 70296 - DNA, 1272 bp, Glycine max
  Peptide Sequence Number=SeqID_187074
atggcagaagcaactcgtaatcaagcagcattgcaggaacaagaagagtgcttggaacaccgaatcatgtcaaaacttgaagcgcacataatggagatcacatcttcaatatggcaagcgattgactcttccattgatcgacgaatcttggagacgtcacaaaagaattttgattcggagattattgctacgaaccaaggacctcatcgcagagacgaacgccatgcaaattccaattattcttgtggaacgcgtttggtgcgaattgttttcccgcgctttagtggtgatgtagttcaacaatggatctaccaatgtgaaacatatttcgggattgatggcactcttgcaaattttcaggtgaaattggttgtaatacacttcgaagggaaggcactacagtggcatacctcctttgtgaagactcttccagaagatgtaagaaaggcattccagttggctaaactgtatgaatcaacttccaattcatacatctataccaaaaccttccctaaattccagaaaaatcaacctagtacaaaagccattttacccacacctaaccctacccacaagcctatcgattcacaatttaccttaaacccaactcaacgacaacctaataaaaaactcacacctacctttatggctgagagacaatccaaaggactttgttgtttttgtgatgaacaatatagccccaaccatgccttaacacataagaaacttgagattcatgttatggaggtgagtgatattgaggaggagacgatagatcagtttgacaaaatgcaggaagatggtagcacttctttggaccctcaaatatcagttaatgccctgactgatatagctagtttcaaaactatgagagtgacttgttgctataagaagaaacccttacatacactcatcgatagtggcagcacccataattttttggatgagggggtggctaagaaattgggttgtcttataacagatattcctatcttaagtgtggcagtagctaatggagctcggtttgaggacattttccaggaacctaccagactgccacctaagagaaaaggtcatgatcataaaatttccttggttgcaggggctaatccttttaataagaggctctatagatattctaagcagcaaaaagatgtcattgacaagttggtgtcagattctcttaagtttggtataatacagaaaaacaacagtcattttgcaagtcctattgtcctaattggcaagaaagatgactgttggatcaagtga

SEQ ID NO: 70297 - DNA, 684 bp, Glycine max
  Peptide Sequence Number=SeqID_187075
atggaaaatttgattgatccctgtctaaaaggaaccataaacgtgcttaactcttgcataaaagcaaatgtgaaacgtgttgttctcacctcttcttgctcttccataagataccgtgatgatgtgcaacaagtgtgtcctcttaatgaatctcattggactgatctagagtactgtagacgccataatctgtggtatgcatatgcaaagacaatagcagagagagaggcttggaggattgcgaaagaaaatggcatggatctagtggtggttaatccctctttcgtcgttggtcccatgcttgcaccacagccaaccagcacactgctcttgatactaagcattgtcaaaggcatgaaaggagaatatccaaatacagcagtggggtttgtacacataaacgatgtgatagctactcacttgttggctatggaggatcccaagacatctggcaggcttatttgttcaagcacagtagctcactggtcgcaaatcatcgaaatgcttcgtgccaaatacccttcttatccatatgaaaataggtgcagcagccaggaaggtgataataacccgcacaacatggacatcaccaaaatatctcaattggggtttcctccattcagaacccttgaacaaatgtttgatgactgcatcaaaagttttcaagagaaaggcttcctatga

SEQ ID NO: 70298 - DNA, 1176 bp, Glycine max
  Peptide Sequence Number=SeqID_187076
atggaggtggatgcaagttttgcgtcagaaggatccgtaatgaatgagttaaagcagtggaatgatttcttgtcccatggattcagtctgttccaggaaggcaagagtagtgggaatctgaagactaatgaatcttacaaggaaaattctggagaagatattactggtgcaaagaatgaaatgaagtgtgacaaccaagcacctgaaaacaagagtgagacagagaaatccatcccagtaacgaagaaagatggtgaaaatcctacacttgcaaaagtggaagttcctgacaaaaaatttgagaagtgcataagaccagaggttatccctgcaaatgagataggggttacatttgcagatattggtgcattggatgagatcaaagaatcacttcaagaggcaattgctaatgaagctggtgcaagtttcattaatgtctcaatgtcaaccatcacatcaaaatggtttggagaggatgaaaagaatgtccgagctctgttcacactggcagctaaggttgccccaacaattatctttgttgacgaggttgacagcatgcttggacagaggactagagtaggagagcatgaggctatgaggaagattaaaaatgaattcatgacacactgggatgggctattaacaggacctaatgagcaaattttggttcttgcagcaaccaacaggctatttgaccttgatgaagctatcataagacggtttgagagaaggatcttggttggtcttccatctgttgagaacagggaaatgatcttgaagactcttttggctaaagaaaaacatgaaaacttatacttcaaagagctggcaaccatgacagaaggatatattggaagtgatcttaagaacttgtgcatcactgtggcttatcgacctgttagagagataataaagcaggaaagaatgaaggacatggaaaagaagaagagagaagcagaaggccaaagctctgaagatgcttcaaacaataaagataaggaagaacaagaaattgccctgaggcctttaaacatggaagacatgagacaggctaagagtcaggaggctgcaagttttgcatcagaaggatctataatgaatgagttgaagcactggaatgatttgtatggtgaaagaggttcgaggaagaaacaacagctcacttacttcctttag

SEQ ID NO: 70299 - DNA, 711 bp, Glycine max
  Peptide Sequence Number=SeqID_187077
atgggggacaacaaggaatcaaaagctggtcagctacttaaaaaattatggactcaagttaaccaattggaacacaatacgataatggacttgataactcgtcctccgctagtgctgtttgatgcaataaaatcaggaaatgctgaggctgtgaagatccttattgacaagaattgtgaattagtgacaataaaggaccccaaaaatggacggaacctactgcacttggttgtgctatttcgacaaaaaagaatatttataagtatgctatggggattggaagagcatatagtacgagcagtggaagtggacaatgaaggtaacaacattctacacttggctgcgcatcttccagttgaattcgaagaattgtccagtttcagagcaagcattcaaatgcaaagagagctcgaatggttcaagttggtggagtggcgtgttcctggtgaactaagaagaatgagaaacaacatgggcaagagaccaattgatgtattttatgaagaacacaagaagttatccgaagaaataaaagatgcagccaaaggaatagccgaatctggcatgctcgtggcagcacttgttgctaccgtagcatttgcggctgctctgagtaatgttccaggcaaatgcagtcgcattattcacttcttctgcgtctatactttcattcttgtcaaatttcacttcatcaagattcgcacaaagtga

SEQ ID NO: 70300 - DNA, 468 bp, Glycine max
  Peptide Sequence Number=SeqID_187078
atggatgttcctcgtgagttaaggacaatgagaaacaacatgggcaagataccaattgatgtattttatgatgaacacaagaagttatctgaagaaattaaagatgcagccaaaggaatagctgagtctggcatgctcctggcagcacttgttgctaccgtagcatttgccgctgctctcactgtttcagcttttactgcagcctactttctgatatttgatcacagttccaagtgggtttctttggcttcaatgggggctgtgatcctgttgagacataagggtatatatattgtctgtattcgagcaatcagagatatgtacaatggggtcaaggctaatgtaagaacacgaggtgggtcacagaagaacttagtgtctatttcccacgtatgtgtggagaaaagctatggaatccgaatacaggaagtgcatgaggatcaaatgcagggtagtcgcattagttag

SEQ ID NO: 70301 - DNA, 351 bp, Glycine max
  Peptide Sequence Number=SeqID_187079
atgagaaacaacaagggccgcaagaaaccaaaggatgcatttcaagaagaacacaagaagttatctgaagaaattaaagatgcagccaaaggaatagccgattatggcatgcttgtggcagcacttgttgctacggtagcatttccaactgctcttactgttcttgctgacaacaagaacaatgcgtggtttactgtcttcatcttaacaaatgcagtcgcattgttcacttcttctgcatctctactatctttctcgtcaaatttcacttcatcaagactcgcaaaaaacgatcgcaaatttgtcaaatcactgcatccgagcttgacttttgggctgtttccgacttaa

SEQ ID NO: 70302 - DNA, 375 bp, Glycine max
  Peptide Sequence Number=SeqID_187080
atgggttcacatgccaagtgtgaagatgattctcatgtattgaagcagaatgacaaccatcaaagcaatgaaagcatggaaaatgcatcggaacctgcagaagttaagcagagttttccagtaagcaaaccgaccgaagtgtgcattcgaaattttgacttaaatttggacccagatgaggatatggattcattagacacaccaacttctgtcccagctagttcatctgcaaaatcagtgtcagaagagaagcatgaggaataccctggatggcccttgtctgatatggaaaaaatgaccattgatcccattcaactagctaacataaatggaaggattgatgaagatgaagaggattatgatgaagaaatgtag

SEQ ID NO: 70303 - DNA, 402 bp, Glycine max
  Peptide Sequence Number=SeqID_187081
atgactccagaagagctgagttctttaaaagaagatctgacgagatatataaggtgggatgatcatgaggggctcgaattaaaatcgataattgataaatgtgctgatatagtacgcattccgttaaatgataggggagacacagctcttcatgaagcagtaagtgaacggagcgatgaaactgtgaaagagttggttaaacgtatgaggccagaagacatgctaataccaaacttagatgggatgcttccagttcacttggctgttttatatggccgcaaccaaatcgtgaaaattttgtcttctcaggaagtgcttgacaaaatgaagttggaggatattaaacgactgtttttaatgaccattagggtcgacatgtttggtaagtgtaaaactaattaa

SEQ ID NO: 70304 - DNA, 1182 bp, Glycine max
  Peptide Sequence Number=SeqID_187082
atggattttattgtcggtcttccagtgtacaaagggaacactgtaattcttgttgttgttgacagattctcgaagggcattcacttggggatgttgcctaccggccataccgctcacatggtggctagccttttcctgaacatcgtggtcaagcttcacggcttccctcggagtatagtctctgatcgggatccgctattcataagccagttctggagagatctttttagtctcagtggcacgctattacggctaagctcggcctaccatcctcagagtgatggacagactgaagttcttaaccgtgtgattgagcaatacctgcgtgcctttgtgcatgagaagcaaggaacctggggaaaataccttccttgggttgaatggtctcacaattcagcttggtctgccaccacgggatcaactccttatgagatcacttatggacggaagcccctaacctttcccgactaccttgccggcacttcaaagaacgacgctgtggatgagttcttagtggatagggagaccacatttcattccatcagaaagaagcttcttaaagctcaggagactatgaagaggtttgcggatgcaaagcgcagagatgttgtctaccaacccaatgattgggttttggtcaaactacggccacgtcgacagttgactgccagggggtcaaacgcccgtggggagaaactagctaagcgttattacgggccttttaggattgtggaccgcattggtgcagcggcttatcgattgcaattgccggaggggacccgagttcatcctgtatttcattgttctgtgctcaaacctttcataggcactgtggattcgattactagtcccaccctgcccctacagtttgaagaaggacaaccagtggtgactcccctcaccattcttagacgccgccagattccgggaaccttacccatagcttgggaagtcctagttcagtgggacggattatcacctgacgaagcaacgtgggagaactggcatcacttatgtcacgaataccaccttgaggacaaggtggattttcaaggggccgaggatgttacgcatgaattaaagatgccagatacacaggaaacaccagcatccatggtgcagaggaaggaagagaccaagagaaagatagtgaaacccgtttacctggctgattacgtgtag

SEQ ID NO: 70305 - DNA, 1788 bp, Glycine max
  Peptide Sequence Number=SeqID_187083
atggccatggaagtgattgaagagggtagtactcatcacgagcaatcagatgattcaaatgatgatcaagaagaacatgtgaaacaaactgtaaaaccaaaagttgaggtacagaagccaaataatgtcaggggcactagaccagctcctttggaagtacttgatcgtgtgcaattgaatcactcctttgaaactccacgttcaactatcaaaggtgttctcaatttccctggtaatacagaactaaatttcagtagaaaaaatttgaacaaagttgaggaacaacttcaacggtcattcattgaattctaccgcaagcttaggcttctaaaaagctatagcttcctgaatacattggcattttcaaagataatgaagaaatatgataagatcacgtcaagagatgcagctaaagcttatatgaaaatggtggacaactcccaccttggaagttctgatgaggtcacaaagctcatggatagagttgagaaaacattcactaagcacttctacaactcaaatcgtaataaagccatgaatatcttaagaccaaaggcaaagagagaaagacatagagttacattttcaatgggtttcttagcaggatgcacagcggctcttgtgttagccctaattctaatcgttcgtactcgtaaaatattggatgagtcagggagtactaagtacatggataccttgttcccactgaacagtctatatggatacatagttctacacatgctgatgtatgcagcaaatatttacttctggaggcgatacagagtgaaccactcattcatatttggttttaaacaaggcactgagttgggctacaatcaagtccttctcctaggttttggtctagcagtattggcgctcggcggtgtgcttgtaaacctagacatgcagattgatccacaaacaaaagattacaaaacattgactgaacttattccactcatcttgctgcttgttgtgattgctattttactgtgccccataaacatcttttatcgctcaagcagggttttctttctcatatgcttgtttcactgcatatgtactcctctttacaaggtcacactcccggatttcttcatggcagatcaatttactagccaggtggaagccttgagaagttttgagttgtacatatgctactatggctggggggatttcaaacagagagaaaacacttgcaactctagtagtgtattcataacttttaaattcatcgttgccgtcattccctactggtctcgtttccttcagtgtctcaggcgcctgttcgaagagaaagatccaatgcaaggatataacggattgaaatatttcctcacaattgttgctgtttgctttaggacagcctatagtcgtaacaattcaatggcgtggatggtgctggcttggattttctcagtatttgcagcagttgcatctacatattgggaccttgtaattgattggggccttttgcaaaggcgttccaagaatcgctggttgagagacaaacttgcagtccctcataaaagtgtatatttcttagccatggtccttaatgtcttgctgagattcgcttggttgcagactgttttgaatttcaagtttagcttcttgcataaacaagccatgactactattgttgcatgtctagagatcattcgtcgtggcatgtggaacttcttcagattggagaatgagcacttgaacaatgttggcaagtaccgtgcattcaagtcagtgcctctacccttcaattacgacgaagatgaagataaagatgagtga

SEQ ID NO: 70306 - DNA, 586 bp, Glycine max
  Peptide Sequence Number=SeqID_187084
atgaagtttgggaaagaatacacctcccaaatggtgccagaatggcaagaagcatacatggattacaatcttctgaaaacccttttgaaagaaatccaacgcttcaaacttaggaacaagccttctcccaccccaagtggtctaaggagaaagctaacactatacagagccttcagtggcctcacacaacaaagacactaccaacaacttactccctcagaacaagacatagagagccaacccattatggtgcactcagtgaacaaccatgatggttctgagaagtacgaaactacgttccgtatgacttcagaagaaggtggagaatacgagttggtgtatttcaagaggctcgatgatgagttcaacaaagtgggcaagttttatagatcaaaagtggaggaagtgttgaaggaagctgcaatcctcaacaagcaaatggatgctttgatagctttcaggatcaaagttgagaacccaactgggtcctttgatcgatctgttgagatgactcgtcttgcttctgatgttgcttcttcatctgctgtgttggcagcttccacacccagaggagccaaattgaaca

SEQ ID NO: 70307 - DNA, 651 bp, Glycine max
  Peptide Sequence Number=SeqID_187085
atgtatctaaccgcaactgcattcctctatcaatcatataaatatgaggaggatgctctaaatgatataaagaataaattaatcccttatctagagtgtaaagagaacttaaaaacgtattttaaaacgtatttaaagactttagtgatagaatcacggatggctaaacggccattccaatatttatctaatatttacctattcttattatcagtatcggatttaatgtctttcgttgatctgtataattgtgttcctgtaactcaggatgctagcgctagcgcatatcaactgatggcttatttcctcctggataagaattttgcgaaactaacaaatctttttgataccggcagcggtgagatatttgacatctattctcacatgagaattgaattaatttcattcatcaaagactctcttagtgaggagaatcctgagctatgcgcaattttggatagggtcctaactaggagtatagttaagcaaatatatatgccaattatatatggtaaaacagctaatagcacaactaaggatcttatagtgagtctttgccaagatctcttgccaaaagaatctgatcagcctggtaggtcgggtatgctcttacctagatcgaccagtcttgtacagcacagaatattttag

SEQ ID NO: 70308 - DNA, 609 bp, Glycine max
  Peptide Sequence Number=SeqID_187086
atggctacgctggatctgaatctggtgccgagtcattcagtggagaaggagtcctgggatttgaacactgaagagaaacttgaagctgctgattcttcatccatggctgctgaagtatattaccaggctattagtactttgcagtcccgttcttatctgaataatttaaatcatcaccaaaagcatcaaaacaatttagtaaggttggtgtctagggattttatcagcaataatggcttgtcaacaagaagaagtaactgcactggccaaaggaattgtagtgtaattcgatctctagctttgcaaacatcagtcgctgatccagtgttgtcctcttcaagaagcaatgctagtgacacttacaagaaatcaagtggttgcaacattcaggcaactttaatccttattcggcatggtgagtcgttatggaatgagaagaacttattcacagggtgtgttgatgtccttttaagcaagaagggtatagatgaggcaattgaagctgggaaaagaattagcagcattccttctgaagctggagtttatgcctatactaggatattatttgtctggaaggctgcaatggcacttgcagacctctaccaatag

SEQ ID NO: 70309 - DNA, 213 bp, Glycine max
  Peptide Sequence Number=SeqID_187087
atggcgagtttgctgaccatctcccacgtggcaaggaaaacgccagtggtgatggcgagttcataccacctgcaaatcgccaccccttctggcgagtctgagcacaggggagttgcaactgccattggcaacttgagggcaagttgcaactcccaccagcgagttagggaagaagaattagccagtactggtagcgatttaagggctatataa

SEQ ID NO: 70310 - DNA, 1338 bp, Glycine max
  Peptide Sequence Number=SeqID_187088
atgtcttctcaaggttatggcgttcactttttcaaggttattcttgaaagcacccttcgaaaaggacaactgaaagtgccctcaagttttaccagaagacattggcaaggaatttcaaatcctgttattctaagtcttccaaatggcaccaaaaggaaagtttattggctgaaagatggttgtgatgtttggttttccaatggttggagagaatttgcaaaaaaattgcgtttggatgtgtcacattttgtggtgtttcgatacgaaggcaattcttgctttaacgtgattatttttggtaaaagtgctttggaagtagagtacccttcaagccatgattctaatgtagaagtggaagagattaatgatactgatttttctgcgaaatttggtgaagatcatacgagtaaaagtagtaagaagagaaaaatcatccccaaagaagaagatgatgatgatgatgatgaacctaagcattgcaagaaggatagtggatttgattattctaagcaaaagaacggtggtagtagccaaggagatttcaagaggagaatcaaaatgtttcacgagaaagtgaaggaaatgttctacgctgagaatgaacatttcacatgtttaatccaaaagacatacacggaaagagatctcttgatcttacctatggaattttccaaaccatatctgcacaaggaaggaaatgctacgctttttgttgacgatggcagatcttgggatgttgggttaagggtcaatcactatggacaattgacattttccagaggctggagaaaattttcgttagagaataaattgaaagtaggtgatgtttgtggttttgagctacacaatagtgaaaaattttcattcgaagtttctatttatcgtctcgaagagaattctagcactcccatcttcaaaggtcatgaacaaagactttctaatatgccttcttcatcctttagaactcctgtgacccctaatgctagtacatctaagtcgaaggatgatctctgcatctttattaagtcttcaaatttaccgtgccaaacaatatcatttaaatacatcaggagctacgttaacgagagttgcagtgaaatccatggaagactcgtgacccttcgtgttgggtgtagagcgtggcaagtgaaattgctctgttacaatgcaaattcctttgctagattctctagtgggtggcccgaatttgccagggagtgtgacttgaaaccgggggatgtctgtatccttaagatgatagatgtgaaaaaactagtgttcgaagtttcatgtttgaaaggaaaaatttctagagaagagaatgaagtatataagtag

SEQ ID NO: 70311 - DNA, 318 bp, Glycine max
  Peptide Sequence Number=SeqID_187089
atggagttacttaacatcggttttagcaaaaccgatgttaactacttcatgttaacatcgggagccgatgttaaggagttgattttaacatcgggtgctgaaacagtcgtcggtgctcaaaggtcaaagctttctccgcgaggctccactgacgtgcatgtgttgctgggttctcttcatcaagcaagcttgataattgagttcaacattgattcacttgagagatgcagaggggatccaaacttaatcttggagggagaagaactccacgatcctgctttcatggatggggaagaagaatgtgggcgtggttcttga

SEQ ID NO: 70312 - DNA, 315 bp, Glycine max
  Peptide Sequence Number=SeqID_187090
atggaggagtttctgcagaaggtggcctggccaagagtccaaccttctcctttgggagggggtgaggcctttgcagcccaggagcctcagccggaccaagaggatgacattcgagaggcctcaaagcccattccatctgagcctttcattgtggagactagtccagccattccacaggaggatgctgcagcagttaccccacagcttgagtcatctgcaccagtgccagacctgcctctttctcgggattcaccatcaagcactcctgcactggatttgaatgagcatgccatggactctgcacaggatcattga

SEQ ID NO: 70313 - DNA, 312 bp, Glycine max
  Peptide Sequence Number=SeqID_187091
atggttttgaatttcggtaagaacatttggcacccactgtggggctgcggtacaacataccttgtggtgtcttgtcaatcctccacatttatccatgcggctggtgtctcactaaacaaggtccatgtgcttagcgagtatcatccgctaagcgagacatcagcccgcttagcgagtaagaggaatcttgaaggaaatttgccacacaagcacgcgctcaacatgtcatcagctcgcctagtgagtcgtttgtctcttctggcgcttagcgcacctggcttactaagccaaagatcacttattcgtgcttag

SEQ ID NO: 70314 - DNA, 190 bp, Glycine max
  Peptide Sequence Number=SeqID_187092
cacttgcaaagcaaggatcaaaggtaataaggaatttgtgaactccaacctaggacatagcccgtatttggagtgcaagaaagatgggcttatatcaactttagccatggaccacccatcaaacctaaaggtgccaaatctaattgatcatgagggaggtagttggaagacggatattgtcacaaaatga

SEQ ID NO: 70315 - DNA, 447 bp, Glycine max
  Peptide Sequence Number=SeqID_187093
atggtatttgtccagggtgtcacgtcgtaccctgctaaaatccagggctatgtcgccatcgtggaacctttaacatctctcatttgcaaggatcaactctcgtggcactcagaggcacaacaagtatttgacaagttaaaggaattaatgacaaaagctttggtacttgccactccagattttactattcccttcacactggaaacaaatgcttcgggcacgtccatgggcattgtcctcttccaaaattcccacccccttgcctactacaggagggtgttttgccctcgtctccagcgcgcttctacttacatccacaagcttcacgtcatcacctccgccgttcggaaatggcgccaatacctgttaggatacccatttgtaatcttcacatatcacaagagtttaagggacctcatgccgcaagtgattcagactccaaaatag

SEQ ID NO: 70316 - DNA, 258 bp, Glycine max
  Peptide Sequence Number=SeqID_187094
atggaggcaatgaatgagtgcttgtgggaagaattgtctatcccgatcaaccagattattgctcgttcgaggaatgtgcagaacgatgcgacaatcacatgtcggaggagaaccattgatttgccaataataaaatgggaagctccatccactagattgatagcatgcgatcgatgtggatcaagaaaaagtatgaggacctttttgccaattgtggaggaagggaaaacaattgcactgctagaagcaatctattag

SEQ ID NO: 70317 - DNA, 495 bp, Glycine max
  Peptide Sequence Number=SeqID_187095
atgaccacaccttttaaaacaaaggaagtcaatgaggaaataaccacgaaggatattaggagcttaatggaacaggctaattacgccaacaaataccttcaggtgttacaggaatctattagtgaagaaaaggttttaactaaacccaaggaccacgagtcgtcatcatcaaccgttcaaatggaaaaaccttttttcaaccttttatttaaggaaaacacattttcaagaattcataccgtggaggaggagggtgttttggagcagaaggaggcacaagcgtcgaagtcaaagaaggaggaagtggtggccatgagggaaagtgttttggagattaagaggttaagggagagggagggggtactgggtaacagtgaaagagtgaggggggttgttggtcttggaagagctataggaacaatacttgtattctggaaagagacatatgcaagagagttagatagagagagagagttacaccacgaaggagagtga

SEQ ID NO: 70318 - DNA, 591 bp, Glycine max
  Peptide Sequence Number=SeqID_187096
atgtgcccaaaactagagacattaattttcaatagtgcttttctatcagacaaagatgttcacgcaattatttacaattttccgaacttgaaagatttaaatgtatcgtcgaacaattttaagtctctcccagcacatattaaagaatgtactaagttgacaagtcttgatgtgaggtactgttataagcttcggaaaattccagaacttccatcaagtgttcagaaagtagaagcaagcggatgcaattcctttgccacagagacatcaaatatcttatggtctcaggtccgtaaagatatgaagagaatagaaatgccaaaaaggaagattccagaatggttcgactatgttaacggagggtatccggtttttgaagctcgtgggaagtttccaacggttgctttagtgtttgtgttcgggaaagaaaatttgccatcattttccaatataacatggctcatgtccaaatctgcgatcaattgcaaggcatgcagcagtccaagcgagtatccttccaaaactgagatgcacggactagaccaaagggactttgccgcaacaaacgagcctaagtcatcatggacatag

SEQ ID NO: 70319 - DNA, 375 bp, Glycine max
  Peptide Sequence Number=SeqID_187097
atgacttctgcaagtggagatgctactccaccattcttagacgattatatggaactttctcagaataaccttctagatgcagaaggtcccaacgcatcttcctctcgcatggtgctcaccaactatgctgctactgcttccgacaacagagactacattctcagtcaggatttcttttgggtaacatatttcaaattcattatgccacgaattgtttcaaaaagaaattatagctttttagggtttagtttcgtaggaaatacgctttgtcccaaattgctgaagaacctcaacactaccaaaaggaagagatgtcaacttggtaaaattgcggtgacaaacagacacccaaaaacatcaagaatgaaatcatag

SEQ ID NO: 70320 - DNA, 246 bp, Glycine max
  Peptide Sequence Number=SeqID_187098
atggcgtgtcttcttatgaagaaaacgcgtggagtcgccaccaacatttatttaagagaaaatgttagaaaaaccaaaaacgatgaaggtctgcgcattttgaaaataagggttcgtgagttgtttacgcacggggaaggtatacgcacgggaaagggtgttgcccttgctcctacgtatcctcagattgattttaattatgaacaaaagtcgcttaaggtgttggaccttgaaacgatgttttaa

SEQ ID NO: 70321 - DNA, 384 bp, Glycine max
  Peptide Sequence Number=SeqID_187099
atgctccttcaccatctgagtcggagccccacgaattcattgcctagcattgttcatgtgtcctcccacatcgagtctggaaccccacgaattgattgcttagcactgttcgccaattctccattctccaattttattcggagacccatgaattcattgcctagcgctgttcatatgtcctccaccatcgagtctagagcctcgcgaattgattgcctagcgctgttcaccaattctccattctccaatcttattcggagacccatgaattcattgcctagtgctgttcatgtgtcctccaccatcgagtctggagccccgcgaattcattgcctagcgctgttcgccaattctccattctcaatcttattcggagacccatga

SEQ ID NO: 70322 - DNA, 213 bp, Glycine max
  Peptide Sequence Number=SeqID_187100
gtggttttgttcatgctagcgcgactatggaccgctcaacgcgcattagtgaatttcggcttagcgcgtgcttttctcgctcagcggatggactcaagaggtgcgcttagcgggataagccctcgctcagcgaacaagcacagctcatccttcttccagattcttccttgtgctcagccaagagaatattgcgttcagcggatggctcgctaa

SEQ ID NO: 70323 - DNA, 318 bp, Glycine max
  Peptide Sequence Number=SeqID_187101
atgaaagaagagataaatttcatgagacataatgatgtttgggaccttgtagaattatcaaagggttgtaagagagttggttcccatgataacttggagctacatcagatggatgtgaaaattgactttcttaatggagatttagagaaaaatgtttatatggaccaaccagttgggttctcagttgaaggaaagaaacacataatgtgcaaattaaagaaatcaatatacagtcttgagcaatcttctcgccaatggcatttgaggcttaatgatatcattttttcctttgaatttaaggaaaatactgttgattag

SEQ ID NO: 70324 - DNA, 633 bp, Glycine max
  Peptide Sequence Number=SeqID_187102
atgactacattgacccagacgtggatgacgttgctgctcagcaacatcctacccagcgatcataactccgacctccctctgccgaagtctcagctggtgtatgccatcctgacacggatgagcgtccatgtgactcagttgatcgctgacgccatttatttatttgtaggtatgccacctaccagacaccctttagacctagataagtctaatagggccctgggttttccagaattgatcacaggtctctgccagtcgttcgaggttcccgtcacacctagtaaggccccagacgcaccgccaccacctcatcaggctgatccagctgggtcatttgacacggagcggtatttacggcatttggttcgccagcaggcagccaaccacagggcgcatgtgcagacccataactgtctctaccagctcagcctcagtctgcagagccagggtttcgctccttttccgtgccctactcctgatcagttcagggcagaggtcgcatggctcggagattggcctgaggcccaagcaggggaggcgcccgcagaggctcccggtgatggaaaggaggcccgcatggatgaggagatgacggatttgctcgatttcttgggaggcagcggagccacgtga

SEQ ID NO: 70325 - DNA, 486 bp, Glycine max
  Peptide Sequence Number=SeqID_187103
atgtcattgcctagcactgttcatgtgtcctccaccttcgagtctggagccccgcgaatgtcattgcctagcgctgttcgccaattctccattctccacttttatccggagccccatgaatgtcattgcctagcgctgttcatgtgtcctccactttcgagtctggagccccatgaatgtcattgcctagcgctgttcgccaattctccattctccactttttcagagccccatgaatgtaattgcctagcgctgttcatgtgtcctacaccttcgagtctggagccccgcgaagttatgcgtagcgctgttcaccaattctccattctccacttttatccggagccccatgaatgtcattgcctagcgctgttcatgtgtcctccaccttcgagtctggagccccgcgaatgtcattgcctagcgctgttcgccaattctccattctccacttttatccggacccccatgaatgttattgcctag

SEQ ID NO: 70326 - DNA, 180 bp, Glycine max
  Peptide Sequence Number=SeqID_187104
atgcaaaccgccagccccattggcgtgtttgctgtggctatgacacgtggtgaagacaccacaaccactggcgagttccatggtgtcgccagccccattggtgatttcatcgtgcaagggggagtagctagtcaaactggcaagttccaagcacaggctagagggaggtggtacttttaa

SEQ ID NO: 70327 - DNA, 630 bp, Glycine max
  Peptide Sequence Number=SeqID_187105
atgcatcctccaccttcgagtctggagccccgcgaagttatgcgtagcgctgttcgccaatgctccattctccacttttttcggagccccatgaatgttattgcccagcactgttcatgcatcctccaccttcgagtctggagccccgcgaagttatgcgtagcgctgttcgccaattctccattctccacttttattcggagatccatgaattcattgcctagcactgtttatgtgtcctccgttatcaagcgcagagcctctggtgactgggaaatatgtttttttgttattttccggatcggttccttcgccaaacataagaaaaaagaagtagtagagacaagagtcatcatcacggaaaaggcaggacgaacaaaatcagtgtcttatctttgctttcctcttatctccgatgagagattcttcctccaggaggctgttgcttctggaggaagcaaccttgctcgcctgggcgagctgggtggcaagctcctcccctattttgctataaatagggggaggagtgaagggagaaggggttcagccttctgggcacttcttattctctcgaaattgctgaggaaaattgtttccgtgaagaaaatccaagccgaggcgcttccataa

SEQ ID NO: 70328 - DNA, 483 bp, Glycine max
  Peptide Sequence Number=SeqID_187106
atggtggtaattgcatcgttgttgagattgtgtaatcacacaatcttacgcattaaaagccccctttcgtgcaaacttgtgctgtggatcatggttgagtgggatcagtcttccacactcaatcgtatagttggtgatcccctgcgagcaggaagaaacagaaaagcagagcaatcgtccactgctcttgatgcactcattgcgaagcacctgtcttttgcagatgttgtggagccattttatggggtgcaaattgcagtgttttgtgggcttcatggtgactcctccatttgtgccgttgccagatatggcactgcaacctgcgctgtcgctggacagcctctgtcactggacagcctctgtcacctccctcttgctgcttccgacctcccagtacacctccatttgtgttctctgtcatctgcattgtgcaatagggaattaaggtggcacttgctttttcagaacagcggcggcacttag

SEQ ID NO: 70329 - DNA, 1191 bp, Glycine max
  Peptide Sequence Number=SeqID_187107
atggtcatgttgttgagctacaggggaaacgtgaagctaacattcagtgtcaaccaccaccagctacagcgcatggttcaaaccaatggtgtcagcaccctcttccacattcgcctcaccacacctgagcccccttctacccaaatctccacacttaacaaccactcaccagaaatagagtccatccttcaccgttacactttccttctccaaacacccactaccctacctccaaaccacgaaacaaacctcaccattaaccttcttccccacttaaccccggtcaatgtgcaaccttatagcaagtcctttgaagaccatttgcgacatttggattgtgccttgcaggtcccgaaggatggtcgatttttcctcaaattatctaaatgttgcctggcccaacagcaaattgaatatttgggacatgtcgtgtccggggctggagttcaaccagtgctcgaaacgacgattcatcaagggaaatgctgcgatagcagcccctttggttcatctcttaacccgaaacacttcgaatggtcacttgaaacacaggatgccttccaaaccttgaaatccatcgttctggaatgggtgtcgtgctatctcagcaaactcacccaattgcattctttagtaaacagttttatccaaggcttcaacaagcttcaacttatgttcgtgaaccatgcgatcacgattgctgtcaaaaaatggagacagtacttgcttggtcattcctttgttattctcactgaccatagaagccttaaggagctaatgagtcaaattgtgcaaaccccagaacagcataagtatttaaccaaattgatgggctatgatttcaccatccaatatcgctcggatagttcgaatatagtggcggacgcactttctcatactctgaagacacccacaggcatggtgtttttattatcaattccgcacttcacgttcttgaccgagcttaaaaatgaactagctgcccaccaagagtttgtggctcttcaaaaatcgttgcaagacgagcccttgagtcactcggagtacaattacaacaatggcttaattctgaagaagggttgtatttggttacccaatagcttaaaatttatccatcttttgcagcaagaattccactcaacacctacgggcggacatatggggattactaagacattgtcaatattatag

SEQ ID NO: 70330 - DNA, 168 bp, Glycine max
  Peptide Sequence Number=SeqID_187108
atggtgatttggagggaagaagatgcattggaggggaaatggacacttgggaaatttttggtttccggttttgaaattttggttgggtggggtagagatagctgtgcaagatgccagatccttgatgttgcttacctaatgtgtagatttatgtggagtggtgattaa

SEQ ID NO: 70331 - DNA, 2130 bp, Glycine max
  Peptide Sequence Number=SeqID_187109
atgaattttctcttttcacgggaaaaccttcccccacctccgggaatcccaatccccgccaccattgccgccgccaacaccaccccaaacccaattctaatcccaaagctcgaacctttcgacgaattgctcaacacccacacaccccaacaacaacaacaatctcaggaccccagtttttcaaatgggtcccttgacctcgacctcgacctcgacctcaagctcgtctgcgacgaaacccccggtgctttctctggcgacccaagcttgctctcagatttcaaccgtctctctcagcttttcaaaaccgctttcaccaacaacaacgccgttctcgaccccatcgcccaagggctccagcagctccaaaacgacgctgtttccgaccctctagacggcactaccgttgttccaccgcagagcttccaaaattcggaccccgggatgcagcagcagcagcagtacccgaacggggccgtttcggacccggattcgcgggcaattgtgccggtcccggaggaagggcggtcctcttcggtggcggtcaccacgccgcggcagcggcgcttcaaggagctggtccgcctgacggatgtcggcgggccggagcaacggcacttccgggacgtggtccgccggacgaggatggtttacgactccctgcgcgtcctggcgacggtggaggacgagggccgggtggatgcccgccgggggcgcagcgatctgcgcgcctcggcggtgatgaggaactgtggcctgtggctgaaccgtgacaagagaattgttggtgcaattcccggtgtctgcattggtgatgtgttcctttataggatggagttgtgtgttgttggccttcacggtcagcctcaggctgggattgattatctccctgctagcatgagttccaatggtgaaccaattgccactagtgtcattgtttctggtggttatgaggatgatgttgatgagggtgatgttattatttactctggccatggtggccaggacaagcattctaggcaggttttccaccagaagcttgagggggggaaccttgcaatggagaggagtatgcactatgggattgaggtgagggtcattcgcggagtgcggtatgagggtgctgcctctgctactgggaggttgtatgtgtatgatgggttgtatagaattcatgagtgctggtttgatgtggggaagtcgggttttggggtttataagtataagctgtgtaggattgatgggcaggctaagatggggactgtggtgatgaaggaggcgcttatgcttaggaaggatcccttgagtttcaaacccacgtgttgtttgtcgcttgatgtttcaaataggaaggagaatgtggcggttcggcttttcaatgacattgatcctaactatgaccctctgcagtatgagtatcttgtgaagacaaattttccgcagtttgtgttccatcagagcgggagggggacaggttgtgagtgtgcggacgggtgtgttgaggggtgcttttgtgccatgaagaatggaggggattttccttataatcagagtgggattctcttgagagggaagcctttggtttttgagtgtggcccattttgtcgttgtcctcctcattgtcggaaccgtgtcacgcagaaggggttgaaaaataggttggaagtgttcagatctagggaaactggttggggagttaggtccatggaccttattcaagctggtgcttttatatgcgagtacacaggggttgttctgactagggagcaagcacggcttttgactatgaatggtgattccttgatatatccaaatcggtttactgataggtgggcagaatggggggacttgtctatgatagactccaattttgtgcgtccatcatatccgtcaatacctcctttggattttgccatggatgtgtcaagaatgaggaatgttgcttgctatatgagtcatagttcaactcccaatgtgttggttcagtttgttctgtatgatcacaataatttgatgttccctcgccttatgctatttgcgatggagagcatccctccgatgagagagctcagccttgattatggggtagctgatgagtggacaggaaagctctctatatgcaatgaatga

SEQ ID NO: 70332 - DNA, 451 bp, Glycine max
  Peptide Sequence Number=SeqID_187110
atggttatcggttcaaggacgcaaggtgcccctgctttttcagggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaagtggagggcaaagaaggcctccttctgggggggccagagccatca

SEQ ID NO: 70333 - DNA, 231 bp, Glycine max
  Peptide Sequence Number=SeqID_187111
aatggtgtaagtttggacgccaaaaattttcttccggggaagatattacagctgcggaagaaaaaaacttcttccgtggagtctcgtggaagacgtcttccgtggaatctcacagaagacgtcttccgcaagactccacggaagaagtttttttcttccgcagctgttatatcttccccggaagagaatttttatcgaattcctgcagcccgggggatccacttgttctag

SEQ ID NO: 70334 - DNA, 612 bp, Glycine max
  Peptide Sequence Number=SeqID_187112
atggaagatatttggagtagtatgctcatacagcaaaggcttcttagtaaccaattagagatgttgtctaagcatcttgaaatcatgcaaatagtggtcatacacccacaacctatcaattgtgatttttgtggaggaaaatatttcaatgatagttgtcatctttactccatggaaaattcttggtgggagcaagagttacacccttacaatcaatataaagaagaaagactctttattcttgagaatgtgttaatgcatttcatggaaacttcccaagctagatttaaagccaatcaaagctcaattcaaaatctggagattcaacttggtgaggagagaacacaacaacaatggaagaagtgctcacaagtagaaattcaacaagaaagccctctccaagtcaatacctctcctcatcaattgattggcaaggaagaaatgcatggagaatgtgataaatctttaagtgtcattttctccttgatcaccaacacttcccttgcaacgatatggaaggtgtttcagggatacatgattctcatggagtttctagctaagaagcaaaaatgcaaggaagatgtgttctatgtgaccttcatgccaccttaa

SEQ ID NO: 70335 - DNA, 2307 bp, Glycine max
  Peptide Sequence Number=SeqID_187113
atggttgatccctctagttctttgtctaattcatggaagaagagtaaggaggtcataagttcaaacctagaaacagtttgcttgcagggtaaggttgtgtatatttaccctccccaaaccccacttggcgggagccttgcgctcgagtcgtcctttattcagaggagggtgagactggcatcaacttctgattttattctacccagccagtgttatcacccgccgtataatcacaccattgcgccttatgggtgcctcccttcgcaaattgcctatggcgcctatgcgatggaaatatcaaatgattcgggtactaagaaacctaaaaggctgacatctgttgtctggaatcactttgaaaggattagaaaggcagacatctgctatgctgtttgtgtgcattgtaacaagaaacttagtggatcaagtaacagtggaactactcatctgagaaatcacttgatgcggtgtctgaaaagatcaaactttgatgtgtctcaactacttgcagcaaagagaaggaaaaaagataataccatcagcctagcaaacataggttttgatgaaggtcagaggaaagaagaatatataaagccaacaatcatcaagtttgaacctgagcataagaaagatgaaatcattaacttcggaagtagtaaatttgatcaggaaaggagtcaacttgatcttgcacgcatgatcatattacatggatacccactgagcttggttgaacaagtaggattcaaggtctttgtgaagaacctccagcctctctttgagttcacgccaaacagttctgtagagatttcttgtatagatatctacaggagggagaaagaaaaagtgtttgatatgataaacagactacatggtaggattaatctgtcaattgaaacatggtcttcaacagaaaattctttgtatttgtgtctatctgctcattacattgacgaggaatggacattacagaagaaactcctgaactttgtcacacttgattcttctcatactgaagacttacttccagaagtgattatcaaatgtctcaatgaatgggatattgactgcaagctttttgccttgacacttgatgattgttccatcaatgatgacatcactcttagaatcaaggagcgagtttctgacaaaaggccttttttaagtactcggcaattacttgatatacgctctgcagcacatctcataaaatccattgctcaagatgccatggacgcattacatgaggtgatccaaaagattcgagagagcatcaaatatattagaagttcacaagtagtgcaaggaaaatttaatgaaattgctcaacatgctaggattaacactcaaaacctcttatttcttgattttccagttcagtggaagtctacgtatctcatgcttgaaactgcactagaatacaggactgccttttctcttttccaagaacacgatccctcctattcatcaactctaactgatgaagagtgggaatgggctagttctgttactggctacttaaaacttttagttgaaattatgaatatattttcaggcaacaaatttcctacagcgaatatatacttccctgagatttgtgatgtccatattcaattaattgactggtgcagaagttcagataattttcttagttccatggctttgaagatgaaagacaaatttgacaggtactggagcaagtgcagtttacctttagctgtagctgcagtcctggatcctcggtttaaaatgaagttggttgagtactacttctccctaatttatggtagcactgctctggagcatatcaaggaagtttctgatggtatcaaagaactttttaatgtgtattctatctgttcaactatgattgatcaaggctcggccttgcctggcagcagtttacctagtactagttgtagttccagagataggctaaaaggctttgacagattccttcatgagacatcacagggtcagtctatgatatcagacttagacaagtacttagaggaaccaatctttccacgcaattctgattttaacatattgaactggtggaaagtccacatgccaaggtacccaattttgtctatgatggcacgtgacgttcttgggactccaatgtcaactatggcaccagaattggcatttagcactgggggcagagtgctagattcttctcgtagttcactaaacccagacacacgagaggctttgatatgcacccaagattggctccaaaatgaatctggagatctaaatccatcatcaatccattctgctctacctcttctcatcgaatga

SEQ ID NO: 70336 - DNA, 999 bp, Glycine max
  Peptide Sequence Number=SeqID_187114
atgcctcgcaaagagaatgccactagtgaaatccattcgaaaagagggacttggaaaatagtttttcgtattaccaacctttggtttgttagaaaagcagggggcaaatgtgcggttgaaatggtgttgatggaccagactggatctaagattggggctactctaagtgaggattattttgcagaatttagacacttgctgcagcatggtaaaacatatgttcttgaaaacttttcagttgtaagaagcactagagagtggagagtgagtaagagtgattatatgttgtattttggtaaaccaacacgtgttacagaagaagaatgtcttgaaatccctgagaatgtctataatttcacatcttttgaagacgtcattgtgggtgaggcaaaactagacactttagttgatattatcgatgtggtggtgaatatcatagaacaacatactcaatcacctccttatagagtaactgttgttcttagagacaaaaaattggatctttccaagccttatcatactgttgaagtaactcagggagatgcccattctcaatctctgttttctcagggatctcaaggttccccacttggtagatttttacataatgcaaaagtggtgaggctaggagagataaaaccactgacacaagatttatactatttgactgttgggactgttgatgaaatcttggtgaaggatccatggagctacgatagctatttgtattgtacctgttttgttgaggcaaaatgtttgcataaaaatgttcagcagaagtgctgcagagacaaggaaacaattgcaagatattgtcccaaccaggaaggtatgaagaatatgaattcttttccaacatgtgttgatgaattgattggaaaacaacttgctctaaggttaaagtatcgccttcaatatcgtcagtgttctgttgtggatgttagtgagaatgaagacatcatcactgcaatcaaagcaaaactttcaccatcacagaat

SEQ ID NO: 70337 - DNA, 216 bp, Glycine max
  Peptide Sequence Number=SeqID_187115
atggaggagttaattgacaaaacacaactctctcccaaaataatcccaacatcatcatgtcagctcggcggctccacaaaagaatctcacttgttgtactctactgctgtcattctgctcccacaaacaaaggttcgcgatcatcgcagtatgatgcatgcacctgatctcaattctcaaatgcaatatggtaccatccccaaggaaatagcctaa

SEQ ID NO: 70338 - DNA, 219 bp, Glycine max
  Peptide Sequence Number=SeqID_187116
atggaaaattgtcttgtgaagttgaaaaccaaatttcgagaagatccaacggttaacgaaggctgggaagcatttttaccgaggcagcttcatggtgttacattctcagtcacaacaacccaagtagatgtaccctccaatgtgttaagacaaagttctcaggcggttagtcctttgaaactttgtgaaggggaaacaaaagatatctcaagcggttag

SEQ ID NO: 70339 - DNA, 446 bp, Glycine max
  Peptide Sequence Number=SeqID_187117
atgtcgcggaactccacggatttcctaacgataggtgttaagtacctcgaagcggtcaagcgagggtcgcatgctatcaaacaatggtccccggacgaaattaggggtgcagaagatgacgttagtctccgcgggtcaacaggcacataccgcgattcacaaagggtgcagaagacgacgttagtcttcgcgtgtcaatgggcacataccgtgattgacaaaggggtgcagaagacgacgttaatctccgcgtgccaacaggcacatatcgcgattgacaaagggcacataccgcgattgacaaagggcgcagaagacgatgttagtctccgcgtgtcaacgggcacataccgtgattggcaaagggttcctccgcatgtcaccggactcttgggtcacggtaacaaaggtggggtggtcgacaaaagcaaggcttttgctcctac

SEQ ID NO: 70340 - DNA, 300 bp, Glycine max
  Peptide Sequence Number=SeqID_187118
atggaggtatcggaaagactttcatgtgaaaaacattggcattggcaatccgatcaaaagttctacaacaatcctgagtacttacagtcaagagccatacttgcctctacaattgaagttattgataaagtcaatgagtatgtgatgtcattgatacctggagatgagatagaatattacagtgctgatagtatcaacaaatcagatgcacttcaaaatccagcatttgaaacagtaactccagaatttctaaactcacttaacacatctgggatacctaatcacgaaatgaaattgaag

SEQ ID NO: 70341 - DNA, 598 bp, Glycine max
  Peptide Sequence Number=SeqID_187119
atggaaggtggtgactttggtggtgaaggtggaggcgcgagcacaagatactcagtggttataggtggaggaacagtggtaggaggtggtggagttggcctattggagacgcaacaattcttgaaggtgctcctcagacacactagttggagcaatgacggtgaagagggttatctcacgtggagtactagaggtgttgattgttgtgagtgcatcttcaaagaggggttaaggttgggaagtgagttcaaccagcagaggttcaactgcattgacctaggttccaagatgagcatcttccttctacatctccatcagctggcagttgagtttgtcttgtttcctttgaagttcaacaaccattccttgtcctggaacccaagggttctaatcaggagagaaaggatgctctttgagtgtaaaaaactatgcccaagcagttactatagcttttctcatagtagcttttgggtacttgtgcaagttgaagacaaactgagagcgaagagggggaggtttctagaagtttatgagagaaggagatgtttaggtgtagaaaggtttctaagagagagagaatgtggagagtttgcagaag

SEQ ID NO: 70342 - DNA, 438 bp, Glycine max
  Peptide Sequence Number=SeqID_187120
atggagcagctctactttgatgtaatgactatttgtggacagcttggatttcctgatttgttcttgacatttacatgtaatccaaattggcctgaaattgaaagaaatgtcaagatcttgaatttacgatctgatgagcgcccagacatggtgacaaaagtcttcaagcagaagcttgatgatcttatcaatgatctcaaaagcagacaagtgtttggtcaaatacttggatcatctactggtgagctattcttcatgagaatgattctttcgattgcaaaaggaccaaccagttatgatgagatcataaaaattgatggtgtccaatatccaacattcagagctgcatgttttgcattaggatttcttggaaatgatcaagaattcattggtgcaattagagaagcaaaagattggggcactgcccatttcctttaa

SEQ ID NO: 70343 - DNA, 549 bp, Glycine max
  Peptide Sequence Number=SeqID_187121
atgtcagtgactaaaattttcactgagttgaaggttctatgggaggaacttgagagccaaagacccagaccagttccaacgggtacttctctgactctaagttcctgtgcatccatgagaaatgcacacatgtttcaacttcaagatcaagtcatccagttcttaacaggaattagtgaccaatcctctgtgttgagactcgttgatactcgaaagccacaaggccgaggaagaggagcaaatagcaacaattatagtggaaaaaattcgaacaggatttgtatatactgcgggaaaactggacacaccattgaaacatgctatagaaagcatggtttcccaccaaatcatgggaaaggtgttcaagctgtagcaaatgctacacaacaactgcagaaaactgagtcaaaggatgaagttgtggggctgtatcacttggtgattgatgacaatcaagctcaagttctagctgtacataaaaatgtttctgttgccatacctgagccgagattgcattgtcacacttctgctgggacgcttgtatcatga

SEQ ID NO: 70344 - DNA, 546 bp, Glycine max
  Peptide Sequence Number=SeqID_187122
atgtcacttgtgcagtgtttagatggaaagggatttgcagtatgcaattccctgagaagaaatactggtaggtggttattcagttatgttgagctggatctacttttagctcagcctttaactaatttctcaggtaaaaagtgcaagcgatgtggaatctatgaggaagacaaatttctttcagatgatgtgtttgacgtgtgggaattctgtccttctgattttactacccctgatggaagatacgtccacttcaaggaaaaagaattcaatgctagttttctgtgcccagagtgcttatctttttctggtgcttctgtctctgcaccacctgtcgagaatcacaatcccaataaaaaaggaatgaatgtagcagttatcattttactaagtattttgggctcaactatattgattctgggaatgttgggtgcatacaagtattggcaaaagaggaagagggagcaggatcaggctcggtttttgaagctatttgaagaaggagatgacattgaggatgagctcggccttggcactataatatga

SEQ ID NO: 70345 - DNA, 930 bp, Glycine max
  Peptide Sequence Number=SeqID_187123
atgccgccgaagcagcaatcaaaagctgatcttgtgaagaagcagaagatcgttgaagacaaaaccttcggtctcaaaaacaagaacaggagcaaaaatgtccagaaatacgtccagaacctcaagcaatacgtgcaacctaaactcgacccttcaaaactcactgcaaagaaaaagaaggaagagaaggccaaggacaaggagttaaatgatttgttcaaaattgctgttagtcagcctaaggtgccactcgctaatatcgtctcagtatcattgtgggcttgtgttgatcctaagtccatattgtgtgagtttttcaaagtggggcagtgtaccaagggcttcaagtgcaagttctcccatgatttgaatgttcagaggaaaggggaaaaattgacctttatagtgataagtgtgacgagggtattgaattatagttcaagagggacattcatttgcttgcttcttgttttggctttcatggctttctgttgttctaacttttggttggctctctttttgtcagaaacaatggaggattgggatcaagacaccttggagaaggttgtagagtctaagaaaaccgagtataatcagaacaaaccaactgacatggtctgtactttttggacacagtggagaagaagcaatatggttggttctgggtctgccccaatggcacgtgccaaagtgacaactacaactcctatgactcctgaattattcatgcaatggaagaaaaagaaaatggaagagagagaggccaatcttggtgcacaacaggcagagagggctaagaatgttcgcatgaggtatgcaatcttgctgcacaacaggcagagagaggccaatctttgtcttacggttcacagttcacacatgaatgagttttattactcaaaagaaaaagtacatgctgcacattcttga

SEQ ID NO: 70346 - DNA, 834 bp, Glycine max
  Peptide Sequence Number=SeqID_187124
atggtcgataattttcctgcacaaaaaggcaaagttataaaatatcgggtgggggtaaaagtaagaggactttgtggagatttcgtgatccttggctcctccgttgtaactcccttttcttcttcttcaacaccgcatcatcaacatcgtcaccccatcaaaccaccccacaagccttctctcccaaagctcgctcctttttcttccaattggaacatttcctgcgccctccaagccccactcgctctcagccactgcgctgattcaaagctcgttcaggaatttgaagtggtttttgaggactttattgattctggggtggtcgatgctgagcttctggccaaggtggttctgttgggaattcgagggaagaaggttcggagtgtgattcacgccctcaacaaagttcagggtcgaagaatttctttgtctactcatcttaatggctctgatatcattgcaaaggagtgttgccgcttggtcacgtgcagccacgttgaggaggctgttgaactcatggaggttctcgcacgtttccagatatcaatcagggaacttgttcagccgtctgacataattaaacgatgtgttcttagtcggaacccaattttagctgtgagggatttagtttctgctttgaaagcgtatgaggcgtcgaagaaacacttgaatactcccaatatgtacatatatcgggcaacaattgacacttgtggtttatgtcgtgattacatgaaatctaggtacatatatgaggcagcactcaagcacaagaatcctgttggatgggaaatgggaagagatgtcaagcaagttggcacaaaaatggcctaa

SEQ ID NO: 70347 - DNA, 1143 bp, Glycine max
  Peptide Sequence Number=SeqID_187125
atgggttggattccctgttctggatattcaggcactaagaacaaggttgagaagatggaagctcaggatagtctcgttggtcagatcaaagccaccacaggaaagttgaaaaggaattcatccacaaaatccaaagatacatctaaaaatgggaaccctgatcacattgcagctcagacattctcattccgtgagttggcaactgcaactagaaattttagagctgaatgtcttttgggagagggaggctttggtagagtatacaaaggacgtttggaaagtattaatcaagttgttgcgattaagcaacttgaccgaaatggactgcaagggaatagggaattccttgttgaagtgctgatgttaagtctacttcaccatcctaaccttgtcaaccttattggttattgtgctgatggagatcaaaggcttctagtttatgaatatatgccattaggatgcctggaagaccacttgcatgacattcctcctggcaagaaacaacttgactggaacacacgaatgaaaatagctgctggggcagcaaagggattggaatatctacatgacaaagctaatcctcctgttatataccgagacttaaagtgctccaacattttgcttggtgaaggttatcacccaaagttatctgattttggtttggctaaacttggtccagttggggaaaacacccatgtatcaacaagggttatgggcacctatggatattgtgctccagagtatgcaatgactggtcaactgactctgaaatcagatgtttatagctttggtgtagtacttctggaaataattaccggaagaaaggcgatagacaattcaaaatcagcaggagagcagaatcttgttgcatgggctagacccttgtttaaagatcgaagaaagttttcacaaatggctgatccaacactccaaggtcaatatcctccaagagggctataccaggtcattgctgttgcagcaatgtgtgttcaggagcaggctaacatgcgtccagttatagctgatgttgtcacagcattatcttaccttgcttcacaaagatatgaccccaatacacaacacacaggccaaagctctcgtcacgctcctggtacgcctcctagaaacaggagggggcaatga

SEQ ID NO: 70348 - DNA, 633 bp, Glycine max
  Peptide Sequence Number=SeqID_187126
atggcatgctctccttctacaactcttgtgtcaaattctcttctccttaacaaaacgactagagttgagtctccggtgttgggtgaggataccacgagttcactggattcggtgaaagtgtttgatttgaatggaaacgggattccaatttctgacttgtggaaagataggaaagccgttgtggcatttgcacgccactttgggtgcgtgttgtgccgcaaaagggctgattatctttcatccaagaaggatataatggatgcatctggtgtggcacttgtattgattggacctgggagcattgatcagcactttgacatgaccttgttatctcttctagaaatctatgcagaccccactcactcatcatatgaggccttaaattttgtttctggagttttaaccacatttacccccaatgcaggtcttaagataatacagctatatatggaagggtatcgacaagattggaagctttcatttgaaaaggataccgttagcagaggaggctggaaacaaggaggaattatagttgcaggcccgggtaaaaacaacatctcataccttcacagagacaaggaggcaggggatgacccagaaattgaagatatcttgaaagcatgttgctcgtga

SEQ ID NO: 70349 - DNA, 273 bp, Glycine max
  Peptide Sequence Number=SeqID_187127
atggggtggggttttgctacatcgcagctagccgagctggttggcttaagtgtttgcaagccagaatacatgaaatttgtgatggggtggggttttgctacatcgcagctggccgagctggttggcttaagtgtttgcgagccacaaaaattcttgtgtctaagttgtctctattttcttgccccaagtttcatctgttggctatgggccttggccaacgtgtattggttgaagttttcctgtggatactacttagcagccatattttgctga

SEQ ID NO: 70350 - DNA, 1515 bp, Glycine max
  Peptide Sequence Number=SeqID_187128
atgcatatcaaggaagcagaaagggtggtcattgccaaaccagttgcatcaaggccaacttgttctactttcaaatctttctcagagctcctagcaggtgcaatcaatgcttctcccgctattccatcttctcaaacaacagtttctgccattagaccaaagacagtgaggttcaagccagcaatgaatcaacccccttctgggtttgttttttctcaggctgatacttttggagctgcacttgataattcctctgagatgagtcctaaacttgacaccaaacagtccctcatatacaagccaacggcaaaactcgtatcaaagacaactgtgtctcttttggcaaatatggacatgaacgcgtttcaattgcagctcaattacgcccttgccttggtagaaccaaaagaagaagaagatgaagaacaagaagaaggagaggaagagaaaggaaattgcagtactagtcggcaacaaacacagcaaccaatggaggccaattttcaacattccatccatgaaaaatttagaaccaacacgagctcaaatcttgatcagagtattaccccgcaaacagaaataaattatcagagcagtgaacctagtaagatggtgcagcagaacatagaggaggaccaaaaagttttaacatcctcagtcaattgtgatcgaccttcttatgatggttacaactggagaaaatatggtcaaaagcaagtaaaagggagcgagtacccgcgaagttactacaagtgcacacatcctaattgtccagtgaaaaagaaggttgaaagatcatttgatgggaatattgcagaaattgtttataaaggtgaacacaatcattcgaagccacagcttcacaagcgaaactcagcagcagggacacaaggatcaggggttgtgtctgatggaatagttcaagatatgtggagtaatagtcacagtgagaggaatgaaggcaatgaagttagaattgagaacacaggactgtctatgcattcagattattatgtcaaagttccacggcctaatgattctgctctaaatgttggtgcaactaatgctggtggagtaagcacggaaaactcgtgtggtctaagtggggaatgtgaggaaggaagcaagggatttgaggcacaggaagatgaacccagatataaaagaaggaaaaatgagaatcaatccaatgaagcagcactatcagaggaaggattagtagagccacggattgtgatgcaaagttttatggattctgaaatacttggagatggctttcgctggaggaaatatgggcagaaggtggtgaagggcaatccatatcccagaagttactatagatgtactaatatcaaatgtaacgttcgcaaacatgtggagagagccatagatgacccaagatcgtttgtgactacatatgagggaaagcacaatcatgagatgccactcaagaacacaggaactgtagcatctgaaagagattcacaggcttctcttagtaaagataaagcatga

SEQ ID NO: 70351 - DNA, 129 bp, Glycine max
  Peptide Sequence Number=SeqID_187129
atggctactgcaggtgtggaagaaattcgtcctcctacgcttggtgccatcttcgaaccaccacctctctttgatggaacaaccagggtttacaagacaagatcaaattgggtcctattgaccttatga

SEQ ID NO: 70352 - DNA, 699 bp, Glycine max
  Peptide Sequence Number=SeqID_187130
atggcaaaaatcaactggcggcatatcgaaatctttcacgcggtgatgaccagcggcaatctgacccaggccgccacgctgctgcacacctcgcagccaacggtgagccgcgaactggcgcggctggagcagcagctgggcttacagctgtttgagcgagtgcgcggccgcctgcagcccaccgtgcaggggctgcggctgtacgaagaggtacagcgctcgtggtacggtctggatcgcatcatggatgccgccgaagggttacgcaatttccgccagggcgagctgtccatcgcctgcctgccggttttttcccagtcgctgttgccgccgttgctgcagccgtttttacagcgctatccgcaggtgagcctgaatattattccgcaggagtcgccgctgctggaggagtggctgtcggcgcagcgctacgatctcggtctgaccgaaacccagcatgcacccgccgggactgaacgcctggcactgctgacctgtgatgaagtgtgcgtgctgccgccgcagcatccgctgtgtcagcgggcggtgctgacgccgcaggatttccacggtgaaaactatgtcagcctgtcgcgcagcgatagctatccaggtggagcggcggctggtgctggagacgcacagcgccgcgtcggtgtgcgcgatggtgcgcgccggggtgggtatttcgattgttaa

SEQ ID NO: 70353 - DNA, 169 bp, Glycine max
  misc_feature (132)..(132): n is a, c, g, or t
  Peptide Sequence Number=SeqID_187131
atggctggtccagctgaacagcagcgagaacacggcgatcagcgagaagctgaggatcaggctgaacgacactttccagtccgccagtttcccgccaacaatgttacccaccgtcaggccagcgccaatcangaacagcgtccagctgacaccgcgatcgctgatgccg

SEQ ID NO: 70354 - DNA, 378 bp, Glycine max
  Peptide Sequence Number=SeqID_187132
atgttcatgccacgtccacttaacgattcccagacggcgcttaacgccacaaatctgctgccgctggcgcagcgctacagcggcccgttctgggcttacgatgccgaaatcattcagcagcgtattgcacagctcagcgcgtttgacgtggtgcgctttgcgcaaaaggcctgctcaaatattcatattctgcgcctgatgcgtgccgccggcgtcaaggtcgattcggtctcgctcggcgagatcgaacgtgcgctggctgccggttttcagccgggcggcgaggatattgtgttcaccgccgatgtgccggactcaccgacgctggcgcgcatcgccgagccactcattccgttgaataccggatcacaggattag

SEQ ID NO: 70355 - DNA, 462 bp, Glycine max
  Peptide Sequence Number=SeqID_187133
atggcgaccttcgccaccgtgccgggcctgcaaattaacgtggtgcgccacggtaaagacgcgccaaatctggtgtcgacgctcaacatttcggccttcaacgtcggtaacgcactcggtgcgtgggtgggcggcgcagtaatcgataaaggctatggcctgacggcggtgccggtcgcggcggcagcgctggcggcagcgggattagtggtttgtctgctgaccttccgcaaatcgggcggtcagcgcgagacggtggtcgcaaaagtgatcgaccagcgccgatgccggccgatgctgtggccgcaccaggctcaccgtgaacggcacggcaatactgaagcggcgcatcaccacaccgctgtcggcgtaatccagcgcccaccagccgccgctccacctgctgctcatggaacagcgcatccagcaactgacgatagctatcgctgcgcgacaggctga

SEQ ID NO: 70356 - DNA, 660 bp, Glycine max
  Peptide Sequence Number=SeqID_187134
atggaaggacataatggtttgaatactttagagtgcctcagagggagattactagctgagagacatgcttcaagggtagcaaaagaagaagcagaatcattgggcaacaagtttgttgagctggaaaagaagcttaaagaagagataaaactaagagacaaagcagaaagaaagcttaaacttttaaagaagaagcttgaatgtttcaacaatgtgaccaccccatcatggcaaaaataccattcgtctgagaaatgcgaagattcttgtggatcatccttgtctagtgctgtttctagagattcagaagcaaatgaaacgaagctagttcatacagtaaatccagctttgttagaaaatgaagtccacaaccacaatgtagcagaagaatgtgtacttgttcagacccaaaatagtccattcactaccaaagattgtaattcagacccaagtaactttctcccgcaaattctgggcaataatccaaatcagagctcagataatttgaagaatgatggaaacaggctttcactttcaagctcaaaatcattggcagaaggttataattctcagggtaccgatgattgtagctcaaatccaagcccaactgaagctttccctgaaaatatttgccataactcaaatccaattccaagttaa

SEQ ID NO: 70357 - DNA, 1113 bp, Glycine max
  Peptide Sequence Number=SeqID_187135
atggttagattctgctggagaccagctgcggtgggtgatgatggagatgtgaatggtcgagttgaagggctgctatggtacaaggatttggggaaccatctttatggggatttctcaatggctgtgattcaagctaatagttcgttggaggatcgtagccaacttgaatctggaccattgacttcggactatttgggtcctcaaggaaccttcataggtgtatatgatggtcatggtggcaccgcagcctcgcagtttgtcagtgacaatcttttctgcaatttcaagaattttgcaggtgaacatcaaggcatatcggagaatgttatacaaagagccttttcagcaacagaagagggttttctgtctgttgtgaggaaacagtggctaagcaagccacagattgcatccgcaggtacatgttgtttggcggggataatttgcaatggcatgctatacgttgcaaatgcgggagactcgagggcagtgttggggcgagtggagagagcaacaagggaaacaacaaccattcaattgtctgcagagcacaacgttaacatccaaactgagagagatgaagttcggacaaagcacccttatgatccacaaatcgtggttatgaaacacaatgtttggcgtgtgaaaggcatcatacaggtttcaagatccataggtgatgcatatctgaagaaagacgaattcaacagggagcctctaccgaacaagtttagactatcagagcccttctctaagccaattcttagttatgaaccagcaatatcagtgcataaacttcgccctgaagatcaatttatcatctttgcttctgacggtttatgggagcaactcagcaaccaagaggttgtgaatatagtcagcaatagcccacggaatggaattgctaggcggcttgtgaaagctgcgcttcgagtagcggctaggaagagagaaatgagagtctcagaccttcaaaagattgaacaaggagtgaggagacacttccacgatgacatcacagttattgttgtatttctaaatcacaaactcattgataatagctctctcttggcttctcctctttcaattaaaggaggtggctcagccagtttttag

SEQ ID NO: 70358 - DNA, 690 bp, Glycine max
  Peptide Sequence Number=SeqID_187136
gtttatgttgccttggcaaacataagaggtggaatgagcatctacgcagagattattgcacaaagcgtgccagaatggcatgaatcacgggaacggttacgatgtcgcgaaaacgcgacagaccggtttgaagctgtctccgctgagcgacaggctgtgcaaggaaagggacttgaaccctcacgaagtggggtggctaatgggactcgaacccacgacaactggaatcacaatccagggctctaccaactgagctatagccaccattactacttcttactcacgcgggcagcgctctatccagctgagctacgggcgcgtagcgccgttgcgggaggggatactacggatttacgccaatcctgtctagtgctttttcgcagaaatgttgcgtttgattacgctttgctcactcccgcgcacaaaagcgcactccgtagccccttttcgccgtttattggcgcgtttctacccgattttcaaccggatgatggaaatgcgcgtatccgggttgattcccatgccgaccagcacgcaaaccagaaaagcgatggtcagatagttcacatacgggaacatgatcgacttaaagctgtggtttttgatcgcttccttatgggcgcggcggaaatagagttggcttatcagcaccacgaaccacggcaccatgcccggcagcacgctcgcgct

SEQ ID NO: 70359 - DNA, 111 bp, Glycine max
  Peptide Sequence Number=SeqID_187137
atgactgcaactgttagcagcatcatggctacatacctctcttggccaccattaatattcttcaccaaggcctaccagttggaaaagtcttctcaagttgattccacctaa

SEQ ID NO: 70360 - DNA, 327 bp, Glycine max
  Peptide Sequence Number=SeqID_187138
atggaaacttctacctacaacgtagacaaggatacctacgaattgaaggtggacttgtggaacaggggagttgttttacaaggggatgattacaagtgcccctttttctcacagaatcgagagagcatgaggttctactccacgaaaaatagctctattccttgccaaccacaagcaccagcaggtccaagttgtgttaccaaacaatatagctatgcacttgtggcatcgtggcaagatgattatgttcttcgagtaggaaaggagcaaacagtgggacgtggcatggggagcagccatgtggagcttgtggaagtgcaggaatga

SEQ ID NO: 70361 - DNA, 288 bp, Glycine max
  Peptide Sequence Number=SeqID_187139
atgcctcagaagatcgaggtggcgctaatctccaaatcaatgggaatcaaatcgcctgcaatagatcttctttgcatacaagaaaatagaacaacaattatccagttcaaaagaacaatgaatggaaatccaattttccggaaagcgcaccagatcgtcaagtatttaaaattaaaatggatgaattcgagtatcgaactcagggaactagtcttagacagggttaaattcagaaataaggcattgttgaaagaaacattgataattgatgatttagaacagaattaa

SEQ ID NO: 70362 - DNA, 540 bp, Glycine max
  Peptide Sequence Number=SeqID_187140
atggtggtcggagataagacctatcaaacacagcatttcaggggcaacattactcgcgagagaattgagactgatctaggccgggttcgggtcgggagggtcatcctcttcagcgatcaagagaaaaaccctagaggcacaacggtgacctctatggtatttctcgtcgcagtgggagcgggtaaaagtggtgttggggaaggtggaagaagaggggagcctaaggtcgtgacggtggacactggtcatgaaacttctcctcctggagtcgcgccaagcccgcggcttgaaccagggtcaaaggttgcagcgcctgcacctctcaacggatggcacccatggggtcgtcgtattatgacggtgcaaacaggactgataggggtggctgtaggcgaaggtggtggaggaaggcagagtaggatcgagctttttgggagaccccgggctatggctggcttcgaggaccagaacctccagagtgacaagaggaagaagaagaataaggatcttttgattgatatgaaagaagaagatgaatga

SEQ ID NO: 70363 - DNA, 273 bp, Glycine max
  Peptide Sequence Number=SeqID_187141
atggagatgggttatgttttcacatcgcgatgcttccgcctaagactcacgcaagggaaacttctgaagtctctcccacaattcaagttctcttggttcggtttgaggctctgttccaacctcctcactcgttgttgccggccagggacacggaccatcatatccatctcctccctccctcagcaccagtcaatgtgcgtctataccgatattcgcactttcaaaagcatgaaatcgagcttcaagtcgatctcatgcttcagaaaggcttga

SEQ ID NO: 70364 - DNA, 327 bp, Glycine max
  Peptide Sequence Number=SeqID_187142
atggctagcttcgagggccaaaacctccagagtgacaagaggaagaagaagaataagaatttgttatgcttgtcgggtgaaatgagacaagcagaaaccaagcaagattccctgatgttgcattgcccaaactgccctttgcttcaaaccctacttctgctatcctatcattcccccgcccttgcagaatcaccttgtcctcaaggtgataatccttgcataactgggtccagtcttcctaggaggtttcatctaggacaaccccttccattggaccaacacctgccaagaagcatcagatgtgttcgggtccctgcgataatctaa

SEQ ID NO: 70365 - DNA, 407 bp, Glycine max
  Peptide Sequence Number=SeqID_187143
tggagaggtcatactcggagtcgtggcaggagtatagaggaggagtaggggagaggaatggggatgtgaggagtggtggttttaatcccaagttgatgaggagtaatagcagtgtgagttggaggaacgggcagggtatgataggtggtggtggagggtttgggaatgtgagtatgaggaagagtgatgtgcaagggaatgggcttggacttgaacttgggggtaggaaggggagggacgagtttgttgggttggagaggaaccgtcgtgcaaggtattcctcgccgaacagcattgataacaatggtttattgaggctctatttgggcagccggagaaacgggtctggcaaaggaaggtcgaaccaggcacattctattgccagaagcgtacttcgattgtattaa

SEQ ID NO: 70366 - DNA, 975 bp, Glycine max
  Peptide Sequence Number=SeqID_187144
atggcctttcgcacacaccatggccattatgagttcaaggtaatgccattcggtttgtgtaacgcgtcgttgtattttcaggccacaatgaacatgatctttcagccatacctccgacaattcgttttgaagttatctaagtgcttttttgctcagtctcaggtggagtatcttgggcaccttgtttcatccaaaggggttgaacccgttgcttccaaggtcgagaccattcgacagtggccggttcctcactcaacgaaagccttaagaagttttctgggccttgccagattttatcgtcggttcatcagaggatatccaaccattgcaaccctattggttaaggccaccactatggaacctttccagtggatagctcaggcccaagcaggtttcgattatctgaaggaagcgttatccactgctccagtcctgaccctaccagactttacgaagtcgttcatggtggagactgatgcatccggtgtcgacatgggcacggtcttatctcagcagggccatcccatagctttctttagcaagccttttcctcccaagctgttacgagcttcaacatacgtgtgtgagctttgtgtcatcacaacagcggtgaagaaatggcgccaatacctgcttggccaccgtttcatgatcatcaccgaccaccacaacctcaaagaattgttgagccaggtcattgaaacactggagcaacacatgtacttagctcatttgatgggctatgattacctgatacaatattgtttcggcacgaataatcaagttgttgatgctttatccagattgcctgagcagactccagtcatggcaatgatccttttggtaccttccttaaccttcttagaagaattacggtgccaattggataatcactctgggtaccaacaccaacgtcgcaccatcttggattctctgaccacgcacccagagttctcaggcaatacttgcgtgtaa

SEQ ID NO: 70367 - DNA, 174 bp, Glycine max
  Peptide Sequence Number=SeqID_187145
atggcggaaatcaaccaaggtaagacgatgaccggtcacgattggccgcgtattgtttgtctcctacttgcaggctttaggcctatggtgtattctgaagcaatggggcatgccacattgcccccattctcttgcaatttatgtctaaacatgcgcccaccaagtgctcggtga

SEQ ID NO: 70368 - DNA, 261 bp, Glycine max
  Peptide Sequence Number=SeqID_187146
atggagaaaacaaccacaaggagccattgggagggatggagatgtgaaaacaatattacttggccaaaaagcagtctaaagctactatgtcatcatggacctcatgtatcaaaagcaaatacaaatggtaatgatgctgatgttgcacctgaattttctcctttgaaaactgttcaatttggaaatccttctcaagacactgttgaaccaagagatgaaggctttggaggaagactatggagatggaaatgggaaaaatga

SEQ ID NO: 70369 - DNA, 553 bp, Glycine max
  Peptide Sequence Number=SeqID_187147
ccccaagaaatgcgttttcgttcaagtgtcctcccccttcgagtttggagctatgcgtagtgattgcttagtgcaattctccattctcaacctttttcggagccccaagaattgcgttttcattcatgtgtcctacaccttcgagtttggagccatgcgtagtgattgcttagtgcaattctccattctcaacctttttcggagccccatgaattgcgttttcgttcatgtgtcctccaccttcgagtttggagctatgcgtagtgattgcttagtgcaattctccattctcaacctttttcggagccccatgaattgcgttttcgttcatgtgtcctccacccccaagaattgcgttttcgttcatgtgtcctccaccttcgagtttggagctatgcgtagtgattgcttagtgcaattctccattctcaacctttttcggagccccaagaattgcgttttcattcatgtgtcctacagcttcgagtttggagctatgcgtagtgattgcttagtgcaattctccattctcaatattttcggagccccatga

SEQ ID NO: 70370 - DNA, 456 bp, Glycine max
  Peptide Sequence Number=SeqID_187148
atggtgtgggcaaagggatatgaggagttgatagatttatcagcaaagcataaggctgaccttgatggtttcaagttagatgtatttcaaaatggagaagatgctaatgaaattcagagtgcagccagaaggttggatttgaatctcaactttcagaaaataagagatcatgcagatgattctcttcatggaaatggaactgagttatcttttaatcccccatatctttacaaactgaacaaggaaaataatggtgaaaagacaagtgtagataagggaaagctcattgctaagtcagcatcaatgcctaatctgacagaactagtagatggaggcttagcatttcctcactattgtcttattgggaatcaatttcagagattatgtataggagcaatacctgggacacgtgactatgacaaccagcactgtaaagaccttcatctcttgccttga

SEQ ID NO: 70371 - DNA, 126 bp, Glycine max
  Peptide Sequence Number=SeqID_187149
atggccaagcactttcttctgcttctttttgcagtatatgttgccgctattgatgaagtgttgatgttcaaagaccaaagtaactatgaatggcatgttatggatggagttgatcgagtagagtaa

SEQ ID NO: 70372 - DNA, 276 bp, Glycine max
  Peptide Sequence Number=SeqID_187150
atgggtctccagcaagaaactgcatcctcaacaaagcaattgtcattgacaccttttggtgaagcttgtttgagactggaccttactgcaatacatgaaatattggagaaaactggttacaaggatgatgaaggaattgccaatgagctttcctttcaattgtggaccagtcaaatgcaagagaccttgaatttgaagaagcatggagatactgcttttagagctaaggactttgttactgccattgactgctacactcaaagttgcaatgactga

SEQ ID NO: 70373 - DNA, 132 bp, Glycine max
  Peptide Sequence Number=SeqID_187151
atgaagggtcgtgcaggttcttacaaggaacatagattgcatggtgttttcactgatgaccattcaaagaagctagataaagatatagcaggcatttttccttttcctatagaacattgttattgttcatga

SEQ ID NO: 70374 - DNA, 1110 bp, Glycine max
  Peptide Sequence Number=SeqID_187152
atgtcacactcacgcccaccaccatcagaggcaaatgttggaaaaatgattgatttcaagtggggcgataagagaggtgttggtgggaaaaataaagacatccagtactatgagtcctttgtttacgagggtgtgcagtattttctgtatgattgtgtttacttgtacactgccggccatgttgaaacttccattggcaagcttgtcaagatattcgagacacgaaatcgtcaaaagatgatcaaacttgtctggtttttccggcccttcgatattcgtaattggctcggacaatataagccgtgttggaatgagttgttcttggcatctggtgagggcaaaggtgtttccaatttcaattacctggttgaaaatggttctgaagcaatctttttgtcaatggctaaaatggtcattctgcaccatgacttggaatcaattattcgaaaatgcagtgttatttgcacttcaaaggacaagagaaatcctaagccatcagaaatagagttaaagaaagcagactactttttcaattgcactttcgatgttgtaaggggtgtaatcattgatcaatttactaatgagattgatggaattagagtggagcggttctttaacaggaatggggatgaaaaaaccagtaaccatctgcatgttgggacagatataagacccaaaattgtgattaagactaggactaatccttgtactatctcacattgtcaagttaatgataaagctaaagttaggacttatgagaatgttttgccaaagcaatcatcagattcttatacatataaaaagaggaagattgtagaagagaagccaaccattggccaaattagcaaaacccctaaggaacaggaaattgatgagaagaaggcagaactcagacaggatgaaagagtcaaaacaaataaaaaagttattgatgtaattgaaaggccagatgcattctttcatgctgagcattcacactgggctggtttctgtattcattatggaaactggcccaacatgaatgcccaactgactgggggttgtttggaaaaaagaaggtggtttaagaaaatgatgatacacttgcggcaaagaaatttaaaaatttag

SEQ ID NO: 70375 - DNA, 507 bp, Glycine max
  Peptide Sequence Number=SeqID_187153
atgggtaccttggttttactgaataatctagatccatcctacacgtcatttgaagtagaggatcttgtttggtgtgctctcaaagcaagggttgaggcaaggatgatagaatggagcccaggtagagcattagttatttttaagacaaaagatgcagctgaatctgcaatatatcagttgaacaagagatgccttgttcttggagaagggaggattgtcagtgccatcaagggaactctacgtgagcctggcaagaaaaaaagattcactggccatttggtccttgacagagctgcgcatcaaaggcaacaccaagagatgagaaatgcagtatcaacatcacattgctcccaacccaatacaattgagtacgggatggccactgaatggatactgcattatgagaagtccaatgcatgctggaatgcactatatgaggtggagcatgaatttgtttgccatgcagaaacaaatgaaggagatacaagatgtgaggagcaagcttaa

SEQ ID NO: 70376 - DNA, 453 bp, Glycine max
  Peptide Sequence Number=SeqID_187154
atgctctttggcgaagctctgcagcagatgccactttactctaaatttttgaaagatatgttgacaaggaagcacaggtacattcatcaggaaaacatcatagtggaaggaaattgtagtgctataatccaaaagatccttccacctaagcacaaagatcctaggagtgtaaccattcctttttcaataggagaagtcaatgtgggaaaggctctgattgatctgggagccaggattaatttgatgccactctccatgtgcagaagactgggagagttggagattatgcctcaacgagatgactcctcagccctcatgcatgaagttttttcggggttacgaggcctccgcacctatgttggtgaacgctttgattccttggatggtcgtattgatgccattgatgctcactttgaaggaatggatacccgcatcactcagcttgaggaggat

SEQ ID NO: 70377 - DNA, 555 bp, Glycine max
  Peptide Sequence Number=SeqID_187155
cgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacg

SEQ ID NO: 70378 - DNA, 420 bp, Glycine max
  Peptide Sequence Number=SeqID_187156
atgaaggaaggtataggtcacatcttagacctcactaccataggagagaaaatgaaagaaagcctcaagaggctaacgttaacctcctatacttccatgggaaggacaataaagtctactttaaaaccttacggctctcactcttatccaaagaaagaccaaggtctaggcatcttaggggcagcaccttctaagcccaaagatgataaggggaagacaatagaaaagcaaccccctaaggctaaggacacatattacttctcaatgccccaccaaaaaaaccatgattatgaggagccaaagacatttatagtagccaagatgaggctactacttcaccttcctttagtgaaagtgaagaagcaaaaggggaagaatctagtgaagaaatttacccccaagaagaaggacaacctttaa

SEQ ID NO: 70379 - DNA, 300 bp, Glycine max
  Peptide Sequence Number=SeqID_187157
atggccaaaatacaaggcccaaaagaaggaaaaacctattcaaatatttacaaagaagagtggatccaaccttggcccatgggctcaaaaatctaccctgagtatcatgagaaccctagggccttctttagtagctctagcccaatcctcttggatccttctatccaatacccttggggggtattcaattatctacaaggtcccccctcttgtccttttaacaaaggctactctcagttcgacgtgcgagatcttagagcctaccttggccacgtccaccctgacaagggacaactctag

SEQ ID NO: 70380 - DNA, 270 bp, Glycine max
  Peptide Sequence Number=SeqID_187158
atgcctaaatcatctcccaacatgcatgtgaagcaagaagtatcaacaagagtcaagccaaggctattgtgcaagcaatcaatggggcaaaacacactgaataaaatagatgatgatgactcaaattctcaccaaggagaaaaaacaaggatttcaattcacaaaatgccaagaaactcctatttcaaaaacaattacccattacctgtacataacccaaaattcaaagaggaacatgcaaggttgtacacaaacataaaaccaaaataa

SEQ ID NO: 70381 - DNA, 600 bp, Glycine max
  Peptide Sequence Number=SeqID_187159
atggacattatagaagtgccctccttttaccaccgacaatgggcaccagaataccctaagtttgtcaactatagatatgatggaacaatataccaaatcaggctaaggcagcatcggacaaaagtctactttgcggaaggaatgaaagaattcagaaaagatttatcaatttttgaatctgtgatgattaaattcttggcatgcaacaaaaaatccatgtttgatctttatttctttccctcactggaatgccagacttgcagaaggccaaaagttatgtcaagacaacatatttggacagttgaaatcacacaatcaatacttagtgcaccaggaccactaagactccccaactgtgccatgacacatgtaaatgcctgcggtcaacacatgaccattctcagaagatttggacctccattacagtggaatgttgtcgtggttgatggtggagttgggcgcaaatatgttgtacaaccatggtatcaattccttgcagataatgatttctcccacggtgatgaagtctccttctattacaggaccattgataaaatatgggaaattgtcatctgccggagaaagaattgggactattag

SEQ ID NO: 70382 - DNA, 909 bp, Glycine max
  Peptide Sequence Number=SeqID_187160
atgacatactctaagccatcatcatatgtgtgtaaatcaggggatctaatgaacaaaattagcattgtggaagctggtgcattagagccaataattagtttcctcaagtcaccaaatccaaatctgcaggagtatgcaactgcatctttgctcactctatctgcctctccaaccaacaaaccaatcattagtgcttgtggcaccattcctcttcttgtgaatattctaagagatggaagtcctcaagctaaagttgatgctgtgatggcactgtccaatttatcaacaacacaacctgaaaacctcagcatcattcttgaaacaaatgcaatgccttttatagttagtcttctcaaaacctgtagaaaatcctcaaaaatagctgaaaaatgctctgctttgatagaatccttggtgggttatgaaaagggaagaatttccttaacatctgaagaaggtggagttcttgcagttgtggaagttcttgaaaatgggaccccccaaagtagggaacatgctgttggggcattgctgactatgtgccaaagtgatagatgtaaatatagggaaccaattcttagagaaggtgttattccaggacttcttgagcttacagttcaaggaacccccaagtctcagccaaaggcacgtacccttttgcagttactaagagagtctccatattcaagacctaaagctgaacctgacattcttgagaacatagtgtgtgacatcatatcacagattgatggggatgatcaatctggtagagcaaagaagatgctggctgagatggtccaagtcagcatggagcagagtttgagacatttacagcaaagggctcttgtatgtacccctagtgaaatgcctattgcaagttgtgcttctgaagtttcttcaaaatattag

SEQ ID NO: 70383 - DNA, 786 bp, Glycine max
  Peptide Sequence Number=SeqID_187161
atggcagccaaatctgaaggcatccaagaagaagaaatgtcaagtatggaagagggtgtttcttcccccagctcttccagaacatgttccatgtcacataactgttgttctaacgttgtaaccctcgcgcagaaggtgatggcagaagttattggcacatattttgtggtatttgcgggttgtggctctgtggcagtgaataagatctatggctcagtcacatttccaggggtttgtgtcacatggggactgattgtaatggtcatgatttactctcttcgtcgtatctctggagctcacttcaatcctgcagtcaccattactttagccatctttcgccggttctcatataaagaggtgccactctacatttttgctcagttgctggggtcgatccttgctagtggcacattagccctaatgttggatgtaacgcctaaagcttactttggaacggtaccagttggatccaatggccagtctttagttgctgaaatcattatcacttttctcttgatgtttgttatatctgccgtttctacagatgacagagcggtgggtgactttgcaggtgttgcagttgggatgactataatgttgaatgtcttcattgccgggccagtatcaggagcttccatgaaccctgcaagaagtattggtcccgcacttatcaaacatgtttacaaagggttatgggtatacgtagttggtcccgttgttggatccattgctggagcacttgcctattattttcttagatccatagacaagtcatcttcagaataa

SEQ ID NO: 70384 - DNA, 342 bp, Glycine max
  Peptide Sequence Number=SeqID_187162
atggcagtattcacagacccagctttaattactgcctcgcttttctcgctttcgctctctctcttctcactttctctctctcgctcgctttctctctctggcggaggatggcatcgtttgcactttcgcatttggggtaatgggaagcgttgtgagagtgtgaacgatgacgttgtggaggccaaaaatcctggtggcaccgcatatgaaggtcgaaaatcacggcagcgtcacatttggagattgactgagtgtgctaatgttgcaagagtgattttgagttctgacagagaaggttggagcatgaaggcagtgtcggagatcgataaatttcagatctga

SEQ ID NO: 70385 - DNA, 462 bp, Glycine max
  Peptide Sequence Number=SeqID_187163
atggataatgaagagggcgtgcaggaacagatgaaggccgatctatcggccttaaaagatcaaatggcttccatctcggaggtcatgctaaaacttcagaaaactatagaggataaagccacggcaactgcctccaatacagctagggaagcggagccggtgctacagcccgccttaaatctgggccgagacagaaacacggcagtgtttggtcggaggtatagtccgcaagcttacccctatggcttgccttcggacttcactccccgtgccgccctggaagatttgagccaagcccctaccttcgaggggcaactcccaccttatgccgattatcccgtgcaagacgatgaggaaggagatacccatctcggccccctgctccacctcaaagatccatccccccatgaactaccccaaccaaacaagtccgccacatcccatcttcacccgcacccgtaa

SEQ ID NO: 70386 - DNA, 360 bp, Glycine max
  Peptide Sequence Number=SeqID_187164
atgttgtggacaactccctgcaagcctttatacagatcccaagctttagataggacccttacttatccaaagggaatagtagagaatttattggtaaaagtcagaaatttcatctttcctggtgactatgtaatcctaggcatggaggaggataaagaagtccctataactaggcctcacccaattgtgaggaagaaacaccctctaaaggatagtgtcactccaaaagaccttagaaggggaattagggataagaaaaagaaagatggcaccactattcaaacacctagctatagagtggattatcttgttgagggattactgctagaaaaggacatcatcctattcaagggtggttga

SEQ ID NO: 70387 - DNA, 252 bp, Glycine max
  Peptide Sequence Number=SeqID_187165
atgtcttttgaccgagactactttagtctccccttcaccatccagagacggcaagtccgatggcacgtagagacaaatacgtgtccttcgatcgagactattgaagtctcccctatcaaccagaggcaagcgaacccgttgacgcgcaaagacaaatatggtcatctgcacccttcgtcgaagactccatgtctttcgactgagactattacagtctccatcctgtcaaccagaggcaagcaaccccgttga

SEQ ID NO: 70388 - DNA, 862 bp, Glycine max
  Peptide Sequence Number=SeqID_187166
aggactcaaggtcctcgccttcagaggactcaaattcctcgtctttagaggactcaaagttctagcctttagaggactcaaggtccttgcctttagaggactcaaagtcctagccttcagaggactcaaggtcctcgcctttagaggactcaaagtcctagcctttagaggactcaaggtcctcgcctataaaggactcaaagtcctagccttcaaaggactcaagatccttgcctttagaggactcaaagtcctagccttcaaaagactcaaagtcctcacctttagaggactcaaagttttagcctttagaggactcaaagtcctcgcctgtagaggactcaaagtcctctccttaataggactcaaaatcctcacctgcagagggctcaaagtcctcaccttcaaaagacttgaagtcctcgtcttcataggactcaaagtcctcgccttcataggactcaaagtccttgacttcagagggctcaaagtccttgcctttagaggactcgaagtcttcgccttaagagggctcaaagtcctcgccttcagaggattcaaagtccttgccttcaaaggactcaaagtcctcgcctttagaggactcaaagtcctcgccttcggaggactcgaagtcctcaccttcataggactcaaagtcctcgcctttaggggactcaaagtcctcacaattatcaagtccaagactattaaagtcttctttgctatccagagacaagcgagtctgatagcatgcagagacaaagtatggtcatctgccaccctcgtcatccaaagacaatcaagttcgatgacacgcagagaccaatgtggtcatctgcaccctttatcaaagacttaa

SEQ ID NO: 70389 - DNA, 540 bp, Glycine max
  Peptide Sequence Number=SeqID_187167
atgagatatcttttgtttccccttacaaagattcaaaggactaaccgcctgagaattctttgtcttaacacattggagggtacatcctttgtggtacaagtagagggtacatctacttggattgttgtaactgagaacaagagagggtacatctcttgtggatcagttcaagtggagggtacatccacttggtttttcaaagagaacaagggagggttgaaagaaatctcaagaaccgcaggttgcttgcggactggatgtaggcacgggttgttgccgaaccagtataaatttttcatgaggaaaaatacttgtacttgggggcatgtcactcggtttggaactcccttaagactcaggttgatccatggggggagagggggagttgcctgtgcacgacaaggtgacctcgacacttactgcctagttttcctaagtgagagtggcgtgtgtacacgcttagactatttccttggggatggtaccacattgcatttgagagttgaggtcagttgcatgcatcatactgagcatgattga

SEQ ID NO: 70390 - DNA, 351 bp, Glycine max
  Peptide Sequence Number=SeqID_187168
atgggattgattcaagcgccttcgcttaaaaagaggttctatcaagtcaaggtcaagagcctaggagtcaccagtctgaaggagttaagacagttgatgggtaagctccggcgacaagcttttcgcaaagcttacggtaagatctgggacctagccatggcagaggtctccatagaggccattgcctcccttgcccaatattatgaccagccgttgaggtgcttcacctttggggacttccagttatcacccacggtggaagagtttgaagaaatcttgggatgccctctgggaggaaggaaaccatacctcttctcaagattctatccctctttagctaggaatttctaa

SEQ ID NO: 70391 - DNA, 387 bp, Glycine max
  Peptide Sequence Number=SeqID_187169
atgttgccaccaaaagcaaaactccgtatttcttctagagaatctcctaattgttccagagcaactagaaagagattctttaaccagaaagaattcagttcagatgtaggatacctatccagaagttttcgcaactcaatcatactcgagaaacaaagagaagatgtgtacgaacgagatatccagcaacaaggagaaggaaaaggattgaatagaagaactcctgaacatttagcgatctcagatgtgtcgatattaataaagaagattagtaacaattacccggaatctcacttatcagattccatatctcacttatcagattccattgtggaagacacaatggaatctgacgaattcgccataatatatctgacccatgcataa

SEQ ID NO: 70392 - DNA, 318 bp, Glycine max
  Peptide Sequence Number=SeqID_187170
atgggtaagggctggggtcctggcgctgctggtgcagggtatactagtagaagttttcgttcaactacacctgacccctatggttggcagcctactggtcagccaaatgctgcatgtagagctccatcctttgcatgtgagccaagatggactctagagatagtggctgttgtgaaggtggcggtggtgagtctacggccgcctgctgctgctggtcctaccccggctgttgtgcctaccttggcatatgagctttgtgggcgtaaccggcaccccaaagaactggcagagacctgtgatcaaagctgggaatcctag

SEQ ID NO: 70393 - DNA, 255 bp, Glycine max
  Peptide Sequence Number=SeqID_187171
atgaccatgctctctcagacatggagtgttccttctttttctaacatcattcctaccttccacacatctgatgtgactttggatagagccaaattgatttatgggattattatgaagatggacatgaacctagtgatgcaatcctaccccgcaagggcattggatagaaaactccaagtagattgggccagagatgcaagagaaggccctagggttcttatgagccttagggtagatttcgggcccatgggctaa

SEQ ID NO: 70394 - DNA, 411 bp, Glycine max
  Peptide Sequence Number=SeqID_187172
agttttctgcctttgctctgcttttgcttggctgtgatagcttgtgctgtttgaatgttgttttgcttggatgttgtggaagcttgggaggattgatggggacccggggatggtgggtttatgcgcgcattgtggatgtggaaaacttgttgtgcaccatcgcccgaccgccacctagtaccacatgtgatggagtggtacctggagatatgtcgcgggggtcaggagaccttggggacgtcaggcgagctcctggcagtcaacagataaaaggaacaaagaccacaaagcaaggaggcttgtggcttaaaaatgaagacaggaggctaagatggtctctggaagctaagggagcctctggtaatcgattaccagcctgtgtaatcgattacacagagggatgggtcactg

SEQ ID NO: 70395 - DNA, 273 bp, Glycine max
  Peptide Sequence Number=SeqID_187173
atggaggagaaagtaaagctgaaaattagtggaggtttaaggagcacctacttgaagctcttgtgctctgataccacttgttggaagcttgcttatgaagcttctatggaggctggatctttgagcttcaataaggtccttcaatggagaagcttcaccaccaagagagtggcttggataagaagcttaaagaggaagcttcaatggaggaagagaataccagagagagagggggaggagggggggcgaggtgtgggaattgaaggagattag

SEQ ID NO: 70396 - DNA, 231 bp, Glycine max
  Peptide Sequence Number=SeqID_187174
atgatacaatgcaaagggcttttctctaagctcagatatgattttgaaattcccaacggtgagaatgttcggaattgggttgcgaacatgatactcaaatttcacgacgatccaacggtgaacgagttcgagattgttgttttactgaaacaggtttggtgggctgcgggaagaagaaagggttttgagagaagaggaaaaacgaaaatgaggccaaaaggaggcagctga

SEQ ID NO: 70397 - DNA, 249 bp, Glycine max
  Peptide Sequence Number=SeqID_187175
atgattattgaagaatctatccatgttgtttttgatgggactaaccctataaggccaagaaatgagaaagggaacaaaggcaaaggaaatggaaatgaagaagactttcaaattgatgaaaataaaacaaatatagatcttccaagagagtggagaacttcaagatatcatcctcctgataatatcatcggtgacatctcaaaagggaattctctcaagatatgcaaaatgaatttgaaatgtccatga

SEQ ID NO: 70398 - DNA, 1401 bp, Glycine max
  Peptide Sequence Number=SeqID_187176
atgagtacctgcatgcagacgcatttttatttcgtaaaccgccgcggtcttttaaaagcctctctccgtccggtggccgccgccgtggttctcgggctgggcgccattccggcagcggcgtcgcctgccgtctggttcaatccgcgctttttgtctgacgatccggcgtcggtggccgacctcagccgcttttccctcggagaagaggtgccacccgggacctaccgtgttgacatttttctcaacggctcgctgatgagcacccgcgacgtgacctttgtggccggagacgggaagcagacgctgtcaccctgcctcacgaccggcatgctcagaggcatgggcgtcagggaagccagtacgccggaccgcttctctctcaggaatggctgccgtcccctcgctgcacttatccccggcgcaaccacacactatgacgttagccgccagcggcttgaccttaccgtgcctcaggcagccatgcagagcacggcaagggggtatattcctcccggtgagtgggatgagggcattccggcgggcctgctgaactatacctttacgggcaaccgcatgtccggacgctatgcgggagaaaactatttcctgaatcttcagagcggtctgaacgccggtccgtggcgcctgcgtgacaacagcagctggatgcagagcagtcagggtatctatacggccagccggtggcagcacatcaatacctgggttgagcgggacattattccatggcgatcacgcctgattatgggggacgcctccaccccggccgatgtgttcgacagcgtgagccttcgcggtattcagctgctttctgatgaggcgatgctgcccgacagccagcgcggatttgcgcctgtgatacacggtattgcccaggccacatcgaccgtcacggtaaaacagaacggctatcagatttaccagaccacagtcccgcccgggccgtttaacattactgacctttaccccgcaggcaacagtggtgacctgcaggtgacgctgagcgggcccgccggaagccgcagctggacggtgccctggtctaccgttcccgggcttcagcgggaaggcttcaccaaatatgcactgagcgcaggagagtaccggagcggcctggcgcagcaggataatccgtcctttgtgcagggcacggttctgcgggggctgccgtacgggtggaccgcgtacggcggcacccagctttcggcgaactatcacgcctataacctggggctgggtaaaaacatggggcgggcaggcgcactttcagttgacatcacccacgcgacggccgttctgccggacggttcacagcatcaggggcagtcgctacacctgctttacaacaaatccctgactgactgggggacaagtatcagctga

SEQ ID NO: 70399 - DNA, 939 bp, Glycine max
  Peptide Sequence Number=SeqID_187177
atggttgaactgcaacatcaacggctgatggtgcttgccgaacagctgcagctggacagtcttatcggcgcagcgccggcgctgtcgcaacaggcggtggatcaggaatggagctacatggacttcctggagcacctgttacatgaggagaaactggcccggcatcagcgtaaacaggcgatgtacacacggatggcagccttcccggcggtgaagacgttcgaggagtacgacttcaccttcgccaccggcgctcctcagaagcaaatccagtcgctgcgctccctgagcttcatcgaacgtaacgaaaacatcgtgttactgggcccctcgggcgtgggaaaaacacatctggcgatagccatgggctacgaagcagtacgggcgggcatcaaggttcgcttcacaacagcagcggacctgctgttacagctgtcgacttcccagcgtcaggggcgttacaaaacgacactcaatcgcggtgtcatggccccgaagctgcttatcatcgatgaaataggttatctgccgttcagtcaggaggaagccaagctgttcttccaggtcatagccaaacgttacgagaagagcgcgatgatcctgacctccaatctgccgttcgggcagtgggaccagacgttcgcaggtgatgcggccctgacatcggcgatgctggatcggatcttacatcactcacaccccggcaagccgacacaaaacggatttattgagagttttaacggacgctttcgcgatgaatgcctgaatgagcactggttcagcgacgtcagtcatgccaggaaaaccatcagcgaatggcgtcaggattataacgaatgtcgtccgcactccacgctgaattatcagacgccgtctgaatttgcagcgagctggagaaagggtaattctgaaagtgaaggatccgacattactaactga

SEQ ID NO: 70400 - DNA, 238 bp, Glycine max
  Peptide Sequence Number=SeqID_187178
acacttgctagcattgccacacctcttgggcttaagtttattcctcaagtaaaggagttgttggatgagggtttggttcgcaagagcttaaatccttgtgctttgttggtgcccaaaataggggttcccatggaccctaagagaataaaggtcattccggattggcctactccatcaacaccactcattgagttggtgaggaatcatgttccttcatgggaagatgtccatgaaaggg

SEQ ID NO: 70401 - DNA, 195 bp, Glycine max
  Peptide Sequence Number=SeqID_187179
atgacgacgttagtctctgcatgtcaatgggctcgcttgcctctggttgacaaaaggtgcgggaccataaggtacccccgcatgtcatcggactcgtcgtctctagatgacaatggtgcagatgacgatggtcagtatgacaattattatggggcggccgacaaaagcgaggctcttgctcctacgtatccttaa

SEQ ID NO: 70402 - DNA, 1791 bp, Glycine max
  Peptide Sequence Number=SeqID_187180
atgcgcccgcagttccgctacaacctgatttcgattaaagccgtatttaccggcgtgatcatgtcgagcatcgtgtttcgtattttgaacggcgaaggggcgattatcgaagtcggcaagttaagcaatgcgccggatatgttccagcgcctccacggcggcaatatcaaaaaatgggtgttgattggcgggcttatcggcggcctttgcggcctgctgggcctgatgcagccaacggcggtaggcggcggttttagccttatcccgatcgccgctgccggtaacttctcggttgggctgctgctgttcatctttattgctcgcgtcattaccacgctgctgtgcttctcttccggcgcgccgggagggattttcgccccgatgctggcgctggggacgctgctgggtacggcgttcggcatggctgccatcccgctgtttccctcctatcatctggatgccggtaccttcgctatcgccgggatgggggcgttgctggcggcttcggtacgcgcgccgctcaccggaattgtactggtgctggagatgaccgataactatcagctcattttgccaatgattattacctgccttggggcaacactattggcgcagttcctcggaggtaagcctttgtattcgaccattctgcagcgtaccctggcgaaacagaaggccgaagaggcggcgaaagcgcagcagtatcaatgggagcaaaaaatgagtgatgacgtagcgttgccgctggagttcaccgaagccgcagcgaacaaagtaaaacatctgattgcggatgaagataatccgaacctgaaactgcgcgtgtacatcaccggcggcggttgcagtggtttccagtatggctttacttttgacgatcaaatgaatgacggcgacatgaccatcgagaagcagggtgtggcgctggtggttgacccgatgagcctgcagtatctggtgggtggatcggttgactacaccgaagcatctgatgctgggctggctgccgttctggcagccatgatttaccactcaatggtcaccaggcgtgccgtttcacggcgcatcgcatcgcggttcaatacgctttgtgtcacgcgtggctgcgcgctgaaatgccggccgcagtcaacagacggcagcgtctgctcactcgggcgtgagatatcgcagcgggagaaaatcgttagcgagacggcgatagagcccgtggtggttgccgcaccgatcggtgcagccacgatcagccctatggccagcagcagcgctctggtcatggtgaaatcctgcttcgcacaattgctttgccgccagcagcaagcgcggacccggccggctcagccagtcatcgttaagcgcaatcaccggcacgttaagctgcggctgccagaagcgcgcgacgctggcggcgcggctggcatcaccgccagtgacaatcgcctgcgggtgccgcgtcagcacctgctcccggctcacctgaggccagcttacgctgctgtcagcaaagatattgcgaccgccgcacaggcggctgctggccaaactgcagaaacagcggcaccggcgtttgctgctgatagcgctgacgcagcgtctgcagctgctggtgtaacgcctgtgcggccgctgtggcacgctggggctgtgggctccagcgctgcagcgccgccagcgcgtcaatcatctgatcgagtgattgcggatcgatccattccacatggatgcccagacgctgtagctgctccacctggcgcagcggattgccgccgcgccaggccagcaccacatccg

SEQ ID NO: 70403 - DNA, 105 bp, Glycine max
  Peptide Sequence Number=SeqID_187181
atggcctccatcattgtggccatggcctccatgtcggccttcaccttctcttgcacctcctctgctttacccattactctagctctagcacaggaaagaatgtaa

SEQ ID NO: 70404 - DNA, 696 bp, Glycine max
  Peptide Sequence Number=SeqID_187182
atggagcagtggaagggtctatgctttatgacacaattgcagttgcataagggaaggaaaagttcagataagctaccaggagtggataaggaaaaggctccaggatccaatggtttttctattgctttttccagagctgttggtaaaaatatgaattcctctttcatcactcgagtacctaataaggatagatctttcaaggttattagtaagttcctttctatgaggcttagtgatgtttcattaaatatttgtccactcactgtttatgcaagtagccaagcaggctttcttatcactgaatatgtaagaagggaagtactgcaaagccatgtaacagtcaacattcaaaaagggcacttcaagggaatgctttttcaccaagtaattaagcactatgtgattcaggggcctggagctactgaagattggaacctgttaggaaaaaaatatgcaagtatgagacatgaagcattcatgcttggaacatcaaagggaaaatactttaacaaagtatttgatcttttcatcacaactgcaccaataccagatctaaatgaaaagcttattgtgtttggccgagtcatcaagggacaggatattgttcaggaaattgaagaagtggatacagatgagcattaccaaccaaaagtttccattgggatacttgatgtggctcttaaacagctggagtga

SEQ ID NO: 70405 - DNA, 324 bp, Glycine max
  Peptide Sequence Number=SeqID_187183
atgactgtcatagtcaatttatcatgccctaaagcttcaacatcaaaagtttgcgactatggtcgtggtggagtttcccacgaccatagtgcacctcagacaaatatggtacacttgcccttgtgtgagcattatttttatgcatcaacgacgattcaaaaagagaacaagaagaaggacgacaaggctttgttcatgctacaccaatgtgttgatttggctaatttcaacaatattgttggtgctattactgcaaaacaaacatgggaaattcttgagaagtctcacagtggtggagaaaaggtcaagaaggttaggctttag

SEQ ID NO: 70406 - DNA, 273 bp, Glycine max
  Peptide Sequence Number=SeqID_187184
atgagagcaacaaaagtgctagtgatggtgcattttgatagtgaggaacttaaaatcttccaaagatttaaagtgatggttgagaaacaaagtgaaaaatccttgaaggtgttaagaactgacagaggaggagagtataccttaaatgagtttgaggaattttgtgtgaaaatggcattcaacatgagattactcccttctatactcctcaacataatgggttggcaaagaaaaggaatcaaactatgcttgatatggcaagaagcatgttga

SEQ ID NO: 70407 - DNA, 1314 bp, Glycine max
  Peptide Sequence Number=SeqID_187185
ccatattggcagatgaaatgggtcttggcaaaacagttcaggccatcacatatttaactttgttgaaacacttgcacaatgattctggtccacatcttatagtatgtcctgcttctgttctggaaaactgggaacgggaattaaaaaggtggtgtccatccttctctgttcttcaataccatggggctggacgggcagcatactgcaaggagttgaactccctgtccaaggcaggattgcctcctccatttaatgttcttcttaaagatgatcgcaaaatcctgaagcggtggaggtggagctgtgtgctgatggatgaggcacatgctttgaaggacaaaaatagctttaggtggaaaaatctaatgtctgttgcaagaaatgcgaaccaacgcttgatgctgacagggacaccacttcagaatgatctacatgagttatggtcattgttggagtttatgctgcctgatatttttgctactgaagatgttgacctaaaaaagttactaaatgcagaagatggagatttaattggtcgtatgaagtccatcttagggccatttattttgcggcgactgaaatctgatgtgatgcaacaacttgttccaaaaatacagcaggttgaatatgttataatggaaaagcagcaggaaactgcttacaaggaagccattgaagagtatcgtgctgtttcacaagctcggatggaaaaatgttccaatcttaattcaaagagtgttcttgaagttcttcctcgacgacagataaacaactattttgttcagttccgcaagatagcaaaccatcccttgttaataaggcgaatctacaatgatgaggatgtcattcgctttgctagaaagctacatccgataggtgcttttggttttgaatgtactttggacagagttatagaggagcttaaaaattacaatgacttctgtattcaccggcttttacttcattatggtgtcaatgatagaaaggggatccttccagataagcatgttatgctttctgcaaaatgtcgggccttagcagaacttcttccttcactaaaggagggtggtcatcgagccttgatctttagtcaatggacttcaatgcttgacatattggagtggactttggatgtcattggattgacctataaacggcttgatggaagcactttaacaaacaaggaaaaagttaagtcatctgagaatgatatgacaaaaactgtgagtgtagccaatgttgtcaaaattgagatcctattgaggattgagataggaggaaagaaacataaatcgtgtgacataactgggaatg

SEQ ID NO: 70408 - DNA, 438 bp, Glycine max
  Peptide Sequence Number=SeqID_187186
atggaaattgttctctttatgaatgatttcaagaaaggaatgaggttgatagtactgttcctatatgtggcggagaggcaaacaatagttgatacgttcaataatgatacttcaatatttgcatgcttactttccacgagagctggtggacagggcttaaacttaacaggagccgatacagttgtaattcatgacatggattttaacccacagattgatagacaagccgaagatcggtgccatcgaattggtcagacaaagcctgtaaccatatatcggctggtgacaaagggaacagttgatgaaaatgtgtacgagattgcaaaaagaaagctagtattagatgctgccgttctcgagtccatggaggagattaatgaaggtgacatgcccgagaagaccatgggagaaatattgtctgcaattttattgagttaa

SEQ ID NO: 70409 - DNA, 279 bp, Glycine max
  Peptide Sequence Number=SeqID_187187
atgaagcaactcgtggcacagcaggaggctctcgcggaagaagaagaagcagctcacggcacagcagggaggctcacgggcagaagaagaagcacgtcgcgggagaaggaaaaaagcgtgtgcctgtcaattttttctttatcgatctactgtaacattagaaaagtccatattatttactttgtccctggtcgttcgttgtgcaataggatgatggtggctcttgtaaaattgtcactttgtggctactggacttggatagctaggaagaaggcgtga

SEQ ID NO: 70410 - DNA, 387 bp, Glycine max
  Peptide Sequence Number=SeqID_187188
atggaagcatgcaaggaagccatatggctattctactcgtttggaggctcatcagtcatcatcaacaacccgcaacagaatggcaagcaccagcagaaggagcgctcaaatgcaacactgttccaggaagaaaactgttttggagtgagaatgattgttggtcatcattgtggtaactttataaaggctcaaactcttgttcatcaaggtgttccagaaccacataaggctgaatcctggggtcttttgcaagctgtaatctggatcaactcgcttggaatgaataatgtcacttttgaactagattgcaaatctgttgttgacagcaccagttcttcatatcatggcacttctgaatttagctatattaattctatcaatgtgtaa

SEQ ID NO: 70411 - DNA, 183 bp, Glycine max
  Peptide Sequence Number=SeqID_187189
atgacccttcgctcagtgaacatgcacagctcatccttcttccagattcttcctcgcgctcagccgaggagtattgtgctcagtggatggctcgctaagccgacaggttggcttagcgagacgattgaagagatctctctatgggttgaagcaatctccaaggaagtagtacaagagatttga

SEQ ID NO: 70412 - DNA, 222 bp, Glycine max
  Peptide Sequence Number=SeqID_187190
atggtgagtgagagaccttgggtgatatttgaccactacctcattgtgtccatggacttcgaagttcataccgttagaagcaacaatgaacaaaaccttggtatcggttcatttcctaggccttggaaagagtgtggctgctatggccatgtagcaaggaattataccaaagctgaaatgaagacgcagaggatggccatgggagtgatgttctgccattag

SEQ ID NO: 70413 - DNA, 2142 bp, Glycine max
  Peptide Sequence Number=SeqID_187191
atgcaagggcagagaggtacaattggttccttgccagaaaccatagaatttgattgtggatctacatcaagtgctgctacagttgaaccacatatattctggaataatatgcggaatcctgcagaaaatcaatttgtactttcccccagtgatataaacccatctcacatgaattctataaacaatgaatggcagaacttgagtggatggagcataggcgagccaagttccagtaatacacagaatggggttgccaacaatgagcagaaaagagagctaggattattgtcttcattaagttccggtgctatagctggtccaagacttgaagaaaggcgctttgaatcaaacaatgccttttcattggacaacgtcaatacaagtcctatgcatatacgcagctccagttctcacttggtgccacagaacctcaacttaaacgcaagtttagccgatagtggtactgataacagctatcatgtggaacgacctcctagcttgatcaagtctagtggaccgttaaatgagcatgttgcaccaacagttggttctggtccttttctgcttccttctggaactgctaatggctttttaggtgaggaaactgatggtaggccaggttgttctctagacacccgccgtgtatcttgtaaaagaaaggctgttgaacgaaatgttggacaatcttcagatggtggaagttctagctatagtcagcatacagatggtagtacttggaacactcttcctactcaggcttatggggggatcagttttaacagatctgccccaacggatcaggtaaatgcgagacttggcctgagtacaggggatggatcctctgaaagcattcctgtgtcaaatgtagcaagaagctcaggaagtttccacagaaattttcgtccgaggacaagtccttcaagtcaacaaatttctgttcctcccactgcaatctcaagtgggaatgttattaggagttctggtgtttcatcaccctctcctatattgcaacgatttcatcctgttgataattcttttgacttgagggcagtgccacctgttgatactatggttcctcaaagtcagccccttgttattcatgttcctgctttaccaaggaatgcacagtcattcaggtggagtggtggttccagttcaacaaacaaccattcctcaaactcagttatgtgtgcagatagaaataatctaccaaatgaggaagcaagctcaagaagtatgcctagaaacattatagaatacccaatgtttgtgcctgcaaccaacttaagaaacgttgttcggaatccagctagaacttcaaataatgcaaatttaagtattccaggaaatgttggttcttcatcgcggacaggctcaaatccagctgtcaatccaccacctgcttcggcgtgggtttctcgccctaatcctcagcagtatccgcgcagattatctgaatatgttcgtcggtccttgttttctcctggtttggaagctgctggaagttcaagcaatagttatactcccttccgtggtcctcctacttcatctgaatcaaggggactgtcatctggggtaaacccgttcgagaggcaaggtgatagtgaatttggaattccatattcgttacaatctttggttgttgctggtgaaggaagtagtagacttgtatctgagatgatcaggagttattttaaggaaaactccaggctggatgagctgcgcaatgtgttgggcctcatgcgtaggggtgggaacctgcgatttgaggatgttatgatccttgacccttcagtgttctctggaattgctgatattcatgatcgacacagggatatgcgacttgatgtggataacatgtcctatgaggagctattggctctggaagaacgcattggaaatgtgagcactggattaagtgaggagattgtatcgaaacttttgaaaaagaagaagtattcagctgaaccagattctcagcatgaggcagaaccatgctgtgtttgtcaggaggagtataaagatggggatgatttaggatcactggattgtgggcatgattaccatagagattgtattaaacagtggctaatgcataagaatttgtgtcccatttgtaagacaacgggcttggcaacctga

SEQ ID NO: 70414 - DNA, 972 bp, Glycine max
  Peptide Sequence Number=SeqID_187192
atggctggtgacgtaggaagagccttgcctcctcctgattcagaagaattctcaaccttgttcagccaactcctccacaattctcccccactaggaatggaccccaatcattcacctcctgatttcaccccacacaacaacaccatcgacatcaacatcaacaacaacatcatcaacaacaacaacaacaacaaccctgttccttcctctccctcaaatttcaatttctctgacccccatcattacatccctgcctctgatgccaccacctttaaacaacacacccctgatttcacttctttttctgttgagataaatatggcggatgtcaacgcaattgcggttgtggagactcagaaaaaccttgatgttatggagaaaatcgtagtaaagagtgtggaggcatcgaaacctgtcccaccaccacgttcttcttcgtcaaagaggagtagagctgcagagttccataatttgtctgaaaagagaaggaggagtaggattaacgagaaaatgaaagccttgcagaatttaattccaaattctaacaagacagacaaagcttcaatgctagatgaggccatagaatatttaaagcagcttcagcttcaagtgcaaatgttaatgatgagaaatggtttgagcttgcatccaatgtctttgccaggaggactaagacctatgataatgtctcagactggattgaaccttgatgggagtaatggatttcataattctaccagtgcaattgcctcatcttcaaatgatgaaagcttagtgcggcatgcttttagttttccaaagcaatgcagcatctcaaatcagtctattggtgtaccctcagtgacaaacatagcaacttcggatacctcatccacttttcatccctctattaaggatgcactctacggcaacatgccacaactgtttatggatacaacaacgatgggaaaaccctctccagatgtgtcttaa

SEQ ID NO: 70415 - DNA, 330 bp, Glycine max
  Peptide Sequence Number=SeqID_187193
atgtcaatccttaccctcggaagcaaaaaagaaaaaaaggggggggggaagaaggaaattcccaatcaaaagtgggagaaagcaaaaggaaaagaaggaaattcccaatcaaaagtgggagaaagcaaaaagaaaagaaaggaaattcccaatcaaaagtgggagaaagcaaaaagaaaagaaaggaaattcccaatcaaagaatgggagaaagcagaaagaaaaggaaagaaagctcctgatcaaggatcgaaagaaaacagaagaaatatgcagaaaggtctttggaccagacaatatctgaacgtatacagaattgtcaccaaatga

SEQ ID NO: 70416 - DNA, 921 bp, Glycine max
  misc_feature (27)..(27): n is a, c, g, or t
  Peptide Sequence Number=SeqID_187194
atgaccctagctaggtttgttggtggntacccttttggtcattttgagtcaaagttgtatcttttgtgtcttcatgttgttgggtttgctccgggtcctgttcctcctgctgatggcagtgatggtggagttgatttgcaattgcaatggaattatggtttggagccagagaggaagagactaaaagaacaggattttttggagaacaattctcagatatcttctgttgatttccttcaaccacgatcagtgtcgactgggttgggcttgtcactagacaatactcgcctgacatccactggagactcagctttgttgtcactcatcggtgatgacatcgagcgtgagttgcagcagcaggacgcagagatagatagatttctcaaagtgcagggtggacgtttgcggcaagcagtcttggagaaggttcaggcaacacagcttcagagtgtctcactaattgaagacaaaatccttcagaaacttcgcgagaaagaagctatggtagaaagcatcaacaagaggaacattgaactcgaagatcaaatggagcagttgactgtggaagctggttcgtggcaacagcgagcaagatataatgaaaatatgattgctgctctcaagttcaaccttcagcaagcgtatgtccaaagcagagatagtaaagaaggatgtggtgacagtgaggtcgacgatacagcttcttgctgcaatggccgttccctcgattttcatctgctttcaagggagaacaccgacatgaaagagatgatgacatgcaaggcttgcagagtcaatgaagtgaccatggttttgttaccttgtaagcatctttgcctctgtaaagattgtgaaagtaagcttagtttctgtcctctatgtcaatcctccaaatttatcggcatggaggtctacatgtaa

SEQ ID NO: 70417 - DNA, 615 bp, Glycine max
  Peptide Sequence Number=SeqID_187195
ccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccgggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 70418 - DNA, 147 bp, Glycine max
  Peptide Sequence Number=SeqID_187196
atggatgctggctacacaaatgcatggtttgatgtcgtcgtgtacgagaatcaagtgagccattcttggatgctagggaatttggaatctctaaagaagttggggatagacattttatcaatcttggccaatagacattgttactga

SEQ ID NO: 70419 - DNA, 276 bp, Glycine max
  Peptide Sequence Number=SeqID_187197
atgacgagtgtagcagcgatgaaagcacaaagaaagatccccaacaaagatgggacaaattgcaatggaatgcttcaccattcgactgattcctcgcagtggaagaagattaaacatttgtatccagattttgagaaaaagacaagaaatcttagacttggacttgccactgaccgaatgaatccctttgaccgtttaagcaatcatcataattcatgcccaagacagtcaggaaatgacattggtgtttatctcagtccattgattaaagactag

SEQ ID NO: 70420 - DNA, 159 bp, Glycine max
  Peptide Sequence Number=SeqID_187198
atggagaggaagaggtgcgagagcgaagaagatgagatggagaggaagagggttgaaaagtttcgtttcacaaaacacccgtcaagagaggccccactcgcactaaataatatggatgcaaaactgcagcaagtcatgatcgtgcaattgacggtataa

SEQ ID NO: 70421 - DNA, 425 bp, Glycine max
  Peptide Sequence Number=SeqID_187199
tgctgacccgcagtgattccggggtgaaaaacgtagaaaccctggcgcataaacggctcggagtgattcagggcacgctgcaggagaactatgcgctgcagcacttcaaacagaccgatctggtgcgtttccccgataacaacacatcggtgtccgcgctgaataacggcacgctggatgctatgttcctcgactacgaagccgccaaagattatgccacccgctttaagctggtcacggcggcgaacatcccttcatttgacgcgcctgcgggtgtcgccatcgccaaaggcaagcccgagttcaaagcatcgctggataaagccatcaaagcggcgatgcaggatgggacctggaaacagctgtaccagaagtggttcccgggttcgccaatgccgcaacagtatctgcccggcggccaataa

SEQ ID NO: 70422 - DNA, 210 bp, Glycine max
  Peptide Sequence Number=SeqID_187200
atggagttccagtctggagacatgccaaattacactacatcagatggatcagttaagattcaaaaagatagtgaagtgagactaaagataattgggactcgagtggatgctacagaaattctcatgatcactgtcttagcagtagtttttgtgaatatcatgaaaattggtttacatttctggaatgctagtttatgctccgattgctag

SEQ ID NO: 70423 - DNA, 162 bp, Glycine max
  Peptide Sequence Number=SeqID_187201
atggttcggactctaaaatcggtggcaaaccaaagactactggatccggtcttgcctatgtcaatagaaatacttgaaatgccaacaactgcatgcaaggggaaaaagattcaaacaaaggtgatcatgtggaagtgggaactatgtatgaagaacttttag

SEQ ID NO: 70424 - DNA, 462 bp, Glycine max
  Peptide Sequence Number=SeqID_187202
atggaaaagtgtgaaagtgtagttgtagtttcagcaatattcaatgaccacgacaagatccggcaacctaggggccttgggtcccaaacactacaaaatgtttgtttcttcatgttcatagatgatattacactcaaaggacttgaataccttgggttaatttcaacaaaatccagagaatacaagataggagtgtggaggattgtgaaggtttcaaaagaggatttgtatcagaacccagcaatgaatggggttataccaaaatatttattccataggctattcccatattccccaattcagtatttggatagatgcaaagttgcaactaatgaatgcagacatggctatatcaaagcacccatattttgttcataccatggaagaagccatcgcaacagcacggtggaagaaatggtgggatgtgaatgccttgaagatgcaaatggagacctactgtga

SEQ ID NO: 70425 - DNA, 702 bp, Glycine max
  Peptide Sequence Number=SeqID_187203
atggaatctgctatttgcctacgctattgccccattccctatggtcccaaaggatttcatggtgcaaatcctagcagatttcatctcaagattaaccatgccacccctctttctctccctcaaatttccaccaccagaagccctgttacacgttcatttgggcatgcaaattgcatgcttgaaagattctcatcagtaccctccgagaatgagggaagtggcaacaaaattttgagaggagtgacactatcttctctggttctgacatgtgttcttggattatttagttttggtggcaagaatatgaatcctaaactcaccacagcttatgcttcaccatatgataaaattgcatctttatttgtccgtgagactgaggctcaaggaagtgttgctctcaagccacggttggatggggctcaaggaagtgttgctctcaagtcactgttggaaataccgagcgatgcagaactcgcagatactcagaagaaaaggtcttccaacttcggtgagcgtggacctagccagctagaagttaacaaccttaagtggctggctatcggtctaagcaaatctccggatagaagtaaagcactgaaaacactgacagatcaatacaagtactgcaaggcgcacaagatcactggagagtcagaacagtacctggaactggctatggtagaactttccatgtttaagtag

SEQ ID NO: 70426 - DNA, 237 bp, Glycine max
  Peptide Sequence Number=SeqID_187204
atgtcatctattgtttgcagggatcacgcccgcaagacacccagtgcacccggagaagtccaacagggtcctggggtttccagctctgattacgagcttctgtcagtttttacggagtgcctgtcaccccccaacaaggtcattaggccccgcattaactgggctttcatcaagaaatactgcgcccccaggcaggcgcagggcgagacaccacaacaacattgggatggacgatag

SEQ ID NO: 70427 - DNA, 279 bp, Glycine max
  Peptide Sequence Number=SeqID_187205
atggctacttcaacctatcttgacttagaagagaaagaagccgaatatatagctgtaggaagttgttgtgctcaaagcctctatatgaaggaacaacttgaagactttggagtaaaccttgatcacgtttctctaaaatatgacaacacaagtgctattgatgcaatcctacccccaagggcattggatagaagactccaagaggattgggccaaagaggcaagagaaggccctaggattctcatgagccttagggtagattttgggcccatgggctaa

SEQ ID NO: 70428 - DNA, 1038 bp, Glycine max
  Peptide Sequence Number=SeqID_187206
atggttgttctttctcaccaatcagcactaaacgagttatttctcgtgaaaacatgcaagagcacgttcataggggtgcctgaggttgatctcacgcaccccgaggccaagacgaccatagtgaaggcatgtcaagagttcggtttgttcaaggtggtcaaccatggcgtgccgttggagttgatgacccatttggagaatgaagcgctcaagttcttcatgcagccacaatctctgaaagacaaggctggtcctcctgacccttatgggtatggaagcaaaagaattggcaccaacggtgatctgggttgggttgagtatctactcctcaacaccaaccctgatgttatctcccccaaaacacttcaactttttgaacaaaacccagaaatgttcaggtgtggagtggaggaatacataggggcagtgaagaagatttgctgtgaagcgttggagctaatggcagatgggttggaaatagtaccaaggaacgtgttcagcagaatgataagggacgagagaagcgatagttgcttcagaatgaaccggtacccagaatgtccagagcttaaggtagaagctttgagtggtcgaaatttgactgggtttggagaacacacagacccacagataatatctgtactgagatccaacaacacatcaggactgcaaatatgtctcccagatggagatggagatgggactacttgggcttcaatccagcctgatcacacttcctttttcatcaacgttggtgatctcttgcaggtgatgacgaatggaagctttaaaagtgttaagcatagggtattagttgattcaagcatgtcaagactttcaatgatttactttggaggaccacctttaaatgaaaagattgcacctttaccttcactcgtgtcaagggaagaagagagtttgtacagagagttgacatggctggaatacaagaatgctgcatacaagtcaaaactctctgataataggcttagtctctttgataaatctgctgatcacagtgacaaatctccattgtga

SEQ ID NO: 70429 - DNA, 522 bp, Glycine max
  Peptide Sequence Number=SeqID_187207
gacttcaaattgtgttatgatgctaagtttggtagaaagaaagtcgcggagaacggagatgatgctgccggtaaagcggtcagcaatggaaatggaaattcagtgacagtggccattgtgtccaatggcaacaaaagggcatcggaaatggctgtttatgagcagtttcgaagcgaggggcagaatcagattcacacaaatggctttgtgccgacccttacagatgaaaggccgcagaagtctttgcttccaccctttgaatctgcggaaatgcgagctttagcagagagcttaagtagggatatcattcgtggaagtccagatgtgaagtgggaaagcatcaaggggttagagaatgccaaacgtttactgaaagaggctgttgtgatgccgattaagtatcccaagtacttcactggtctgttatcaccatggaagggtatcctcctttttggcccaccggggacaggaaaggtttgtattggtattccatcagaaatatttacaacattgcctccttag

SEQ ID NO: 70430 - DNA, 441 bp, Glycine max
  Peptide Sequence Number=SeqID_187208
atttatgaatcagtgatcataaatttcctagcctatgaccaccactcaaaatttgacctccacttcactccaccattacaccagcagacatggaaaaggcgtcgcgcatcaagaaaacatatctggacatatgaaatcacccaatcaatgctaggggcaccatatccactgcaacttccagcctctgtcacacaatgcctaatccactgtggtgatcacatgacaattctcagaagattcggacctccactgcagtggaatgtagttgtgcttgacaaaggaattggtgataagtatatcactctgccttggtataaattccttcaagaaggtgattttagccatggagacgaactctcattctactataggcatgctgacaaaatttggaaagttatcatcaggcgtgcaattgattgggatgacagtgatatagattag

SEQ ID NO: 70431 - DNA, 153 bp, Glycine max
  Peptide Sequence Number=SeqID_187209
atgactcagattgcagatgtgcggtcttgtggggtgaccttatatgtcatgttgaggattttgaatgttcaatactcaattcctgactatgttcatatatcttccgagtgtcgtcatctgctatcaaggatttttgtagctgatcctgcaaag

SEQ ID NO: 70432 - DNA, 712 bp, Glycine max
  Peptide Sequence Number=SeqID_187210
atgagcgttggcggcggtggtggggcgggtaaagttaattttcaggacctttcggtacaagcattgatagataaagcaacgccggcagttctcaagttttgcgctagcggtaaacatgtcgctaaagtcgaactatcaatttgcaaagccggcggctcgcaaattgagtattcgcgtgttgtccttgaagatgttctggtgacgaaaaccagttttagcggtgtgggtcataccgacactattatggtgaattacctgtttcaggcatctaaagttaatctgcattattgggagcagtcttctcaagggaccaaaggcgcagaaactaaatcggcgcctgcaatgccagatattacctccgagataaatgcggttctctccgatcattcccggtttgacgcagagcagctggatattattatttcattcgtcaatgaactggataaaggaactttgagtcagtttgagaacgctccggatcgcacgattatggatacctatgagcgcttgctttctgccagtaaagagcctgccagaagacaacgcgacgaagaatacgaactggaatctctgacgggggccagtcgtcgtactaccaccatgagcaatcatgccgcgttttttgatcgcttcagaacaacgcccgcgcatatgtatggttacggcggcaacgtctaccgggatcagacaaaaagctattacgatgtggccg

SEQ ID NO: 70433 - DNA, 543 bp, Glycine max
  Peptide Sequence Number=SeqID_187211
atggaagtacaacagagaatcaagagagtagttgacgtgtggggaccaagtggaagtcaaccttcagaagaagattatagagaggagatggctaaaatcagaaaaactattgttgatttccacggtgaaatggttctcttagtcaactacagcaacatcaattacacagggttggcaaaaattctgaagaaatacgacaagaggacaggggggcttctgcgtttgccattcatccagaaagtgttggagcagccatttttcacaacagatttgatctcaaagctggtgaaggagtgtgagagcataatcgatgcagtgttcccggcagaggaagaagctgagagagcaaaggaagcaaaagatgcaataactgtggcaggagaagggattttcagaaacacagttgcggctttgcttacaatgcaagaaatccgaaaaggtagttccacagagagccctttctctctgccaccactcaacttgctagactctgatctcatccaatcaatacaactcaatgctgctgttcccattgtcaagtga

SEQ ID NO: 70434 - DNA, 999 bp, Glycine max
  Peptide Sequence Number=SeqID_187212
atggacccaacaacaaaccttgttgagttttcatctcagaatttggaagcatgtaccaacaatttcagtcagagcaatctcattggcttgacaaagtttggtagattgtatagaggcatccttgaaggtcaacatgtagtagtgaagatatgggatggtgaaagaatggaacagttaagttccaaatatgatgatgagaatttgattatcaaagcaagttccctccccatctcttgcacttttgaggaagtaaaattttggactaatccaacattaagaggttaccccaatttggtgaagttgattggttatacttgggagagagatgcaaagggacttgtttatgatctcaatccacttgatactttggataacgtaataatgaaagataacctgaattggcttcagagaataaatgtaattcatgaacttgcaaagctcctgaaattcattcatgaccaggaaaagcaaaatatggtgttgaatatcagtgcatctcatattcttctcgacaaggattacaagccaaattttattgatttggtgttgcttagtgaagtgacaatgctaagggaacaactaacaatgtcaactagctacatcaatccttatttttctctaaggggtggtgaatgggatagaagctgtgaagtgttctcatttggcattgttttgcttgaactaataaccaaaagagtttcagtcattgggaagagagaacatgcaagcataaacttggacggtgtggttcatatttgggccaagaaagaatacaagccaaattgttctcttgtccatgaaactttgcaggaagattggtgttactgtgctgaagatggtgtttcaataactttattggcattgcaatgcatagaattttttccagcaaaccgtccaacaatgagggatgtcttgcacaggctagataatcttttggtgttacaacgtatggctgatgctagagcaaccaaaagggaaaagcaactcatttcatcctga

SEQ ID NO: 70435 - DNA, 447 bp, Glycine max
  Peptide Sequence Number=SeqID_187213
atgtctccttatcgagttgtctttggaaaggcatgtcatcttccaagggagatcgagcacaaagcatactgggcagtgaagacctgcaacttctctatggatcaagctggtgaggaaagaaagttgcaactgagtgagttagatgagatccgcctagaagcctacgagaatgccaagttctacaaagaaaagaccaagaagttccatgatagcatgataattaagaaggacttcatggtcgggcaaaaattgaggtctaagtggattggtccttttgttattactaatgtttttccttatggtacagttgagatcaaaagcaactccataaacaagaacttcaaggtcaatggacaccgacttaagccattcctcacaaacccttctttagtggacgtagtggtggaagagacttccttactccaccctactcttcctccaccatga

SEQ ID NO: 70436 - DNA, 240 bp, Glycine max
  Peptide Sequence Number=SeqID_187214
atggagaagcaaatgaagggcacggaggaagaagggaagaagaagaaggaagaagaacgaaagcttgctgggagattgctggggtattattggtacttcattgaattgctgggtgcaccaacaattttgctgggtgcacctagcaacacccttgaaaggaaggacaatgaggatgtggagaacaagacaatgtcatctcacagtggtgatttcagtgctacacgaggtagcctattctag

SEQ ID NO: 70437 - DNA, 1464 bp, Glycine max
  Peptide Sequence Number=SeqID_187215
atggttagaacacgaggtttaggtcgtgtgttaggagctggtagaggtagaggcattagagaggatgcgcatcaggttgatgttcctcggcgtcacaggcctactgcttcagcacgtaggcaacggattcgtgtgcgtgaggacgatgttcctcagttgcatgaggatgttcctcacgtgtctgatgctaccccagagatgacaggcgccgccgatgctgttcacacagagggagtggctactgatgggagcttggggtcacctgctgtagatgagggattccccagtgggccacgcgacccatcggttttgaccggttttgctgagcatgtcacacacaacatctggagtggacaggaacgacccgatctgaagttggtctcccatggtagaaaagtagataaaattgggagaccagcgcctgagatcgaaggcatgattgctgccaccggattgagtccactgatcaggtgttctgttatcaccactgatcctggactcatatccgccttcatcgagaggtggcattgcgagactagcacgttccacctgccagtaggcgagttgacgatcacgttggatgacgtggcgtcactcctacacgttcccatcactagcgcgctgcataagttcgagtcgctggttacttcagacgcaattggtctactgacgaagcttcttgagggccagacgatgggttgtagcagcctgcacggacctggcctaggcagggggattcgcctagggagcggctgcattggtccacatgtacgagcatctaaacgacgcgtcgcaggcctctacacggcaggtgggtggttacattacacttcttcagtgcatacatgcgttgttcatgatgtttatgatgaggggagcccacgggcctgcaggtggcttacgggtaaggctcatatgacggggatcaagggagccccgtatcggagacatatggatgccctgactgtgactgacgtgtgttggatgccctatgttgagcaccggggagtcaggggctttgacttgatatcgtcgtacaccggccagctcagatgggaccatttggtgcctgcaggagagctctgtgtagttcctgggcaggtggcgccagactacatggagtggtttttttggatttcgtacccgttcgtcacgcggaccgaggaaactgctgagccgagacatccacctccccctcatgatgaggagttcgtcgagccacccatccccgaggtttcaatcgcgtccgatctcgctacgcattcagtggttgactgcgaaggatgtcaagggatggctgaggatttaggagcgattgctgaggatttggagcgggtcatcaacctcaggatggtcactgaaggcactgacttatatgacatcatgactcgttgtctgaggagagctagaggtgacgccacagatggaagtcttaggccgcgacagagacgccgcatagattag

SEQ ID NO: 70438 - DNA, 360 bp, Glycine max
  Peptide Sequence Number=SeqID_187216
atgaatatgattgttggaaaacacccaagtccaacattggcaagagatagagccaaattagaatatataagtgaggggcaaccctcacccctcgagccagcttttggggttgagttagacccaaactcattttccaaaatggtatcagagcctattctagatccattcaaagggccacccaccatttttgttcacgcatcaagtcaaagaagtactgggcgtgaggggtgtgttgggaaacactcaagtcccacattggctagagatagagccaaattagaatatataaatgagaggcaaccctcaccccatgagatagcttttggggttgagttaggcccaaatccacatatattctaa

SEQ ID NO: 70439 - DNA, 918 bp, Glycine max
  Peptide Sequence Number=SeqID_187217
atgcctattgacatcagggaaatcgaggctgctctgtgcatacctggccgagggtttattttaaaagctgaaggtcaccttgggaagatcctcggaaaagatctaaccactcttgctcgggtctggagtgttctctcatactccaacctggctccgacttcccacacctcggatttgactgtggatagagctaggttaatctttggcctagttactcagctagacctgaatgtcggagctctcatctctggacaaaccatatcaatggcccagcctaactcttttagactcgggttccctgctcttatcacagctttatgtaggtccagaggagtcgtgtctgacaacttggtctttgaacgtttgagcccgaccattaatttggcctacataaggaaaaactgttggaacccggatgatccaacatttattattaggggggccaaaagaccaagggcaaggccagctaaggctctttctacatcagtagctcctcatccaggttctacatcaacagctcttatgacaacagctccttctatgctacctcctgcagattttaaatgtttcgaagccatgcttcaaagcatacatcaggggcaaattattttactacaaagcctacaactggtagcgcctctagactccatcccgacggtagagcaatttaatgaatgggtagcctggccaaggactcagcctcctcttcacagggaagacgaagatcccgctgctcagttaccccatcagccggaggatgagtcatcagagtcttccactcctgagcccttgatcaggaaaaggagggtagttgtaacccaggaagctgcagctatctctgaaaagtctcttgaagccactccagtgcctccgacactagtggtagatatcacttctaatgtaaacccatttgcataa

SEQ ID NO: 70440 - DNA, 585 bp, Glycine max
  Peptide Sequence Number=SeqID_187218
atgtccccactatcgagccgttattggaccatcttcagatgtccaatcctactaacttcatgctcgagatgtccaatccttggcgtgaggaggcttactgcttatcatgagagcggccatgcaattgttgcccttaacacggatggtgcacatccaattcacaaggcaacaatcatgccacgtggatctgctttaggaatggtcactcagcttccatcaagtgacgagacatcaataagcaagaaacagttgttagctcgccttgatgtgtgtatgggaggaagagttgcagaagagcttatctttggccaggattatgtcacaactggagcaagtagtgatctccacactgctactgagcttgcccaatacatggttgtgaaactccttcgagaagcatatgatcgtgtgaaagcccttttgaaaaagcatgagaaggcattacatgtgctggcaaatgcattattagagtacgagacacttagtgcagaagaaatcaggagaatacttctcccatatcgggaagcacggctaccagaacaacaggaacaagaagcagcagaaggggatctggtgttggtgtaa

SEQ ID NO: 70441 - DNA, 381 bp, Glycine max
  Peptide Sequence Number=SeqID_187219
atggagaaggagcacaatggggagtttgccagttggcggtgttggtgtgaaggagcagtagctagaggggttgctggagtgctgtggtgctggaaaactgagggtggagggtttgtggaaggaggcgacgctgatggaagtgccgctagcgagtgggtctcgccagaaagatggtcacgtgccaatttgaggttgaacagcggtgggtcttggacagagaaagggatgccggagggtggcggttctgctcttagggttgcactggagacaaactggcacagcgacaaccaaaacggctgtgcagtggggaggggcactgtgtgctcccagaaagaggcatccactgccagaaggaaagaaagagggaggattgaaccctag

SEQ ID NO: 70442 - DNA, 1426 bp, Glycine max
  Peptide Sequence Number=SeqID_187220
gtttgttggagttggtgctcgacgtgttagatccttatttcaagcagccaaaaagaaggctccttgtattatttttattgatgaaattgatgctgttggatcaacaagaaaacaatgggagggccacacaaagaagacattgcatcagctacttgttgaaatggatgggtttgagcagaatgagggaataatattgatggctgcaacaaacttgcctgatattcttgacccagctttaactaggcctggaagatttgatcggcatgaacgtggtacgggtggactgatctgtgtaggacatgagtcaagaggattctactatctggaaacaagttcttctatgttatgtgttgctgcttcatctcctaaactttttcatgatcgcttaggtcatccaaatttgtcaaagttaaagaaaatgggacctcaaaagcattacttttctacttggtgggctgacttaagggccattactcaacaccagagtatgtttgctgctgctaatcaaatctgttggaagttgggtagaggtgaccaatttctcttttgggaagatccttggggtgatgagggaatccccctcaaagatcaatttcctgagttatttagagtttcttcccaaagagatctcagggtggcagagatgggatcttggtctgagaatggttgggtttggaacttgtcttggagaaggaatctctttgataatgaactgcagttagcgtctaaattcattgatcaaatccatgcatctagtctaaacatcaacctgaaggacacctggacttggagagctgaagctaatggagagttcacaactaaatctacttaccaagttcttcaatctgagctggatgatcaagatagactccctaccaaggataacctggtcaagagacaaattcaggttgaaaatgacctctgccctttctgccataatcaacctgaaactgcatctcatctttttttcaaatgtgataagattatgcctatgtggtgggaattcttctcttggatcaaggaagacaagactaatgaccttgggtgccttaaatactttcttggtattgaggtagctcaatcaaaggaaggcattgtgttctcacaaaggaaatatgctctttatattttagaagaaagatgcatgggtaattgtaaacgcattgatagtcccatggacccgaatcagaagttaatggctgaccaaggacaggggtttttatatgaggataaaggaaatacccagatctttgggtattgtgatgctaattgggttggatgccccatagaccgaaggagcactactagatattgtgtatctattggaggcaatgttatcccttggaagagcaagaagcaaaacactgttgcttggtctagtgcagaaggcgaacatagagctatggctacagccactttgagttag

SEQ ID NO: 70443 - DNA, 1071 bp, Glycine max
  Peptide Sequence Number=SeqID_187221
atggatataattcctaaatacctaggggatgacctagttcttttacctggattaagcgaggttggagcagaacgagttatgaatggcggaacatatggaaatgcatctgtcttctactcaatggagagatggaatccaagtatacgcacggggaataagatgatttgggttcaatgctggggtatcccacttcaagcttgggataagaaacatattaggcagattatcgcgattatgggagaagtggtggatgtcaacgacgacgtcgaagccaaacggaggttggatagagcaagagtgctcatcaagaccccatggacgccactgatcaagcacaccgttgacgttcatatcagtggcgaaaccttcaaggtgcatgtagtcgaggagtgcagggcggctttttgcgagaatcacaacaacggttgtagctacagagactcatcggaggagatcgatttcgacgaaagcctccaaggtgatttaccttcggctatgacaagcctaacgatcgtcgaccacgatcataaacgcgccactgcgacggaccatcaccccaaatcaccccacaaaccttctatgccaaccgttagcgatggaaaaaattggtcgattggattacacagcgatcagcacgagtacgattatctgctagataagaccaacgaccctcggatattgaccggttgtaaaggtaaggcaatggtaaactcgagcttcaaggagccacaggatcgtgactttcacgagaatagtaagagagataaaggaaagtccagcggagtccagaaggagccttttttgccatcacgtgactttgcaggagataaaatcccatcaagggcagtggacgcttatcaggaacataaaggtgctgacgtggcaatcgaaatagtgaaaaatagggaacaagagactgatatggtccaagacagtgagacacatgcaagtagtagaggcaaggtccataccagtgagataaacgccaatagtaatgacatggatgtggagaggaggggactaacagaggagagtcataacaagaatcaggtgtatggaggacagagatag

SEQ ID NO: 70444 - DNA, 1064 bp, Glycine max
  Peptide Sequence Number=SeqID_187222
gggaatggatcaaagaggcacaacaagtaagtattgttaccatatattcaccatgtgacatccacatcaagataattctatgggatacattgaggcagttgaaagattcatcccaagaggggctatggtgtgttctaggtgattttaacagcatcagggatccagcagagagatttggaacctgtgaaaggatatcaggggacaacaacattaaacaattcaatgattggatagatgatttggaggtcttggagataccttgtttaggcagacaattcacttggttcagaccaaatggagcaccgagaagtagattggacaggttcttagtatctcctgagtggctggacagatggcctggaagcttgcagcttactctaccaaggaagtttttagatcattgtcctattctgcttagagctaagactgtagactgggggtggggagcatatgtactaaaagaaaaaattaagaggttaaagcaaaggctaaagatatggaatcaggaacagtttggaaacatcctcaaaaaggtcaaaaaccaggaagctgaattaaataaactagaggaagacacaacacaaagacaactaactgatcaagaaatgatggaaagaaagcaattacaggaatcactatgggtagctgcccaagcccatgaatccttgctaagacagaaatccaggtcaagatggataaatgagggagattgcaatacacactattttcacctaatgatgaatgctaatcaaaatagatactctattaagggggtactcattgatgacatatggactgatgacccacataaggtgaaggaagaagttagatcctttttctcccaaagatttcaagaaccagatgatcagagacccaagattgatggtattagttttaaaaccatcgatcaacatcagaataacttgcttgtggcacctatccaggaggtagaagtacaaaatgcagtttgggagtgtggtagtgacaaaagcccgggtcctgatggcatgaactttaagttcattaagcagttttggaatacactaaagcctgatatcctttga

SEQ ID NO: 70445 - DNA, 246 bp, Glycine max
  Peptide Sequence Number=SeqID_187223
atggagattctggacgcatatgagaggggagataggttctacttgtacaccggacacggaccttgctctgaggccttgcatttgggacacttgattcccttcatgttcactaacgagttccctgggttggatggttctggaggtcccttgtatgcaggaactggttgctttcacaagagagagtctctttgtgagatgaaattcaatgatcaatatagcaatgactggaatagtgaagatgattag

SEQ ID NO: 70446 - DNA, 699 bp, Glycine max
  Peptide Sequence Number=SeqID_187224
gcacccgatttcaaaccgcgtaaagcttttctgttcctgtttttcctgctggcggcgggcattcctaatcttttggtgagtgaggactgggcagcctatcgcacggttatcgcgctgtcgttaatcactacctcagccttcattgctggcttattcgtgatctttaataagctgaagataactacttctgccagtatcgtttgcctcgtcattgcggtgctctcatgcatgctgaatattcagaagggcttttctacgcctcagcagcgcgagtatcagttgttaagcagcgcaatcaccgggaacgtgcctgcagaatactctggccagctttattatcgtatcgatagcgacaacttacctgctgtcgcaaaatccaaaaaatacgatgagttcggttcgctttcgctgggtatgccatggacctttgccggtatggccgacgcgattaaaaaagagcacgcgatgaagtattccttgccaaaggcgccccgccgccactatttcgctaaccgcgcaacggctctgcttaccgttgcgtggttttctggctatggcgcgacatcagatcggctggtagcagccacgttctgctggcggctgaatactacgctaagtcattttttgaacgccactcgtcgtgataatatgcgtgccgctcaggggctcgccccgctggtttacgcctgcatcgattga

SEQ ID NO: 70447 - DNA, 607 bp, Glycine max
  Peptide Sequence Number=SeqID_187225
cgctgatgcgggaagcgcgccgctaatggccattctggggctgggcagcgatatcgtcgagatcgagcgtatcgctggcgtgattgaacgctctggcgatcgtctggcgcgccgcgtgctgagcgaagctgagtggcagcagtatcaggcgcatcagcagccggtgcgcttcctcgccaaacgttttgcggtgaaagaggcggcggcaaaagccttcggcaccggcattcgcggcggcttagcgttcaatcagtttgaagtgtacaacgatgcgctggggaagcctggcctgcgcttctttgaacaggccaaagtgattgccagccagctgggcgtgcagcatgtgcacgtcacgctggccgatgagcgccactacgcctgcgccacggtgattatcgaagacgctctgacaggtcggctcatcataatgacccacgcattcagtgcagcggtcagcgtcgatctgatagatcgattcacccatgctaatcgcctggttcgggcactcaggctcgcacatgtcgcagttaatgcagcgctcagtaattatcagtgccattgcataagctcatcagttgcttgttttcattgcatgtttcatggttag

SEQ ID NO: 70448 - DNA, 280 bp, Glycine max
  Peptide Sequence Number=SeqID_187226
gagcaaaagccctgcttttgtcgaccaccctaccttttgctaccgtgacccaagagtccggtggcatgtggagacacccgacggtaacccgcacacaacctttgctatccagcgacccgagagtccagtaacatgcggagacaccttacggttatccgcacctcgtcattcggagaccccaagtcggattgacaagcagagaccaatgtggtcatctgcaccctttctggagatgccagcatcttccggtagagactatttcagtctcacacttctttag

SEQ ID NO: 70449 - DNA, 429 bp, Glycine max
  Peptide Sequence Number=SeqID_187227
atggcgacatacgaatggcaacacgtgagtcagcttgttccgccaatacgaatggcgataccagcccagtcagctttcgttccgcttttggcaatggcggtacacatggatatcgctgatggcagtggcgatacatgcttgccgccattcccaaacaggggatttcaaaacctaaagcaaatactactggaaagccttttaaggttgaaatccatcgttattgaagatggagcattgccttctctcgaaaagttacagttagtttttattccccgactgaagaaggtgccttctagtctcaacaagttaccaaagcttgaggttttccatgttactgatatgtcagatgaatttgaagaaaactttcatctcaacagaggacaacgtcaatggataataggtgtgcttttattcttatgccgaatataa

SEQ ID NO: 70450 - DNA, 234 bp, Glycine max
  Peptide Sequence Number=SeqID_187228
atgggaattgggaaagggaatcaatggaggattgagctaggcagagatgcttatttggtaatatttatttttgagatagtcagagagaaaacgaaggcaaacgatattggaggaatggtgtgcattattggaggaatgatgcttatttgctccaagaagtcagatggggatgatgaggggtctaaaaggtggcaagacatgaatgtgatgtgtcagaggtcggagtggggatga

SEQ ID NO: 70451 - DNA, 684 bp, Glycine max
  Peptide Sequence Number=SeqID_187229
atggctaattatacacctaacaatgaggggaaaataggtgatgtttttgagtggctggacaaacaagaagaagagtttgtggtgtatgtgtcacttgggagtggatacacaatgtcatttgtggaaatgaaagagatggctttggggttggagctgagtggaaataaatttgtttggtctgtgcgcccacctgtcaccaaagctggcactggcaactatctcacagcaggtgcacctcttggagaaaccggaactacccttgggtctaataatgaaccatcaaattcttttcctgatgagttctaccgcatacaaaccaatggaattgtgatcacagattgggcaccacaattggatattttgaagcacccatctattggtggttttgtgtctcattgtgggtggaactcattaatagagagtgtttcatgtggggtgccaataattggattgcctctttttgcagagcaaatgatgaatgctacgatgctaatggaggaagttggcaatgcaattcgagagttatcaaaagcaataaggaagataatggataaggatgacaaagaagggtgtgtaatgagggaaagggctaaagagcttaagcaattagcagaaagagcttggtctcatgatggtccttcttatttagcactttcaaaaatcactcactcaaatgggatgtga

SEQ ID NO: 70452 - DNA, 153 bp, Glycine max
  Peptide Sequence Number=SeqID_187230
atggggtgctctcagttttgtatcaccaaacccgcttctctattcagaaaaaatacaccatctattcagagtagtaagggtctggaagaacaaaactgccttcaggttcgtgtatttgcaatggttggagtagagaaactgtggttagattaa

SEQ ID NO: 70453 - DNA, 381 bp, Glycine max
  Peptide Sequence Number=SeqID_187231
atggccctctcgtggggacagcaagtgttgaaaatgccagggcttttaacgggaacctcattgcacaccttagatcattggtgcactcctttgatgcctgggaaatctgtggacacgttcatttttgcgctctatgatgaggatttgaaacaaggtccagcttctgagcgaccatttggtctcttcaaaactgatctcaccatggcatatgatgttggcctagacatgtcaagctttagctacacgaatccaacaactactcctgtaacgggagcacaatggtgcatcccaaaagtagaagtggccgaggctcaattgcaggcaaatattgattatatttgtggtagccaagttgtagattgtggtccaattcaacaatga

SEQ ID NO: 70454 - DNA, 2166 bp, Glycine max
  Peptide Sequence Number=SeqID_187232
atgaaaatcaatgaattgttgaactgtgcggttcatatcggtgatacagaagcatgccaattcattcatatacggcagaatgaccgactagctgttagcaagctggttaccagcttaaccaggggaaatgttcgctctcctttggcccaatgccttttgatccgttatacaagtcaggtaattcgggagtcaggaaataatacacaatcaggggaccgtcccttctatgattatcttgagagttgccttcgtcacaagtcagagatggtgatttttgaagctgcaagggcaattacagagctcaatggagtaactagccgagaattaacaccggcaattactgttcttcagctcttcttaagttcgtccaagccagtcttgagatttgctgctgtccgcaccttgaacaaggtggcaatgacacatccgatggcagtcactaactgcaatattgatatggaaagtttactctctgaccagaaccgaagcattgccacacttgccattactactctattgaagacaggaaatgaatcaagtgtggaccgtcttatgaagcagattacaaatttcatgtctgatattgctgatgagttcaaaattgttgttgttgaagcaataagatcattgtgcttgaaattccctttaaaatatagatctctgatgaatttcctaagtaacattcttagggaagaaggtggctttgattacaagaaagcagttgtagattcaattgtgattcttattagagatatccctgatgctaaggaaagtgggttgcttcacctttgtgagtttattgaagattgtgaattcacttatttgtccacacagatactgcacttcctgggagttgaaggaccaaaaacttctgaccccagcaaatatattcgttatatttataacagagtacatcttgagaatgcgactgttagggctggtgctgtgagcacattggcaaagtttggtgctgctgttgatgaattaaagggtgatatttcgactaatgtaaaatctcctaattacactttgcagccccgcatattcatactgctaaggcggtgtctttttgatagtgatgatgaggttcgtgacagagcaacgctttatctgaacacacttggaggtgatggttcagttgttgagacagataaagatgtcaaagatttcctctttgggtcatttgatatcccacttgtcaatctggagactagtttgaaaaactacgagccttcagaagaggcttttgacattgattcagtccccagggaggtcaagtctcaacctcttgcagagaagaaagcccctggtaaaaagcctactggtttgggtgctcctcctagtggtcccccatctaccgcagatgcatatgaaaggctgcttctatccattcctgagtttgcaaactttgggaagctttttaagtcttcagaacctgtggagcttactgaagcagagacagaatatgcagttaatgttgttaaacacatttttgatcggcatgttgtgtttcaatacaactgcacaaacacgataccagagcaattattggaagatgttattgtaattgtggatgcatcggaagcagaagagttctctgaagtgttctcaaagcctctcagatctcttccttatgattcgcctgggcaaacatttgtgggttttgagaagcctgagggattgtcaattgctggaaaattttctaacgttctgaaatttattgttaaagaggttgacccaaccactggtgagacagaagatgatggcgttgaagatgaataccaactagaggatttagaggttgtcaccgcagactacatgttgaaagtgggagtgtctaatttcaggagtgcatgggaaagcattggccctgactgtgagcgagtggatgaatatggtcttggccccagggagagtttggctgaagctgtaaataccgtcattaatcttcttgggatgcagccttgtgagggaactgaggtagtcccgcccaattcaaggtcacacacatgcttgttgtcaggtgtattcataggaaatgtgaaggttcttgtgcggttgtcttttggacttgatggtccaaaggatgttgcgatgaaactttctgtcagatccgaggatgaaactgtcagcgatacaatccatgagattgtggctagtggctag

SEQ ID NO: 70455 - DNA, 1266 bp, Glycine max
  Peptide Sequence Number=SeqID_187233
atggagaaaagtggggccgtgtgtagaagagttggcattcgcatatggcagcgtcagaaagagcgtcactctgctgccaccgacaccgtcaacaatctcagacaccgtttaaagcagaagcgcctttcgttgctcgacacagatatcgtcgttgtttcagtttctgggtatgcaaggtctcagggtagaacgcctgtgacctttggacctacggatctggtttgctgtagaaccttgcagggtcacacgggaaaggtgtattcattggattggacttctgaaaaaagtcagattgttagtgcatctcaagatgggcgattaatagtgtggaatgctctaactaggcagaaaattcatgccataaagctaccttgtgcatgggtcatgacctgtgctttttcaccaactggtcagtctgttgcatgtggtggtctggacagtgtttgttctattttcaatcttaattcgccaactgacaaggatgggaatctacctgtttcccggatgcttagtggacataaggggtatgtttcctcttgtcagtatgttccagatgaagatactcatttaattactggttctggtgatcagacatgtgttttatgggatattactactggccttaaaacatctgtctttggaggagagtttcagtctggacatactgcagatgtacttagtatctccattaatggatccaactcgagaatgtttgtatctggttcttgtgatgcaactgctcgattgtgggatactcgcgtggcaagtcgagcagtgcggacatttcatgggcatgagggagatgttaatgcagtcaaattctttcctgatggaaatagatttggaactggttcagatgatggaacctgcagattatttgacattaggactgggcaccaacttcaagtttattatcagcagcacagtgacaatgagatcccacctgtgacttccattgcattctccgcttcaggaagacttctctttgctggatacacaaatggagattgctatgtctgggacactttattggcaaaggtacttggtgctctagcgaaacatacaacaacttcaggttccattttttctggttgcactatgattgaagtggtactgaatataggatctctccaagactctcatgaggacaggatcagctgtttaggtttgtcagctgatggaagtgccttgtgtacaggaagttgggacacaaacttaaagggcataggaggacaacttaaagccattgaaggaaaggccaaatag

SEQ ID NO: 70456 - DNA, 504 bp, Glycine max
  Peptide Sequence Number=SeqID_187234
atggggagcagattcggcaaggggaggtcggttgcggtgttctgtggctccatcgctaagggctccactggtggcgacaaatttgttttgggtttgggatggtgggaaactaccattggaagtggggctgacatggggacatctgaggatggcatcgagcttaaagtccatggaggcttaggttgtggccaagcggaattgagtggcagcgagtttgacaatgacaacctcgagacggtccaggttgacggaggaagagggagggatcctgcaagatcttgcaaccttgttgttgcactacatgaagttagcaaggaacttgggcttttgttgtacccgtttgggcttgtacctcacagagatcgagaagatggttggtttggaaagaaaataatgtgggtaaatataatgtacattcagcatacagagttattcagaggaatagcgtggagcaacaaaatgttgagatctttgagtcattatggaagattgatattccactga

SEQ ID NO: 70457 - DNA, 477 bp, Glycine max
  Peptide Sequence Number=SeqID_187235
atggctgaggatgttcatagaccatggatcatgatgggggattttaatgcgtatcttgtgccttcggagaaggaagtgagagaaaaactggatatggttgttggggatccttcttggaatcagagttttccagaggcttcggtaattcatttgccagcccttaaatctaaccataaggctatccttttgagaacgagtctaggtttgagggataagggtaggacacggatgttcagagtgatggctagttggatggctgatgattctttgaatagtatgctcaagaagacttgggatagtactggggagtggaaatatttagtaacttcctttcaattggcatttgatgattggaacaataattgctatgggaatctatttcataggaaaataagaatcctagctcgtttgcatgggattaatgagaaacttactatggaggagaattgtgttggaagtgtggcctcaataacttaa

SEQ ID NO: 70458 - DNA, 1230 bp, Glycine max
  Peptide Sequence Number=SeqID_187236
atggagagaaggcaaacaattcgaggcagaggaagacccaaaaagactataagagaggttatcaaaaaggatctcgaacttaatgatttggatagaagtatgaagcctaaccttgctgggttgtctgaatttctgaaaccattgaacgaagtgatcacaaaagctaccaaattgacagaaggaaggagatctgatttttttaatcacttaaaggctgctgctgatagtctctcggctttagcatggattgcatatacagggaaggattgtggtatgagcatgccaattgcgcatgtggaagaaagttggcaaatggctgagttttacagcaacaaggtgcttgtagagtacagaaacaaagatccaaatcatgttgagtgggccaaagctcttaaagagttgtatctccctggattgagagattatgtcaagagctttcatcctttaggccctgtttggagtccaacaggaaaaatatttgctccatcaaaagcttctgctcctgctgcacctccccctccatctgcttctctctttagttctgaatcatctcaggcttcatcttctaagcctaaagaggggatgtctgctgtttttcaacaaatcagttctggaaatgtcacttcaggtttgaaaaaggttacgaatgatatgaagactaagaatcgcaccgatagaactggagttgttggtgctattgaaaaagaaactccggcaagttcacgcgtgttttctaaagcaggacctccaaaatttgaacttcaaatgggtcgcaaatgggttgttgagaatcaaattgagaagaaagacttggtgattgaagattgtgattcaaagcagtctgtatatatttatggatgcaaaaactctgttttgcaaatttcaggcaaggtcaacaatataactattgacaaatgcacaaagatgggagttgtatttaaggatgttgttgcagcatgtgagattgtaaacagtaatggggttgaggttcaatgccagggtgcagctcctacaatttcagtggacaacacttctggctgccagctatatctgagtaaagactccttagaagcatccataactacagcaaagtcaagcgagatcaatgtaatggttcctggtgctgatccggatggtgattgggtggagcattctttgccacaacaatacattcatttgttcaagaatgggcactttgaaacgacacctgctgctcattctggaggttaa

SEQ ID NO: 70459 - DNA, 1029 bp, Glycine max
  Peptide Sequence Number=SeqID_187237
atgactcttaaagagctcgttgggattcttaaagtccatgagcaagaccttgctcaagatgaaggaacaaagaaagggaaattgctatcccttgtagatcaaagaccaaaacgcaactttgtgttcaaagagacatcatccaaggcctttgttgttaagtatgcttcagaaaaagaatctaacgatgatgactctaataaagaagataatgagctaagtctgatcaccagaaagataaaaaaaattggaaaaataagaactcctctaggttcaatagatcatccaaaagatccttgcacaagaaagagaaaagtccaatcatctgctataagtgcacgaaacgagggcacttcaagtcagaatctgaacgattccttatctgacaaggacagtgaggaagaagccaacctatgtctgatggctgatgcatccactagtaaggcagaactagctctagatgacactatcaactctaatgatgaagaggcaatgtttgaatccaaagaagacttaatcaaaggttacaatcaacttctatctgcctctgcttgcgtctctaaagcttatagaaaattaaataaacattttcaacaccttgaaggagagcatgaggatctcaagaaagctcatcgagttcacttagttgattttatcctggaaacaacctcgcttggtagtgtacaagatgcttgtgcttgtgaggaagtcaaagcactactaggcgaaaaggtatccagtggatgcaaaactcttcttaaggattttcaagacctagacgattcatcattgaataaggacagggaggaagaatcaaacttgtgtctgatggctgatgcgtccactaatgatgaggaacctcaacctgatgacactatcaactctgatggtgaagaggcattagtagaggaaaaggtatctagtgaacggaaaattattcttaaggattttcaagacttggaagaaagggtgaaatccttaaccataactcttgaagattcagaagaagaacacaaggagatgcttaaataa

SEQ ID NO: 70460 - DNA, 915 bp, Glycine max
  Peptide Sequence Number=SeqID_187238
atggaggaagttcgagccgtccacctcgtcgggttcaatggaagaacaaggaagagcaatgttagagtggctagggttcaatggaagaacaaggaagagcctaggatgctaacgctgagggagaagtactatgatttcgaccagatttccagtaaggttttcaagtgcaggcgtgatgatcagtttttcaccatgaaaattgtctccattctgaacgaagaaaaccaagcgaacaacggggttccgtactggattataagagaaatctctattctcaaagagctggaccacatcaacattgtgaggttgatcgatgtgatgaccgatgggcccgacctgtttcttgtttttgagtatcttgacaatgaattccaagctgatttcctgaaaaatccaaagatgtttatgtacccacaaatgaaaaaagagtttctttatcaaattctcaatacagttgcgtatctgcatgctcgtaaaattcttctcagagatttgagacctgagaatattctggttaatgtcagaacccaagttctgaagattgcactctttggggcagccagaacatttgaagctcctcttgaggcttactctagcagtgtgggttgtctttcttataggtcacctgaagtcttgtttcagtttggctgcgagaaatactcaactccaaatgatgtctgggccgtgggttgtatatttggcgagatgcttcttcaccggcctctattctctggtccaagtgatgtggagctgctggatgagatatttaccttgcttggtaccccaacagaagaaacctggcctggagtgacttctatatgcggaacctgtgctttaatgggacctccacaacagcccaaggacctggcaaaagagtttccaatgctcaatccagatggtcttgatctactctcc

SEQ ID NO: 70461 - DNA, 408 bp, Glycine max
  Peptide Sequence Number=SeqID_187239
atgaaggacaagagcattaggaaggacatcaatcaaagtgttgtcctaacaaaggtgtttgaagctcatggagtgataaggaagttcttgtacgagacacctgtagataagttaggactcaacactaggagatatgactacctagacgaagtttgggaaaaggttgctgaggaagatgaaagagtggatgcaactgaagtcactgagcaaataaataagaagaagatggacacaccttcatccaagcctgcacctactcaacaacatccacctcccactctcatagctccaaaggcaatagatgtcatggctcatgtgtccaaaaatcctgtactaaagaagcaaaatcctttgtccactacaaaattcctaagggcactcagtgagactgagagtgacgatgattaa

SEQ ID NO: 70462 - DNA, 219 bp, Glycine max
  Peptide Sequence Number=SeqID_187240
atggccgttttaagttttgctgaaaacaagttcccaaaatttttgtctctctcaaatactgccataccaagtgctcctgtcgctaaatcccagttgctaatcactgttcatcactgtgcacagcaaaacacaaagctgaatcagtcgctaaaaacagtcgctaaacaggggatgcaactgaaatgccaaatagaacgctacacaaaatttgataactaa

SEQ ID NO: 70463 - DNA, 156 bp, Glycine max
  Peptide Sequence Number=SeqID_187241
atgacaattttgatagagatttggctgagaatgctcaagttatggtccttgcagcaacttatcgtccttcagaacttgatgaagcaatacttcagcatcttcctcaagcctttgaaattggagttccagaccaaagggagaggattgaaatattga

SEQ ID NO: 70464 - DNA, 288 bp, Glycine max
  Peptide Sequence Number=SeqID_187242
atggctaagagcatagacaattctggaagaaggatgagctttatagaagcactgagcaaaagccaactcgctaagtgcaccgtcttcaccttcaggctaagcgaagtttttggttgtggagagactaagagagagctgagcttgaagaggaagccatctaagggagctttggatgagattgtgaggtttctagaggtggaggagacatccccactacttgtatttcttctatctttcatcttctcttctcattgttgtaaaggaagcttccctgctatggagagctaa

SEQ ID NO: 70465 - DNA, 450 bp, Glycine max
  Peptide Sequence Number=SeqID_187243
atgaccactcttacacagatatggatgacgttgctacttagcaacattccacccgacgaccacaatgccgatctccctcctgcgaaagtatcagttggtctgtgccatcgtgacatagggatcacacccacaaggcacccagtggacccaaagaagtccaacagggccctggggtttccagctctggttacgggcctctgtcagtcctacagggcgcccgcccccccagcaagttcatgccatcgtgacatagggatcacgcccgcaagacactcagtggatccggagaagtccaacagggtcctggggttttcagctctgattatgggcctctgtcagttctacggagtgtctgtcgcccctaacaaggccatcaggccccctactaatcgagctttcatcaagaagtactgtgcccccaggcaggcgcagggcgagacaccacagtag

SEQ ID NO: 70466 - DNA, 612 bp, Glycine max
  Peptide Sequence Number=SeqID_187244
atggaaaccattcaccttcaaaagaagaagagaactttgtccactgctgatctcaacgataaagttcaacatgaagcacctccatcttcgattcaccttgattgcttccaccatcaaggatcaccttccatcgacccgaacccaatagatgaaaacattgcaaggatgcattttgaagtggcctttctctccgagaatgcttacaacattcaaaggagattggacgtagagttccaaccttcaatacattggacgcaatttacattggaagttgaagaagaagtagtcagcttcccttcgcctatacataaagctgatcaagccgcatcctcttctactaccctggatccacctacaaggattgaagttcttcctccctccacatggaaaagacttcagcccaaagtttccaagccttcctccactatggccaagcacaaaagttggccaagctattctcctggaattcacattaaaccaaccaccaccatcaagtccatgtcggactgtattgctctgaggttgcctccattggacctcaggaagaagaaagggaaggttcatcctcacaacaagccaatgcctcatcctagtccaaaggataatacctaa

SEQ ID NO: 70467 - DNA, 132 bp, Glycine max
  Peptide Sequence Number=SeqID_187245
atgggtttgaagagcaaaatggatgaagatggagggatagttggtggtgactgtggtggtgaaggtggaggcataggcacaagattcatagaggttgtgagtgcaggaatagtggttagtggtggcagatga

SEQ ID NO: 70468 - DNA, 1333 bp, Glycine max
  Peptide Sequence Number=SeqID_187246
ccatcgtgccggcatttatctgatgcaggaccagcagagcggttcggtcgacagctggaaaagcctggcggcggcagccactacctcattgcagcaggcgcagcagctgtttgctgcctatcaggcgaaaagcgatagcccgctggcacagggcttcgtgctgctggctggcgggctgcaggagcagctgaaagggctggcagccaatgatatcaacgcattttttatggtgccgatgcaggctttccagcagcagttcaacgatgcctggtttagcgaaatcgaacaggccaatcagcagctcggcagcgtcaaccagcattcgctcagcacgctcaagcagagccgcaatctggcgctggcgatcgccgcgttattgatggcgctgctgctgctggccgccgcgctactgatgcgcggcgtgttgctgccgctgcgtcacgccaacgcccagctggcacaaatcgcgacgggcgatctggtcgccagcccggcaccgacgcgccgtcagtcgctggaaacgcgccagctgctccagtccatcgataccatgcgtcagggtttgcagcagatcgtcagcgacattacgacggtagcaacccgtgtggcggccggcgctgacgagatgcagcagcataatcagcaggtgatgcagcagcatcaggcgcaaaatgccagcttccatcatctgtcgcagcggctgcatcgcgtgtcagaagaggtggaaaaaggtgcacacttctcgcaacaggcgacgcacgacgcgcagtccgcggatgcgctgatgcgtcactgcgcccacgaagtcgacaatatggaacaccagatgcagcagatcgtcgcggccgctggcgatatcgctggcatcatcggcatgctggacagcctgtcgatgcagacgcgtctgctgtcgcttaatgcggcgattgaatctgcgcatgctggcgcttacgggcgcagtttttcggtcgtcgccaaagagatgggattgctgtcgcagcagagcggcgcttccacgcggcagatcgacggtttaatccagcacacgcagcagcacgtgcaggatggctttgcgaaggtgcaggcgctggaagtgctgtttgcgcggattggccaggcggtatccggcgtggtcagtcagctgaatgagctgcaggataacagtacggcgcagagccatcgcgtgagcaaaattgcccgggaagtggtggaaatgagtcttcagctccagcaaaacgaagccctgactgaccagcaggtgcaggcagcggcgcagctgagtgaactttcagcgcgactgacgcagcgcgcgcagcagttccgcgttagctaa

SEQ ID NO: 70469 - DNA, 192 bp, Glycine max
  Peptide Sequence Number=SeqID_187247
atggatctgtctctgattgttgatgaggatttcttagaggaagtgtgggcaattgcccttgttgccaggccatattcaccaaaacaatgttgcaggccagagttctcttcttctatgttctcacatcgcagtcaccaaattcagattggcaattcaatcgtgatactaatcctaccacgatttaaagattaa

SEQ ID NO: 70470 - DNA, 1479 bp, Glycine max
  Peptide Sequence Number=SeqID_187248
atgtttatttcatgtcaaaaatacaacctctaccttctttgctcctctgttcccctgcgcaattcaacaacatgcagcattttcaattgtcaaaacccaaacgagcatcactccattctccgccaacccaattccaaatccacagcatatcttcttcaccacctctcccacaaggatgatggggcacccatccccattcccattcccaaacccagcgagcttcaagacccgatgccccacgaagaaaaagtcaaggttttggagctttccctcgtcagaaaaaggagccctcagttccctggctccatctacgctcaatctcccagtgactccgatgtgggttcttctctgccccctctccgcactctgtttcaatcaagtgatggtaaagacaacgaggaggaggaagaggagatgataatgcgcgctcttgagattcgaaggaaggttactgaagaggtttttaaagaagccgtgcgaaaggggaagtttggaatcacttacactaccaatttggttaccaggttatccggtttcattgattacatcatgattgaagctgctaacttgaaaagattgcccgaattttcaaactccaccttcaacttacgcgccaaaattgtcattgatgactctaaagttgtgccacttattagatggttgaagcacaatgcaatatcatttcctcggatagcaaagcttattttgatgtcgagaggaaaccttgaggccgtaaggagttttgttgagtggttgaaatcggtatatgtgaaaggagagtttctcggtgttgtaatggtgaatgctggagataatattttccagcgcagccatgcggagctggatgagattgttctgtacttggagtccaatggagtcaggagggattggatggaatatgtcattagtcgttgtcctcagttattgtcttatagcttagatgaagtgaagactcgtgcacagatctaccatgatatgggcttaaatgagaaggattttggcacaatggtttttgattttcctaaagttcttggttactattctatggaagaaatgaatgcaaagatgactattgtgccaaaggtcattttcttgatgaccaaagctggagtcagtgagaaagatattgccaaggttgtagctcttggacctgagctgttgggatgcaatatagcacataagcttgacgtaaatgtaaaatactttttgtgtcttggcatacgtcttcggcaattgggtgagatgattgctgatttcccaatgctgctcagatacaatccagatgtccttcgtcccaactattctcttgagggtcgaattatcccaagacataaggttctagtggagaatcagattaatattaagctaagatacatcatgttgactagcactgacgaagaattcaacaaaatggtcaagggcataattagaaagcgcctcagatttgaatctgctgtcacaaatgaggatactacttag

SEQ ID NO: 70471 - DNA, 834 bp, Glycine max
  Peptide Sequence Number=SeqID_187249
atggtacgtgctcagctgaaacagattttcctctgcatggggtttgaggagatgccaacaaataatttcgttgagagcagcttctggaactttgatgccttgttccagccccaacaacacccagcccgtgattcacatgatacattctttttggaaactccttcaacaacaaagatattgccagaggactatgttcagagagtgaagcatgttcatgaatctggtggttatgggtctagagggtatgcatatgactggaagagagaggaagcaaataaaaaccttctgcgaacccatacaactgctgtttcctccaggatgctttaccaattagcacagaaaccatttgcccccaaaaaatatttctctatagatcgtgtattcagaaatgaagcagttgatcggacacatcttgctgagttccaccaaatagaaggccttgtatgtgatcgaggactcactctctgtgacttaataggaatcctacatgatttcttctcacgcttagaaatgatttcattaccaagttcaggcatgaccaagctgaagttcaaaccagcttacaatccatacactgaacctagcatggagatttttagttatcatgaaggctttaaaaaatgggtagagataggaaactctggcatgttcagacctgaaatgttgcagccgatgggacttcctgaagatgtccaagttattgcttggggtctttcccttgaaaggccaacgatgatactatacgggatagataacatcagagatctctttggacacaaggtggatcttgggcttataaagaaaaatccagtatgtcgtcttggaattgactaa

SEQ ID NO: 70472 - DNA, 315 bp, Glycine max
  Peptide Sequence Number=SeqID_187250
atggcctcaagctctctcagcaaacaaaaggcttctgactcctcttggacgccaaaacagaacaagctgtttgaaaaagcacttgcaaaatatgacaaggatacccctgagcgctggcagaatgtagccaaagcagtaggtggaaaatctgcagatgaagttaagagacactatgaaatcctcttggaggatctcagacacatagagtctggccgtgttcctcttcccaagtacaagtccacaggaagcagcaccaatgttgatgaagaagagagcttagcaaaggcaaaatttggtataactgctttcacttaa

SEQ ID NO: 70473 - DNA, 408 bp, Glycine max
  Peptide Sequence Number=SeqID_187251
atggtgggagatccagttagcaatttgcctcttcttcggtacgaggttcgtgaggcctgtagaaacagtcctgaagatactaaggagattgtgaagtctatcctaggagtttctgagtgccttggaacaggcaagtatctggggatgccctctatggttgggaggaggaagcgggctgtcttcaactatctaaaagacagagtttggagtaagataaatcattgtaacaggagttcaggaaagtggataaattggttggggtgggatcggttagcagtgcagaaagaaaatggaaatttgtttttgatcaagatgctatggtgtctagagtcttcaaagccaaatatttacccaaaagggctgatcttgttgatgataggaccaaacattggaatctggagcttgctg

SEQ ID NO: 70474 - DNA, 1263 bp, Glycine max
  Peptide Sequence Number=SeqID_187252
atgttgcattgtctcaacacttcggggaatctaggagccacctgttcggacatgacagtgttggaaagacaacgggaagcaaccatcaagtggcagcaacacctccagaacaaccaaccaccctacttaacggactttaacgttaacgttaacgccgtcttctcttcttcttcttcttcttctcagagtcagggcctggtcatgaatatttgcgctgattccgcgctcggcgaggtcctaactcactccgtcaaacccgacccgggtgtctggcccgaattcgacgccggattcggatcctcttccggttttctacccaccatttcgccaacttgtagcagaggcggagacttggtttcacccaaggaaaacatggccagtgcgaaagaaaacactaagaagagaaaacctcagaactccaaggttgttgcggcgagtgataataaacaggacaagagagtcaaagcaagtggtgaagaaggagaatccaaagtaacagagcaaaccagcaacaagaatggcaaatccaacgcaaataaaaacaacaacagagaaacaacctctgcggagacttccaaggataattcgaaaggctccgaggttcaaaatcagaagccagagtacattcatgtccgagcgcgtcgtggacaagccacggatagtcatagcttagctgaaagagttaggagggagaagattagtgagagaatgaagtatttgcaagatttagtaccgggttgcaacaaagttgcagggaaagctggaatgcttgatgaaattattaactatgttcagtctcttcaacgccaagttgagttcttgtcaatgaaattagcggctgtaaacccaaggcttgacttcaaccttgacgaactatttaccaaagaggtgtttccttcttgtgctcaaagttttccaaacattgggatgccattagatatgagtatgagtaacaacccttcgtatctaccatttaattcagcgcagcaacttgtatcgtgctgtggtggactaataaacaacatggggataagccctccaaacatgggactccgaaggaacattagtactagccctgtacctttgcccgaaacgtttcttgactcgtcctgtttcactcaaattctaccctcctcaaattgggaaggtggtgatttccaaagcctttacaacgttgcttttgatcaagggcgaacagcatcttttccttctcagccatttacaggtctagttgaagctagcaatctaaagatggagatgtaa

SEQ ID NO: 70475 - DNA, 847 bp, Glycine max
  Peptide Sequence Number=SeqID_187253
gctgccgtcccttgggacgggcgtgtggggtgctaataccttccccgcacgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaaggatcgtgtggacgggggtgcacactacctacttacgtctaaccacaaggtaaacgaaaagaacgcacgaaatggtgcggtgaccggtcacgtggctccgctttctcccaagaaaccgagcaagtccgtcatctcctcattcttacgggcctcctctgcatcgccgggggatcctgaaggcgcctcccctacctgggcctcgagcctgtctctgggccatgcgacctcagccccaaactgctctggagtagtgcacctagccccggtgggtctcattctgagcgttttgatatatatattgcctactttcaaaaacggaccccgacgggtgcagagaaacgcgaggaactggaaccagagaggcgacatgcaaactgaggcaggatttcaacatccaaaaggtcaaatttttttctcctttgtggctgagtatgaagtcaaatcaaaggaaaaagcccaaatcttctctctcttcattcagaaaatttcagaaacttctccctctttccacgttgcttttctcttcttcttctctaccattgaagcctccattgaagctccaaaaattcctcttcatttctactccaaattgcaaggagaagtcattttcggagtcttggagcacacctctacttcgtga

SEQ ID NO: 70476 - DNA, 537 bp, Glycine max
  Peptide Sequence Number=SeqID_187254
aggttcattccatctgaatttggatcagatcctaccaaggttcgagtatctgagcttggagatggctataatttctatgcacccaaagttgaaattcgtagacttgtggaggctgaaggcattccatacactttcatttcatgcaatttctttatgagagttttgcttccttctcttgctcagccaggctcagatgctcctccaagggacaatgtcaacatttttggtgatgggaatacaaaggttgacgaccctcgcacgttaaacaaagtgttgtatttgagacccccaggaaatgtttgttctttgaatgagctgaagcttgagaaattgcatgtctctgaaggagagttgctccagaaaatcaaagggacatctttccctgccaactttgaaatgctctttatatattctgctttcgtaaagggagatcacacatactttgatattgagtcatcctctggcgtgaatggtacacaactgtatccacatctgaaatataccacaataagcgaattcttagacacactagtttag

SEQ ID NO: 70477 - DNA, 366 bp, Glycine max
  Peptide Sequence Number=SeqID_187255
atggaaaagagcaaaattttggtaattggggcgacaggaaacctgggatacaatttagcggaagcaagcctcatgttttgtcatccaacatttgctcttgttagagactcttctttctctgaccccatcaaagcacaaaagcttcattcactttctcaagccggagctaccattctcaaaggttcgctggaagacgaggccagcattgctgaggctgtgaggttagtagatgtggtcatttgtgccgtttcagccaaacagactctgcatcaaaagcttcttatccgagttatcaaacaagctggctctatcaaggtcatccatgcaattttgtttctctatttctttcttgtctttttgcgttaa

SEQ ID NO: 70478 - DNA, 167 bp, Glycine max
  Peptide Sequence Number=SeqID_187256
atgactccattgatgaagaagatccaaggcctacaagctccacatggagcttacatcaccatcctaggagcaccattggatttaaagcaaccaaagcctcaccaaattttgagtgaacacttgagaaaaaccaaaaggtgtaggtgtgggagctatgttgttgcaag

SEQ ID NO: 70479 - DNA, 216 bp, Glycine max
  Peptide Sequence Number=SeqID_187257
atggaggagcttgccacccagctcgcccaagcgagctcagctcgcccaggcgagccagtttgcttcctccagagacaaccgccttctggtggaagaatctggaaggcccaagttttgaaaaagttacggaaactcacggattgcgtaacaatacttccttttggttttcgtcacattatggaatttcacggattgcgtaaccacgcttccttttga

SEQ ID NO: 70480 - DNA, 1266 bp, Glycine max
  Peptide Sequence Number=SeqID_187258
ctgaaaaacctgttttcggcgtgggaagatgttcgcattgaggtgttcgacggccagaattcagcgctgcgcaaactcacggtttccgccaccgaatggctcaccaaggcgggggcatgggtgaaggccaatcctgagctggtcggcacgctggtgaaagtcacggcgggcgttacggccctgatcggtggcctcgctgcgctgggccttattgcatggccggtgatggccggggtcaatatgttgatcgccggggccgggctgctgggaacggtctttaccaccgttggcgccgggattgcggccgcattcagtgtgatcaccctgccggtggtcgctgcggcggcggtgattgtcggtgtggcgttgactatccgtaaatactgggagcctatcagcgcctttttgaggggcatcggcgaaggcttcagcgccgctttcgcgccgatgcgcgccgtgcttgtcccgctggcaggcgcatttacgccgctgctgaacatggtgcgcaacgtctggcagtggttcggcaagctgatcgagccggtgaaatcttcacaggccgaactccagacggccgcgcgctatgggcgcatgttcggtgaatggatcgcggctggattgagcctgccgctgcagctgttgggcggattgcccggcctgttgaccggcatctggggcgttgcgagcggcattgcggagcgtgccgccgctgtctgggacaccatcggcgagcgtgttaacgcggcatggctggcgctgagcgccgccacggttcaggcatgggatcggctgaccggctggcttaatggcaaatgggaggggctggtaaacggggctaaagcactgccggggcagttcaaagaagccgggatgaacatgatcaacggggtcattgacggcattagcgaacgctggcaggcgctgaaagacaaattttccagcctcacggatatgctgcctgactggatgaagtttggcgacgatgaggcggaggttaacccggcgatttcatacaaccgcccggcacctgagctgatgccggggccgggctatgcaggggcattcgacaagggcggtatcatcccgcgcggccagtttggcatcgtcggcgagcgtggcccggaaatagtcaacggcccggccaacgtcaccgggcgccggaaaacggcggcgctgtcggcggcgatgttatcgctgtcaacgccggtgatggcgtcggccccggctgctgcacctgccacggcgccagccccgatcacgattcag

SEQ ID NO: 70481 - DNA, 396 bp, Glycine max
  Peptide Sequence Number=SeqID_187259
atgaaccggacaggtctgactgaactggaaattgtgctggcggtcgcgcggcgcggcacctttaaagcggcggccagcgagctggagatgtcgccttcggcggtgaccaatgcggttgccgcgctggagaaacggctgggcgtgcggctcttcaaccgcaccacgcgcagcgtcgcgctgaccgatgccggacggcgtttcagcgagaaaattgtgccagcgctggcgatgatccgcagcgcggctgaggaagccggcagcgatccgggcgatccggccggcatgctgcgtcttaacgtgccgccggagagcagcgcgctgtggtacgcatcgatattgctgccgttcctgcagcgctatccgcgcattcgcgtcgatatttacgggatcctctag

SEQ ID NO: 70482 - DNA, 471 bp, Glycine max
  Peptide Sequence Number=SeqID_187260
atggtgcgtgctactttgccgccacgcaacatgcaaaggagcatagccatgcacatgattgaacacatctatatcaacggccagtttgtcactcctgacggcgatgaatggctggatattatcaaacctgccgacggcagcgtaatcggtaaagcgcgtctggccaatgcgcaggatgctgaacgcgcaattgcggcagccgcggcggcgtttcccgccttcgccgcgaccacggtggcgcagcgcatcaccctgctggaacagatgtaccatgcggttaaccgtgccgaaagcgagctgcgcgcggcgatccttgaggagtacggcgcgcccaccgcacgctccgagtggatgagccgctatccggctgatgtgattctgcaggtcattgaagagctgaaacgctatccgtttgtacaacaggcaggccgcgcgcagtgcagatgctgccgctcggcgttgccggcctga

SEQ ID NO: 70483 - DNA, 425 bp, Glycine max
  Peptide Sequence Number=SeqID_187261
cttcttcggttgaatttatacccggctcttcggtgttggctgaaccggcttcgtgttccggttcggaggggctgagattgggttcggaggggcagaaggtgcagcataacggtgtggagaggacgcggcgcatgggggggaaggagagggagaatggggagtggttcggagagaggaacgggaatgggaatgggagggaaggtttggagagaagggaaggatttgggggagaaggaggaggaggagggtgtaagaaaagttaccttatccagggattattgaaattggcgccagctttggagatgttgtgtgtctctacggattttattgcaatttttgcaaatattgttttgttcggtcgtataattacgcttggattgaaaaatgttcgtttcttgcctcttcatatcgtggacatttcgtaa

SEQ ID NO: 70484 - DNA, 354 bp, Glycine max
  Peptide Sequence Number=SeqID_187262
atggcccgcaccaagaaaactggccaaatgatgtctgagccaacaaaggaaattactgacaagattagactcgcgctgcctcctgagcctgaggttgattctttagctgctcgtgtcagtacaaaggaaagatttattgatccctcagggaacgatctagacacgggtgactcagagaattacgggttgcacgttgaagaaaatcctccccgcctagttgccttaggaagactttatgaggggtcaataaccattcacaacatccctttgtgccatgatcaagtcagggttggtgttaaggaagttagctatgcagatgctcccattcatgtacccattgaagaggttcagtaa

SEQ ID NO: 70485 - DNA, 268 bp, Glycine max
  Peptide Sequence Number=SeqID_187263
gtggtgtattttgtttgttgagttggttcttgagcaattcttgcatcagtatggtgacactagtcctgaatctgtcatcaagtggtttgaacaaagggatcgagctgtagacagtaaaggggttgcggaatatcttcgagctcttgtggtcactaatgctattagcgaatatcttcctgatgaggattctggaaaagcttctagccttcctaccctggtattcattttgaggcatcgtgttcttggtatcctgcttttcaatttttag

SEQ ID NO: 70486 - DNA, 363 bp, Glycine max
  Peptide Sequence Number=SeqID_187264
atggccacaagcctttggattatggaccgggcctttgaattgatgcagagaagagtgtgtagccatatgatacatcatcatcttcttcttcttcgttctggacacgcgacaattaacatagggtttgggattgatgcgcagaggaaaacattagataaaaagaaaaaagggaaaaagctatgtgggattaacaatatactggtacttagttgtttattagatgctatatgtgagctaaatctctgttcaaatattaggcgactcatgtttaagaaagaatttgacacaagctatgtgggattcaattctggatcagagcttctctctcgtcagaatttatgtaatgcgtaccttgacttctaa

SEQ ID NO: 70487 - DNA, 714 bp, Glycine max
  Peptide Sequence Number=SeqID_187265
ttgcaagatttgaagcagcgtgcattgggtaactcagatgaaacttttcttagccctggaatatctgacaagctgccactacatgtggttatgttgttctcggaatctcatgaagctgtttcctcctttaggttgatccaaaagtttatgggtgctgctgcacttcaaaaatacattggaagcttgggtgggattggaccttcaggagttggatcaagttcttcctatgccccaaaggagctgaataaggaagtgatgcctgaaaagaatgtaaaaacctttaaggatgtgaaaggttgtgatgatgcaaagcaagaacttgaggaagttgtggagtacctaaaaaatccatctaagtttacacgccttggaggaaagttgccaaaggggattcttttgacaggagcacctggaactggaaaaactctgctagctaaggctattgctggagaagctggtgttccgtttttctatcgagcaggctctgaatttgaggagatgaatatgatgtacaataagctgtttagtcaaaactttttccctaacaaaaacgatatctatctccatatgcttcgttctggcttggagaacaggattataagcaatggccacaatcaaggttatcaaactcgagagtttacgcagactcgtgagagtttcatagacttgattagtgactcaactcgtagactcgtaagagtctacttcatataa

SEQ ID NO: 70488 - DNA, 861 bp, Glycine max
  Peptide Sequence Number=SeqID_187266
atgcctgacggcaaaccggccaatacccgctgcgttcagctcgacgaacagcagcgctgcaaaatttttggctcgccgctgcgtccggcggctgaaacgattcactttcagcaagcgaggagaaatatgttccagctcgaagttcaggccattcacaccggcgccagcgcgtccgataaagaacaggccattcgtcaggttgccgctgcgcttactgcggccggaaatgtggccgaaggctacgtcgacggcatgctggcgcgcgaacagcaaaccaccacctttctcggcaacggcatcgccattccgcacggcaccaccgatacccgcgatctggtgctgaaaaccggcgtgcaggtttatcagttcccgcagggcgtggactggggtgatggccagacagcgtacgtcgccatcggcattgccgctaaatctgacgagcacctcgcgctgctgcgccagctgacccacgtattaagcgatgacagcatcgcggagcagctgaaatctgcctctgctgaagagctgcgcgcgctgctgatgggtgaaaagcaggccgctgaattccagttcgatacgtcgctgatcgccactgacgtggccgccagcgatctgatgacgctgcaggcgctgaacgccggtcgtctgcaggcggccggtgccgtcgacgccagctttgtcgcggacgttgtctcgcacgcgccgctcggcctcggtcagggcatctggctgagcgacagcacgcacggcaaccttaacagcgcggtggcagtgagccgcagcgcgacgccgctgacacatcagggcgaaccggtagcgctgctgctgacggtcgccgccaccgatcagcgtccgcttgag

SEQ ID NO: 70489 - DNA, 549 bp, Glycine max
  Peptide Sequence Number=SeqID_187267
atggctaagcccagcactaccgcgcttagcgagcttagtgcgagattgacgctaagctcaaattcacttactcgcgctaagctcaaattcacttactcacttatgtcgcgttccactagtaatcgattagatcctctggaagccatggataagagcttgaaggtaggacaagaaccaaacccaaacaaccaggctaaacttgacttcaagaacaacccaccatctgcttcattcgaagaaggtgaagttgtacaaatcgtcagatctacacgaatgtccattgtcactgtagaagtttcattgaaagacaaagagcctaaggttcacattcaacacttctttgacattgagtcattggagactattgggtgtattatcaaggcacacctaatgttgtgcaacatccaccgcttcttcgagaacctaaaggtggtggtgcctaaattcatccgagagttctggaggacagccaaggtctatcattatgagctatcagtaaaaaccattgctcaaccattggttgtgagcgtaaaggcaccaagttcatga

SEQ ID NO: 70490 - DNA, 864 bp, Glycine max
  Peptide Sequence Number=SeqID_187268
atggggaaggcgaaggggaagcaccgtttggacaagtactaccacctagcgaaagagcacggttacaggtctcgagcctcatggaagctggtccagctcaacaacaagttccacttcctggaatcggcgcgcgccgttctcgacctctgcgccgcccccggagggtggatgcaggtggcggtcaagagcatgcccgtgaaccaccttgtgatcggcgtggacctctcccccatcgcccccgtccgcggcgccatcgccatccaggaagacatcaccaggcccgagtgcaagtcccgcatcaagaagctcatgaacgaccacggctgccgcgctttcgacgtcatccttcacgacggttcccccaacgtcggcggcgcctgggcccaggaagccaccagccagaacgctctcgttattgatgctgtcaagttggccactcagttcttagcccccaagggcatctttgtaaccaaattgtttgagaaggttgaggtggataagcctgcggctagtcgttctgaatcagctgagatatatgttttggggcttaaatataaggcccctgccaaaattgatccgcggcttcttgatgtgaagcatctctttcagggatctgtggaaccgcagcctaaggtggtggatgtacttagagatagtaagcaaaaaaggcaccgtgatggctatgaagatggagacacaactttgaggaagctgtcttcagctgcaaatttcatttggtcaaattctcctctggagatccttggttcagtcacttccataacctttactgatccagctgattcaccaatcaaggatcatgacctaactactgaagagtgggggtttgagcaacaatcaatgtga

SEQ ID NO: 70491 - DNA, 258 bp, Glycine max
  Peptide Sequence Number=SeqID_187269
atgtctcatccacctctagaacctcacaatcactcacagactcatctcatgctctcaggatggcttcctcttctcgctcagttctctgccagtggccttgttggtgcttttgcacttagtgcaactctggctcgcttagcgcatattagtgaatttcggcttagcgctcgtcttttcgctcagcggatggactcaagcggtgcgcttaacgggattagccctcgctcagcgaacatgcacaactcatccttcttctag

SEQ ID NO: 70492 - DNA, 1299 bp, Glycine max
  Peptide Sequence Number=SeqID_187270
atggatcatgaagttctacaccaagcacctccatcacccatccatcttgatcgtttccaccatcaaagaccaccaaccaaagaccctaacctctccaaagaagacatggcaaggatacagtttcctgtggactttctctttgagaatgcttacaacattcaaaggagattggacatggaattccaaccttcaattgattggacgcaaatgcaattggatgttgaggaggaagttatcacatgcccttcatccatacataaggtagatgaagttgtaccctcctcttctgcattgtatcaacctatagaggttgaaatccttcctccatcaacttggaagcggattcattctaaggtatccaaacctgcatccctagtgaccctttgtaagaatgtttacaagattccatttagggcttgcaaagaattggtcagctatgataaagacatcattggatggagtcaaaagattgatactcaaactgactccaatgttgatatggatcatgaagttctacaccaagcacctccatcacccatccatcttgatcgtttccaccatcaaggaccaccaaccaaagaccctaacctctccaaagaagacatggcaaggatacaatttcctgtggactttctctttgagaatgcttacaaaattcaaaggagattggacgtagaattccaaccttcaattgattggacgcaaatgccattggacattgaggaggaagttatcacatgcccttcatccatacataaggtagatgaagttgtacccttatcttctgcattgtatcaacctataggggttgaaatcctttctccatcaacttggaagcagattcattttaaggtatccaaacctgtatccctagtgaccctttgtaagaatgtttacaagattccattcagggcttgcaaagaattggtcaattatgataaagagatcattggatggagtcaaaagattgatgctcaacatattgacccttcttcttatgaccttttgccaccattcctgcatccaaaacacgtccaactctttactccgatgtcccagtttgtacctttagtctatggccatcaagtcattcccttaacaaaggatcacatcttcaacgttgggatgatcatgatgcaatgcagtctaactgatcaatggccaagttatccccctgtaattcacattttcccaataatagcaatcaagttcatgcccgatagaatagctctcaggttgcctcccttggacctcaagaaaaaaagggaaggttcctccccacaacaaacccatgcctaa

SEQ ID NO: 70493 - DNA, 2292 bp, Glycine max
  Peptide Sequence Number=SeqID_187271
atgaaagctgaacgtgtgagttcccggagaaagtcaatcagtctatcaatcatgatgcctgatgatgttgctgcacaagcatttcatgatggtgatagggttgaagctcaggcaatgcataggaatcaatcggcgtggatggctcattggaagcaaacaagttataaatcagcaacccctgcttgcaagaatttaggggttgattctgaggtgagaaaagagaaagaagacagcggtgctgagcagcatgatttacttggtgggttagatagttccatgcgtgctggagcagttggagaagcagctagggccacaagtgttaccttcagcaacgaggcagacgatgaaaaatctaagaaagcaggctgtgatcccaaaccatttcctacattcaaattttctcgaaagttagatggaagattgtctctgcagagggaacagcacgacggggaaggtggaaaatctgaaaccgaaccctgctctggagatggcaatgtttctctcaacagagctgggacttctggagtaggcttatcattagcatctgcacatgctcctcctaaaatagaagcactagcaaaagagtgccaagtattgtctcaagaagttttaccgacagctctggtgatgaaatctccttgggatgttgaacagaagaacctagctgtttcaacatcaccatggaatgactttgcaaaatcagcttctgacatagtgccaaatggacgtgacaaagggaaaactgtgatgccccagttcacccatgaaccttttgaaatttgtcaatcaagctaccatttagcatccagagggcagttcacaagtaccaaatatcataccttttcatctcttttaatcagcgagaagaaaatgagtagcctcttagatcctcaaaaatcttctttttcaagatggatgcaaggtggtattgctcatttaccgcatgattccatggctggtagtgatgatagattatactttattcgtggtcagcaccatgagattgaaaaatatgttgctaatccaaatattacatgccagactgaatcctcaaagtcagctaaaccacaaaacctttatggactaagctctttggttgcacaagtgccttgttctattcgtgatgtggggtctatgaagatatacaccagtatagattcggttgaagaatcgtcaagaggtcatcccaaaatttcccagacaactcaccattttctaatgtcgaaaaaaactgatgttaacttctctgacagaggtcagttctttagagagccaatagcacctatcaaatccaagggaagtgctttcaatgagatccttgatttctctccacccacgagtggccatgctctgaaaggtctgaagctggaagatctagggagccccataaagagtgaaggaaaggaaaatgtccaagatttcaaatatccaacatgcctgaagaatgagtcatctgctgaaacagatactatggacatggatgctttacataagaataatcctcccggtgatgttccatttcaaacaaataagtgctccaaggatagtcaaaactcgcttacgtctcaaggtgcaacaatttctgctagagagaaaaccatagcaaaatcagtgaatacaacaataccagatataaaccaagagcctcaggagcttcttactgaggaaagtcctgtggttgacagggagactagcacatcaagaacccacagccttgatttggatcactttctttctcatgcagatgagcatgctaggtcaagttctggcaatagttctttaagaacagacccaagcagcagatgggtcaaaagactcaagttgtgcacattgggctctgctaatggtactgagagtacaaaaattggagaaacgtcttcacatgaaaaagttaacaatatacttggcaaaattctgaaagatagcaaaactagtttggaacccaaaatggtacatcatgctgaaggacagatggtaccggatctatctacaacagtatcaacaaatggcaagtcctctttgactgcagcgaagaaaactgtagaaattaccctttcacatccctggattcagagatggagtcatgatcgttctgcatcttcccaaaagaggcatgaaataggggagcttcatgaaccaaagtcttcaactgctgtgctaaaagagttaaaaaaaaaacagtttccgagcattgctgccatggccctgatgggaaaagcaatgaacaatttgaatccctctgagctgataaaaaagggacctgtgatagtttggaatatgaagggattttga

SEQ ID NO: 70494 - DNA, 213 bp, Glycine max
  Peptide Sequence Number=SeqID_187272
atgtgttgcttggtggatttagtgggacccatgaaggtacaagttacaagtggattgttaaatggtgggccacagagctctcctccagattttggacatagagcccagccagcagcattcacggttctcgatttctcatatgtgggcccatttggcccaccatcaaattctgtgtatgtagttgtggatcatctggcaagcaatcgcgcttaa

SEQ ID NO: 70495 - DNA, 147 bp, Glycine max
  Peptide Sequence Number=SeqID_187273
atgtcattgatcaacaatgggagacgtgatgaggggcaaattttgcaacagtgtcatatagtctatgccttggctcagcttctattgcaaaatgcaaatgaaattgaacaggtgaaactaatacatgttatagttaaaaatgtgtga

SEQ ID NO: 70496 - DNA, 150 bp, Glycine max
  Peptide Sequence Number=SeqID_187274
atggagagaggcagaaaagaaaggcctaaggaagtgaaatcttatttttttcctcgttcaaggaaattaaagtacaccggagagaagccttcctatggagaaaggaaaccccttaaagatttacatgtgatatcagagcatgtgttatga

SEQ ID NO: 70497 - DNA, 903 bp, Glycine max
  Peptide Sequence Number=SeqID_187275
atggtacctcaagctttgtcagtgcctgcgagtgccagcttcactatcgcttctcgcaccagaagtccctcccacctcgtattttctcacagaaacccgtgctcgatagcttcttccttaccaaacccatatggccattcatcaggagttgggttatcaagtaaaagccgtggttttcctttaaaacttgatgagaaaaatatccatggtgcgagtacaagttatggtgcaattgaagccaaggggaatccaccaataacacccgcagtgatgactcctggaggacctcttgatctctcatctgttttgtttaggaatcgtataatattcataggacaaccagtcaattcacaagtggctcagagagttatatcccagcttgtgactctagctactattgatgaaaatgcagatatactggtatatataaattgccctggtggaagcacatattctgtgttggcaatttatgattgcatgtcttggataaagcccaaggttggtaccgtgtgtttcggagtagctgcaagccaaggagcacttctccttgctggaggagagaagggaatgcgctacgcgatgccaaatgctcgcataatgatacatcaaccacagagtggatgtgggggtcatgttgaggatgtcagacgccaagtgaatgaagctgttcaatctcgccatgttagtgtttcttcctttgagttgtacaattctaataatttgtacaactttaatgctcctatgatcttgatcatgctggaaatagatgctatccttaagtccctcctcatacttaatccattagagaaggtgcaacagtacacagagagggaccgttttctgtctgtttctgaggctttggagtttggtcttattgatggtgtcctggaaactgagtattga

SEQ ID NO: 70498 - DNA, 564 bp, Glycine max
  Peptide Sequence Number=SeqID_187276
atggctcctactctagcgcttcagtttctttctcttttccttttgttccttatgaatggccagggcattggagctagagatatgaagaaggtagaagcagtagaactccaagatcaaaaagaagtggaatggttcgaagccactgatcctgaatatgtagcttcgtacactgcccatatacacaagcatcaccatgaaaagcttcatcaacctaattacataaccaaatatggtggaaccgttccaaaagatagttccaacattatggaccatacagaggctttcaagacaggatatttcgctttggatgatcgtcatgttgggaacgtgatgaccctccaacttgagacagcaattaaggtgttcaaagtatcactaggtgctgagaatggtgatagcaaaattgaaactcttggtgtttgccatttagacacatctgattggaaccctaatcatattatatttactaggcttggaattaagcctgggaaggctccagtatgccacttcttccctgtaaaacatcttatgtgggttcctcaaccttcacaagccaccaagtga

SEQ ID NO: 70499 - DNA, 210 bp, Glycine max
  Peptide Sequence Number=SeqID_187277
atggagaaagtgactaacccacttgtacacaattcccgttggcatccttcggagttttatttatttcagcaagccacggaaagcattattcctagagcaaaagagttgaagcttccaaaaggttccctaggctttctcaatgcacatttaggacctcaaggcacccaacgctttttcaagttgcgtagctttctcaaggtgttcggatag

SEQ ID NO: 70500 - DNA, 820 bp, Glycine max
  Peptide Sequence Number=SeqID_187278
atggaagcctctcaatctcatttccatgttcgttcaaacagcttgccctctagaccacaccctctcatcctacaatgcaacgagcacttggacaggttaaggtcttccaatgaaacctcctcttcctcttcatcccttagccataagctaggagggttgcaagatctgcatgaatgtgtcgaaaaattgttccatctttccctctcccaagaagcacttcaccatgagtgtcaagaaaaccgggtagatgagcttctgaatggatccttaaggctcttggatgtgtgcacagccgctaaagactctctattgcacacaaaagagtgcatgcgagaacttcaatcagttatgagaaggagaaagggaggtgaagtggagctcaaggcagaggttaagaagttcttgatttcaaggaaggtggtgaaaaaggccatctcaaaagccttggcaaatttgaagggtactagaaaaaattgcaacatctcatctgcaaacaaagacaatcaattggttagcttattagagagcgtggaagtgatcactctatcaacatttcagtcactacttcaattgatctcagggactacacaatcaaagtcaaacagctggagtttggtttccaagctaatgcagaccaagaaagtaggttgctcacaattggcagatgaaagtgaatttgcccaacttgatgaagaattgcaatcatgcatgtttgcccagacaagcaaatttgaaaacacgaataatctgcaaacccaattggagaaagtggagtctctttctcaagatcttgaagaagggcttgaatttctctttaggc

SEQ ID NO: 70501 - DNA, 855 bp, Glycine max
  Peptide Sequence Number=SeqID_187279
atggtagccattgaaaagaaaacccaaagctcactacatcttcgcagaaacagctttcccgccgcagctcaccctcttgtatcacaatttgaggagcaattgcaaagattgaggggttctgaagccacttcttcattgtcatcatcttcagtgtgccacaaacttaatgacatgctggatttgcatgactacactgataagttgcttcaattgccaatcgaacaacaagtcttagcacgagagtgcaacgataaatgtgttgatgacctactagaacagtctcttaggctcttagatatctgtaatacagccaaagagtgccttctgcaatcaaaggagagcatgtgcgacttagtttcagttatccgaagaaagaaaaacaatgaaattggattcacgattgaaggtgcaaaatacttggttgtgagaaagaagatgaagaagcaaattcgaaaggccctggaaaatttgaagcaaaaggacaaaaacacttcaccaatgctcagcttcttgaatgaagcagaagcaatcaccctgagctcattagaacaaatgctactgttcatctctggcccaaaaggacactcaaagcacagcagatggtcagcaatatccaagttgatgcagccaaaaagagtaatgtgtgactctcaagaatcaaacacaaatgaatttgaaaaggtggatgcagctttgcagtctctcatcagtctcaagccttcatctattgagaattttgaaagtcatatggaaaatttggagctgtgcattcaagatctagagataggagttgatcagctctcaagaaaattaattagaaacagggtttcccttcttaacatcttcaaccactaa

SEQ ID NO: 70502 - DNA, 270 bp, Glycine max
  Peptide Sequence Number=SeqID_187280
atgagagggtataatcaagagggcaagctacttgagcgagcatggaaatgggcttttgggttcaaagaagaggttggcatttttcctcaaaagaagagaacacttgagatgaatgtaagaattgagtatgtcgatctaacttccttccattgccagcttctttgcatatgcaagggtaaggctgcgtacaacatccctcccccataccttcgcatagcgaagagcctctgggcaatggggtacgaagttttatacatatcaaagaaatga

SEQ ID NO: 70503 - DNA, 1500 bp, Glycine max
  Peptide Sequence Number=SeqID_187281
atggaaacaagctcaaagaactctctgcacattaggtgcaacagtttaccctctgcacctcacccacttgtatcacaattcgaggagaacttgcggagattgaaggactctgaagccaccagcacttctttgtcatcatctttgataagccaaaaactaattggcttgcaggatttgcatgactatgctgataagttgcttcagttgcccactacccaacaagcctttgcacacaaatgcagtgacaagtgggttgatgtcctattagaagggaagggtgctgacactgaatttgcagttgagggtggaaaatacttggcatttaggaaaaagatgaagaaggcaattcaaaaggccttaggcaatttgaaaggaatgaaaaatgagttaatggtttcttcctcgagcaataatactgagtctttgtttatccttggcatcttaaaagaagtagaagcagccactgtgaggttgctagaatctttgttggtgtttgtctctgacaccaaggggcaatcaaagcagagaagatggtcaataatctctaagctgatgcagtctgatagaatgaattgcgaccctcaagaatcagacacaaatgaatttgtaaaggtggacacagctttgcaatctctcatcagtcacaagaccttatctgtggagaattttcacagccatatggaaaatttggagacatggattgaagatctagaagcttcgccttctgataattcaacttcctcttcgtcgtcattgttcaggcacaaactaactggcttgcagactttgcatgattgcatcgaaaagctggttcgactgcctcttactcaagaggtactagtccaagagcgtcaagagaagtgggtagatgagcttttggacggatcgttaaggctcctagatgtatgtactgtagcaaaggattctctacttcacatgaaggaatgcgcacgtgaacttcaatcaattatgagaagaaagaggggaggggaaatggaggtggcagctgaggtcagaaaatttttggcctctaggaaagtaataaagaaggcaatcctaaaagcattggagaatttgcaggcaactgtgaagaaagcaaaattccctccaagcaacaaggacaacccgaccgtgaccttggctagcttgttcaaagatgtgcaagtgatcactctttccatattggagtcactgctgaacttcatctctggaccagcacaatccaaacctagcaaatggtctttggtttccaaactaatgcataacaaaaaggttactactaccacacaagaatcagatccgaatgagttttccaatgtagatgctgcattgcaatcgtttgtgtttcacatgacaagaaaggcagacagtatcagtcatttgcagaaccaactggaagatctagagtcagtcattcagggctttgtggaaggacttgaaactctttttaaacgttttatcaaaattagagtttcccttcttaacatcctcaatcactaa

SEQ ID NO: 70504 - DNA, 162 bp, Glycine max
  Peptide Sequence Number=SeqID_187282
atggacttaaaagatgcaagccacacgtaccacaaagaaggtgcaggcaccaaacaatatttgatgaaaaggagcttgcttggaagggaagtatgcaatgcagttgttgacttgcctttgcaattacatggttggagtttgaagacattggtgaactcatga

SEQ ID NO: 70505 - DNA, 165 bp, Glycine max
  Peptide Sequence Number=SeqID_187283
atggagcagagacatgtcaaattttcatattctataatctacatctccaaagttcagaacttgatgtgcatgactgcactcaaatggattgatgaactactagaagggtctctgaagctcttggatttctacagtatagctatttattcacaggagaggtgctga

SEQ ID NO: 70506 - DNA, 879 bp, Glycine max
  Peptide Sequence Number=SeqID_187284
atggctacaaacatgaaaacttcattgcataatcgctccaatagtgtgccctctgcacctcaccatttcatttcacaatacgatgagcacttgctcagattgaaggcttctgaagccacctcatcatcatcatcatcgataagcagtaaacttgatggtttgcatgctttgtatgaatgcacagataagattcttcaattgtcaaccatacaacaagcattggcacaagaatcctgcaaaacacgggtcgatgagttactagaagggtctttgaggctccttgatatatgtagtgctaccaaggatgtcctgctacaatcaacagaaagcataaatggacttcaattaagtgttcgcaggaaaggtggtgaagcggcattcaaagttgagggggccaaatacttgtcatcaaggaagaaggcaaagaagactattcagaacgccttggaaaaattcaaggggcttaagaatggtcttattttaacttcctcaaacacagacaatgagacactttcaatgatcagcaacttcaaagaagccgaagctgtcactctggttcaacttgagtctttgttatcttttatctctggctcaagaggaaaaccaaaagagagaaggtggttaattgtctccaagttgatgcagcctaatagagtatactgtgattctgatcaatcaaacacaaatgaatttgaggagttggataatgtattgcagtctctctttcacaagccttgcagtaatatgtctgttgagactttccgaaaccatatggaaaatttggagttgcgcattcaggatctagagggaggaattgaacgccttgaaaggcaactaattaggacacgagtttctcttctcaacatctacaatcactga

SEQ ID NO: 70507 - DNA, 396 bp, Glycine max
  Peptide Sequence Number=SeqID_187285
atggcagccattgaaacaaacacaaagagctccttgcatattcgcagcaacagcttgccctctgcacctcacccctttacatcacaatttgaagagcatttgcacagactaaaggattctgaagccgccttgtcttcaacatcaccttcgataaactacaaactcaatgccttgcaggatttgcatgaaagcatgcatgaacttgagtcagctattcgcaggagaagagatgataccgaggccggactcacaattgcaagtggaaaatacttggcatctaggaagcaggtgaaaaaagcaattcggaaggccttaggaaatttgaaaggattcaagatagttggttcttcaaacaaagaacatgactcatgtgataaactcatcccttatctctaa

SEQ ID NO: 70508 - DNA, 273 bp, Glycine max
  Peptide Sequence Number=SeqID_187286
atgcatttcgtgctcggaatttggggatttagttggggttggttcttcggtggatccgaagtaggcagcagcaggagtacgaggagatgcttgtcccgcacacggatttggctgagaataatcaccaacccatggaagcttgctggtgtacatctctctacactgatcccatccagaagcgatgatgcaatcagccttgtgatgagttgcttttacatcctttcatcccttcgcaccagagctctaaccaaaactccactatctggtttgtaa

SEQ ID NO: 70509 - DNA, 213 bp, Glycine max
  Peptide Sequence Number=SeqID_187287
atgccccaacgtggcttctatgcttatcccgcaatcaacgtaggcatcaaaggacgattcagatcaaattttatacccacatcaccaaccgatcatcgccaccagatgaaggatagagccaaggagctcaaggtcttgctcaagaaaggggtgaagattgtgggagattcatgcaagaaggggtggaacaaagtcaaacacatcaaacgctag

SEQ ID NO: 70510 - DNA, 282 bp, Glycine max
  Peptide Sequence Number=SeqID_187288
atggagaaagcagaggctatcatgcagaaaatgcagaaaattaaagagtacactttcatggaggctctaatgctagaaataatggagaactttaacatagataggatggagaatttacaaacacaacggaagccgatagcccgggcaattggagaatggttaacacaccatgttgaggcaaatggttattttaaagctggccatcttgaaaagtctttgacagtgttgaagaaatcggggcaattaattgaagccaaaaagaggagggaggaatacctatga

SEQ ID NO: 70511 - DNA, 1176 bp, Glycine max
  Peptide Sequence Number=SeqID_187289
atgagaaggaaatgggatgaggaattaactagttttgctaaaggtagcatcgatgttgccattgtaaaggaattttacgcaaacgtctacgacctagaagataactcacctaagcaggtgcgggtcagaggtcacttgattaagtttgatgaggccacactgaatacattcttgaggacccctgtaatcatcgaggagggggagacattatcagcttactctagatttgcactcttgaggcctgatcctcaagagttggctactaagctctgcatcctggggaggggatttgaactgaatgctgatggtcagcctctgaagattttaaggaagaacatgatcacacttgctcagacttggagtgttctttcttacgccaacttggtccctacctcccacacttctgacatcacaatggatcgggccaagttgatttatggcattatcatgaagatggacatgaatctgggctacctcatctcccgccagatttctatcattgcccaacatgactcctctaggcttggatttccagccttaatcacaactttgagtaaagctagaggagtcacatcagattctagatcgttggagagtcttatccctgccattaagttggcatatataaagaagaactattggaatctagatgatccaacagtgacattcagaggagggccaaggaaagccaggggtaagagatctaaggctccccctatttcagcagcaccagatgcttctactccttcttcatctactttaccagatccttcagcaccatccacagtttccagttcagctcccagcttcttctactcctgcatcagatttcttgtttactccagagatgcttcactccatgataccgagcctccacagaggacaagttattcttatgcagagtttttagagtctaggcctgccttctattatgcctatggaggatttccatgcacagcccaggaacttgactctgctaagccagtggaggagcaggcagtagaggagccaatttttgtagaggatgagctcactcctcttgagcccttttcatttgctgcagatacatctatggctcaggaggaggagacttctccagatcccatgccagagccattccctgcacctatatctgagggcaccatgccattagcactagccatggagccagagtag

SEQ ID NO: 70512 - DNA, 279 bp, Glycine max
  misc_feature (75)..(75): n is a, c, g, or t
  Peptide Sequence Number=SeqID_187290
atggctccggatagaatgcaactacaaatcatgtgtaagagggagcatagatctttcaaagaatacacccaaagntggagggatctaatagctcaagtagtgcccccaatgatggagagagagatgataataatgatagtagacacactacctgtgttctactatgagaagattgatgtagctccatgtgaagcttgtaggccttggatcttcttcatcaatggagtcctttgcttcttgaagtttaatggcagcagaatgaagaaggaagaaagatga

SEQ ID NO: 70513 - DNA, 249 bp, Glycine max
  Peptide Sequence Number=SeqID_187291
atggctccaaagaagcttcttactaaaaggactaggaagactaccgctaggggggatccagtgcagccccgcaagcgaagattgaagagacgggtccaactaagagaaggggaatacacagaattccaggaggaggtcgccaggaggcagtggacccagctgatagagcctatggctaagtatgaccctaagatagtcatggagttctatgcaaatgcctggcccaccgaagaaggagtcatggattag

SEQ ID NO: 70514 - DNA, 270 bp, Glycine max
  Peptide Sequence Number=SeqID_187292
atggcaccaggctatgtgaagactgatctaggtctggatagcgtaggccagctggcatttaggcagcgggagatcagaattatggtcgctggaagggatgttgttgaggagaagcatcatccagatctttgtcaagtggtcatgttagtgtggagcacagtagctggcctatggcctcctcatcaaatcctaagacctagcttcttctctcgctgtactcacaacactgcccctcctctaggactaacagatgccccaggaattggttga

SEQ ID NO: 70515 - DNA, 1317 bp, Glycine max
  Peptide Sequence Number=SeqID_187293
atgctgattaaccttggcgcctacagcactgaaatcatccgtgccggcatccaggtgacaccgcgcgggcagtgggaagccgggcgcgtgctcgggctgagccgcacgcaaaccttcatccgcgtggtgctgccgccctcgctgcagcgcatttatccggcgctggtcagccagtgcatcattgtgatgctcggctcgtcggtggtgtcgcaggtctctttatctggtgaccacgctgatctatctggcgttgtcgattgccatgcgtcagctgctgctggcgctgggtcgcaaatggtttggagcgcagccggcatgacaacgtttactgactgggacatcctgcgcaacctgctgctggcggcgcgctggacgattttgctgtcgctggtggcctttttcggcggcacgctggtgacactgccgctgctgtttctgcgtctgctgcagcgtcgctggctcacccgcctgatccgctgctacaccgagctgtttcagggcacgccactgctgatgcagctgtttctcgccttcttcggcgtcggcctgttcggcatcgacgtcgcgccctggaccgcggcgtcgctggcactgacgctgtataccagcgcgtttttactggatatctggtacggcagcattcgcgcgctgccaaaagggcagtgggaggcgtcgcgctgcctcggcctgaactttggccagacgctgtatcgcgtggtggcaccgcaggcgatccgcatcgccatcgcgccgaccgttggctttgccgtgcaggtgatcaagggcaccgcactggcgtcgattatcggctttgtcgagctgaccaaagccggcaccattctcaacaatgtgacgtatcagcccttcaaggtgtttggcctggtggcgctcgccagtacctggagaaaaaattcaatgccgctcatcaccattaatcaggtccagaagtactacggtgataaccacgtactgaaaggggtcgatctggatatcgacaacggcgaagtgatttccatcattggtcgcagcggatctggcaaaagtaccctgctgcgctgcatgaacgggctggaaggctatcaggaaggcagtattaaactgggcggcatgacgattaccgatcgtgaatcgcaggcgcgtgaaatcagccgctcggtgggcatggtgtttcagaactttaacctgtttccgcacatgaccgcgctggaaaacgtgatgctggcaccgcgccgcgtgctgaaaaagagcgaggcggagtgccgcacgctggccacgcagatgctggaaaaagtcgggctcggcgaacgcctcaattag

SEQ ID NO: 70516 - DNA, 1152 bp, Glycine max
  Peptide Sequence Number=SeqID_187294
atgccctggactgagactgttaccatgcaacgccttgaattcatcctcgcctgccaggcaggcggggaatccatgacgcagctgtgtcaccgccacggcatcagccgcaaaaccggctacaagtggctcagccgctttaaccccggcgagctctcctcgcttgaaaatctctcccgcgcccgccatctccagcccgataaaatcgcccccgacatcgccgcgcgccttgttcagttccgccagcagcaccccgactgggggccaaaaaaaatccgccactggttcctcagcaacggcgctgacttcatcgtgcccgccgccagcaccatcggcgacctgctgaaggcggcgggaatggtgcagccgcggacgccgcgtaagcgaacgccgggcaacctgcgcagtctcacgacacccgtgaggaataaccacgtctggagcgctgattttaaagggcgcttccgcctgaaagacggcagctggtgccgccccttcacgctcaccgataaccacagccgctacctgctgtcctgcgagccgggcacgtcggagaccacggtgttcgtgcgcggctgcatggaaaaggccttcctggaaggcgggctgcccgacgttatccgcaccgacaacggctcgcccttcgttgcgccgggcatcctcgcgctgacgcagctgagcgtgtggctgataaaactggggatacagccggaaagaaccgcaccgggctgtccggggcagaacgcccgccacgagcggatgcaccggtcgctgaaggtcgccatgagccatcacgacgtctttggctcgctgccagagcagcaggcgtggtgcagcggatggcggaacgagttcaatcaggaaaagccgcatgaggcacacgggcagcagccgcccgcaaaaatatggacgccttcaccgcggaaatggaacggaaaagtgccggaggtggggtatccggagggggcgaagctgtacaaagtcggtgaaaaaggcgacctgaggctgaacgggcggaccttcctgagcgcagcgttacggggcgagtacgtgcggttcctggaagtggacgacggcattgacgtcatcctcttcgacaggctcatccttgcgtattatgaccgggcagaaaagcgtattatccggatcgactga

SEQ ID NO: 70517 - DNA, 612 bp, Glycine max
  Peptide Sequence Number=SeqID_187295
atgtctaaactcgacctgcttgactcacagaactcaaccctgatcttcatcgaccaccagccacagatggcgtttggtgtcgccaatattgaccgccagcagctcaaaaataacaccgtcgccctggcgaaagcggggaaaattttcgacgtgccggtgatttacacctcggtagaaacggaaagcttcagcggctacatctggccagaactgctggcggtgcacccggaatcgaagccgattgagcgtacctccatgaactcctgggaagacgcgaaatttgtcgaggcggtagagaaaaccggccgcaaaaaactgatcatctcggcgctgtggaccgaagtgtgcctgactttcccggccctgatggcgctgaaagccggttacgaagtgtatgtggtgaccgatacctccggcggcaccagtgttgatgcgcacgaacgttccgtacagcgcatggtgcaggcgggtgcggtgccggtgacctggcagcaggtgctgctagagtaccagcgcgactggtcacgcaaagagacctacgatgcggtgatggatctggtgcgtgagcacagcggtgcctacggcatgggcgtcgactacgcctacaccatg

SEQ ID NO: 70518 - DNA, 525 bp, Glycine max
  Peptide Sequence Number=SeqID_187296
atgagttccacagaggtcgcagccacaacgaagaagggtggaagagggaaacccaagaccacaaagtccgtttcccgttcctccaaagccggccttcagttccccgtcggccgcgtcgctcgctacctcaaggccggtcgctatgcccagcgcgttggttccggttcccctgtttacctatctgcggttctcgaataccttgccgctgaggttttggagcttgccggcaacgctgcgagggacaacaagaagacgaggatcgttcctaggcacattcaacttgcggtgaggaacgatgaggagttgagcaagctgatggggtctgtgaccattgccaatggtggtgttctgcctaacattcaccagaatttgttgcccaagaaggccgctggcaagggaaagcccgagattggatctgccattgactccaccttgattgtttttctggtattgaaagtggtgaatgcaggggctgacaatttggtggttgttgtggtatgggatggagagaactcagagcagtga

SEQ ID NO: 70519 - DNA, 273 bp, Glycine max
  Peptide Sequence Number=SeqID_187297
atgaaaacaggggaagtgaatattggtctgaagaaggattatagaagatgtgaaacagagattttaagcgaaaaaccacatcgtgtgttacgcaggtgtgagactgagaatggaaggaagagcatcgaacctgctactattcaagaagtggcgcaaatttcgtgccctgaagatgggatgagtaacgaagagtttcgtcaaactgtggaggctttcattgctaggcaacagaggatgcgaagagaagaagaggaagattattatttaatgtga

SEQ ID NO: 70520 - DNA, 216 bp, Glycine max
  Peptide Sequence Number=SeqID_187298
atggtgaaagaaaaagaagtagcagaaactgaaagtgaacgagaaaacggtcccgaatgcagagctttcgatccttttgttggtagaaaaaacaacggaaacaaagaaagagaaagaaaagagagagaagaaaatccaaaaccacagttgacgcgaaatgccgccaaggagcgtatgcgtggattgttccccagtgtacattaccgtatagtgtag

SEQ ID NO: 70521 - DNA, 1575 bp, Glycine max
  Peptide Sequence Number=SeqID_187299
atggcaagtgattctcttgtgatttccaatggcaatggcaattccaagtcagagccgcatccgcagaggacttaccaagcagtagtggttgcaaccagagatatgggcatttctaaggatgaaaaactgccctggacattacccactgatctcaatttttttgaggagatcactacaacaacatctgatccggggaagaagaatgccgttgtgatgggtaggaaaacatgggagagcatccctcctgagaataggccgcttcctggccgccttaatgttgttctgactcgctcgggtagctttgatattgcaacagctgagaacgttcttatatgtggaagtgtgtcttctgctatggagctgttggcttcttctccttactgcttatcaattgagaaagtatttctcacaggaggtggagagatatttagagaggctcttaatgcacctggatgtgaagctgcccatattacagaaattgaagcaagcattgagtgtgacacttttatgcctcgagttaatacctctgtatttcagacatggtattcatcattccctttggtggaagacaacctccgctattctttcaccacttatgtgcgtgtaaggagttttccaccagagtccccggatcagaatgctgatccattttttgataataattcagacgctttgaaatttgaggtcaagaaattttcttttcttccgaaaatggtttatgagagacatgaggagtttaagtatcttaggttggttcaagaaatcatttctgaaggtacaactaaggatgataggacagggaccggtaccttgtcgaaatttggctgccagatgaggtttaatctgcgcagaaactttcctcttctaacaacaaagaaagtattttggcggggggttattgaagagcttctttggtttatcagtggctcaacaagtgccaaggtgctgcaggaaaaaggcattcatatatgggatggcaatgcatccagagacattggtttgacagacagggaggagggtgacttaggacctgtttatgggtttcagtggaggcactttggagccaagtatactgacatgcatgctgactactccggccaaggatttgatcagcttttagatgttattaacaagataaagcacaatcctgatgatcgaaggatcattctctctgcttggaatccatctgatcttaagttgatggcacttccaccctgccacatgtttgcacaattctatgtagcaaatggggagctatcatgtcaaatgtatcagcgatctgccgacatgggcctgggtgtcccatttaatattgcatcttatgcgctcctgacatgcatgattgctcatgtttgtgaccttgttccgggtgattttatccatgttatcggggatgcacatgtttaccgcaatcatgtgagacccttgcaggaacagctccagaaccaaccaaaaccttttccgattttgaagataaacccaaagaagaaagatatagattcttttgtggcttctgatttcaagctcataggatatgttcctcaccagaagatagaaatgaagatggctgtttag

SEQ ID NO: 70522 - DNA, 1716 bp, Glycine max
  Peptide Sequence Number=SeqID_187300
atgtctatgtcgtccgcacctattacagatcatcgacctgttaaaggtggtcttgagatggaatatgtagaggatgataagaaaaaaaagcttggctctttaaagaaggtagcaatcagtgcatcttcaaagttcaggcattccttgcaaatgaaggggagaaggcatagcagggttgtgtctgttgctattgaggataacgttgatgcccaagagttgcaagtagttgatgcttttcgccaagcacttatcttggaagagctattacctgcaaaatatgatgatcaccatacgatgttaagattcttgagagcaaggaaatttgacattgaaaaaacaaaacaaatgtgggcagatatgcttcagtggaggagggagtttggtgctgacaccatcatggaggattttgaattcaaggagagagatgaagttcaaaaatactacccgcaagggcatcacggagttgataaggaagggcgacctgtttacatagaaaagttgggtcaggtggactctaacaagctgatgcaagtaacaactatggatcgctatcttaagtaccatgttagagagtttgagaagacattcgttgttaagttccctgcctgttcaatctcagcaaagaagcacattgaccaaagcacaactatcttggatgtgcaaggagtgggtctcaaaagtttgaacaaagctgcaagggatctcatccagcgtcttcagaagattgatggtgacaactatcctgagtccttgaacagtatgttcatcatcaatgctggttctggatttagaatgttgtggaacagtattaagtcgttccttgatcctaagaccacctccaaaatccatgtcctaggtaacaaataccagagcaagttgcttgaaatcattgatgccagtgaacttccagagttcttgggtggtacttgtacctgtgcagacaaaggtggctgtatgctttcagacaagggaccatggaatgacattgaaatcttgaaggtaatggttcaaaatggcgaaggaaaatgcaagaggaaaaccttatctgggattgaagagaaaacaatcattcaagatgaaatagcatgccaaaaggaacacgatcctttcaacaaagaatctgtgcaactcggcgctgttccagaagtcgcctttgtcccagtgattgacaagcaagttaatgcatcttgggaaaaagcggtacaaaataatcaacttgcagcttctaaagattgtttccctagcgatgcttccaacacttttaacggttttaggattccatttactggtggaatcattaccattcttatgggagtgataaccatgctccgcatgacacggaatatgccaaggaaagtcactgaagccaccgccttgtatgctaaccctctatattgtgatggcaacatgatgaaagcacctgccatttccatgaatgatcaaatggccctgatgaagcgcatggctgaactcgaagagaaggtgaatgtcctctctatgaaacctaccatgccacctgaaatggaagaattgctgaataatgctcttaacagagtcaacaccctggaacaagagttggatagtaccaaaaagtcacttgatgatgcccttgctcgacaagtggagcttcaagctcaccttgacaaaaagaaaaagaagaagaaattcgtaggtcgtctgaactttgacacttatttaatacttttccgctggtaa

SEQ ID NO: 70523 - DNA, 192 bp, Glycine max
  Peptide Sequence Number=SeqID_187301
atggcgcgagtggtgagaatatggagtcgcgcgcgtggagctgggaataagaagagaatgttcgggaatcacgaggaggaggaagagaatggatgtacggtgacgggaatagccggtgaaagtcagggacagctgacacgtggcggtggaaaggcaattaattgggaacggcccaatgatttggtcagatag

SEQ ID NO: 70524 - DNA, 252 bp, Glycine max
  Peptide Sequence Number=SeqID_187302
atgtcactacctgaaaaagcaaagagaaatggcagaaagcaacatggcattgtctttgggcaacgaacctggggttatggtttcatgaagatctccattaattctccatccatgataagttcatatcaactgatttgtgccaatatgctacattccaacatatacgtactatatgttttgtcaccatcaattccaccgttcaattttgcagggcaccccaaaaacctactagctccacaccatcatggatga

SEQ ID NO: 70525 - DNA, 225 bp, Glycine max
  Peptide Sequence Number=SeqID_187303
gactacatgcagccggacatcccacaggttccagtgacatttgacccccctcaacatgtagtggtgatcgcagaaaggttgaagcgtgtgctctaccttaggatggtcactgcagggacagagttacatgatatcattcaagattgcctgaggatcgccaggggggtgccagcgcagatggaagtgttagggctcaacaaagacgatgcacagagcatagatgat

SEQ ID NO: 70526 - DNA, 234 bp, Glycine max
  Peptide Sequence Number=SeqID_187304
atgtacgtgcgttattcaagagtatacaatgaagttgggtcgttattcgtcgccgaagaagaaggaagaacaaccaccaacaacggaccacgagccaccaagaagatgaaaggaccacgagtagcaatacagtggcaacaacgaaggaccacgaaccaagccaagcacccacaaagaaaagaggaaaaagaacaagcaaataagaagaagaaagcgacacaggagaatgaatag

SEQ ID NO: 70527 - DNA, 261 bp, Glycine max
  Peptide Sequence Number=SeqID_187305
atggcgaagagcaaccgttccgatgctaccggaagaacttcttcggaagaaccttgtttcggtagaacgatttgttctaccggaagaaccttattccagagaagctatcggaagaagttatttcggcagcttttccggaagatggttcttctggtagaacaaaatattctttcggagaagctactgaaagaaggttcttccgaaaaatctaccggaacaagttcttccggtagcttctccgaaagaaccttcttttggtag

SEQ ID NO: 70528 - DNA, 357 bp, Glycine max
  Peptide Sequence Number=SeqID_187306
atgatgacaatacagaaggaccaagatgccattgatggagttatggaggacaagggtgagccaaaggatgacggcaacacagagggaaatggttacactgaggaagagttcgtagaggacaattactatatgaatgatgacagtgactcagaggacaatggtggcatcgttgatggcttcaaggtgctttacaaaaataagagggagtgcgtaaagatggagatagtgttcacggtggattcacactccctctataccagtgtcgtggttgctcctgatgttagggacatgctaagtgcacccagcaatgttgttggtgcacccagcaattttttgaaatggaaaaattgcccttaa

SEQ ID NO: 70529 - DNA, 492 bp, Glycine max
  Peptide Sequence Number=SeqID_187307
atgaagaatattgtatgggatgaccaattaaaatccaacaacacaataattgatgaaaataagaagggcagctcactagagcttggtgcaaccttaaaagaagtaacatgtgtttatgatgttggtggacgtaaaaaaataaatgggctgaaaaatgggttggatagatgtgagaaaatcgcaaaatgcacgatagttatcaaagtttcaaaccaagactcttgtgcagttaatctatcaattcaagagacacagatgtgccagatggagatagcaacaaatagctctcttttcgatccaaaaagatccttgatgaccaagtcaaatcctaaaagtcaaacatgcactaaaaaagcttcatttagcatcataggtcaagccagcatggctcctatacacataaaacaccgagggcaaaaaagttcgacaaaaagaataaaatgcaatgtaatgaacaaaaacaaagatctaaacaaccaaaaatacaaataa

SEQ ID NO: 70530 - DNA, 399 bp, Glycine max
  Peptide Sequence Number=SeqID_187308
atgtccgaggtttgtgatggtgctgtcatggaaggtggaagcaaaggggcttgtggcagtttggtgcgtgaccacacaggagcttttctctgtggagtaagcattaacattggtaaaggttcagttttggaagaggaattgaagggtatcctctttggcctgaagctagcttggtcgagagggtatagaaggatccgggtggattcagattcactggtcgcgataaagctcatgtctaaaggttgctgcatgcgtcacccattttataatctggtccaggagattcatgcagtgcatggctatcaggggaacatttattggaatcatgttctacgtgaagctaaccaggtggcagatgctttggctaagaaagctattacgactttaagtctttatcaa

SEQ ID NO: 70531 - DNA, 340 bp, Glycine max
  Peptide Sequence Number=SeqID_187309
atgagactttttcgcagtctcggtcggaagacgctgacatctccggggaagtctcggatggaagacgctgacatctcaggggaaagtgcagatgacgattctcgaccgaaagatgctgacatctctggggaaggtgcagatgacaacccggaagatactaagatcttcggggaaggtgcagattacgattgtcgcaacctacccttcggcgggagggtgacgcgtgactcgcgggtgcgtgttccaagaaaggaatacgtgcgaagtctccaccaacgtttatttcaagaaaacgtcggaaaaactggaaaagacgtgatctacgaacttaaagtgaaag

SEQ ID NO: 70532 - DNA, 1185 bp, Glycine max
  Peptide Sequence Number=SeqID_187310
atgatgagcaagaacactcactgccacagcgtttctactcaaacgatgcctgaaaccaccgccaagattcccaaacttgtttctccaaccggcgatgaatacccttcgtgccattcgttggcggtcttaccatacgatctgatatgggagatcctccttagggttccggtgagatcccttattctgttcaagtgcgtctgcaagtcatggaaaaccctaatatctgatccccaattcgcaaaggaccacctttgcatttcaaccgccgatccaaacatgactcatcaacgaatagtcgcccgccatcaccgtgatatcctatcattctcggtgcaatcgctgctccaaaacccatcaaatcctgctaaacctcatagctggaggatgagtcacaagtactgcattgtaggttcttgcaatggcttactttgtttgtctcgttttaaacatggttattgcagattgagattgtggaacccttgcaccggattgaaatccaaaagattgtcgatcggcttttaccctgttgatatcactttccatggtcttggctatgatcatgtgaatcacaggtacaagttgctagcaggtgtggtagattattttgaaacccagaccaaaatatattcctttggttcggattcctctactttgattcagaatcagaatttaccgcgtgaacccatcaggatgcaagggaaatttgtgagtggcactctaaattggataattgagaaaggtacaagtgatgatcatcaatgggtgattctttcccttgatatggtgacggagacatttggtgaagtgtttcttcctaaatgcgtcgaggacagtgaaaagatttgtcatcccattctaggtgtctcgcgtgactgtctttttgtttgtttcttagattcgaagaaagctcattggagtgtgttgatgatgaaggagtatggagttcgagattcttggactaaattgttgatgacccctcacattagtatcttcagaacacaatatttatatcccttgtttgagaccttgcgcatttcagaaaatggggttgttctcctgagaacgcgtaccaatttacttctgtataattccaatgacggttggttggtttatcctaggattaggcgcaaacttgggttcgacatgcatatttaccatgaaagtttggtttcaccaaagagttaa

SEQ ID NO: 70533 - DNA, 2925 bp, Glycine max
  Peptide Sequence Number=SeqID_187311
atgcttcaacttctcaatctctcttccaccaatgtctctggctccattccaccctcttttggtcaactctctcatcttcagcttcttgatctatcctcaaactctctcactggttccatacctgctgaacttggaaggctctcttctcttcaattcctttacttgaactctaacagattgacaggaagcattcctcaacacctttccaatctaacttcacttgaagttctttgcctccaagacaatcttctcaacggttcaatcccatcacagttaggctctttgacatctctgcagcagtttcggatagggggcaacccatatctcaatggagaaatcccctcacagttaggcctactcaccaaccttaccacttttggtgcagctgccactggactttctggtgccattccctctacatttggtaacttgataaacctacaaactcttgcactttatgatactgaaatttctggttcaataccaccggaactcgggtcgtgtttggagctgagaaatctgtacctatacatgaacaagctcaccggttctatccctcctcagttgagcaagttgcaaaagcttactagcttgttactttggggaaatgccttaactggtccaatcccagcagaggtttccaactgttcatcgcttgttatatttgatgtctcttctaatgatctctctggtgaaatacctggggactttgggaagctggtggttctggaacagcttcatctatcagacaattcactcacaggtaaaataccatggcagttgggcaactgcaccagcctctccactgttcagcttgacaagaatcagttatcaggtaccattccatgggagttaggcaaattgaaggttctgcagagttttttcttgtggggtaatttagtgtctggaaccataccatcctcttttggaaactgcacagaactatatgcacttgacctttcaaggaacaagctgacaggttttataccagaagagattttcagcttgaagaagctgagtaagcttctgcttctgggaaattcattgacaggaaggttgccatcaagtgttgcaaattgccagtctttagtgaggctgagggttggagaaaaccagctttcggggcagattccgaaagagataggccaattgcagaatctggtgttccttgacttgtacatgaatcgtttctctggaagcataccagtggagattgccaatatcacggttcttgagctgttagatgtgcacaacaactacctcactggggaaattccatctgtggttggtgagcttgaaaatttggagcagcttgatctcagtagaaacagtttgacaggtaaaattccttggagctttggaaacttcagctatttgaacaagctcatcctcaataacaacttgctgacaggatcaatcccaaaatccattagaaatttgcagaagttaactcttcttgatttgagttacaacagcctttctggtggcatacctcctgagattggtcatgttacaagcttaaccatcagtttggacttgagctcgaacgcatttacgggagaaatcccagattcagtgtctgctttgacacagttacaatcacttgatctttctcataatatgctttatggagaaatcaaggttctggggtctctcacgagtctcacttctctcaatatctcctacaacaacttctcaggtcctatcccagtaactccattcttcagaactttatcttctaattcatatcttcagaacccccagctttgtcagtccgtggatgggactacatgttcttcaagcatgattcgaaaaaatggtttgaaatccgcaaaaaccatagctttggtcacagtcattctagcctcggttactataattctcatttcatcctggattctagtaactcgtaatcacggatacagggttgaaaaaacactgggggcatcgacttccacatcaggtgctgaggatttctcttatccttggactttcatcccatttcagaaaataaacttcagcattgataatatcttggattgcttgagggatgaaaatgtcattggaaagggttgctcaggtgttgtgtacaaggctgagatgccaaatggggagttgatagcagtgaagaagctatggaaagcaagcaaagcagacgaagcagtggattcttttgctgcagagattcagattcttggatacattcggcacaggaacattgtgaggttcataggttattgttctaacaggagtattaatcttcttctctataactacatcccaaacggtaatctgcgacagctgttacaagggaacaggaacctagactgggaaacaagatacaagattgctgttggatcagctcaaggtctagcttaccttcaccatgattgtgtccctgcaattctccatagagatgtgaaatgcaataacatactcctagactccaaatttgaggcatatctggccgatttcggtcttgcaaagctaatgcattcaccaaattatcatcatgcaatgtccagagttgctggttcctatgaatatggctactccatgaacataacagagaagagtgatgtctatagttatggggtggttttgctagagatactaagcgggcgtagtgctgttgaatcccatgttggagatggtcaacacatagtggagtgggtgaagaggaagatgggaagctttgaaccagctgtatcaatactagacacaaagctccaaggtctgccagatcaaatggtgcaagagatgcttcaaacacttggcattgctatgttttgtgtgaactcttccccggcagagcgcccaacgatgaaggaagtggttgcactactaatggaggtcaagagccagcctgaggagatgggcaagacctctcaacctctaataaaacagtcctcaaatcaaagctga

SEQ ID NO: 70534 - DNA, 705 bp, Glycine max
  Peptide Sequence Number=SeqID_187312
atggagggggaggggccgaagaaaggagaagggggatggggaggtcgtggaggagggaggaagaaggggaaggggaaggggcagaagaacaggttggagagagggtggttgcaacgcaacgcatcccataaacccttcctattggctatgcattcccatatcgagagaatcctatggagcgaggaccaaatttctcgccgtgtctccgagctcgccgccgaaatctccgccgacttcggcggacaatctccggctcccgtggtcgtcggcgtggccaccggtgcattcctcttcttggctgacctcgttcgcaaaatagatctgtccatcgccgttgatttcgtccgagttgaatcctacggtttcggaaccgtttccaatggcgcacccaccatttccttcgatttgaaggtcgacgtcaacgcccgtcacgtcatcgtggttgaagacattgtagatactggacataccttatctaaagtcattgggcacttgaaatcaaagggagtatcctctgtttctgtatgcactttccttgataaacctgcaaggagaaaagttcattttcagttgctgggtgaagggaaatactaccggggatttgagtgtccagactatttcgttgtaggttatggactggatttcgctgaactctatagaaatttgccttacattggtgttttgaagcctgaactttacaagtga

SEQ ID NO: 70535 - DNA, 477 bp, Glycine max
  Peptide Sequence Number=SeqID_187313
atgctccaaccatatgagatcagcataggcttaaaggagcactcaaacccggtggcccccaaggcctacactctgaagagtccgtcaggtcctctccctcctgattcagcgatagccacatctctagcagttcccggaaattctttcaattattcatccgattgctccgatagaattcccaaacgtaagagagacggagaagagattgaaacctccacttgtactgtctttcatacgattcctttttctccctccacgaatattatctcgcaaatcccaacggtggaagcctctgggtttctgcgggaaagaaaaaggctacaatgcgaagggtttttctctcagttcagacatgatatcgaaattcccaacggtgagaatgctcggaattgtgttgtgaacatgatactcaaatttcacgacgatccaacggtgaacgggtttgagatcgtcatttttctgagactggtttggtag

SEQ ID NO: 70536 - DNA, 153 bp, Glycine max
  Peptide Sequence Number=SeqID_187314
atgagtgagcgctggtactggagagaggagttcttggaacctctgaggagagaccgagagagaggagtgagcgctggtatggagagaggagtgagtgctggtatggagagaggagagaggggtgaacatagagacgagattaatactaactaa

SEQ ID NO: 70537 - DNA, 342 bp, Glycine max
  Peptide Sequence Number=SeqID_187315
atgaatttgaacatcttttgtgttgtacacactttctctggctccttctgtaggtcactagtatatctcctgccacagattctcccgaaaacctccgcacttgttcagctgccggcggtggtttctggtgactgcatcggaaaggaagaagaaaaagaaggtgattgtgttaggatttcgataggttctctctcgctccttcattcttgcaaagtttctcactcttctctctctcttggaacaatttctccctctgcattattccgaaaaaggtgccggtcacaagcaagtgtggatgagttgcctgaagccgtgcaaaagcaatccgcgcttgaaacttga

SEQ ID NO: 70538 - DNA, 426 bp, Glycine max
  Peptide Sequence Number=SeqID_187316
atgacagacttgtcactctacaagtgggtttcgtttcctgtttcaacgatatgggacactgctgggcaagagagattccagagtctcggggttgcattttacagaggtgccgattgctgtgttcttgtgtatgatgtgaatgtgatgaaatcgtttgatacccttgagaactggcacgaggagtttctcaaacaggcaaaccctcctgatccaagggcatttccgtttattttactcggaaacaagatcgatattgacggtgggaatagtcgagtggtttctgagaagaaagcgaaggactggtgtgcctcaaaagggaatattccctactttgaaacatctgcaaaagaggattacaatgttgatgctgcattcctgtgtattgccaaggctgctctagccaatgagcacgaacaagacatgtaa

SEQ ID NO: 70539 - DNA, 624 bp, Glycine max
  Peptide Sequence Number=SeqID_187317
atggaagctgtgatgggactgatgcggaggattccgccgaaacacacagaaacagctctgtctgcgcttctgagccttatgcctcaccactcctccgatctcctctctcaagtcgatcagcccctccaggttctgtgcgatgtcgaatgcggcaaggagttcattttgtgtgaatacaacagagacgccgactcttacagatcaccttggtcaaataaatatcatccaccattagaagatgggtccctcccttcttcagagttgcggaagcttgaaatcgaagcaaatgacatatttgcaatatatcgtgaccagtattatgaaggtggcatttcatcagtttacatgtgggaagatgataatgaagatggctcaaagacagggcagggtcgacggggatatttagaggaaggtgcatgggatgctatacatgttatagagatgagtatgaagctatcagttgctgatggtcatctttgtaacatgggaaggatgattgaagaaatggagagtaagctgaggaactcactagatcaggtatactttggcaaaacaagagaaatggtttgcacactgagaccaccatctgaagtggcacagatgagaatgcctgatagcgcctga

SEQ ID NO: 70540 - DNA, 972 bp, Glycine max
  Peptide Sequence Number=SeqID_187318
atggcgtatagaacttctagtatcacaagttcgttagtcacattggtgctgttaggcacaatattatgtgatgcagaattgtcttctacgttttacgacagtgcttgccccattgcactcagcaccataagaactgtgattcgcagtgcagtatctgcggagcgccgcatggctgcgtctctcattcgccttcattttcatgattgctttgttcagggttgtgacgcatcaattttgcttgatgatagctcctctattgagagcgaaaagagtgcacttcagaatgcaaactcaataaggggatataacatcatcgatcaagcaaaatctgaggtggagaaactatgccccggagttgtgtcatgtgctgacattgtagcagtagcagcacgtgatgcatcatttgctgtgggaggtccatcatggactgtgaagcttggacgaagagattcaaccactgcaagcaaaagttcggctactagtgaccttccacgattcacagacgatcttgacactcttatctccagattcaataataagggtctcactgccagagacatggttactctatccggtgcccacacaatcggacaagctcaatgcttcacatttcgtggaagaatatacaacaatgcaagtgatattgatgcaggatttgctagcactcgccaacgtggttgtccatccgttagtaatgatgataatgacaagaaattggcatcactagacttggtcacacccaattctttcgacaacaactacttcaagaatttgattcagaagaagggtcttcttcaatcagatcaagttctgtttagtggaggatctacagattctattgtgtccgaatacagcaataagcctacaacctttaagtccgacttcgcagctgctatgattaaaatgggagatattcaaccattaactgcttcagctggaatcataagaaagatttgcagctctatcaactaa

SEQ ID NO: 70541 - DNA, 171 bp, Glycine max
  Peptide Sequence Number=SeqID_187319
atgaagataacagatataaggggatttctggtgaggcaacatagcaatggtgttcatgaaccaaaggcatgtaaaacagtaaacggtgtgatatgttcttgcaaatgtgagagtggattgcctataaggcttgatctggcatttacttcgtttgatagttgcaggaaataa

SEQ ID NO: 70542 - DNA, 619 bp, Glycine max
  Peptide Sequence Number=SeqID_187320
gatcccacccactcacaaacttccctggcttcctggtgggatgacacgggaaattctgaatcaccttgctacaataacaatctgcaccaaagccaaagcaatagtaagtgaaacaactccgaggcgaaaccatgatttggaattttttggattgcgatctgatggaagggttgcacaatacgacatggggattgaagagttttgcagcagtgaatgcacagagtatgatacgagtttggaagaggtcaattgttggtgggcaatgtttggatgggcgattgaggtacgaaggcggtgcatggcgaattggggatgggagattagggttttccatgatttgcagacgcatctgaattgcagaagggatctcaccggaaccctaaagaggatctccgagatgagttcctctgtctatgttgttaaactcaagattctacctaggatcgggagggaggtgaaaactcttaacttggggatcataactaggaaaccaaagggtggcacaattggtagcgcaatagaaggcgtaggtggcaacagaccaggcgtggtgtggtggtccagcagttgcaacatggaagatttgcaaagggataaggagaaggttacgaatgggtag

SEQ ID NO: 70543 - DNA, 1023 bp, Glycine max
  Peptide Sequence Number=SeqID_187321
atggcgacgcaactgagcgatgcggaactcataaccagcttgcaagccagggtcaaggaattagaaactgagaatgcaaagttattgtcccaacttgctgattgccgcagtcacgagatggagaaaaaagtatatgtccctgatgagagaggcgggaaatcaaaaaaaggcaacaggaaatctgaagagaagatagagaaaatgccaggctataacacaaggtttatgagtcatcatagcaggagatatgtagctttaaaagtcatgtactttggaaaaaggttttatggttttgcttcagaggcacaaatggaaccaactgttgagtctgaactttttaaagcttttgagaaaacaaggctattggttggcaataagaaggaatcacagtattcaagatgtggtagaacagacaagggggtttcctctgttggacaaagtatagacctatatggcaaatgctatggaagaaaagatgaggtacttttgctgagcgcctcaatagagatagagagaactatagaggaaatttctaaacaaacaagtaactggattggaacctctgttattgttgctaaactcagtgcacttgtattctttaaatggtcaaacgaatttggatccttgattcttctggtgatagctcttttcctaagatcaaacctcaagatatctgaaacaaataatggaaattctggagttgttttggatgagcaacatgaaggggaaatagattatgttagagtgctaaatcgtgtccttccaaatgacattagaattatgggctggtgtcctgctcctgtggatttccatgcaagcccaaaagggctgggcatgagggggtgtattgggaaaaacccaagtcccacattagctggagataaggataagatagagtatataagtgaggtgcatccctcaccccatgaattagcttttgggattgagttaggtccaaacccacattctaagagcaatgctggacaagggaactactttcccttgtggccacactggacatag

SEQ ID NO: 70544 - DNA, 585 bp, Glycine max
  Peptide Sequence Number=SeqID_187322
atggaggagaaacgccgcgacgccgctccctccgccgccgattcgccggcatcagagcccgcaacctctcgccgccgcgccggagccaacaagaggaagtccggcgccctcagcgcctccggttcctcctccgcgccctccaaacgcgcctctcgcgacaaggcctcaccgctccaccctcctcccctccacaatggccccctcaccagggcccgccaaacccccaacaacctcgcctccgcctcctcttccgccggcgcttccgctcccgccgccgtcaaacgctctgaacgcgcccacccttccgccgccgagtccgccgcgctcgctgagcagctcaagaaggagagcgagtgggagactctcgaggccgcgattgaagccgaattcgaagctatcagatctcgcggtgccaatgctcacgtggttcccactcacagcggtgagactttgtgcctcttctcaaaccctaatttgcttctgtttaggtttagggcttcaattgcagtggatagtgttagaaaacatcatgtgtttgattttatgtcatttttgttcactttttgttctggaatgaacgagtga

SEQ ID NO: 70545 - DNA, 2646 bp, Glycine max
  Peptide Sequence Number=SeqID_187323
atgactcttcgcatagcgaggagccttctggcaccaggttggttttcatggtcatgtattcatccaattgagaagcaaatgttgccttctttctttaatagcaagactgataatcggactcctgatgtatacatggagataaggaattggataatgaagaagtttcattcaaatccaaacgtacaaattgaattgaaagatatgtcacagcttaatgttggagactcagatgctaggcaagaggtaatggagtttttggactattggggtttaattaacttccacccattcccttcaatggattctgctatggccactggcagtgatgatggagaagctgaaaagaattcattgcttgaaaaattgtatcactttgaaactctccaattatgtccacctgttcaaaggtctagccaaatgactccagctactacctctggcttgtttccggagtctacaattgctgaagagttggtgaaacaagaggggccagcagttgagatgcttgagtaccattgcaactcttgttctgctgattgttctcgcaaacgttaccattgccagaagcaggcagattttgatctatgtaccgactgctttagtaatagaagatttggctctggcatgtcttcgttggattttatactcatggaaccagctgaagttgcaggggttaatggtggaaagtggactgatcaagagactcttctgctccttgaagcattagaactttataaagaaaattggaatgaaattgcagaacatgttggaacaaaaacaaaagctcagtgcatattacactttgttcaaatgccaattgaggatacctttgttgactgtgatgatgatgttgttgctgtttgcaaagaaactgtggatccagttgcaacaaacaatgactcatctatggacaaggatgcttcagaatgtattgagaatgatactagtgatggcatcaaagacaatgataaaacttccaaggctgaagatcttgaagtgaaagtgaatcaggaggagactacaaagttacaagaaggcagtgatgagaaatctaccgagggaacttctaaatcagaagatgctgttaaggtaaagattgatcaagaagcaggcaatgactgtgctataaatgctcttaaggaagcatttgcagctgttggttattctcctggacctgaaggcccttcttcatttgctgaagtgggtaatcctgtcatggcactggcaactttccttgcacacttggtgggttctgatgtggctgttgcttcagctcatagctccataaaatccatgtcaagaaattcacctggcaccgagcttgcggcaaggtgttgctttcttttaaaagatcccccagataatgagaaggaaccgactaattctgaaagggattctaaaagtgagggagatcaggatgaagtaaatgtaaaacaggataaaccaacattggaggataaagatttaccgaatgatcacagtaatacaaaaattgaaactaatgctttagaagtcaagggacagccggcttctacagatgatggagccttggaaaaacccatttcttcaaaggagcaagcagtgagtaatcatgaaggtgggcttgacaatggtaatgatcccaacaatgcaaagctacccaatgatcaagcaccagccactctgcataattcaggtggttcaacatccaaggctgaaattccactttgttctgacaaggctcaggaggaaactttaattgaagaatcttgcccttctgtaaaagacaaacatgtgtctgattctcttctatcagacacatcaaaagatgctgaaatggtttctaattctattccctcaactaagagcaagcctcaaaatccagagcctacaaatccagcttgtgaatctctagaaacaacggactcagtaatggatgttgatggagtttctaattccttgccatcggaaaagattgactctcagccactaattacgtcaaaatcatcccaatgtaatgggacagaaaaggatgtagatatgatgtcaccttcaaatcctgttgtatcaaattctggtgctgaaaatggtccaaatacaggtaaagatcatgcagataatggagcaaaagtggaagatgatggtactgagactaaacaggatagcagttttgagaaagtgaaacgtgctgcagtttctacacttgctgcagcagcagcaaaagccaaacttctagcaaatcaggaagaagaccaaattcgacagcttacttccttgttgatagaaaagcagttgcacaagttggaaacaaagttggcttttttcaatgatgtggagaatgtggtgatgagggcaagggagcatgtagagcgatcacggcataagctttatcatgagcgtgctttgataattgcatcacggcttggtataccaccttcctcatctagaggtgtaccaccatctataactaccaatagaattccaacaaatattgcaaactcactcccaagaccacaaatgatgatgaatccaccaaggccactgatttctagacctgcaggcactgtagcaactactcttcaaaacccattagtatcttcaactgcagcaggaaattcagttcggccatctaaccaggaaaagctttcttctgttgggacaaaataa

SEQ ID NO: 70546 - DNA, 174 bp, Glycine max
  Peptide Sequence Number=SeqID_187324
atggcagggctcaagttcttcagggatctagaatttgattggactcctctagccttgcatagagttgtgatcaaggcagggaatccaagtctggatgtatcatgttgtgcagtgacatcaaatgtgtgggaggtagcaatcaggttagagaaggaaataacaccccatgtttga

SEQ ID NO: 70547 - DNA, 624 bp, Glycine max
  Peptide Sequence Number=SeqID_187325
atgccttcccgaagaagaactctcttgaaggtcatcattctcggtgacagtggggtggggaagacatctttgatgaaccagtatccttcggtttctgtctacaaactccgtatttgggatacagctggccaagaaagattccaaagccttggagttgctttctatcgtggtgctgattgttgtgttcttgtatatgatgttaattcgatgaaatcatttgacaaccttaataactggagggaggaatttctgattcaagcaagtccttctgatccagagaattttccttttgttgtcataggaaacaaaatagatattgatggtgggaacagcagagtggtgtcagaaaagaaggctcgggcttggtgtgcatcaaaaggaaatattccatattttgagacatctgccaaagaaggtcttaatgttgaagaagcattccaatgcatagcaaagaatgccctgaaaagtggagaagaagaagaattagtactaaaactaaaatgggacatttttgttaataaccttgaaagagcaccggtaaagttgcatatgcaaggatacctgccagacacaattgatgttggaaacagcagtcagccacgggcaacaggatgtgagtgctga

SEQ ID NO: 70548 - DNA, 186 bp, Glycine max
  Peptide Sequence Number=SeqID_187326
atggaattcaatagcaacctaggcgacctgatggagctttcacctcttttttctgatgatagtcgtgttgttgatgctgcttcgattgcccaaaaattatggtcatttgctaaagaagatataagaagacatgaaacacctgtcccattagctataggtgtagaagcaagattcattgcttcatga

SEQ ID NO: 70549 - DNA, 315 bp, Glycine max
  Peptide Sequence Number=SeqID_187327
atgaccacaaaagggtcaagctcttctgctgcttcttcagcttcaggggatgctaaaatcaaaagggttctcacccatggtggtaaatacgcacagtacaatgtgtatggaaacttgttcgaggtgtcttccaagtatgtgcctcctattcgccctattggtagaggcgttaatggcatagtctgtgctgctgttaattccgaaacacacgaacaagttgcaatcaagaagatcggcaacgcatttgacaatataattgatgctaagagaacattgagagaaatcaagctccttcgtcacatggaccatgataat

SEQ ID NO: 70550 - DNA, 417 bp, Glycine max
  Peptide Sequence Number=SeqID_187328
atggcgctcgatgcgctgcagggcgacgatccgatgctgtggatgatgaacggcggggactggttctggcagctgagcggtgcgcggctgattgccgcgcgtcatgcgctgaagcgctgtgccgatctgccgctgattttacatctgcaatttgaagagcgcgtcatcgtcattgctcatgccgactatcctgccagtgcctatgcactgggacaggatgtcgactggcatcaggtcgtctggagccgcgaccggctcgctcgccatcagcgcggtcgttcgcagccgatcgccggcgccagtgcgttctactttggccatacgccgctggagcagccgcttaaagccgcgaatcagcattacattgataccggcgcggtatttggtaaccggctgacgctggtgcagttgcagtaa

SEQ ID NO: 70551 - DNA, 123 bp, Glycine max
  Peptide Sequence Number=SeqID_187329
atggcgaagctgaaatcccaccactacatgtgttgtggtcaaagaaggaagctaatagcagtggttgcgaaccttccttcaaggtgggattcagtgcctttgagtaaagaagtcagagtgtga

SEQ ID NO: 70552 - DNA, 678 bp, Glycine max
  Peptide Sequence Number=SeqID_187330
atgggtgaggcttcaggagctggttctgctgattgtttcagccagatgatgtcgtcgatgccgggttttcgcttccatcccacggatgaggagttggtgatgtactatctgaagcggaagatttgtgggaagaggctgaagctcgacgtgattcgtgaaaccgatgtgtataagtgggatcctgaggatttgcctgaagttgttggtttcgagatgagggttgagatcttcatgttgttaatattggtaatgtttgatgctcatatggttagagtaccaatcgttgacttggggcaatctatattgaaaactggagataggcaatggttctttttctgtcacagagataggaagtatcctaatggtggaaggtctaaccgagcaaccagacgtgggtattggaaagcaacgggaaaggatcgtaacgtgatatgcaattctaggtcagttggagtgaaaaagaccctggttttctatgctggcagagctcctagtggtgagcggactgattgggttatgcatgaatataccttggatgaagaggagcttaagagatgcctgggtgttaaggactattatgcactttacaaggtttacaagaaaagtggacctggtccaaaaaatggtgaacagtatggcgcaccatttaatgaagaacagtgggcagatgatgacata

SEQ ID NO: 70553 - DNA, 728 bp, Glycine max
  misc_feature (16)..(16): n is a, c, g, or t
  Peptide Sequence Number=SeqID_187331
actttaacgacacgcntgcggtgttggacttcattacaagcttgagaggcttacctgagagataccctcgccaggttccaacaaacatcacaactcaaatagtgaccactatttctgttaacactttgccatgcccaaatggcagaacctgccagggaccaaatggaaccattttcgctgctagcatgaacaacataagttttgacacccccaacattgacatactaaaagcttattactatcatatcaatggggtatttaaaccgggatttcctagatttccaccctttatatttaacttcactggggattttttgcctataacattgaatataccaaagcaagggactagggttaatgtactgaattatggtgcaacggttgaaattgtattccaagggacaaacgttattgcagggatagaccatcctatgcatctccatggattcagtttccatgttgttggatatgggttaggcaatttcaaccaaagcaaggaccccaagaatttcaatctcgtggatcctccttatttgaatacagtgattgtgcctgtaaatggttgggctgctgttaggtttgtggctaccaaccctggagtatggttcatgcactgccatctggaacgccaccaagtttggggcatggagacggtgtttattgtgaagaatggaaaggcttcaaatgaaacgttaccaccaccaccgccagatatgcccctctgttga

SEQ ID NO: 70554 - DNA, 1692 bp, Glycine max
  Peptide Sequence Number=SeqID_187332
atgacgtgtggcaagaatctgttcctccaaattctgtggtgtttttccttgatcggtcttagttcccaagcacagaattacacttttgttgtgacagaggtcaagtacacaagactctgttccacaaaaaacatattgactgtgaatggagaatttccaggaccaactatcagagccaccaggggagacacaatctttgtagatgtttacaacaagggcaacttcaatattactttacactggcatggggtgaagcagccaaggaatccatggacagatggtccttcatacattactcagtgcccaatccaacctggaaggaaattcacacagaggttgatttttactttcgaggaagggaccatatggtggcatgctcatagtgaatggttaagagccactgtctatggtgctatctatatctatcccaataaaaatactccttacccttttccccaacctgatgcagagattcccatcatatttggagaatggtggacgagtgatgtcaacgaggtcttcagacaatctatggaaagtggagcagccccaagcgtatctgatgctctcactatcaatggtcaacccggggatctgttaccttgctcaagtccagaaacattcaagttaaatgtagagcaaggaaagacttatcatctccgtgttatcaacgcggcagtgaatctcattctcttcttctctgtttcccaacacaacctcactgttgttgctgctgatgctgtgtactcaaggccattcacaagggattatatttgcatatcaccgggacaagcaatggatgtattgctgcatgccaatcaagaacctggtcactattatttggctgcaagggcatattcaagtggtgttggagtagcctttgataacacaacaaccactgctagaatagagtacagtggcaattacactccaccttcatctccttcattgcctaatcttccagactttaacgacacccgtgcggcattggacttcattacaaacctaagaggcttacctgagagagcccccagtcaggtcccaaaaaacatcacaactcaaatagtgaccactatttctgttaacactttgccatgcccaaatggcagaacctgtcagggaccaaatggaaccattttcgctgctagcatgaacaacataagttttgatacccccaacattgacatactaaaagcttattactatcatatcaatggggtatttaaaccgggatttcctagatttccaccctttatatttaacttcactggggattttttgcctataacattgaacacaccaaagcaagggactagggttaatgtgttgaactatggtgcaacagttgaaattgttttccaagggacaaaccttgttggagggatagaccatcccatccatctccatggctacagtttccatgttgttggatatgggttaggcaattttaaccaaagcgtggaccccatgaatttcaatcttgttgatcctccttatttgaatacagtggttgtgcctataaatggatgggctgccattagattcgaggctgtaaaccctggagtatggtttatgcactgccatctagaacgccaccaatcttggggtatggagacagtttttattgtgaaggatggagagtctgaaaatctaagattgccaccaccaccgccagacatgcccccatgttga

SEQ ID NO: 70555 - DNA, 603 bp, Glycine max
  Peptide Sequence Number=SeqID_187333
atgaaacttttgatgattcacagagtgaaaggatacgaagcatttatcagttattcatttaagagaaggggagggtatgtatgttttcccagattgatgagtagtcttgtgttctgggttgtacaggatggtattgtattagggcaatcctgttggctaccaactacgtacgaattacctaaaacagtagttgcttcatatgaacctgtgcttaacaaagatgtggtgatattggactgtggggcttctctatactgggaagatgggaaagtagcaaccttccattgctccttcttggcaaacttaaccatggacataacagctattggcacaagaggaactctgcatgtgcatgattttgttatcccttatcatgagaaggaggcatcatttttggctggtacagaaaccggctttaatgatcttgtcacagggtgggataaacaaccaagtaagaatacagtgaccactgatctccctcaggaggctcttttggttaaagaattcgccggttggtcggagaaatcaaattcaaaaactccaagcctgacaagaagtgtccaactattactaggaaaacgcaactggtattggatgctgtga

SEQ ID NO: 70556 - DNA, 135 bp, Glycine max
  Peptide Sequence Number=SeqID_187334
atggcaacgcaatcttatcttctgaatctaaacacttttcatgttcatgcgggaatcagaggacggcaatgcaaacctttaatattcaaaccaaccaattttggctttggggtctggaatttcgaaatgggttaa

SEQ ID NO: 70557 - DNA, 582 bp, Glycine max
  Peptide Sequence Number=SeqID_187335
atgccacctctgtcgcgccgcagctctgccaccgcccttcgttccaacctccgacgcgtcgcagctccaccacctccttcatggccatcaccctccctctggtcccttgaggtaaccgccaacctccgtcgcgtgaggtcaccgccacctccttcattgtcgcgcgaggtcccttcgctcctccttcatcgtcggcaagcgtctcctctcacgtcgcgcgcgttctttgtcgccaccaaccttgttgcgaaggtccatggccttacagattatgaatccgtgatgaccttacggattgataatccgtataggttatacctaagagtgtttttggtttttcacccaggcctccagaatgcggtggaactgtaccacgtcgagcgccacgggcttttccaggagcaagtggtttttgttctaggccgcaagcacggcccagtgaaaatggaggctggtggggagtgggatgtagatagcgtccacgttgaggacctcgtaggagccgtacattttggcggagagagggaagccattggtggcggcaaatgcgacggccccttttggtgggagcggcttgcctaa

SEQ ID NO: 70558 - DNA, 204 bp, Glycine max
  Peptide Sequence Number=SeqID_187336
atgagtgggggtggccatgggaaccagcagaagcaaaatcagaatgtggtgggaggaagaacaagttggatcgatagggataggtcccgagggggaaacataggaggagccactggagcgccgccaaaacctccacgtctccttgattttggcgatgaaggtggtagccgagttggagaagaaacgatatcggacaatgcgtga

SEQ ID NO: 70559 - DNA, 1551 bp, Glycine max
  Peptide Sequence Number=SeqID_187337
atgtggggagaatgtgttaaaactgttgtctttctgatgaatagaacaccaagtcctattttgcaacataaatctgcttatgaaattctacatcaacaactgcctaactattctgattttaggacctttggaactctatgttatgcatctactcttctatccacacgacacaagttcagtccaagagctactgcaacagttttcataggctatcctcatggatataaaggctacaagttgttagacttgaccactctcgaaactttcatatcaagggacgtgaagttctttgaacacatgtttcctttcaaagacaaagattctacaacaaggtccactaatcctctcaaccctcacattactccaaatctgatcactccaagcacttgtgatgattttgaccctacacacacacaacaccatccagacaatcaaccaagcatacaaaacaacattcagcctaacccaccttcagaaaaccaactcagaagatcaactagacaatgtggtcaacctaaataccttactgattatcattgttacaatacttacaagcaagacatcaaatttcctcactggaaacaagtcattcaagctgaacttacaaccatggatctcaacaacacttggaccatcactcagctaccgcccaacaagaaacctatcaccagcaaatggttattgaaattgaaattgaactcagacgaaactgtggccaaacacaaggcaagacttgtagtgcgtggtttcacacaacaatatggcctagattttaaagagacattttcccctgtggctaagattactactctcagactcctttggctgaataagtctatttatggcctgaagcaagcttcaagaagttggttcaataagttttgcaccacattgacctctcaaaaatacattcaatcaaagcatgattacaccttgttcaccaaaggaacaggttcatcattcatagccattttggtttatgttgatgacattgtcattgccagcctagataaaacatctattcactctacaaaaatcatgcttcaacaatacttcaaattaaaagatttgggtaatctaaaattctttcttggtcttgaactctcacgatctcaagtaggaatattcatgtgccagagacattatactatgtctattttggaggacactggaatgcttgcttgtaagccatctacagtccatatggaagctgatctgaaattgaatgcagaatcaggatcacaacttccagatccagaaacttatagaagactaattggaagactgttgtacctaaccatctcaaggcccgatatttgttacactgttcacaaactaatccaacttgtatttgatccttgctcaggacacatgaatgctgccaacatcctgctaagataccttaagcacacagctagacaaggggtcctctttaagatccatgcttatgtagatgcagattggggttcatgtcttgatagccgaaagttgacaactggatattgtgttttcttaggaaattcattgatttcctggaaggcaaagaaatag

SEQ ID NO: 70560 - DNA, 420 bp, Glycine max
  Peptide Sequence Number=SeqID_187338
atgtcgttgcagcaaggcaccaacgatatcaacacgtattacacgaaacttaagtctatttgggaagaattagccagttacaaacaaaccttctcatgcacttgcgaaggtcagagtaatgttttctcactaatccttcaagaagaagctcaaagggaaattgtggtcactcactcacccaccaatgctttaaacagtatagctttttctgttaattctgcatcaaagaaccaatatgacaacaataaagggaaatacatcaagaaagaaagacccaaatgtgctcactgtgatatgttggggcacacgaaggataaatgctacaagcttatgggttatccaccaaattacttcaaagattgtactagtaactcggtgaatcaagtacaacacacacccgaaagttcacctcctgtttag

SEQ ID NO: 70561 - DNA, 888 bp, Glycine max
  Peptide Sequence Number=SeqID_187339
atgtcgttcggcaagaaactgttcctccaaattctgtggtggttttccttgatcggtcttagttcccaaatacggagtcattacagttttgttgtgagagaggccaattatacgagactctgttcgacaaaaagcatattgacagtgaatggaaattttccaggaccaactatcaaagtccacagaggagaaacaatctttgttaatgtttataacaagggcaactacaatatcactttgcactggcatggagtgaagcagccaaggaatccatggacagatggtcctgcatacattactcagtgccctatccaacctggaaggagattcagacagaagttgattttttctacagaggaagggaccatatggtggcatgctcatagtgactggtcaagggccactattcatggggctatctatgtctatccaaccaagaatacaccttacccttttcccaaagctcatgcagagattcccatcatatttagtgaatggtggaagagtgatattaatgaggtcttcacacaatttattgaatctggaggaggtccaaatatatctgatgctctcacgataaatggtcaacccggggatttgtacccttgctcaatgacagaaacgttcgagtttcatgtagagcaaggcaggacttatcttctccgtgttgtcaatgcggcaatgaatctcattcttttcttctctgtttcaaaacacaacctcactgttgttggtgctgatggtatgttaaccaagccattgacaagggaatacatttgcatatcaccgggacaaacaatggatgtgttgttgcatgccaaccaagaacctgatcactattatctggctgcaagggcatattcaagtggtgttggtgttgccctttga

SEQ ID NO: 70562 - DNA, 489 bp, Glycine max
  Peptide Sequence Number=SeqID_187340
atgtctcaaacaacagctcaagtttccaagaccaagccaatggaaaacctttcaccattgatttacaaaaaccccattagaagaacttctaggcgatctacaatgtatcttggtgtgagaaaaaggccatggggaagatatgctgctgagattaggaacccatacaccaaagagagacactggctaggcacatttgacactgctgaagaggctgctatagcttatgatctttcatctatcaagatttgtggcattaatgctcgaactaattttcactacccttttgtgtctcttccaccacttcctatgtcgtcattgcctcctccaccgccaccgccgaccccagagttggatccaagtgttgaagtttgtctagagatgatgaatgctgcttcttacgatggtgatgatgaatctcttgttattgcttccattttgcaaatttttggttccaatgaggctatggcctgcctcttatcaaatcaataa

SEQ ID NO: 70563 - DNA, 312 bp, Glycine max
  Peptide Sequence Number=SeqID_187341
atggaagggtcttcaccatccattgaagaagagagaacagccactttctatgtgtaccatccttgctattttcttcaacaagcactcagggctctcttgaagtgtgtaggtattgatgagtctgaaaacacaatgtgttcacaggccaataaacaagagaaaagctcactgccacaaactccttctgcagatgatcctattacaaactctccaacccacaaaagctccccagatgctgcagatccaccttccacaactaatcaaaccattgtaaggggaatagtgggtacttactttgatgctttaatgtag

SEQ ID NO: 70564 - DNA, 307 bp, Glycine max
  Peptide Sequence Number=SeqID_187342
gaatttacaagatagtggaactctcaagcgggttgcttggggactggacgtaggcacaagggtgaaggtgcgttgcggtggttggcggcggcaaacaaggtacgcaaaaggtggtggctatgttgcggatatggacgaagatgagtggatgtatgaaataatgtctgaacgagcggatatggattatgaaaatgaagaagcatgtggtgcgaatgaaccacatgttgattgtttggatgcgtttaatacttctcaggatgctttatggtgggctcgatccgttgttcatgaaaatggatttgtggcg

SEQ ID NO: 70565 - DNA, 204 bp, Glycine max
  Peptide Sequence Number=SeqID_187343
atgaaggagctcatttggtgtggagttgatctaaatactaaaggatttatttgtgaaaatgctgcaacagtacaaacacttcgtcagaggcatgatttctctatttctggctttatacaagtgaggattcagagattgattcttaagcttcaaatcatgacaagaaatgaggacaaagaaaggatccctgaggggaggggctag

SEQ ID NO: 70566 - DNA, 246 bp, Glycine max
  Peptide Sequence Number=SeqID_187344
atggttacttccatacttcaacttgactcgatgaacctttttgtaaaagcacgaacttggttcaaccccataacccagggaatgacaattttgatcgccaatacttcatcaacaattcatagggatgaaagactcgggaatatgcatgctatgcatggaaaatgtaattatgagattgagatgcccgaagaaacatcctttcttagtcaaccatgcattaggggaaaacacaagggtcacacatga

SEQ ID NO: 70567 - DNA, 591 bp, Glycine max
  Peptide Sequence Number=SeqID_187345
atggatgagttcaaaccggaagacgagttaaaacctgacgccagtgaccgccgtcccacgcggcctcgcaaatcgtcttctgcgccgaaagcgaaagtaccggtttcccgtcagcatatgatgatgggcatcggcattctggtgctgctgattctggtgctgggcattggctccgcgctgaccggcccggacgagaagaaaccggccagcaacagcgccagcaccggtagcgcggctccggctggcggcggcagtgaaaagaatatcgacctgtcaggttcaaccaccatgagcggccagcagaatgccacgccgtcggctgagggcaccgccggtaacgccgcacccgccggcagtgacggccagtcaatctccatgccgtctgtctcctccacgccgactcaggcagcaccggttgacacaccggccaaccagcagcgcgtaacgctgccgggcgatctcaataccgcgctgaataatcagcagggttccgttgatgccgcggcgcagggcgcacagggcaacagttcgctgcctaccgcaccggcaacggtcagcggcagcgctggcaaagcggtcacgccgccggcg

SEQ ID NO: 70568 - DNA, 447 bp, Glycine max
  Peptide Sequence Number=SeqID_187346
atggcttactgcattcgccgctgctgcgagctgaaagccgacgtggtggcggccgacgagcgtgaaaccgggctgcgtgcgctgctcaatctcggtcatacttttggccatgcgattgaagcgcatatgggttacggcaactggttgcacggtgaagcggttgcggcaggcatggtaatggcggcgcgcactgctgagcgtctgggtcagttcagcgctgccgatactgaccgcattattgcgctgctgcagcgtgctggcctgccggttaacggcccggccagcatgacggcagaagcctatctgccgcacatgatgcgcgataaaaaagtgctcggcggcgagctgcgtctggtgctgcctctcgctattggccgctccgaagtgcgtggcggcgtggcgcatgatatggtgctggctgcgattaacgattgcaaagtatcttga

SEQ ID NO: 70569 - DNA, 120 bp, Glycine max
  Peptide Sequence Number=SeqID_187347
atggttcatgcctcatatgacatgggaaatagtataaactgtggcagtatgtactttgtactagggggctatttccttggtattggatacggtacataccacattgcatctgagagttga

SEQ ID NO: 70570 - DNA, 987 bp, Glycine max
  Peptide Sequence Number=SeqID_187348
atggtgcacaaatacttcagctggtggcacgtcggcttggcgcaggcttccacctcagagcggacgcagcaggtggccgacaagctcaatcagcatagtcaacaggcgcgtgtaattatgacgctcaaactcggtgtaatcggtaccggcgcaattggtcaggaacatattcgtcgctgcaacaacgtgctgcagggcgcaaaagtggtggcggtttcagacatcaatgtggaaggtgcgcgcgcggcgctgcagcggctgaatatccaggccgaagtgtatcaggatggtcatcaggtaattaactcgccggaagtggatgccgtgctggtgacctcgtgggacccgacgcatgaagagttcacgctggccgcgattgccgccgggaaaccggtgttctgcgagaagccgctggcgctgagcgcagagggctgccgtcgcattgttgacgccgagatcgcgcacggcaaacgtctggtgcaggtgggctttatgcgcccgtatgatgccggctatcgcgcgctgaaaaaggttatcaccgacggtgacatcggcgagccgctgatgctgcactgcgcgcaccgtaatcagagcgtcggcgagaattacaccaccgacatggccatcaccaacaccctgattcacgagctggatgtcctgcgctggctgaccgaggacgattacaaaagcgtgcaggtggtgttcccgcgcacgacctcaaagtcacacgcgaagctgaaagatccgcaaatcgtactgtttgaaacgcagaagggcatccgcatcgatgtggagatctttgtgaactgcgcgtacggctatgacattcaatgtgaagtggtgggcgaagagggcatcgccagactgccggagccgtcggccattcagatgcgcaaagatgcccgccttggcaacgcgctgctgaccgactggaaagatcgctttatcgacgcctacgacgttgagctgcaggcgtttatcaatgat

SEQ ID NO: 70571 - DNA, 597 bp, Glycine max
  Peptide Sequence Number=SeqID_187349
atggaagagaccgtgaactataccgaacgggcgcgcctgttccgccagacggccaccgacgactgcgccagctcagcggagagcccggtggatatcctcaacgtctttactatggtcaacagccaggcgctgcagcaactggcgatgctagtgaatcccgaccaactgaacaaagcggtgaagatgctcaacgaggcggagaacatctacatcatcggtctgcgccgctcgttcagcgtggcctcgtatctggtgtatgcgctgcgccatctggagcgtcgcgcttttctgattgatggcctgggcggcatgttcactgaacagctcaacatggtgaatccgaaagacgtggtcatcgccatcagctactcgccgtatgcgcgtgaagcggtggaactggtggagctgggcgctaaacgtggcgcgcatcagatcgccatcaccgacagccaggtcagcccgctggcggcgttcagcgatgtctgttttgtggtgcgcgaagcgcaggtagatggcttccgctcgcaggtggcctcgctttgcctggcgcaaaccctggcggtgtcgctggcgctgaataacagcagcaacgaataa

SEQ ID NO: 70572 - DNA, 138 bp, Glycine max
  Peptide Sequence Number=SeqID_187350
atggcagcaaatttcaccagcgcctgtgcggtagtcagtctgatagtgcccatatgcttcttcctttacatgtggtacccgctcagggggtacgacgcagttcgggtcggcggtgaaaacgcgcccgacgctaagtga

SEQ ID NO: 70573 - DNA, 1676 bp, Glycine max
  Peptide Sequence Number=SeqID_187351
acgccgagcagctgtataaagatcctcgcatcgcggcggtcagcttcgttggttcgtccggcgtggccgagcacatctacaaaaccgccagcgcgcatggcaaacgcgtgcaggccttcggcgccgcgaaaaaccacgccattgtgatgccggatgccgatctggatgccactgtgaacgccatcatgggcggtgctttcggttctgccggggaacgctgcatggcgctgccggtggtggtggcggttggcgacgatacagccgataaactgatttcgcgcctgacgccgctgatcaaagcgctgcgcgtggggccgggcatgcagcagggtgccgaagagaatgaaatggggccagtggtatccgctgcgcaccagaagaaagtgctgggctacatcgacaaaggtgagcaggaaggcgcgacgctggtggttgacggacgcggcgtgaaagtcgcgggccatgaagagggctactacgttggcggtacgttgttcgataacgtcacgccgaagatggtgatttggcgcgaagagattttcggaccggtgctgagcatcatgcgcgccagcgacttcgacagcgcgctgcagctggtaaatagccacgaatttggtaacggcagcgccatctttaccagcaacggccacaccgcccgtgagtttgtgcataacgtggaagcgggcatggtgggcgtcaatgtgccggtgcccgtgccgatggcgttccacagctttggcggctggaagcgttcggtgtttggtgcgctcaacgtgcacggtccggacggagtgcgtttctacacccgcatgaaaacggcaaccgtgcgctggccgagcggtcagcagaccgtttctgaattcagcatgccaacgctggtgcagcagccggacagccacgggcgtatccagcacgtgacgcccgagagcgccggctgggaatatgtgggctttgacgcttatctgctgaaaaagggccagacgctgcggttaagcagcggcgagagagagctgtgcctggtgctggtggccggtctggcgtcggtgaaaacccgcgacgcagaattccctggcatcggtaagcgcctgtcgccgtttgagcgcacgccgccttactcggtttacgtgccgcatcatgatgaggttgaagtcactgccgacagcgatctggagctggcggtatgcagtgcgccgggcagtggcaacctgccggcgcggctgattgcaccgcaggatgttggcgtggagcaccgtggcaaagggcgcaaccagcgcctggtgcataacattctgccggataatcaaccggccgacagcctgctggtggtggaagtgtataccgacgagggcgcgaccagttcgtaccccagccacaagcacgatgagaaggacagcccggacgaaacctatctggaagagacctattatcaccgtttcgatcccgagcccggtttcgccatgcagcgcgtctacaccgacgaccgttcgctcgacgagtgtatggccccgtataaccgagatgtggtgacggtgccgcgcgggtatcatccggtggcgacgctggccggttacgataactattatctgaacgtgatggccgggccggtacggctgtggaaatttacctgggagaaggatcacgcctgggtgaacagtgagcagtatccgcgtcgttaa

SEQ ID NO: 70574 - DNA, 2079 bp, Glycine max
  Peptide Sequence Number=SeqID_187352
atgaagatcaaattcggcgctgaaacgcgggtgatgacgggacgggatgacagcaaaggcttcctctcatccgtcatcatttcctgcgagctggctcacaagccagagcacccgcgaaacgggcaagccgtaaagggcgggaaaggtagcggcaccagagttttacctggctcacaaaatcgcgacccagtcaggcaccccgagaccccggaagcattgcgcttgatagtgggcggcagcgcccgccgtgtctgcttatcacagaaggaaaccatcagtatgagtacacaacagaagcggcttgatgtgatttgtattggacgcatcgccgtcgatctttacggccagcaaattggctcgcgcctggaagatatgaccagctttaacaaatacctcggcggctcttccggcaacgtagcctatggcaccgcgatccaggggctgaagtcggcgatgctggcgcgcgtcggtgacgaacacaatggccgcttcctgcgtgaagagctgcagcgcgtgggctgcaatactgacgggctgattaccgataagcagcgcctgaccgggctggtgattctcggcatcaaagacgaagagacctttccgctgattttctatcgcgacaactgtgcggatatggggctggttcccgaggacattcgcgaagagttcattacctcgtcccgcgccgtggcgataaccggcacccacctgtcgcatccggacacgcgggcggcggtgctgaaagcgctggatatcgcccggcgcaacggtctgcgcaccgcgctggatatcgattatcgcccggtgctatggggtctgacctcactgggtgacggtgaaacgcgtttcattgagtccggccaggtgacgcagcagctgcaggaagtggtgcactatttcgatctgatcgtcggaacggaagaagagttccatatcgccggtggcagtaccgatacgctgaccgcgctgaaaaatgtgcgtaaggccagcagcgccacgttggtctgcaaacgcgggccgctgggttgtgtggtgtttgagggcgaaattcctgacagctgggaacagacgcgcctgcacagcggcgtgcgcgttgaggtgctcaacgtgctgggcgccggcgatgcgtttatgtcgggcctgctgcgcggctggctcaacgatgagagctgggagcaggcgtgccgctacgccaacgcctgtggcgcgctggtggtatcccgtcacggctgtgcgccggcgatgccaaccaaagaggaactggacgatttcctcagccgcgataacgcggtgaaacgcccggatctggacgcgcgcctcaatcatctgcatcgcgttaccacgcgtaagcagcagtggccggagctgaatgtgttcgcctttgaccaccgtaaacagctggccgatatggcgcgcgaagcgggcgtcagcgaggagcgcattccgcaactgaaactgctgctgctgcaggcggcacaggaggcggctaacgaagccggtctcaatgagaagagtggcatcctggcggataccacatacggccagaaagcgctcaacgccatcaccggcaagcactggtggattgggcggcccattgagctgccgagctcacgaccactgcgtcttgagcacggcaatattggctctcagctggtggactggccggccgaacacgtcgtcaagtgcctggtgttttatcatccccatgacagtgctgaactgcgtaaagagcaggacgagctggttcttgacgtgtggcgcagctgtaacaaaagcgggcacgagctgctgctggaagtgattctgccggagagcaacccggaccgtaacgagtcctactattacgacatgctgagccacttctatagcctgggcgtgcagccggactggtggaagctaccaccgctgacggcggagagctggcaggcgatcggcgagctgattgagcagcaggatccgcactgtcgcggcattctgttactcggccttgatgcgccggaagagaagctgaaagccggcttcgccgccgccgcgcaggcgacgtgggtgaaagccgtcacgccagtggctgaacggtga

SEQ ID NO: 70575 - DNA, 288 bp, Glycine max
  Peptide Sequence Number=SeqID_187353
atgcggaaattgattaaggaaaggatggaaaataagggggttaatctcgtgggtcttaataaggtggtttctggcataaaatggatgaatgggatgaaatatagaaatggcaataacggaagctacagggctccaaatgaggtgattccaaaacgagaggtggattttctgaaattgtggtttgaaagaacaagggtggagatgataggaaggaaagaatcactctttccagcgagggcaacacacaaaggttgtgaaagtcctttgatacagccagggtgttcttga

SEQ ID NO: 70576 - DNA, 1080 bp, Glycine max
  Peptide Sequence Number=SeqID_187354
atgagcgacagcgcctgggatatggtgacccgcctgcgtcagtaccagaatcgtcgctgcgccgatattgatgaagatttgcagcgcgccggcacccttaacgcctacttccgctcgattggtaccctgcagggcagcgaaatcacctgctcgtcggcttacgggctgcagcacgacacgctggccgggatgatgatgcagccgccaccggtgaccggcaaagcctggtggagcctgtcgatccgcggcacctccggcgtaccggatcgcccggcggtgattttcgtgcgtcacctgccggacagcagcggtttctgggcggtgattgatggccagtatctgatggacttcatgcgcgccatcggcgagtcgaaccgttatcagatgagcctgcgcttcaacggcggcagccccatcgccagcggtccggacgaccagccagagctgctgtacctcagcagcgccaactatcaggcggagtccagccgctatccgatcagcgtcagcgtgacggtacccgccgccgagctgatcaaagcctggcgtcaggcgctacttattttcctgccaatggccgccatcttttcgattttgctgatggtgctgaccgccaactggctgcgccgccgcctctcatgggcggatgaaattcgccgggcgatacgcaaccgtgagttcacggtgcactatcagccggtgtacagcaccgggattcagcgctgcaccggtgcggaagcgctgatgcgctggcagcggcccaatggcgaaatgatccgcccggacatcttcatcagccatgccgaagcggaaggcatgatcgtgccgctgacccagcatttgctggcgatgatggcggaagatatccagagctggcaggttgaaccgggcttccatattggctttaacctcgcggctgagcatctgcaacaccttgattttgtacaggacatgatgcgttttgcccgcaacattcgtgacaaacagatgctgatcacgctggagcttaccgagcgcagcctgatcgaggacggcgacgcggtgtcgcgcaagctgcgctatttgcagtcgcacggcatgaag

SEQ ID NO: 70577 - DNA, 1679 bp, Glycine max
  Peptide Sequence Number=SeqID_187355
atggtcatatcggtgtgctgccggactgcatgctggagccgctgttcagcgcgccaccacagcagcagcgtgagtaacagcgttaccagcagcacgacaaccagcaacgccacactgtgctggcggcgtagcagcaactgctgtgcccgccacgggagcaaattgaccgccagcatcagtaatcctccggacgcagcgccaggcctagcgcaatcgccagcgcgcccgcctctgccggtagtggcggttgcagatagtgcagcagcgccagtggtttgcagcgctgcacttccgcctccggcaacgcctgcgatgggcgagcgtcaggggttcggttgctgcgccgcaggcgctattttcgccggccagcgtccacagccagtggtcgctgagcggatggatcagcaactgatgcgggcgcagcggaacgcgcatggcgatctgcgtcagtgccagactgctcagctcaaacacgtcggggcgcagtccggcctgctgcagcggcgccagccactgggcgatgacgtcgcggcgcgcggcggtgacgtgcagctggctggcactgccgcccagccggtaatccagcgacagcgaggcggcttcgaccgggaacaggcgtctctggcaacggcagcgtacgctgcagcaccagctgcggcggcaggccaacgcgcagtgagtagcgcctgggtaaatgacgctgccagcgcaccaacatctcctgtaacactggcgaggtttgcaacacgccgttgcgtaacgtatcgtgcggcagcggctgctgccaccagtgtcgcagctgccatccgtgacggcgtcgttcaatgccaagggcgcagagttgcccgttctggatgtccagtccaatttgccagcgctgaaaagccatgcgcgcgatctccttatcgttacaggaaaaaggatgattacccgcattgcatgaagaatgacgggtatatcaaagcgtcaggcttgcctttatactaccgcgcgattgtttataaactgcccaaacgccaacagatgggaattctcagcgcggatggcgagctgatcgcccagtacggtgaaaagcgccgtatcccgcttaccctgcaacagatgccgcctgagctaatcaaagcgtttatcgccaccgaagacagccgcttttatgagcatcacggcgtcgatccggtggggattttccgcgccgccagcattgcgctggtctccggccacgcctcgcagggcgccagtaccattacgcagcagctggcgcgtaacttcttcctcagccctgaacgcacgctgatgcgtaaaatcaaggaagccttcctggcgattcgcatcgagcagttgctgagtaaggatgaaatccttgagctgtatctgaataaaatctatctcggctatcgcgcttacggcgtcggtgcggcggcgcaggtgtacttcggtaaaccggtcgatcagctgtcactgagtgagatggctatgatcgccggcctgccgaaagcgccgtcgacctttaacccgctctattcacacgcccgtgcgctggcgcgccgtaatgtggtgctggctcgcatgctggatcagaactacatcacgcagcagcagtataacgacgcgcgcaacacgccgctgaccgccagctatcacggcccggaaattgccttctctgcaccgtatctcaccga

SEQ ID NO: 70578 - DNA, 702 bp, Glycine max
  Peptide Sequence Number=SeqID_187356
atggcgcagcgggatgatctgttacgcaggcagcaggcgcagcaacagcggctgcagcagcatcaacgctggcagcagttctggcagcaactgcccgcactgatgccggagacgctgtggctgagtcgcgtggagcggcgtcaggggcaactggtgctggacggtctggcgcaaagcctggctgatgtcagcgcgttccgccatcaactgcagacgcaaccgctatttgcggcggtgaagcagggcagcgtacagcctggcactgacgtggcgaatagccagcctgcatttgctggcgctgctgctactcgggctggcgtggctactgctgctgcgtccgcaacagcagcaattcagcacgctgcaacagcagctgtcacaactggcgcagcagcaccagcaacgtcagcagcagctggacgcgcgaccggccatcggacagcttcaggcggagatcgcaacgttgcagccagcggcaacggcggcgtccgtatcgttagagcagctggtggcggcgcgcggcaatcagctcgaggcctggcatccggacagccagccacagcagctggcgctgcgcctgagctggccgcaatttctgccgctgttcagcgggctggctgcgacggcgttagcggtgccacagcgttttcagctgcaggcggagcagggcgtgttacacagcgagttctggctggagagtga

SEQ ID NO: 70579 - DNA, 864 bp, Glycine max
  Peptide Sequence Number=SeqID_187357
atgcggcatggtcagggcattcattttgcgcgccagcgcgttcttttcgcgcttttcgatgctggcggccgtctccgcgtacatctgctgcgcttcgctggccggacgccgctggtcgccgatggcggtgatgatcaccgtgcgctcatcgttgccctgacgcagcgtcagctcggcctgcagttcgaccactttgcccggtttgctgcgctggccgttgtaatgcactttgccgccttcaatcatgtcgcgagccagcgcgcgggttttatagaagcgcgcggcccacagccatttatcaaggcggacgccttcactggttttctctttcattgcggctcctgctgttacgctgcgtcgcgccgtgtggcgatcggtcgcacacggtcgcatgacgccggaaaaatggatcgggccggtgccggatacccaaaggtatgggtacaacgtgataaatcaagggcgaggtgccgttgcgggctgccgatccatcgccaatcccttaagcggcgacagggtagcacagaaggcggagggtcagaacagcgagcgcacgctctgcatagtgctgaggttgtggttaaagcacttgtcgtaatactgctgaatctgcgccatacgcaggcggttgcggtggatgcggcgcatcgcccgcaggccgttgctgacggcgctgacaatcagcaccagcatcagcagcgcggtgcccagatagcgccactgcgccatggcgtcgggctcgttgtgcagggcgatgtggcgcgtgccgttggcatcggtggtaatgctggtaatgataccgctggcggcaaacggcgtgtgcagcagcatgccggacaggcgctgcagttcgtgccattgtga

SEQ ID NO: 70580 - DNA, 1457 bp, Glycine max
  Peptide Sequence Number=SeqID_187358
atgaataactcgcgcccccacgagagaaaccttatgtctgttcaagatcaactgcatcgttacctgtttgaaaacgtcgccgtgcgcggcgagctggtcaacgcatctcaaacctggcgcgacatcgtgcagaaccacgactacgccgagccggtcaaaacgctgctgggcgaactgctggttgccaccagcctgctcaccgctacgctgaaatttgacggcgacatcaccgtgcagctgcagggcgatggcccgctgagcatggcggtgatcaacggaaataaccgccaggagctgcgcggcgtggcgcggctgaaagaggatgcggagatcgccgccggcagcagcctgaagcagatggtgggtaacggctatctggtgatcaccatttcgcctgagaaaggcgagcgctatcagggcgtggttggcctggaagccgatacgctggcgggctgtctggaagattacttcatgcgttccgagcagctgccaacccgcctgttcattcgcaccagcgagaaaggcgcagccggtattctgctgcaggtgctgcccgcgcaggagcccaacctggatgacttcaaccatctggccacgttaaccgaaaccgtgaagagcgaagagctgattgagctgcccgcgactgacgtactgtggcgtctctatcatcaggaagaagccacggtttacgatccggcgccggtcagcttcaaatgcacctgctcgcgcgaacgctgcggtgaagtgctgaaaacgctgccgccagaggaagtggatgagattctggccgaagacggcaaaatcgatatgcactgcgactactgcggcacacactacgttcacatgcgcgttaacggcctgacatcgcaagacctcgaaacgctcggaattagcggcaccaccgaggtggtgtacaaccctgattacgccacgttatttcaggaagaaacccgcccggagctggaaggttacgcgcgcggcaccctgacgcagagcggtgccattgccgtggataccggcatcttcaccggacgttcgccgaaagataaatacatcgtgcgggatgacaccacgcgtgacacgctgtggtggaacgatgttggcaacggcaagaacgacaaccagccgctgtcacaggaaacctggcaggcgctgaaagatcgctgcacgcaacagctttccggcaagcgtctgtttgtgattgacgccttctgcggcgccaacccggacacccgcctcagcgtgcgtttcgtgatggaagtggcgtggcaggcgcatttcgtcaaaaacatgtttatccgtccgactgaagccgaactggctgactttaccccggatttcgtggtgatgaacgcagcgcagtgcaccaatccggactggcaggcgcaggggctgcattccgagaattttgttgcctttaacctgactgaacgcatgcagctgatcggcggcacctg

SEQ ID NO: 70581 - DNA, 1272 bp, Glycine max
  Peptide Sequence Number=SeqID_187359
atggttcttagcgtggtgctgtttttcaatgacaacctgcatacctgcctgttgctgggcagctggctggtgctgttgctgctttcgttcagcctgacggtgtggcgcgtctggcgccagtggcagcgcctgccggcgggtcagtccgttacgctgctgccgtggttttgtcgcggccatcgtcatattgcgcggctccggccgtggcagcaggcccgctttccgccggtcgccgcggcatttcctctctgtgtccacgtctggcaggcgcagtctgaagccagtcaacagccgaagcgctatgtgattgaccgttacatcggcgtgattaacggtgaagggcacttttgtaccggccacgcggcactgagctttggcgagtgcggctacatcagcctttatccgcagcaggagatcgatccgcaaccgcacgagctgccgcatctgctgctggccggacagattaacgatcgccccggccgttttctcccctcgctggcggcagagattgccgactggcgcagcccggatttaaccttcagttttcagcactacaacgggcaggcgctcgccagctactggcaggccaaccgtggtgacagcctgtataatctgacggcaaaaaactgttcgaccaccgtggtggatgcgctggacgtggcgtttgaaggctattacggccagcggctgcagcaggtgtttgcgctgctgctgcagccggcattctggggcgcctgcgtgctgcgcgaacgggcagaaatcatgacctggacgcccggcctggtcgccgattatgtgcgcctgatgaaaaagacgctgggtgcctgtccgggcagggctgtaaccacgagtgaagcgatgaaaacccaactgattacccgcgaaggctataacaagctgcgtgctgagcacgaccatctgtggaatgagaagcggccggaaatcacccgcattgtctcctgggccgccagcctgggcgatcgctctgaaaacgccgattacacctataacaagcgcctgctgcgccagatcgatcgccgcgtgcgctatctgcgtaaatgcctcgccgagctgaaaattgttgattatgcgccgcagcaggagggcaaagtgttcttcggtgcctgggtggaagtggagaatgagcagggcgacgtgaagcgttttcgcatcgtcggaccggacgagatctatggcgatacggtgaaagagtacatctccatcgactcgccgatggcgcgcgcgctgatcaaaaaagaggtggatgacgag

SEQ ID NO: 70582 - DNA, 321 bp, Glycine max
  Peptide Sequence Number=SeqID_187360
atgccgcacccagcgctggcgctgaatcagcgccgcgctcaggcagcgaaacaggccgttaaacaacaggcagatttccatcaccgtcagcagcagtttcttcagttgcctttcgtcaccgtgccacagcgcgccggccagcagcgtaccgaccaaaatcagggaaaacagcagattgagccagcgctgcagcgacacctcgccgctcagcagcacgtccgccacgatcatgccggccagcagcacgccgcacagcgccaggccataaatcagcagacgataacgcaccagcagctcgcgtccggccagcagcagcagtaa

SEQ ID NO: 70583 - DNA, 189 bp, Glycine max
  Peptide Sequence Number=SeqID_187361
atggtgaagaatttacacgggcacacaacatcgtacattttatcgcccattgagatcggacgagtacagaagatcaaacaaaatcgaccttttcttccatatcttgtgtcttcttcacagatggggcatgcacgatggcccttaacattgtacctgctcaaattcccatatgttggaaagtcattcatg

SEQ ID NO: 70584 - DNA, 1170 bp, Glycine max
  Peptide Sequence Number=SeqID_187362
atgccaatgcttcgttgcttcttcaacaaagcctttaaagcctccaaatgtgcaaccttgttgcaactcacaattccacgcataaagttgctgagaaacagaagagaggttcatctgaagcagatgcgaagagacgttgctaagctacttgaggctggtcaagaagccaaggctagccttaaggtggagcatgttatgagagaggagaacatcatggctgctcaagacatcattcaactcttttgtgaacttattgctgcacgcattgcatttgttcaatcacaaaggaaatgtccccttgatttgaaggaagcaatatctagtgtatgttttgctgcaccaagatgtgcggatctgccagagttattgcaggttcagtcgctatttgcttccaaatacggaaaggattttgtatctgcagcaactgatctcacccctgactgcagtgttaatggccagttaatagagctgttgtcagttcaagcaccttcacaggaaaagaaactgaaacttctaaaagaaattgctgttgagcataagttagactgggatccaactgcctcagaaaccaagtcctttaaaaaacatgaggacttactgaatgaccccattcaattttgtagtcaatgtgtgtcaaaattgcctcttcctgaagaaaaacacactgaagttgatcttcaatcatcaagccaatctggatcacttggatcagacaaacataaacctaatacttcatttgataaaaaggacagtgaacagtctatgtcattcatctcaactccccttgataataagcttaccaagaaaaatggtgcacatgtgtcagatagcagctttgagaatccattctttgtaagtgttggtaataaatctgaaacagaaagggaacatttcactgaacaaaatgctgcaaatgactatgatgatggtggcataaataatgtggagtttgagcctgccttctcattctctcattcatcaagttttccttcatttgatatacccaaggaagattttggttcttccctacacaatcattctgtattggatgacaaatcctctcatcaccagcttaagagattgccttcactagatgattattcgggtttctcatacccaaacttattcaccccaaaaaactcaaataattggtctcatacattcagataa

SEQ ID NO: 70585 - DNA, 219 bp, Glycine max
  Peptide Sequence Number=SeqID_187363
atgagaataaaagaagaagaaagatatcagttcaatgtcaatgggctgctattaacagaagtgaaacttcatgcacttccgaattttgcttcagacacccctcattacaatatcgaatggccaatccgccagggaactgcaggaagcaaaccctttttaaaatttgtgaacgcaccagacaacagctacaaattagttacgttttgcacagcaaagtga

SEQ ID NO: 70586 - DNA, 267 bp, Glycine max
  Peptide Sequence Number=SeqID_187364
atgagttcacacttcacaggccacgtagctatacagaacatacctcatcagaccattcaagaagctttgaattttgatgcccagaaccctaccgagataaagagaatcaccgtgctagacgaaacagaaagagaaagagaagtacctgacggaaacgcgacgctccggcgagatgtgacggtggcggaagacgtcgacggcggagtgcgaagacacaacgctgcagtgtgctgtggcggcgagatggtctgtctgggtattgggtga

SEQ ID NO: 70587 - DNA, 552 bp, Glycine max
  Peptide Sequence Number=SeqID_187365
atggaggaaggcttccctaatgcaactgggcgagagcaatcaattaaagggatgagaacatcagagttttgcctgcatccagctggggatacacccacttcatgccgactttttgatgcaattcaaagtctttgtatacccgtcattgtcagcgacatcatcgagcttccatttgaaggtatggtggattatgcagaattttctgtttttccagcagttaatgatgcccggaaacctagctggctaggcaatcatcttcaaagcttttccaaagagcagaaagacaggttccgccaaaatatggctcaggtacagcccatctttgtctatgataatggccatccaggtggtattggaccaatacctgtggatggtgcagtgaatcatatatggaagaaagttcaccaaaaactgtcaatgataaaagaagccataattcgagagagaagaaaaccacctgataagttagtcttcaagatgcaattgtatatcggccaaggtgtgcttatcattgactataggcctttctttctctcacttgcgcaatcataa

SEQ ID NO: 70588 - DNA, 273 bp, Glycine max
  Peptide Sequence Number=SeqID_187366
atggggtcaaaccaagtacatgcttttaagaaaaggaaagaatgcgctttatggtgcccttaccgaatgcgtgccaaagctagagtgatgagtgaaataaaggaggtgcaagaacaaatgaaggccgacatagaggccatgaaaaaacaaattaccacaatgatggaagccatgatgagtatgagaaaaatgatggaggtcaacacgactatagtcattgccgcaagtaccaccactgaggtggacccgactcaccaatcttgcctcaattaa

SEQ ID NO: 70589 - DNA, 294 bp, Glycine max
  Peptide Sequence Number=SeqID_187367
atgcgggctgagtcgcggaacaatgtgttgccacacttcggcgttcaatccccagccgtgcagcaacacaagatcgcgatcgcctgtgcctgtggtgtgccacaatcccggccctgtgttggctatgccgtctgccgctgcggatcgcccggcacggcctgtgcagcgtatgtctgcgtcagctaccggcgatgccggcgctctgtccctgctgcggactgccggccagtggcgatcagccgtgcggacgctgtctgcgccggccgccgccgtggcacgctctcacttgcgtga

SEQ ID NO: 70590 - DNA, 1163 bp, Glycine max
  Peptide Sequence Number=SeqID_187368
gcccatgcggatcatccacgccggacgcagatgcgggcggtgtggcagacggaaacgcatcgggaaggcgatgtgcggcgccattttcagcagcacttcacgttcggccagcgcttcgcccaccagacggaattcgtaatgttccagatagcgcaggccaccgtgaatcagcttggaactggcagaggagcatccactgcaatgccggcaccgttgatgccgccgccgatcacgatcaggtctttggtttccacgtcatctcctccgatgttcggaatagttctaaaatgttcgttttcgagcgtaataataatcggaaaccaacattgacgccagcgcttaactcaataaaaacattcttgcgtgatatagctaacatttcggcaggaaaaaaatcacatatccacaggatttgtcaggttatagcggcggcttatcagggtaaactaacgccaaatgatgacgaggctaacgagcatctggcacagggagcgcaactggtagacatccgcgatccgcaaagcttcgccatgggccatgccaccggtgcgcaacatctgaccaatgacaacctggcgacgttcattgccggcgcccggcacgaccagccggtgctggtgatgtgctatcacggcaacagcagtaaaggcgcggcgcagttcctgttaagccagggctttagcgacgtctacagcatcgacggcggtcgccatcggcagcctctgattgaccgattaaaggaaggagagcaccgcatgatgcgcatcacccagtttaaccagccgcgtatggcgcaggcgtttgtcgattacatggcgacgcgcggcgtcacgctgcgtattgagcgcgaaagccactatgtcattgtgctggatgacgacagcaagctggagatggtcgaaaacgaactcgcgcagttcgtgcgcgatcccaaccatccacgctaccaggcggcgagctggcacagcggtaccaccgacagcggtctgcgttatgagcgtggcaatatctgggcaaacattcgcgaacgcgcgggcccgctcacgctgaccatcatgatcgcctgcgtggcggtgtttatcctgatgcagattgtcggcgacgatgtgccacgcgctgctgcacttctcgctgctgcacattctgttcaacctgatgtggtg

SEQ ID NO: 70591 - DNA, 144 bp, Glycine max
  Peptide Sequence Number=SeqID_187369
atgtcatatgacgcagcgattgaggtgaggaaccatgtttccccagagccagaggtggaggacgccggagttgcttcgttggcgaatccaaagaggcttgtgacaaattcggaatgcaaaatgattttaaaggttcaaaggtag

SEQ ID NO: 70592 - DNA, 927 bp, Glycine max
  Peptide Sequence Number=SeqID_187370
atgaaccaagagaacgtcaaactggcgattgcgccgattggctggaccaacgacgacatgccggaactcggcagcgaaaatactttccagcaaacggtcagcgaaatggcgctggcgggtttcaccggcagcgaagtgggcagcaagtatccgcgcgatccggcggtgctgaagccgatgttggatatccgcggtatgcagatttgtaacgcctggtttagtaccttttttgccaacggtgacaaagcgaaaaccatcgatcagttcatcaatcacatgaatttcctgcacgccatgggcgcgcgcgtgattggctgctcggaacagagcaaaagcattcagggcacgtcgctgccggtgctggagcagaagccggttttcacggacgaagagtggcgcctgacggcagaaggttacaacgaactggcggcgatcgcagcgcagaaagggatgcgcgtgacgctgcatcatcacatgggcaccggcattcagacgccagccgaaatcgaccgctttatggcaatgaccaacaataacgtcggtctgctgtacgacaccggccacatttactactccgaaggatcacagcaggtgatgctggatgtgctgacccagcatctgccgcgtattttccacgtgcatctgaaggatgtgcgtgacagcgtggtggcagaggtgcgcgcaaactcgctgtcgttcctcgacggagtgaagaaaggcaccttcaccgtaccaggcgatggcgtgatcgatttcaaaccggtattcaaaatcctcgatgattacggctacaaaggatggatggtcgtcgaagcggagcaggatccggccatcgctaacccattcgaatatgcagtaaaagcccgtaaatatattcgtgacaatgccgggcttgagaacatcacgccaccatcctgcgtccgctga

SEQ ID NO: 70593 - DNA, 1683 bp, Glycine max
  Peptide Sequence Number=SeqID_187371
aacgtgggtggcgtgggtgaaaccggctgtctggcggcgaacctgctggccaaagaggccgatctggtgatcggtattggtacgcgctataccgatttcaccacggcttcaaaatggattttccagcatccggaaatcagctacctcaacattaacgtcaacaacttcgacagctacaagctggatggcgtgcagctgctggcggatgcacgcgagggattaaccgcgctggaagccggactgaacggctttgagaatcactggggtggccagattgaacaggcccagagcaagctgctgaaagagacgcagcgcgtgtacgccgccactttcaacaccgacgactttattccggaaatcgctgaccacatcgatcgcactgcgctgttcgccgagtttgagcgtttgacaaagtcggtgctgacgcagagcagcgtgctgggcaccttaaacgaacaactgccaaaggatgcggtgattgtcgccgccgccggcagtctgccgggtgacctgcagcgcgtatggcgcaccaaagattacaacgcgtatcacgttgagtacggctactcgtgcatgggttacgaagtgaatgccgcgctgggcgtgaagctggcacagccgcagcgcgaagtctacgccatggtgggtgacggctcattcatgatgctgcactccgaactggtcacttcgattcaggaaggggcgaaaatcaacgtcatcctgctggataacatgaccaatggctgcatcaacaacctgcagatggaacacggcatggacagtttcaacaccgagttccgcttccgtaatccgcagggcggcaagctggatggcggcttcgtgccggttgatttcgcggcgatagccgccggctacggctgtaaaacctaccgtgtcaccacgctggagcagctgaaggcggcgctggaagatgcgcagcagcagacggtttcgaccctgattgacatcaaagtgctgccaaaaaccatggtgcacaaatacttcagctggtggcacgtcggcgtggcgcaggcttctacctcagagcggacgcagcaggtggccgacaagctcaatcagcatattcaacaggcgcgtgtaattatgacgctcaaactcggtgtaatcggtaccggcgcaattggtcaggaacatattcgtcgctgcaacaacgtgctgcagggcgcaaaagtggtggcggtttcagacatcaatgtggaaggtgcgcgcgcggcgctgcagcggctgaatatccaggccgaagtctatcaggatggccatcaggtgattaactcgccggaagtggatgccgtgctggtgacctcatgggacccgacgcatgaagagttcacgctggccgcgattgccgccgggaaaccggtgttctgcgagaagccgctggcgctgagcgcagagggctgccgtcgcattgttgacgccgagatcgcgcacggcaaacgtctggtgcaggtgggctttatgcgcccgtatgatgccggctatcgcgcgctgaaaaaggtgatcaccgacggtgacatcggcgagccgctgatgctgcactgcgcacaccgtaatcagagcgtcggggagaattacaccaccgatatggccatcaccaacaccctgattcacgagctggatgtcctgcgctggctgaccgaggacgattacaaaagcgtgcag

SEQ ID NO: 70594 - DNA, 924 bp, Glycine max
  Peptide Sequence Number=SeqID_187372
atgcgtttgcacatgctgaatgcggccaatgcgcgccgtttcgatctcagctgtagcgacaaccgacagtttacggtgatcgccagcgatcagggcttcctgcccgcgccggtagcggtgcaaacgctgtcgctcgcaccgggcgaacgccgcgaagtgctggtggatatgtcgcagggagatgaagtgtcgatcaccgcaggcacggcggcaggcatcatggatcgtctgcgcgggctgtttgagccgtcatcgattgtgaccaatacgctggtgctgacggtgcgcccgaccggcctgctgccgatggtgaccgacaacccgccgatgcgcctgctggcggatcagattctcgatggcgtggcggtgcgcacgcgtgaattccgcctcggcgacggcacgccagggattaacggtgtgctgtgggacatgaatcgcatcgatactacggtgcagcagggcacctttgagcgctggatcattcacgccgaccgtccgcagtcgctgcatattcagggcgtgatgttcctgattaagagcgtcaacggcgcgcagtcgatgggagaagatcgcggctggaaagatacggtctgggtggacggtgatgtcgaactgctggtgagtttcccgcagagttcgtcagagcatttcccgtttgtctattacagccagacgctggagctcgccgaccgcggcacggcagggcagatggtggtgaatccggtcggccattccattgtttcagactcgcccggacaaatccctctcccgcgcgcgggagagggccggggtgagggtgcctggttgcgcagtattacacacttgcacaccgtttcagatttgcgcggacatctccctctcccgcgtgcgggagagggccggggtgagggggcaaaccgcacccttcacccatcgcatccttaa

SEQ ID NO: 70595 - DNA, 957 bp, Glycine max
  Peptide Sequence Number=SeqID_187373
atgcggcacactgcgttttttgctgcccgagagagtgccatgccgaacgatgccctttgccgccagctggcgcagcgcgtgatcacgctgatgcgcgagccacaaaagccgctgtgtgcggtggaaaacgtacggttgatctacgcagaggaaccgctgccgcgtacgccgatgttgtattcggcgggcatcgtgatcctgtttcagggacacaaaaccggctacctcggcagcacggtgtttcgctacgacgccaccaaatacctgatgctcaccgtcacgctgccggtggagtgcgaaactgacgccacgccgcagcagccgctggccggcatgagtctcaccgtggatccggccagtttgcaggatctgctgttaagcattggcgatgacgagcagtttcagccgcagccgcaaacctccggtattcactctgcgtttcttagcgaggagatgctgtgcgccgcggaacggctgctggatgtgatggataaaccgcgtgacgcccgcgtgctcggcccgcagctggtgcgtgaaatcatctattacgttctgaccgggccgattggcggcgcgctgctgtcgctggtgaatcgccagacgcagttcagccaggtggcccgggcgctgcgccgcatcgagaaccactttgctgaaagcctgagcgtggaaatgctggcggcggaggtcaacatgagcgtctcggcgtttcaccataactttaaggcggtgacccagacctcgccgctgcagtatctcaagcgttaccggctgcatcaggcgcggttaatgatgctgcaggatgggctgaaggccagcgccgccgccgtgcgtgttggctatgaaagcccgtcacagttttcgcgggagtttaaacggtactttggcgtgacgccgggagaagaggcgagccgcgcgcgtcagaccggggcgctgcagccgtttgacgccgcctga

SEQ ID NO: 70596 - DNA, 1149 bp, Glycine max
  Peptide Sequence Number=SeqID_187374
atggcaacgaaaaaaattgatacccggcttgtcaccgcgggacgcagcaaacgttacactcagggctcggttaacagcgtcattcagcgcgcatcctcactggtttttgactccgtcgcggacaaacaacgcgccaccgccggacgcgccagcggtgaactgttttatggccggcgcggcaccctcacccatttttccttccaggatgcgatgaccgaactggaaggcggcgccggctgcgtgctctatccgtgcggtgcggccgcagtcgccaatgccatcctcgcgtttgtcaccagcggcgatcatattctggtcagcggcgcggtgtacgaacccactcaggatttctgcaccaaaattctcgcgaagcttaacgtcacccaccacctgccgaacacccgcgtggtgttcctcgaatcaccggcgtccatcaccatggaagtgcaggatattccggcaattgtcgcggcggtgcgcgccaaagcaccagacgcggtgatcatgattgataatacctgggcggcgggcgtgctgtttaacgcgctggagcatggcatcgacatttcgattcaggccggcaccaaatacatcatcggccacagcgatgcgatgatcggtactgcggtggccaacgagcgctgctgggcgcagctgcgcgaaaactcctacctgatgggccagatggtggatgcagacaccgcgtacatggccagccgcggcctgcgcacactggcgacgcgtctgcgtcagcacgaagagagcggcctgcgcgtggccgaatggctggcggcacagccggaagtggcgcgcgtcaaccatccggcgctggcgcagtgcaaaggccacgaattctggcggcgcgacttcagcggcagcagcgggctgttctcattcatcctgcatgaaaaactcaccccggcgcagctggcaaattatctcgatcgcttccaccatttcagtatggcctactcgtggggcggctttgaatcgctgattctggcgaaccagccggaagagctggcggcaattcgtccggcgggcggcgtggattttgacggcacactggtgcgtctgcatatcgggctcgagcacgttgacgatctgctggatgacctgaaagccggttttgcccgcctgaaagcgtaa

SEQ ID NO: 70597 - DNA, 1206 bp, Glycine max
  Peptide Sequence Number=SeqID_187375
atggacgccggtgattcgaggaacaccacgcgggtgttcggctgcaccaaaatcctgagtgggttcgtacaccgcgccgctgaccagaatatgatcgccgctggtgacaaacgcgaggatggcattggcgactgcggccgcaccgcacggatagagcacgcagccggcgccgccttccagttcggtcatcgcatcctggaaggaaaaatgggtgagggtgccgcgccggccataaaacagttcaccgctggcgcgtccggcggtggcgcgttgtttgtccgcgacggagtcaaaaaccaagtgacgccagcacaatcgcggaaagaggctggttgtggcttttattacgtggcggaaaagcaaagcgcaataaattgcgccgctacgacccgtgcgggatgttcgtccgcgccagttgctccagtccgcaaaccgcacccaaccgtagcggcaagtcggagacgcagcgtggtagccagtgacttgatgcaaacggacctctccgtttggggcatgtatcagcatgccgatatcgtggtaaaaattgtgatgatcggcctgttgctggcctcggtcgtcacctgggcgattttctttggcaaatatgcggagctgagcggggcgaaacgtcgcctgaagcgcgaacagctggcgctgggcgaagcgcgttcactgaatgacgcgtatcgcgctgccgaaaacttcaaagccaacagccacagtgccgtgctgctcgccgacacgcgtaacgaactggaactctccgccggcagcgaagacctcgacggcatcaaagagcgcaccagcttccgccttgagcgtcgcgtcgcgggcttcagccgccatgccggtcgcggtaacggcttcctcgccaccatcggttccgtcgcgccgtttatcggtctgttcggcaccgtgtggggcatcatgaacagctttatcggtatcgcgaaaacccagaccaccaacctcgcggtggtggcaccgggcatcgcggaagcgctgctggcgacggcgattggcctggtggcggcaatcccggcggtggtgatctacaacgtcttcgcccgcatgattgccagctacaaagcttcgctcggcgacgtggcggcgcaggtgctgctgctgcagagccgcgatctggaccttggcaacgtcgataccgcaaaagaagttaaccgtccggcggcggcccagaaactgcgc

SEQ ID NO: 70598 - DNA, 210 bp, Glycine max
  Peptide Sequence Number=SeqID_187376
atggggacaaatcaaaacggcaaaaggttttatcaagtcaaggttaaaggtctagacgtcactagcctcaaggaattgggacgattgatgggacccctccaaaggcaagccttccgcaaagtttatgggaagattcaagatttgaccgtagtggaggtatttacgaaagctgtcgtatccctcgcccaaaatactacgaccagccgttga

SEQ ID NO: 70599 - DNA, 462 bp, Glycine max
  Peptide Sequence Number=SeqID_187377
atgcagggcggctcaaagttcgtgatgggcgccatcctcggcgcgatggccaccttcgactttggcgggccgatcaataagaccatgtcgctgttcgccgacggcatgctggtcgacggcatttacggtccggaagcggtgaagtttgtcggctccatcattccgccgttcggcatcaccctctcttatctgctgacgcgccacaaatacaccaaagcagagaaagaggcgctgaaagccgccttcccgatgggcatctgcatgattaccgaaggcgtgattccgattgcggcacgcgacctgctgcgcgtggtggccagctgcgtggtggcctcagcgctggccggcggactgattatggtgtggggcgtggaagcgccggtgccgcacggtggcatgttcgtggtgccgctgttcaccaaaccgtggctgttctgcctggcgctcggcatcggcaccgtg

SEQ ID NO: 70600 - DNA, 1374 bp, Glycine max
  Peptide Sequence Number=SeqID_187378
atgccacaaggaaaaatcccattaggttttaccaaaataaagggtgaccgaatgcaaatactgacttcgcgacaacaccggttagtgaaattgctgttgcaacaggcggcgccgcagccgattggtcagctggcgttacagctcggtgtctccggaaagaccattcagcgcgacctgcagtggctggagagctggctcagcaactgggcgctgacgctggagaaaacccctggccgcggtgtgcggctgcgggttgaggatatgcagcagcgtttgcagctggagcagcagctgaacggcgacgaggccggcgacgcgctcagtcataacagccggcggataaaaatcgcctcccagctcctgagcgatgcgccgcgtgctacgtcaatcagcaagctgtccgagcgctactttatcagccacgcctcgattgtgaatgacctgaaagtgattgaagagtggctgcagccgctgggattaacgctgcagcgcggcccgggcggcacgcacatagagggccatgagcaggcgctgcgtcaggcgatggtgtcgctgatcaacgatgtgatgcagcaacaggtcgccggtacgccgctgctgccgcggctcgatcccggcagccagcaggcgctggtgcactattttggcgaagaggatgtggcctttgtgcaggcgctgctgcaacagatggagcagcagctgagttatccgctgggcgatgcctggtatctcaatctgtgcacgcacatcctgatcatgatgcaccgcatggcgcagggcaacgcgctggcgctggacattctcaccaccgcgcacgatctggatcagtcgattctcaccattgcccggcagatggtggcgcgcattgagcagcgcatcggctgtgcattgccggctgatgaagtcggctttatttatcaatatatcgtctcctccggcattgtggtggaagagcgtggcgatcaggcaatgcagctgaccgcgcgcaccttcgccctgtcgccggtggctgaggatgaaattggttatctgtgcgttcatttccaggcggcactggagcggcagatcgcccacaaacgcatcctggtggtgtgctccagcggcgtgggcacctcacacctgctcaagagccgcattttacgcgcctttccggactgggaaattgccggcgtggtgtcagccagcaatcaggcggcgttttgtcagcaccacgcggtggatttggtgatcaccaccatccacctcgatgccggtgccattccggccgtgtatgtcagcgccttttttaatgatgacgatatccggcgggtcactgacgccatgattggcagccagctacccaacggcacgccctgcgcgttggccgcacactga

SEQ ID NO: 70601 - DNA, 441 bp, Glycine max
  Peptide Sequence Number=SeqID_187379
atgaatcagcgtcttttgcagccagacgatgggctggccgataaaggtcatcatcagcagcccggcgatgatggtgctgagcagcggcagcaccatgattggcatcagcccctgcatcgactgcggcagcctgatcacccggcgcagcagcagcacggtatagccgacgaggaaaccgcccagaatgccgccgatgaagccggtgccgatctgaccgcagatgaagccgacgatcaggccgggcgcaaagccgggacgatcggcaatcgagtaggcgatggcgccgctgatcagcggcacaatcagccccatgccccagccgccgatctggttcagcatccacgcaatgctgccggtctgcttgccgacgtcgggcccgccaatcacctggccgagcgcgatgcagatgccggcggcgacgatcagcgggatcatccatga

SEQ ID NO: 70602 - DNA, 270 bp, Glycine max
  Peptide Sequence Number=SeqID_187380
atggatgtcaaagctgacgataactgtggatatcgtgcgattgtcactttattaggtatgggtgaagattcttggtccttagtgtgcaaccatttgcttaaagaacttggcaaatggtcagatgactatatcaagctctttggtggcacaaacacatttgaggaattaaggaggtccctacttgttgatgggttatccatggttactatggataactggatggatataaccaagatgggatatgtcattgcatcaagtgactatccttag

SEQ ID NO: 70603 - DNA, 264 bp, Glycine max
  Peptide Sequence Number=SeqID_187381
atggatataagagcattcctcttttgcataagagcattgagtgcaatatgtgacaacgactttccttttgaagctataagaatttggagcttttcaagatcaaagttgggtagtgcattgagtgcacttataaaaacaacttacagcttacatgataagcacttcaacaagttcacgcgcgcgggcattgtctggaggcgacatcagtggcagcatgggggttgtggtgacatcggtgggagtgggagcatcgccagcttctga

SEQ ID NO: 70604 - DNA, 1233 bp, Glycine max
  Peptide Sequence Number=SeqID_187382
atgaagaactgtagaaattatgagcattctacgccaaacttcacactcacaccaactctgacttttatactgcttgctccctccaaaccctataaactctacagttcaataagagacagccttgcaattttaagagcagaattgaagagtcaaaagaagcatgtaagaaatttgaagaaaaaatcactatggtccaagattttggaagagttttgtctatggtccaagattttggaagaggtgatggaaaagcttgtagacatcgtccattttctatacttggagatacatgaagcatttggtagttctgtcccccacagtttaattgctgctcctttctttttaccgacaaaatgtagaccatcctttgctgttgttaagataccagatactgataagcaagcgaaagattctcaaggcaaccataagaagttgggatctgctggtcttgctttgcattatgcgaacattatcactcaaattgatactctcgtgtctcgatcaagttctgtgcctcctaatacaagggatgctttatatcaagggcttccacctaatgtaaaatcagcattgcgctcgaggttacagtcatttcagcttaccgtgccacaaatcaaagctgaaatggagaaaatattgcaatggcttgttcctattgccgccaatacaacaaaagctcatcatggctttggatgggttggagaatgggctaatacagggtctgagttcaaccgaaaacctgccggccagaccgacttgttgaaaattgaaacactacaccatgctgacaaagacaaaacagaagcttatatacttgaactggtcatttggcttcatcatctagtgagccaagtaagagttggtaatggaggaataaggtccccagtcaaatcgcccatccgttctcctacccaaaagacagggcagttatttacacagaaagcctgctcttcccccatgttaacggttgaagatcaacaaatgcttcgcgacgtcagcaagaggaaactaacacctggcattagcaagagccaagaatttgacactgccaagaccaggttgagtaaacaccataggctaagcaagagtagtagtcattccccaatcagtgaaagtaaaaatgatatattctctacaaggaggttaccttctgttcctgtcatcgactttgatatcgatcggatgaaggccttggatgtcattgatagggtggataccattggaagttcatag

SEQ ID NO: 70605 - DNA, 162 bp, Glycine max
  Peptide Sequence Number=SeqID_187383
atggtaattaataatgatgttattcttgacatcattcaaggacaagacaacactgagattcctcctcaagcaccacctatagttcaaactcaacagcttcaagaagtgcattttgaagattcattagaaaaaggacaaattttaaagggattcaaaggataa

SEQ ID NO: 70606 - DNA, 270 bp, Glycine max
  Peptide Sequence Number=SeqID_187384
ttcgacataagttcaaagttgctagacatttgcaatgcatttagctctgagctttcacgtctcaaccagcaaaaccttcctcttaagaagatgaagacaatctctggacattgtgttttggtaaaagacatatcagtttcaaaagcagctaaaattctcacaaagtttgtctctgctgacaatggtacttctcatgtcatcaatgcatatctccaccgaccttctgcatctttcaacgagctgaagcagctccacaaggagcttggatga

SEQ ID NO: 70607 - DNA, 630 bp, Glycine max
  Peptide Sequence Number=SeqID_187385
atgaccctctttagatcgttctgtaatattccagtggttgccgcaaggaatgacgtcgtagctcctgcagaagggagcaccttgctatcacgccctgagtttatagacgatgtctttattagagaggatctatacatggtatcttatctaaccaatccgggtaaggggccttcttattgggaccccccgaagaactccgcagtacaactagccgcagcaatcactgccggctcaaggatctatatgtacaagtatatttcaagagaagactgcttatatacagacaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccgaagtctgataaagaaggtaacttatcaatttcgacccaattggaaagaactctcggttaaaaacaaagagagtacaaccactcttggaaagaaggtaacttatacattttaa

SEQ ID NO: 70608 - DNA, 327 bp, Glycine max
  Peptide Sequence Number=SeqID_187386
atggaggctaccctcccttccaattggaagaacttaactattgaaaagtatgatggtaccaatgacccggatgaacaccttgacgtttacatctctcaagccaacctatacactactgatgatgttgttttgtgtcgagtgttccccacatccttgaaggttcgcaatcaattggcctcatcacctgacgtcgctggctttggtcaatatacgccagaagaagaaagaatcgctttggacactcatggtttgttttggaaagataactttggatatctgaaacctagactcaatagttgccatgcacgacttgataacaacacttag

SEQ ID NO: 70609 - DNA, 150 bp, Glycine max
  Peptide Sequence Number=SeqID_187387
atgccgaaagtcgaaagggagcattgtcgcgcaatcggtaaagttctgcaacattccagaggagtgcatttagcaaagggggtgaacttatccagatcctccaagttttgttggaaaacggctttcggggctttcgtaatacttccgtaa

SEQ ID NO: 70610 - DNA, 234 bp, Glycine max
  Peptide Sequence Number=SeqID_187388
atgggtgttaagtacctcgaagcggtcaagcaaaggttgcaggctatcaaacaatggtccccggacgaaattaggggaaatccggtttgccagaaagcgcatcgaattgtcaagtatttaaaattaaaacggatgaatctgagtattgaactcagggaactagtcctagacatggttaaattcagaaataaggcattgttgaaagaaacgttgataattgatgatttagaatag

SEQ ID NO: 70611 - DNA, 225 bp, Glycine max
  Peptide Sequence Number=SeqID_187389
atggaatacgattcgctttcaagatgccttggtggtgaaatggtagacacgcgagactcaaaatctcgtgctaaagagcgtggaggggatctttcaattgagaagatccatcgacctgagacgaagagaaagaaaggaagatctgtttgggaagtcagaagttcccttgacatctcttcatctgtaaagaattgtcgatgtgaaaacacagagactaaaggctga

SEQ ID NO: 70612 - DNA, 897 bp, Glycine max
  misc_feature (30)..(30): n is a, c, g, or t
  Peptide Sequence Number=SeqID_187390
atgtgccgactattcatggaacgtgagaancagatgaataatcatctgcttccgcaagaaatcgaagaatttcttgggaatccggcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctggtgtatcataagggatttgctttttctattgattcctccggattgggtcaaaaacatttcttgaatgagttattcaactccagggatgaatcgaaaaatcactctttattggttctacctcctcttttttatgaagagaatgaatctttttatcgaaggatcataaaaaaatgggtccagacctcttgcgggaataatttggaagatccaaaacctaaaatagttgtatttactagcaacaacataatggaggcagtcaatcaatatagattgatccgaaatctgattcaaatccaatatagcacccatggttacataagaaatgtattgaatcgattcaattgcaacttcgaatatggattcaaagtatcaaataggaatatactctga

SEQ ID NO: 70613 - DNA, 207 bp, Glycine max
  Peptide Sequence Number=SeqID_187391
atggtcaacctcaacaatgaggtcaagcggctgagagaagaagtcaatgtcatcaaaagatgcataaaggttgtgggacttcgattactgggtttagaattgcagcacaaaaagagaaagagagggcgtgctagagttttgaaagaacatcgatggccaacctcaacaatgagctcaagcgatttagagaagaagtcaaagtcataa

SEQ ID NO: 70614 - DNA, 390 bp, Glycine max
  Peptide Sequence Number=SeqID_187392
atgaaattacagtgtactcaaccacacaaagaagcaaaaataggaaagctgcaccgcgatcctcgatcaccgtgtcgaactccgtctttctcctcggcgaccgccgacgacggaggctccggaaaccccacaacacaatggattatggaaaagtgggagaagagaagaaaaacatatctaggagctgcaaaattggaaattaataagatggaccaacactgctacactccttgctctcagaatgttgctggcgaaggggcagttgcgactcttgggtttgttgtcgctgttgcttctgctgcgcctccaagatctgatgttgccatacatggcaccgggaaaagggttgtcggtgaactgttgaaaaacgagagcgggaataccctgtag

SEQ ID NO: 70615 - DNA, 357 bp, Glycine max
  Peptide Sequence Number=SeqID_187393
atggtcttaaaagagcacgctctcaggttcgtggattgtggtggtgttggaagtactgtaagctctgtttctggtggggtttgtttgggagaaagtgtggttgagttttcatatggtcttaaaagagcacgctctcaggttcgtggattgtggtggtgttggaagtacttgagctccttcaccactgcatcgatatcattgtttatgcatttgggtttcaaacctgtaaggcatccagatgcaacaaatgttgatgatcatgaagaaaaatgtgatactgtgagcaatttacagaactgcagctatgggttaaagatgttgacaattataggtttaaaagctaatttgtatcattga

SEQ ID NO: 70616 - DNA, 912 bp, Glycine max
  Peptide Sequence Number=SeqID_187394
atgaggagcatctttgtccttctccttgttctgggtactctcttctttctctgtttcgttctatgctctgtttggcccccacaaagaaaaaagaaggcagaaacaaacacattaatatatcttctcgtctgtttgtttaagtatgcatttgctgaagaagggttttgctctgctccttcggaatcgaaatcaaagcctctttattggaaagtggataaccccactctctcacctatccaccttcaagatttgcctggattcacacgcagtgtttataagagtaatcatgctttggtatcaccagaaagtcatgtatatggcccattgcctgattggatcgacacgtcaggcgcatatttaatttcaccagaaatgggttcacactttgtaatgtacctagctaagttgaaagaaaaatcaaaatcaggactacccctgcctggtgtggagagatttatctttgtgctccaaggtgctgtcaccctcactaatgctgctggtgttagccaactactgaaggttgattcttatgcttattttcctccaaattttgaacattcaattgaatgtgatacacctgctactattgtggtatttgaacggagatattctccgctaccaaatcatatcccagagccattggttggttcaactgataagcagccactccttgagactccaggcgagatttttgaactgaggaagctaattccaacatctttggcatatgacttcaatatccacataatggattttcaacctggagaatttcttaatgtgaaggaggtccattataaccagcatggtttgctgctactggaagggcaaggcatttatcgtttgggtgatagttggtacccagttcaggctggtgatgtcatttggatggcaccattcgtcccacaatggtaa

SEQ ID NO: 70617 - DNA, 894 bp, Glycine max
  Peptide Sequence Number=SeqID_187395
atgtccggaagcagaagcaggttccatggcttccgtggtgcttcgctatcagcaagcttctatcaagtgcctccgtctgcggttcctgcaatgctggattgcattctggtctccaccggtttgtctccgccctcgctcttcgcttcactcctccacgatttccctcgaattcttctcaaggatattaccaatgaaggtgatgatgatttggatgctgataaacgcctccaccttgtgtcaatggtgggcgcgttttgtcacctcctgaagaaaatgggggctgattgtgacgctgtaaggtcgtttgtgtggaggtgttttcttcctttagttaaggtgctacagccattgcagcatgacttgcttaatcagatcacagaattgttcatgggtgtagtgattgaaacttgcgcctgggaagttcttgaagcaacttcggtgccaattttcttaagatcagttggtctttccatgggtatgcttcataacgatgatttggatttttatgaatggagtagtaattcatctcaccaagactcgtatgacgtcatgattgatccactaatggacaaggagctattgctgtctctgtcaaatagtttcaaattgctaacttcatgtaatcttctgtctgtaattctggaagctgcccttcagtatatgcaaacagatacactacctaaatcagcagaaagaaaagggtgcattgtggataaatttgttaacattttgatttgggaattaagtaatatgattgagcggatgcttttacatagtccagagcacaggtcttgcgcagttggccttcttcttcctatcattctcaaagcattacctgccaatggctcattcgaaatctcaattcgtgggcagaaacatgggttttctcggtag

SEQ ID NO: 70618 - DNA, 261 bp, Glycine max
  Peptide Sequence Number=SeqID_187396
atgtacctgattaaatttccatatgctggaaagtcattaaaggtgtcacaacctacccttcagcgagagggcgacgcgagggcttacgggtgcgtcttccatgggaggaagatgcacggagtcgccaccaacgtatattcgaggaaaacgtcggaaaaattggataggtgtggtctacgaactttaagtgtgaaaggttcgggagttgtatttacgcatggggaaggtattagcaccccacgcgtctgtcacaagggatga

SEQ ID NO: 70619 - DNA, 137 bp, Glycine max
  Peptide Sequence Number=SeqID_187397
atggctccaaagaaactctccacgaagaggtctagaagagaggccacaggagaaggatccagtgctgccttagagtttgatagtcatcgtttccggagtgccaagcaccagcagtgcttcgaggccatcaggggatg

SEQ ID NO: 70620 - DNA, 153 bp, Glycine max
  Peptide Sequence Number=SeqID_187398
atgggaaaagaaaagtaccggccgggaccccaattaaagggatcaccatcgggaccgccagctggatctcaaactggagaaatagaactccccatggctgggaactcacaatcgatagagaggcttgccacagaaagtccagaagtcgcttga

SEQ ID NO: 70621 - DNA, 171 bp, Glycine max
  Peptide Sequence Number=SeqID_187399
atggccggtgtcggtcgttatatggccccgactgatatctttcagccgacattgcgcaatttcttttacaaacgctggccgataatgacggctaggtttttccgtgcgagctcaatcgagggttcgttccgaccgacactggcatgttgttcttctcatttaggaggataa

SEQ ID NO: 70622 - DNA, 1471 bp, Glycine max
  Peptide Sequence Number=SeqID_187400
aagacatcaaatggctagaggatgcgtgggtcgagcgattgaagaacccagccatgtttgacagggtggaggacgatctgcagtgggagctgggaatggatataacccctaaatacctaggggatgacctagttctcttacatggattaagcgagattggagcagaacgagttatgaatggcggaacatatggaaatgcatctctcttctactcgatggagagatggaatccaagtatacgcacggggaataggatgatttgggttcaatgctggggtatcccacttcaaacttgggataagaaacatattagagtgctcatcaagaccccatggacgccactgatcaagcacaccgttgacattcatatcattggcgaaaccttcaagggttgcagctacagaggctcgtcggaggagatcgattccgacgaaagcctccttggtgatttacctccagctatgacaagactaacggttgttgaccacgatcataaacacgccaccgcgacagaccatcaccccaaatcaccccacaaaccttctatgccaaccgccggcgatggaaaatcctggtcgattggattacatagtggtcggcgcgggtacgattatccgtgggataagaccaacgaccctcaggtattgaccggttgtaaaggtaaggcaatggtaaactcgagcttcgaggtaagcgttgcaaatgacctttgtatgggacggcgcttaaccaaccaggagccacaggatcgtgagtttcacgataatagtaagagagataaaggagagtccagcggagtccagaaggagccttttccgccatcacatgactttgcaggagataaaatcccatcaagggcggtggacgcttatcaggaacatgaaggtgttgacgtggcaattgaaatagcgaaaaacagggaacaagaggctgatatgtatattctcgtgggagttggtcccaaaggaaacaatgtttgggtgcaatacagccgattgctaaccaagtccaagacagtgagacacatgcaaatagcagaggcaagatatagcaattctcaagaggcagccaacatgtggacaatgatcaaacaactgggggtgacattggggaacacaggaggggaccagcagagtagagtcatagcaagaatcaggtgtatggaggacagagacagaacagaagctgagaggatattgattaagaaggagaacgttgatatgatttgtattcaagagactaagaaagaagccattgataagtcattgtgtcaggcactatgggggaatgctgatgttacctgggagatgcaacctgctaacaactcagtaggaggcattctatgggaatggatcagagaggcacaacaaataagtattgtcaccatatattcaccatgtgacatccacaacaagagaattctatgggataaagtgaggcagtcgaaagattcatcccaaggggggctatg

SEQ ID NO: 70623 - DNA, 1272 bp, Glycine max
  Peptide Sequence Number=SeqID_187401
atgtcagtaaaggctatatcattaatcttgttgtggcgttaccaaatcaaaagagatgctccacataactctgctttcacttttatgtggcaattcttctggaggactactaggtcttcgctttcttgctcagagatgggagcagaaatttctcttgcagcatatgaagcattagtttcggttctcagagttcttgcttcaacatactttcctcattctttttatcttgttgaggaaaatgagcaattgttttcagagatagaaggaaggcctcggttagattatatgtgtgtatctttcattcaaaatatcaatgatctcctagggtcaggagtattggcaagaactcggagggctgttttgttggagataaagtgggtgtgcctagaatctttgctgtcaattccttcatgtgctttcaagaatgggtttaatttggaggaaaaccctacattcttctcagatgacactctaaaatgcatttttggtgatcttgttgagagccttgaaaatgctgcagaaagttgtgttttacccatgctgagatcactcagaatgttatttgagctagttgccaaagtaatgtcaaatgcagctgcttcccattgtcacttaataaacgcacagatgatgtggaatttggtccattcctcttggatattgcatatcagctgcaataagcgaagagttgcatcaattgctgctcttttgtcatctgttctgcatcctttggtatttaatgatgagaacatgcatcaaacagacaatgcacctggacccctgaagtggtttattgaaaatcttcttgaggagggcataaagagtcctcgtacaattcgtcttgcagcattgcacttaacaggattatggctcttaaatcctaggattataaagttttacctgaaggagctcaaattgctatctctctatggatctgttgcatttgatgaggattttgaagctgaactagctgacaacaatgatgctagactggaagtttctatactggccaggagtcctgatcctgagctgactgaagcatttattaatacagaggtctatgcacgtgtatcagttgctgttctgttttacaagttggcagacttggctaggatggtgggatcaccaaatgaagatgcaaactgtattgcggcacaagaatctggcaaatcatttctactagagcttcttgactctgtgtgtttagagaatggactagtgcataagcaacccacgtgggcaccggggttgttgagtgtgttgggattttag

SEQ ID NO: 70624 - DNA, 1338 bp, Glycine max
  Peptide Sequence Number=SeqID_187402
atggtttctgctggtgcttgtgtagataatttagcaatctgtcaacattctgttacagttacagttagagtgaactataacagaatggcactatcttcatatgtattcatagcagctaatgtcattctcaactcatctaaagatgttcaatctagtcatttgaacgaattgtttcctcctctagttccattattaacatcacatcatcatagcttacgtggttttacccagttacttgcatatcaaattctacataaactgtttccattgttgaattatggatcttctgagatgctacctttagagaagaggtgctttgtagatttgaaaacataccttgcaagaaattctgattgtgcacgcttacgaacatcaatggaaggatatcttgatgcttatgacccaaatagctctgttacacctgctggaattttcatcaatcgagttgaggaggatggttttgagtgtgttccaacatctctcatggagcaggttctcaaatttttaaatgatgctagagaagacctgcggtgttcaatggcaaaggatgtggtgacaatcaggaatgagactctaaatttcaatggggataagaattgcatcgaaaatttatctggtggcattgaaggaaccatgcttaaagatatgtcttcagatttccagaaaaaggttacttttaccaaacatgacaaggggggcaacgaagcaggtttcctttatggcaatgatgaaacctataaaaagttggctgttttgtatctaccattatttaatttcaagatcaacatgacagagatagagagggatgatctccttctcgaccaactattgcagtcaagaagatcatctctagatcaacaaaaagcaagtcgacagaattttatccttgttgcatcattgcttgaccgcatacccaatcttgctggcttggctcgtacatgtgaggtatttagagcatcagggctggccattgctgatacaaaaatcataaatgacaaacagttccaactaatcagtgtaacagccgaaaagtgggttcctataatagaagtcccagtagatagcataaagatttacttgcagaaaaaaaagaaagaaggattttccatcttgggtttggaacaaactgcaaacagtgtaccccttgatcagtatatctttcccaaaaaaatggtcctggttctcggccgagagaaagaaggtatacctgtggatataattcatattttagatgcttgcatcgaaattccgcaatttggagttgttagatctctcaatgttcatgtcagtggtgcaattgctctctgggagtatactcgacaacagagatctcaatag

SEQ ID NO: 70625 - DNA, 480 bp, Glycine max
  Peptide Sequence Number=SeqID_187403
atgactgtgcaaagatggctttcaggttgtggttacaaggataggtgtgccaattgctgtaataatgagataaagtggtggaagagtctttatgacttcccacagaactttgtcagcaataatctttcaattgatgtttctcttacttatgatgatgaagacttgagtgcatgggagtctgaagcaaatagatgggcaaaaatgcttttccttgctatcaagaaggatcatcctctggaacttatttttgtggaagacacatcgccggagctggaagcacaccggcaaaggcattgtcacgcgtcagagaacaatgatgcgtgggtgctgtttggcttgtcaaagaaagagcgtgtggaacgccgaatgggaaagtggttttgggaacatgtagattggcgatccaaactcgaggatataaggtccaccaaaagaaatgaggtgagcgaaagggctcattggggagagtgggttgtttga

SEQ ID NO: 70626 - DNA, 333 bp, Glycine max
  Peptide Sequence Number=SeqID_187404
atgtctctacatatatgcatttatggttttaagagttgtttttgcttgactgggttagatgaactccattccataacaatctggggattaagagccattctaaccgatcaaaataagttggttgtagcagtttgtggagtgactgctctggcagcagggaggggtctacactgcaaggttatgactcaaaacctgattttagtggtcatactcatatcattatcattacatgctaagtcctcatggttcatgatgaagtctgttggtagttggttagataactacgcccaatgtatgaccgaacgtggctctgataccactgttggtagttga

SEQ ID NO: 70627 - DNA, 1200 bp, Glycine max
  Peptide Sequence Number=SeqID_187405
atggaggaagaagttgatccatcgataaagagggagaagcacaaggaaaatagagtgatgaatgtgggctgcgaagatgatttttttgataacccaattacaaatttgatcaagaaggaagtcaaagctgttgttggaacatcaatggtgttggaatcttggaatgtcaacttgttgggtgaacctttagcattaaattttgttatgtctatggatgacaactcgacaatggagccaaggcagaagggaggaacaaagatagtcatgatgattcaagttatacggattccaccctcatccccaccaccaccgaagccaccggacctgagtttgcatgaagtggccaatgggttcacagttgttctgaaggatatgaaagaggaagggggagttttggaattcagcaaaggaggtccaactttttacatagtgggtcatgcccaaatgggctgtagaaatgagattcataaaagaggagctgaaacttggaattcaaactgggtggtaggatttatattgctaaagttggatgtctgtgtacctgatgacatgttaaaagagcagaggtggaaagagattgaagcatcacacatggagctacaagggatgcaaatgtcttccaacaatcagagaaaacttgaggaggtttcaatgtgcaattccggttttcaaattccaaccttgaggaaaaggttgatttttaggatgagtgtattgttaggatataaggagaatgaagagttagttgagataggaggtgagaagttgggttatgagactgaggcctttgcaatttatgacgtgatgaggtatgtcaagcctcctatttttactctttgtgttggtaatgcttggggagaagcagcgttgcttttggctgctggtgcaaagggaaaccgttctgctttgccatcatcaacaataatgataagacagccaattgcaaggtttcaaggtcaagcaacagatgttaaccttgcaagaagagaagtcaataatgtgaagacagaattggttaaattgtatgcaaagcatatggaaaaaacacctgagcagattgaagctgatatccagcgtccaaagtattttagccctagtgaagctgttgagtatggcatcatagataaggttatatacaatgataggggtactgaagatcgtggagttgtttctgaccttaaaaaggcacggcttatttga

SEQ ID NO: 70628 - DNA, 1806 bp, Glycine max
  Peptide Sequence Number=SeqID_187406
atggccgcctgtgggggtgtggtgaaactcagtgagaatagtggggatgacctggagacccttaggaagccatatacgaccattttgaaggatgaagtcgtcgcatatggagcagtcagggtatttggaaggatcggcttgaattcgttgacgaaattcgaggaaggcggagttgtggaggagctcctgtttaagttcctgcaagaaatgataattgggaaccgttggaagaaagagttggtggtccgtgagaatggtgaagggattgtccaacaagtactgcctccattttttaatggcggtggtgatggcggtgagttctctgacatacgtggatgcacgaagaagcctagggcagaaaggactgctcccatgccgacaccggaggcgtcagtctcgacgctgaataggatggagaagtctggcaagcttagcacaggtgcattacacagagcctgcttcaggttgaggaaagcttgttcagcgtcagcattccagaagcctcgtagggctcgagtggatcggggaacgggccaattctggactgcctcaatcttagctgacactggttccactccccggcaagacgcaatgaccgaaggtgctgttcattgtcgcctgaaaagtggacggagcgttgcagaggccgaacggcattacaaggaactcgtaatggccgggtggcgctacccagttcctccagaagttcgtcaattttgggtattggaaatcggggcttgtgcttggtctgatgatgccagattgaagcatattggccacttgagtctcaatttcatgtttttggaagtaggggtaacagtatggtttaacattgacaggaattgtgtgaggttgaagaaggataaagtgattggtgggtcagggagggggaagggtgtctttggtggtggtatctcctttaagttcaatgatattgccactgtggacaaatttcatggtcaagctgatgggcataagtggtggcactctatcgttgccgttgccaacaaggacacgaaagcgggtcttgttggtttgggtcctcgagacacgggtcaggcactcatcacagttgaagcagaggccgtgctcccggcggcttgcgatctcggcgggggtaacaagggtggggttgctgagggtaaaggaggtggtggtgtgggaaacgaagatggtgttggggggacgacgttgctccgcgagcttgtcctcctggagacgttccaacccgacggcttggacaagggtcagaggctggagaacttggacctcgcggcgaatatcgagggtcctcgtatggtgaatgcgcaaaacgggtctcgatggcctgcaaaaatcctgcccaagtggggaactggtggttgcacatcatccactggaaacacgctaagggtcggtgccatcaaatttagggacatcaagtttcattttgggagtgttgatgagggtggtttttggtacaggttaggcgaggaagaaggtgaggctgaggagttggtagtgttttcgagattggccatgcgaaggaggagatcttctaatttcgctaatgtttccaaggctgaactgaaggagaagctaaggagaatgtatgacgggaaaggcaccaaccttgtatttgtcttcaagttccgaactcattttggtggtggcaaatccactggtgtgagcctaagtacaggcttatcaggaatggaagagaaatcaaggaagcaaatgaaggagagaaagaatagagctaagaagatttgtggagttaagaagaccaaggcttctgatgctgccaagactggaaaaaagaaatga

SEQ ID NO: 70629 - DNA, 1521 bp, Glycine max
  Peptide Sequence Number=SeqID_187407
atgcttcaatctggcatcatcagaccaagcacaagccccttctcatcgtcggtcctgctagttaagaaaagggacgactcttggcgattttgtgttgattatagggctttgaacgccctaatgattaaggaccgatttccaatacccaaaattgacgaacttctggaggaactgggtagcgccacttggttttccaaactagacctcatgcagggctaccaccagattctaatggcggagtctgatatcgccaagacagccttccggacgcaccccggccattacgagttccttgtggaatatcttggtcacattgcgtcttgccggggagtggaaccagtgtcagctaagattgaggcagtccagaattggcccgttccccgatccactcgagccctacgaggcttcctagggttgtcgggattttacagaaggttcattaaaggctattcctcactcgcagctcccctcacagctctcctaactaaagactcctttcactggaatgctgacgctgaacaagctttcctcaacctgaagcaggctctgtgtaatgcacctgtgctaagcttgccagacttctccatcctattcagcgtcgagactgacgcctccggcttcttcgtgcatccacgtatgtcagagaactcaccgccatcaccaccgccattaaaaaatggaggcagtacttgttggacaatcccttcaccattctcacggaccactgcatgggccaactcatctagacaccagaacaacaacattatttggcacgcttattgggttatttcccgacggacagaagccccctctacccaactctttcttccaacggttcccaattatcatttcttgcaggaacttaaacaggagctcctccacaactccgccttcctcgaatttcgtcaacgaattcaagccgatccttccaaataccctgactgctccatatgcgacgacttcatccttcaaaatggtcgtatatggcttcctaagggtctccaggtcatccccactattctcactgagtttcaccacacccccacaggcggccatatgggcaatgcaaaaactttgggacgcattaacgaaaattttgtctggccttccatgaagcaggatgtcaagctatttatctcttcttgcatagagtatgtcaacagaccaagaacgatcaccgcaacagctcggggttactctgtccacttcccatgccggcgcgaaaagctaggggatatttatggagattgccggcaaaatccatggcatgccacgaagcctcatcttctaccgagatcccctgttcgtgagtcgcttttggcaagaactattcaagctaagcggtaccaaactcaagatgagcacggcgtatcacccctaaacgaatggccagatagaggtgatgaatcgcataatcgagcattacctccgagctttagtccaccaaaaaccgacatggggacatttcctcctgtgggcggagtggtcgtacaacacatccatccactctgctaccggtaa

SEQ ID NO: 70630 - DNA, 1269 bp, Glycine max
  Peptide Sequence Number=SeqID_187408
atgtttgacttattaaaggatgtaatcaaggaggtagggccacaaaatgtagtcataactgataatgctcctgtttgtaaggcagctgggttattgatagaagctgaatttcctcatattttttggaccccttgtgtggttcatactttgaatcttggagtgaaaaacatttgtgctgcaaagaatgttgatggtaatgagaatgtcttcaatgaatatgggtggattgctaaagtaattggtgatgcttcttttatcaaggttttcatcatgactcattcaatgggattagcaatttttaatgagttttcttctcttaaattgctttcaattgctgaaactcgttttgcctctatgatagtcatgttaaaaagatttaaattgttgaaacgttgtttgcaaaatatggtcattagtgatcaatggaatagttatagagaagatgatgtcagaaaagctgcacatgtaaaagagttgattttgaatgatatatggtgggataaagtcgattacatcctttatttcatggatcctatatatagcatgattagaatatgtgataccgatgcttctaatcttcacttagtgtatgaaatgtgggattctatgatagaaaaggtgaagacaaccatctataggcatgatgaagtgctagaaaatgaagtttctagtttctttgaagttattcatgaaatacttaattctaggtggagtaagagttgtaatccacttcattgcttagctcattctctaaatccaaggtactatagtgataattggcttaatgaggttccaaatagggttcctcctcatagagatgatgaactttctagccaaaggaataaatgtcttaagagatattttccacatgttaatgttaggacaaaagtttatgaagaattctctaaattctcatcttgtgcgggtgactttggttcatttgattcaattgaggatagatgggcattagatccaaaaacttggtgggtgatgcatggatcctctacacctatactccaaaaggtttgctttaaagcttctagtgcagccatgttcttcctcatgctgcttttgtctagaaaagaggaagggtataaaaaaggagagacaagattgtgggacattaatggagatgtacatgattcacttgatgatagtgctggaattcttgaaatggcagatttatctcttgatgagccagatttagaagctatgcttttcttagatgatggcaatggaggagaagaaaatgaaacaattagagtttga

SEQ ID NO: 70631 - DNA, 1383 bp, Glycine max
  Peptide Sequence Number=SeqID_187409
atgcagttcaaaacagattcctttgtttctttaatagaagcatataattctaagacagatagtttggttaatttaggtcctgctcagtcagtggtctgggatgccatggtgccttcaaaaaagaggacatgtgcaggtcgtccaaagccttcatctgttgagaagctcacgagagacctgtgcactattcttcatgaacagcagtcttatttttctgcatcttctgaagaggatcttcttttcgaaagtgacacaccaatggtttctgttgagataggacatggaagcattctcatcaggcatcctagctctatagctcgtgatgaagagtctgaggctagctctctctcagttgataataaacaatgcctaatgaatgaagcatattcattttctagtaccattcctatatatagtgatcgcagtagcatgaacttctcatctcacggagttgaaaagatcaaaaactcagctggccaaatcatgcaacaagagaagcttgaaaggcatgttttcccacaccaggacaagtctcagcttgaaaaactacaagttcatggaaatcatgattcaccattgtgctcaatagatttaaatgatgtagtcaactacgaggagtttatgagaaacttgacaaatgaacagcagcagcaattactgaagtatctcccagtggttgatactgctaaatttcctgatagccttagaaacatgttcaatagcttccaattcaaggagaacttaatctattttcagcaacttctcggggaaggagtctttaacatctctttgttgggggcaaaacctgaagaatggaagacattagaaaggcttgcattatctaatctgtcaaagtcgaaatgggtagaacactataattttcttaagaaatgtgaaaacaaatctggaaaatctattggtttgggttctactgctatggaatcaagtaatgttacaactggcaaaagaatgcgtgagcatgacagccgaaatcaaaatattccagaattgaagacaacgatgaggagccccaaaagggtgatcataaagcctcctagctgtgaggtcaaagaagttgtagaagaaggctctagcttcagtccaaaaagcttatttgctttaccccatggtgttggtggcttgcacatgctggattctttcaactttgttggtgagagttctgaggatctgcttttagaggtgccttctaacagttcttttccacaggctgagctcctgcacccatctttaagctatggtgctcgtcagggtccacatgttttgcatctgaaacaccaaagttcatgtacaagagatatgatgatgattgtgtttttgtttccttgcaaccttgagcttggattgccaaaggatggaagttga

SEQ ID NO: 70632 - DNA, 504 bp, Glycine max
  Peptide Sequence Number=SeqID_187410
atgggccgcaagaaaaacgaaccaaaacgcaccgtttgcagcatccctctgatcttcctctctgcgtttctcgtttcctgtggtttgatctacgccttggtagtgctaagagctccgctttcagagtcagagttgttgccactggtcgaagacagtaaagcgtgttgcagaggagtagaaaatttggagctttggggtgacgttgtgaagtggggttctgacttcaaactcaacacttcccaagagtgctgcaacgcgtgcaagtccacgtgcaccgtcaacgataatggaccttgtttgtgcgacacgtgggtcttctgtgccaaccctcacaattgcggatctaagtttggtgagtgctggctgaagaaacaaaaggacagtttagcccctgaacagataaacgcagaaggggaagtagttagttggacttctggtctcatctttggaaaaggagagggaattattgggctggaaactgaattcggaactcttcgtgtaaaa

SEQ ID NO: 70633 - DNA, 399 bp, Glycine max
  Peptide Sequence Number=SeqID_187411
atggcaaatgaatcctcatattttcaggctgcttttggtcccccttttgcattgattcaaggaacgttggaagcccaagggggtgaaggaaccatattcaagaaaattcccattgaagattgccccactataagaaggggttcagttgcttgggttggttctggtccagaattctttataagccttgccaaccattgggaatggaaaaaggaattcactgtcttcggttctgttcttccagaagatatgcacattgctgagaaaatttctacactccccacaaaatctgatgtttggaaaaatgtcaacgtgacccttttgaaaaaacccgttcctttgatgttgcggagaatcgataaaggccatgaaaattttaataccaaagcaaattcagcttga

SEQ ID NO: 70634 - DNA, 1722 bp, Glycine max
  Peptide Sequence Number=SeqID_187412
atgtctaacatccacactgcaacaagcagcatgaaaaggttgtcaagttatttgcattccctatcccaaacccctcacaggctcagaaagagaatgctagccacttggaccccagaacaggaattcaaccaagtgaggcacagatctggtgctgacatgaagaggaagctcaagtggcatgatcttgtggctcttggtgttggaggaatgcttggtgttggagtctttgtcactactggctctgttgcccttcaccactctggtccttcagtcttcatttcctacatcatagcaggaatttcagcccttctctcctctttgtgttacactgaatttgctgttcaagtaccagttgctggaggagctttcagttatttaagattaacttttggggaattcttgggatattttgctggggcaaatatactaatggagtatgtgttctcaaacgctgccgtggcaaggagcttcacagaatatttgagcattgcatttggagaaaatgatccaaatgtgtggagagtggaagtccctggcttgccaaaggattataacatgctggattttccagcagtggctctcattcttattctcactctcttcttgtgtcatagtacaaaggaaagctccatgttgaacctcattatgacagcctttcatattattttctttggattcatcataatcgctggttattgcaatggaagtgccaaaaacttggtttctccaaaaggactagctccttttggtgctagaggtgttcttgatggagcagcaatagtctacttcagttatataggctatgactcagcttcaaccatggctgaggaggttacagacccttttaagagcctacccattggaattgtgggttcagttcttataaccactttgctttattgcctaatggctctgtctttgtgcatgatggttccttacaacaagatatcagagaaagcatcattttcaatagcttttctgaaaattggttggaattgggcaagcaaccttgttggggcaggtgcaagtttgggaatagtggcttctctcttggttgccatgttaggccaagcaagatacctttgtgttataggaagggcacggcttgtgccatcttggttagccaaagtgcatccttcaaccggcacaccattgaatgccacggtctttttgggactttgcacagcaacaattacactattcaccgagcttgacattataattgagttgattagcatcggcacactgttggtgttctacatggtagccaacgctcttatataccgtcgatatgtaatcactagccatgccccacctacgcacactctcgttttcctctttctcctttccctaagtgcactatgcttctcccttgcgtggaagttcaagcagcaatggtgggttctcctactttttggcgggtttatgatcgccatcactgccttctttcaacacgtggtacttactacgactactactattcattggtccgtgccattcatgccatggccacccgccatgtccatcttccttaacgttttcctcatgacaaccctcaaaatcctctctttccaacgatttgccatatgggcatgtctcattacaatcttctacgtgctctatggcgtccacaacacttatgaggctgaggagactgagaatgaagtggattcaagtgtaaacaacttgcataccaaggtagaaattattcaagtgcactaa

SEQ ID NO: 70635 - DNA, 744 bp, Glycine max
  Peptide Sequence Number=SeqID_187413
atgagacggtcatctctagtgggtgcccttcttatagcaaacatgctaatggcaacacgccttaccctcactctccctttctctagctcaatccctccactcttaaaccgcacttatcgttccctttcacacctcaaacaattcccaaaatcccacccttgtcccctctggtcctcttccttctccttctgcctccacacactccgcaagtccacttcccctcttcgcgcttcttcctccctttctactccctccatggctgcgtcttcattagacgaaggcaatcctcttctgcagaatttcgtgttcccacccttcgatgtcgttgagcccaaacacgtgcgacccggcattcgcgccctcctcggcaagctggaacatgaattggaggaactcgaacgcagcgtggaaccgtcgtggccaaagttggtggaaccgttggagaagatcattgaccagttatctgtagtttggggcatggttaatcatctcaaggctgttaaggatagttcggagctacgttctgctattgaagatgtgcaggcagaaaaagttaagtttcagcttagactgggtcaaagcaaacctatttataatgcgttcaaagccattcaggagtctcctaattggcagacacttagtgatgctcgcaaacgtatagttgaaagccaaataaaggaggctgttcttaatggagtttctcttgaagatgataaaagagaaagttttaacaaaattgaacag

SEQ ID NO: 70636 - DNA, 885 bp, Glycine max
  Peptide Sequence Number=SeqID_187414
atgactaacttagggaaattgtcatatttccttgggttagaattcttgtggactgaatatgggattgtcatgcatcaaaggaaatatgctggtgaaattctgcagagatttgggatggaggattgcaatgttgcaatcacaccggcagaaacaaaccagaagcttgaagacaagcctgaggaagaaggtgttgatccaactggttacaaacagttggtaggctcactgagatacctctgcaatagcagaccagatatctgttatgccgtaggcgtgctgagtaaattcatgaataggccaaagaaatctcatttcttggctgccaagagggttctaaggtatgtgaagggaactatgcagtatggcgtgatgtttccaagtagtgttgatggtgctgagatgaaattgattggttactcagatgctgattggtgtggggacaagacagataggagaagcacatctggttacttgttcaaatttggtggagctgctgtgtcttggagctcaaagaaacaaccagttactgctctctcaagctgtgaggcagagtatatatctggttcctttgctgcttgtcaagcaatttggttgaaatcactgcttgatgagttgaaatgtgaagtacagatgccactgtcattactgatagataataaatcagcaattagtcttgctaaaaacccagtctcacatgggcgtagcaagcacatcgaaacaaggtttcatttcatcagagaacaagtgaataatggagttctgaaattgatttactgtcccactgaagatcagttagcagacctgctaatcaaggctgttaaaccagacagattcataaagctaagggaagagattggagtcatttgttttgaagatttgaattaa

SEQ ID NO: 70637 - DNA, 1530 bp, Glycine max
  Peptide Sequence Number=SeqID_187415
cagtcatctcgaaacacctacataggagacgaaggtacaagaggaatatccggcggagagcggcggcgggtctcaatcggcgtggacatcatccacggcccatccctcctcttcctggacgagccaacctcagggctagactccaccagcgcccacagcgtgatcgagaaagtgcacgacatcgctcgcggcggcagcaccgtgatcctcaccatccaccagccctcatcaagaatccaactcctcctcgaccacctaatcatcctcgcaagagggcaactcatgttccaaggctcaccccaggacgtggcactccacctgagtcgcatgccacgcaaaatccccaaaggagagagccccatcgagcttctcattgacgtgatccaagagtatgatcagtctgaggttggagttgaggcacttgctgagttcgcacgcactggtgtcaagccacctcctttgtctggccaacaacaacactctgtgtcttctgttgctccgtcctcgcaccttagccataggtatgaggaaaattctcaggacttgtcttactcgtcgcaagtgagtagaagggtcgttgatggttttgatcacagtctcagaagttcccataacaacaacacatcaatgtcgtggagcactgggaatagtgcggcgtttttgaaattcactccttcgcggcttaagaatgatcacaagctgcagaataccgcgagaaccaatgcttcacctggatactacgcacactggagtgaaatcctcgaagccactccaacaccccgtagcagtgactacacagtgaatgagaaggactacctcgctccctcaaacgccacacaggaacaccttggagcaaagtttgcaaattcctacctaggagagatttggatccttatgcgtcgcaacttcataaacataaggcgcacccctgagctcttcctttcaagactcatggttctcaccttcatgggcatcatgatggccaccatgttcttcaagccaaaagaaactttgcaaggaatcaccaaccgcctcagcttcttcatcttcacagtgtgccttttcttcttctcctctaacgacgccgtcccggccttcatccaagaaaggttcatcttcataagggaaacctctcacaacgcctatagagcttccacttacaccattgcaggcctaatcactcacatgccctttattcttctccaagcaactgcttatgccgtcattgtttggtttgccctaaaacttagaggcccttttctttacttcttgcttgttctcttcgtttctcttctttcaaccaattcatttgttgtgtttgtgagctcagtggttccaaactacatcttgggttatgctgtagttattgccttcactgccttgttcttcttgttctgtggatacttcttgaacagcaacgacattccccattattggcgttggatgaacaaaatttcgaccatgacgtacccttatgaggggctattgatgaaccagtaccagaccaatgatacctttgggtttgggtaa

SEQ ID NO: 70638 - DNA, 1662 bp, Glycine max
  Peptide Sequence Number=SeqID_187416
atggagttaccagatatttggatattaagactggttgtggcatgtgttttttgtctgcttatatttatcagatcggcttctggctctgcaactgaaggctttgaaaacatagcatgctgtgctgattcaaactacacagatccccaaaccaccttaaattacacaacagattacagatggttccctgataaaggaagttgcagaagaactaaagatgtgttaaatgaaaaagttcgactgttttttgtagatgaaggaaagagatgttacaacttgccaacaattaagaataaagtatatctgataaggggcacatttccattcaacggtgtaaattcttcctttaatgtctcaattggggtaacacagttaggtgcagtgagatcatccgggctccaggacttggaaattgagggaattttcagagctaccaaagactacatagacttctgcttagtgaagggggaggtggatccctttatttctcaacttgaattaaggccattgcctgaagagtatctacatgatttgcctgccagtgttttaaaactgataagcagaaatagtttttggggcacaaaagatgaaataaggttcccaaccgacccaagtgatagaatctggaaagcaacttcaagttcattatctgctcttctattgtcttccaatgtcagcaattttgacctcaaatccaatgtgacaccacctctacaagtcctccaaacagctgttacccaccctgaccgattacagttcgtcctcagtggccttgacattgaggataatgaatatcgtgtatttctctacttcctagaattaaatagcactgtcaaagcaggcaaaagggtgtttgacatctatgttaatggtgagattaaaaaggagagatttgatatattggctggagggtccaactacacatacactgtcttgaatgtttcagcaaatggattacttaatctaaccttggtcaaggcctctggagctgagtttggaccccttttgaatgcttatgaggtcctgcagatgcgatcatggattgaagagaccaaccaaaaggatgtggaagggattcagaagattagagaagaattgctgttgcaaaaccaagacaataaagcactagagagttggactggagacccttgttttttcccctggcaaggaataacatgtgacggttcaaatggttcgtctgttatcactaagctaaacctgagccacaacgatttcaatggttatatcccctcgtttccactgtcctccctgttgatatcaatagatttgagctacaatgatcttatgggatcacttccagaatcaatcgtctcactgccacatctaaaatcgttgtattttggctgcaacaaacgcatgagcaaagaggatccagcaaatttgaacagttcaccaatcaatactgagtatgatactctctctgaaatgaaacaacaaaactatggaagatgcaaaggaaaagaacctagatttggacaagtattcgtcattggtgctattacatgtggatcacttttgattactttggccgttggaatcatttttgtttgccgctatagacaaaagttgattccatgggaaggatttggtggaaagaactacttaatggaaacaagtaggcattttgtcttctctagtccttga

SEQ ID NO: 70639 - DNA, 1623 bp, Glycine max
  Peptide Sequence Number=SeqID_187417
atgaactccctcaccacactccgcagactcaatctcagcttcaacaaactaaccgattcaatcccgaagctcccacccaacttgctcgaactcacgatgaaggccaattctctatctggacctctccaaaaacagagctttgaagggatgaatcagttggaagtggtgaagctcagcgagaacgtgcttaccggaaccgtgaatccaaggctacgcgctcgtgaatctcggcacatatcccatgctgtccttcctgttgattttgtacaacacgctgcgtggcgcaatcctgctggggtatgggcagatcaagtccatgaagaggctgttcctcgacgaaggttgaagggagaagaagatagatgcagtcccagcttctacaccaatattttggtggcagagaaagatacgaataaaggaaaagcttctaagagtcatccaacgaaacaacatactgcatatcatgcacagacgacttctcaaaatccaccatgtgcttcacaaccaacaaattcaatggaaggggcacactcacctgctaggacatctgatgtatcacctccaccttcaatgaaaggggtacgctcaccatgtacatcacaaccaacaaattcagatgcaggacgtgctgatagatcttttgcttcattagagacacagagaaatgaggccaagccaattttatatcttgatgggcaaggattcttaccttctcgctctgctgctaatgggattggggatatcctcaagaagaattttactgatccttggccatcatggaagaagataccaattagcactagaaactcgttgtttgaagagtttttggaaaagttctctgtttctccaccggattacaattgggcaaaaaagaattttgaaatgcgaggttcagtattgctgaaaaataatctaaataaggctcgaaccacaatggataaacctcattggattacagatggtgtctgggagagattgtgcaatcattggagatctgaaggattcaaaaagaagagcacccaagcaaaaacaaatcgagcatctaattgtggagcatctcacactggtggctctattagtgcttcacagcatagagctaatatgatgaaagagactggaaccattcctactccattggagttgttccgtcgcatgcaccaacgtaaggacaacacatgggtggataggagatcacaacatgaggtatttacacgcacattgaaacaattgaccaaaagagcatcggcacaaggtaaacctccaccaagtgagttagatgtgtggtgtgatgtagctagatcaaagaaaggaaaagtttatgggtttggaatggaatctacagtaatggcaacaagtccttgctatcgttgctcatcttcttcatcaatggagtgggtaaaaaaacaagagtttgatgaattagcaaaagagatggaagaagttaaaaatgaaagagataagcttcaagccagagttgcaaacactgagaggcttgttgagcataacaatgcattaatacgagaattgattgaaagcatgaaatttacagtaaatgatagtcaagatgaaggcgaagagtctgaccgtgaatatgaagacgaggagtcaccaagtgaaccatag

SEQ ID NO: 70640 - DNA, 865 bp, Glycine max
  Peptide Sequence Number=SeqID_187418
aatccctgccctatcaaaaatcattattgccgttgttgacttcgacatttctctcaaagatgtctttgtcttccacttgcatactctcaacattgaagttgaagatcttggaatctcttcctactactctgctagagtcaaggccaagaagaagatgaagatccaagaagaattggtggaagataaagaatcaaccatggaagaaaaatatatagagagaggggggaggggaggagatcgtgctttagaattgcccttatcctggggcaagttcattatttgggctgaatggtcgtataacacctccattcatgccgcaacagggattactccatacaaaaccacctttgggaagaaaccaccctccatccctcaatacctcattggaacctcgaacatagatgtcgttgatgatttcttaaccagtcgcgaaatagtctttgccatgggattgggtgctgagaagataggcccaattgcttatcacttggagctaccccctcattcccgaatacaccctgtatttcactgctccctccttaaaccttttcaccaaaattcttctacgcacacccctgttggtaacttaccatctaagttcgtggacaatgaccctgtgattactcctctcgtgattctgaacaccaaatgggctccttctgctaatgggctcgagccgttggaaaactaccaccttgaggacaaggtgcttccagatgagcaaggggatgttatgaagcaacccagcataggggagctgcaagtagacaaggaggagacaagcactaacctcagagctaaaaggaaaacgagcaagcctcactacctggatgattttgtaattaactctgaccctaagcgctaa

SEQ ID NO: 70641 - DNA, 249 bp, Glycine max
  Peptide Sequence Number=SeqID_187419
atgaaaggctacaaggtttggacctcaaccttcaacagcagcaccaccaccaccttcatccctttcaataataatctctccccaaattacccgttaacccctccatcctatactgcttcaaactgcttcccatccttccaaagccaaagaccaaaacttatagctcagaatttcaaaccccacattcttctatgcacctctctgcccatgttaagggtgtcactagagttgggtagtagtataatatga

SEQ ID NO: 70642 - DNA, 489 bp, Glycine max
  Peptide Sequence Number=SeqID_187420
atgactcaagccaatggccaccgtcgtgttgatcaaacagtgattgacataaagaaaccgccggtgagcttcaccgggggtctggtgttcgagtgcctcacttacaccgttacaaagaagaagaaggttgaggagaagtggtcgaatcaagaggtggacctgctgcatgaaatcactagctatgcaccaaagggttgcatcactgcagtgatgggccctagtggcgcaggaaagtccactctcttggatggccttgctgggaggattgcgagtgggagcctcaaagggagggtctccttggatggggcaactgtgagtgcaagcttgatcaagagaacttctgcatatatcatgcaggaagataggcttttcccaatgctaactgtctatgagactttgatgtttgctgctgattttcgtcttggaccactttcacttgctgataagaagcagagggtggagaagctcattgaccagcttggcttaacg

SEQ ID NO: 70643 - DNA, 2131 bp, Glycine max
  Peptide Sequence Number=SeqID_187421
atggaaccacaacaagaaatggagtggaatgaggcccaaaagattccaataagcgtggaccttgaggtcgtagcaaaaaaacagcttcagttccttgcaactgttgataagaaccgtcacctctatgacggtcctgcccttgacagagctatctataggtacaatgcttgttggattcccttgcttgccaagcattccgagtctccgatttttgaagggccattggtagttcctcttgactgtgaatggatttggcactgtcacaggctcaacccggtaaggtacaaaactgactgtgaggaactttatggacgggtacttgacaactttggtgttgccactactgttgaaggaatttgtggctggcaaactgaagaaatctggaataaattgtatcctgatgagccctacaatgctgatttggttaatcttctcccagaggatatctctaaaaggatttctaagcttgaaaaatacaccaagtatgatttgatttcagctgctaagaggcagagtccattcttttaccaggtatcaagaacgcacatgaaaaatgatctctttatcaaggaagctgtggccagatacaaagggtttctgcatctcatcaagagaaacaaggaaaagggtataaaacgcttttgtgttccaacatatgatattgacctaatctggcattctcaccagttacatccagttgcttattgtaaagacctcaatgaagcacttggaaaagtattggagcatgatgatacagactcagacagaactaaaggaaagaaactggatcttggtttttctggaaccaccagacagtgggaagtcacatttggtacaagatattggaaggctggagcaatgtataggggtaatgcaccgtctcctatcacaagtaacccttttccatctagcattacttgcaagaaggttgtttcatcaaatgagtacccacaagaaatttcgctaccagatcggaaagttatggaggttctcttggagttcattggggttaaaaacttaccagagggacaggaaggagatctctgtgttttattttccaaatcacagcctgatgcattttttgatgctaaaaggagactgagtattttatcagtgtctagagagaaacaggttgcatctttccggtgtgaaccaacaggagagctgctttttgaactcatgtcctcttcttcttccaagttatcaataagaaaatcaacaaagacacttggttctgcatctttctctatgaaagactatcttgacccagtttcaaaactctatgttgagaaatggttggagttggtgccgggttctggtactatgagctcaaagccaatcttgttacgagtagccatctcatttactgtcccagttcttgccccatatacacttgaaatgactcagtctcgtccattttccaaaaatacatgtctcttcaaccttcctgttaggcctcaacatgctaaaagctggacacatgtaacagatgaaaatggcaccagaatcatcagccttcaaatgagggatttgaagaatgcaaagaacataggaaatcctggaaaggaggttgttggcctcatgaaatctggtgaaactcgcactcttgctgagtttatggaaaatggatggtctattttggagaatctttggttgtttcaccttccaaacaaatctacaaatgatggtcatctctttgagcttactggtgccaacaaaagggtgagaattttccccggaagaaagctagactatgaactgagacacaatgggaaacggggaaatgaaatgaatttcctaacagctgttgaattctccatagaagaaccctatggcaaagcagtggcattgcttgacttgagatctagacatgtcacggcaaaggagaagtggatggtgcttcctggaatcattttgacttttattgcttccaatataatgaaaaaagaaggatatgaaggcatcattgctaaaagtaaagatttgaaggtgaatggcccaaatgaggaaaatgaaaagacagtcttgaatggaacggggttgagttctactaatatgtgcaatgatgatgaggggataacatacaaatctgagatttccattggaggctgtggaaatgcagtggaaagtg

SEQ ID NO: 70644 - DNA, 441 bp, Glycine max
  Peptide Sequence Number=SeqID_187422
atgtcagaattcaacatcttcaacgacaccgggctacaacgatgcatgataaccgatgtagaaagcctattttctagtaaaacaataaagctacaccctcctacaccactattgcttcctagagaaagcaaagaaaaatgtcagatcaatggatatgaaattcttgctagaacaagggtcttcatcaatgcttggctattggaagagaccctaagtattggattaatgctgagacatttaagccagagaggaggaccaggcattgcatttgccatagctgacattgagttgccacttgctcatttgctttaccattttgattggaagctgcctaatggaatcaaacttgaagaacttgacatgagcgaatcatttgggcttagtgcaagaagaaaaaacggactatgcttgattcatattattcatcacctgctattataa

SEQ ID NO: 70645 - DNA, 1425 bp, Glycine max
  Peptide Sequence Number=SeqID_187423
atgaaaaagaaatctgcctcaactccaaatttaccaccagggccatggaagctacctatcatagggaacatactcaacattgttggctcccttccccattgtcggctaagagatttatcagcaaaatatggacccttgatgcatctgaagcttggagaggtttctaccattgtggtttcatcccctgagtatgctaaagaggtgttaaacacccatgatctcatcttttcatcaaggcctccaatactagcttcaaagataatgtcttatgattctaagggtatgtcttttgcaccttatggtgattattggagatggctaaggaagatttgtacatcggagctattaagctcaaaatgcgtccaatctttccaaccaatccgaggggaagagctcactaatttcatcaaaaggattgcatcaaaagaagggtcagccatcaatctcaccaaagaagtgcttacaacagtatctacaattgtttcaaggacagcccttggaaacaagtgtagggaccatcaaaaattcatatcatctgtaagggaaggcacagaggctgctggaggttttgacttgggagatttgtacccttctgctgaatggcttcaacacatctcagggctgaagcctaagcttgagaagtatcatcaacaagccgaccggataatgcaaagcatcatcaatgaacatagagaggctaagtcaagtgccacacaaggccagggtgaagaagtggcggatgatcttgtagacgtgctcatgaaggaggagtttggcttaagtgacaatagtatcaaggctgtgattttggatatgtttggaggtggaactcagacatcatctactaccataacatgggcaatggcagagatgataaaaaatccaagagtaacgaagaagatacatgctgagttaagagatgtgtttggtggtaaagtaggacaccccaatgaaagtgacatggagaatctaaaatatttgaaatctgttgtgaaagagacattgagactgtaccctcctggtccccttttgcttccaagacaatgtggacaagattgtgagatcaatggttatcacataccaatcaaaagcaaggtcatagtcaatgcttgggcaattggaagagatccaaaccattggagtgaagctgagaggttttatcctgaaaggttcattggaagttctgtcgactacaaaggaaatagttttgagtacataccatttggtgctggaagaagaatatgccctggcctcacatttggcttgaccaatgttgagcttccacttgcatttctaatgtatcattttgattggaaacttcccaatggaatgaagaatgaagatttggacatgactgaagctcttggagtatcagctcgtagaaaagatgacttgtgcctcattcctatcactttccatccttag

SEQ ID NO: 70646 - DNA, 501 bp, Glycine max
  Peptide Sequence Number=SeqID_187424
atgaaaggaatatcctatcgagggaatcatatttgcttcggaagatatgctcttcaagcacttgagccagcttggataacatctagacaaatagaagcgggacggcgggcaatgtcacgaaatgttcgccgaggtggacaaatatgggtacgcatatttccagacaaaccggttacagtaagacctactgaaacacgtatgggttcaggaaaagctgataatagcggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctgtaattgtacgtactcgtaaagaactcaaacgtagcaacggtataataattcagtatgatgataatgctgcagttgtcattgatcaagaaggaaatccaaaaggaactcgaatcttttgtcaatcgcccgggaattga

SEQ ID NO: 70647 - DNA, 165 bp, Glycine max
  Peptide Sequence Number=SeqID_187425
atggataagagcttgaaggtaggagaagatgagtggaaagagaaggagaaaaggagcacgagaaaaggagcacgaaattttatgcctcaaataagggtaaggtctgacaacccctttcctgggcatcttcccatgagggaacatagttcttcaccaactcaatga

SEQ ID NO: 70648 - DNA, 156 bp, Glycine max
  Peptide Sequence Number=SeqID_187426
atggtgaacgatattcgattcttcgacctcaacaccggcgccaagatccctttagtctgtctgggaacttggcagtcaaatcctggccttgtttctgaagttgttgctgctgccatcaagaaggctttcttcaagttgtttgatgtttgttgttaa

SEQ ID NO: 70649 - DNA, 459 bp, Glycine max
  Peptide Sequence Number=SeqID_187427
atgagagcactacacgtcctccccgtcagaggtctacatgcccccgccatcaaaggactacacgtcctcaccttcagagggctacacgccttcacctttaggggactatatgtcctatccttcagagtgctgcacgccgtcacctttagaggactacacgtcctcaccttcagaggactgcacgtcctcactatcagaggaatagacgtcctcgcctttagagggctacacgccctcaccttcagaggactgcacattatcaccttcaaaggactacacatcctcaccttcagaagactacacgtcctcacattcagaggactagacgtcctcgcctacaaagggttgcatgtcctcaccttcagagagttgcacgtcctcgccttccgagggctacacgccctcaccttaaaaggactacacgtcttcaccttgaggactttatggcctcacctttaa

SEQ ID NO: 70650 - DNA, 477 bp, Glycine max
  Peptide Sequence Number=SeqID_187428
atggcggcagaaaaaggtgttgagatggtggcattggagtgtttgggaaaaaggttcaatttggccagcaattttcggttgaggttcgcaaagggaattcagaaagagaggttggtggtgcttgatgaacagaacaagagggatattttgattcctggaactagaggagttaccattaaaggggtttctaagaatattcattgtgataaaggggattacgatgtcgtttccctctgtttccacattgacgaccaccaccctgtccaagccaaaatcgggcgtaaaaggagggtcaggaaagtaggctctggttcaacaatgtctatattgagaaaagagttacgagaaggagccttgcagtcccttcttggaagttcttcatacttagcttcctccaattctgagcctgatcctttgttatcatcttttatgtttaacccagctgtaactgatgattcttttgttgaagatactcta

SEQ ID NO: 70651 - DNA, 300 bp, Glycine max
  Peptide Sequence Number=SeqID_187429
atggtgtgccaaaagggattgctaatcggtatctgcaatcttgagaatacgaagcatattcttagaagcacaccgaaacgacgcgtaggaagaagaccaatgaagaacaacaagaacgtcatggttgatgctccaggaaatgacgactttctgagagacacgatgattggtgggttcacgatattcaatttcttccttcagactataatcattaccatttttgtattgttcaaatgtaatcaatcaatggtatattcgattatcttacatcctttaaattctaacggcgtaagagtatga

SEQ ID NO: 70652 - DNA, 228 bp, Glycine max
  Peptide Sequence Number=SeqID_187430
atggccaaggagagaaaagacagtactgtcaaaatggttaatggattcaggaatcaaatgctgaatgctattaaaggcttctcaagatcacctcaaaatggattgttcataaattcatgttttgctcactgccaatctgagaggcaggatacatggtttgctgacaattctcctgtcattgggaacaagaatattcaccttgagaaaaattctaggacatttatgtaa

SEQ ID NO: 70653 - DNA, 919 bp, Glycine max
  Peptide Sequence Number=SeqID_187431
atgaacacaagtgatgacaagttaaaagttgcagcacaagaaggtgacataagccttctttacacactaattcaggaggatctacacgttttggaccacatggatttgacaccatttgctgaaacacctttgcatattgttgcatgtgttggacatctccagtttgccactgagattatgaggttgaaaccatcatttgcttcgaagttaaatcagcaaggattcactcccattcacctcgatatgcaacatggccaaaagagaatggtgcttcgctttgtagacatcaacaaagacctcgttcgagtcaaaggaagggagggcctaactccttttcattttgcaagtcaaaaaggagaaattgaccttttagctaactttctcttggcttgtccagattccattgaagatgtgactgttagatgtgagactgcacttcatattgcattgagatctcaacagtatgaggcttttcgagtcttagtcgggtggctccagagaacacgccagagaggtgcaactacattagaaaaaacaatactaaactggaggaatgaagaaggcaacaccattttgcacgtctcagcactcatgaatgactcaaaggcaattcgattgttggtaaagactaaggtggatttaaatgccaagaattgggagaacttaacagcattagacatagcagccaatgcagaggtaaagattgtgttagctaaggctggtgcaaagcatggttcatcaattactaatgctcccacctttcctgataaactaagatccaacatcacattgatggaaaaaataattatcttcatacttcgcattagaagggatataacagaagaccaacgcaacgcgtttctgatagttgctgctcttgttgcgaccgctacttatcaatcagcactgagcccccctg

SEQ ID NO: 70654 - DNA, 216 bp, Glycine max
  Peptide Sequence Number=SeqID_187432
atgtatatggaagcgggaaatatgtttgatgaattccaatgcaacctgaatgctcaaaagcgcacaactctgacaattttatgcatcttaattgatgcaatcctccctaggaaaggaccagtcactagagccatgagcaagaggctccaagaggattgggctagagctactgaagaaggcctaaaggttctcatgaaccttggggtagatttttga

SEQ ID NO: 70655 - DNA, 339 bp, Glycine max
  Peptide Sequence Number=SeqID_187433
atggtgggtcccacttctacaatgtgcagttgcggaaagtcttgggacattactatgtcagacataaagttgcttctccataccatccttagacaaatggccatgccgaggctcaaactattccctagaaggctcagatccaagtggtctagcccctttacaatcaaggacgtaaagctctatggtgcaatggagctgatggacccttcctcagccgacctgaaacacagttgtattgtaaatggtcaaagagtaaaggtttacaatggtggtgatattaagagattgaccaccatcatagaactccatgagccatgtgagtcctttgcatcaagctag

SEQ ID NO: 70656 - DNA, 165 bp, Glycine max
  Peptide Sequence Number=SeqID_187434
atggtgatttccagccatggagttgcagcgaaagataaaggagaagagcctagcacatgggaagtttccttgagaaggaaggaaggtagcttccttgggaagctagaagaagaaagcttcgttgagaagctagaggggggctactcacacccctccaatagctaa

SEQ ID NO: 70657 - DNA, 624 bp, Glycine max
  Peptide Sequence Number=SeqID_187435
atgacggtgatccataacgagaagaatgaccttgtcccaacacgaacagtaaccagatggaatatgcatattgattaccgtaaattgaatgatgccaccaggaaggaccattttcctttgccattcatggatcaaatgttggaaaggttgtgtgatgcccttgccaccttccagagatgcatgttggccatttttgctgaccttgttgagaaatacatagagaggttcgttaaagacttctctaagattgccaaacctttaagcaacctatcgaacaaagatgttgtgtttaagtttgatgaagaatgtatgctagcctttcacaccctgaaagggaggctggtgtcagccccagtgattgtggccccaaattggagccaagagtttgaaataatgtgtggtgctagtgactacgttgttggtgcagtgctaggacagaggcaaataagatgcttcactcaatttactatgccagataatcctcatctattcaagcttggagcagataacttattgagaagatgtgctaccagggaagaggttaggagcatactatggcactaccacaattctccctatggaggacattataacggtgaccagacaactgcaaaggttctataa

SEQ ID NO: 70658 - DNA, 648 bp, Glycine max
  Peptide Sequence Number=SeqID_187436
atgtatcacaaaaaaagggctaaacttgaaaccaaggatgataaaggcaatggaaccaaagtagttccaattcatgccctaattaagaaagttgttagaaaaagatcttcgtacatcaaggctaatgcaaattcttatggaaaatcactggctggtcttcgtcgactcttggaggaagatcttaaacttgataaatttactctggatccttataagaggtttgcaagtcaacagcttgatgaggtattagcatcgtctgaagttcctgaaccttcaaataatgttaagaaaattgttaagaaaaaacctaataccaaagtaactaaaaaggtcagcaatgaagagaactctgatacttcagataaggagactgatgaagaagagagtgaggaagatgaacattggtctatttacaaaacaaaagttgaaaggaaagatattgagctggtagacgaggaagaagcacaaattggtgttgatcgttctagtgcaacctctaataaatgtgagatttataaggaagaagcacggaatgcagcacagaagcataaaacaaagagggtggagagtgtcaatgctgatgcagaagcctttggtgatcactggaaaattcagattgctttatgcattctgaagttgaagcactag

SEQ ID NO: 70659 - DNA, 246 bp, Glycine max
  Peptide Sequence Number=SeqID_187437
atgatgcaggagaacttcttccaaccagtggcatggcttgaagaccggccttcttctactgagggcaatgagcttgctgctactgctaaggtggagactgttgttgctactactgctgaggtggagcctgtagctgatattgctacagagactgaggcaagaccttctattgctgttgatcctctttatttattgttttctttttgtgatattacttacactacaatactttggtttaccgcttaa

SEQ ID NO: 70660 - DNA, 399 bp, Glycine max
  Peptide Sequence Number=SeqID_187438
atgggagaatcaaaagaattcttagactgtgtcgttttgaattctttgacaagggagaagggagacacaaaagaattcaggcggttagtcctttgttcttttggaaaacgaagaagagagacacaaaaagaattcaggcggttagtccttggcgaattctttttggcaaagggagaagagaatgaaaagatgaatagcacaagttttcaaggtttggaaaacccgaaaacttcagaaaacttttggtacaatgaagaagaagttcaaagagattcaaggcttgtaaaggattgtaagagattgattggaaaagtattcaagattatcgaaatgcaaaacaaagcgttgcttttatacactcttcatgtctggtcaagacaaccattagaagagttatga

SEQ ID NO: 70661 - DNA, 549 bp, Glycine max
  Peptide Sequence Number=SeqID_187439
atggctttcaaattaagttccgaattagtggatgctgccaaaggtagtggcgatgccatacgcaaaaaggaagagactcatagaatggcagaggcaaatagagcttttgcacattttcgcgcgcttggacgtcttgagcgcggcgacgcgggccagccggcgttcctcgtgcttggccagcagctccttgaggtacttgccggtccagctggcgtcgaccttggctacgtcctggggcgagcccaccgccacgatctggccgccgccgtcgccgccctcgggacccaggtccagcagccagtcggcttcggcgatgacgtcgagattatgctcgatcaccaccaccgtattgccggcttccaccaggcggtgcagcacgtggatcagcttttccacgtcggccatcgacaggcccacggtcggctcgtccagcacgtacagcgtgtgcgggatgcgcgaggcgcggccggtcttgatcaggccgtcggtcaggcgcgccttggacagctcggtcacgagcttgatgcgctgcgcctcgccgccggatag

SEQ ID NO: 70662 - DNA, 273 bp, Glycine max
  Peptide Sequence Number=SeqID_187440
atggctacagccaggtgggcactcaagcatcccgtttatggcattgtgatactacggttgggaatttgcacaaacagacccaacgtttccaagaaaaaatggaaacataaacataagaatggatgcgacctctaccctgaactgatccggagtagggcatggaaaagaagtaaaacccaggctctgcaggctgaggctcaactggtaaagacaatcatgggtctgtacatgcgcccggtggttggccgcctgctggcgaaccaaatgccgtaa

SEQ ID NO: 70663 - DNA, 1223 bp, Glycine max
  Peptide Sequence Number=SeqID_187441
tcttcataagtctaagctttgaattgagtgttgttgtcagtgacaatggcataggggaggttatacctataaacgaggtgtttccagggccaaggggagctcagacagtgaagatttttaggaggagtgtgtggcatgtctgcaaactcttggcattgcatgcatctcctgggggtcatcttgtttggttccttcttttcttcgaccataatttccttagtatctatggtgggagtttggagcgtctcttggatgatggtcttgagctgcctaaccttcttggtgctagccagcttggagagcatgttttcttgagtattgctttcactaaggatgtaatacattttgaaacattcaaaatttttgatgagagacttcacaatgtgatagtacttgagcaacattgtttccttggtctggcatgtgttggtaacctgcctttggacaagttgcaagtctatgtagcatcgaagcttcttagctctgacttttctgcctggttgtttgaggctctaaagttgagcttgagggcatgcactagagtgacattgttagggccttcgaggatgatccctgcctcacttccttttacattggatgcaccgtcgacgctttctctaaacttgcttgatggggtagttcgtcttgactaccacttgatgactctaaaagtagggcctaagtcgtcaggccgaggcgcatgtcgtatttgcggagttcctagaagacttctttcaagtccgccacatgttgggattagtgtagttggtgtacattcatcatttgccatcgacctttttgaccatgacgacattggcgagctaggtagaaaacctgacttctctaatgaacacatcggtgatgcaccaatgcttgtgactagtgaggtccctactgagccacgtgcattgcctgggtttagattcaagttgcagctggacaagctctttgatgggtttcgagcctctattggaggtgtcatctcacggatctatgtcaaattcactgcccaggatggcttggtagacaatcagggctcagatttgagacccttcctccacggtcatgactcaagtgacttcagccattgtgtgtatgtctcgttaagcgaggcaccagcgcgctcaacaaggtacaagaatttggcagagaatctgccttgcaagcacacgctcagcgcgttgtcactcgctaagcgagtcatccgtcatcttccaggctaa

SEQ ID NO: 70664 - DNA, 453 bp, Glycine max
  Peptide Sequence Number=SeqID_187442
atgaatgtaaagagaagagaatatatggttggtgtgcttccaaagagaagaatactgatgcggcatgggaagtcacaggggaaccaagacacagcagcatacaccaccacacccgaccataacattcagttaacggtgcaaggcatggcccaggccctccacaccggcgagcacctccatcgcgtgatgggtagtgatggctgctcccctgattggcgggtgcagttctacgtgttcccctatgtccacacccaatcgatgttccatgagcttaggaagtgtttcttgaagaagagggtcatcggcgtgagggaagagttgcgagttcgagaacgagatttcaggaactttcaggtgaaagagaggatgaaggtttggagtagcaaagcaaaggcatatagaaaaagagtcagtgaagaaaactcattccaagaaattgcaaaatacaagtga

SEQ ID NO: 70665 - DNA, 513 bp, Glycine max
  Peptide Sequence Number=SeqID_187443
atgatgttgctatcagcaactcataggaaaaataaaaaatcacatagcaacactgcaaagaacaggaaaaataaaaagtctttgcagtttggacacaacaaaacttactccataaagaaaagggaggaaatagcaagttggccttgtaaaagaaggaatcaaacattacctgaatggttaaaaacggaattcagattaacaatgaatttactgcaaactacaatatctgaggatatgtataagggtattaaagctctcaccattgacaaggataatgctccaaagtgcagcaaggaatatttcacgcaagggtctaacgtgtttctcgaaggctttgaggatatttcatttcacgcaagtaagaccttcaaattcacagaggtcaaaaaggacatagtagcctctgtgaacacaccggcacaagcacacggcaacgagatccacaaagtcggacaaacaggcacaaccacaacaggcacaggcacaaaaaggaaccgaaacaggctgttttga

SEQ ID NO: 70666 - DNA, 176 bp, Glycine max
  Peptide Sequence Number=SeqID_187444
atgctctgggtcaaacacccacgtcactacatgaaagagctaagagcatttcgggtttttataaaggaagcgcaaaacatgcaatggtggttccaaagtcagaaaagatgcaaagaaaagctgaaactaacaagaaacaagcgtagaaccatggttaccttgaaggaaattgaaag

SEQ ID NO: 70667 - DNA, 597 bp, Glycine max
  Peptide Sequence Number=SeqID_187445
ccagagaagaaggacttgggtggcaaagtggatagtatggcgactaagagggatgggcttgccaggctggaggagtccgagctatgggctgcccaagaaaagaggctagtagggagcttgaggaagagttgcttttgtacaagaagaatcatggagaaacatgagaaatgctttcagaaggctgttaggcaggccggtttctttgagaatgaccttgtgtctaaggaccatggcggtcttgtaaagagtaaagtgtggcgaagtcatcttaggtttgatttcaacttggttaaaggtcttgtcacccctttggtaggacttccttctggtcttgcgaaccagtttgggggtaggtcgcttgacctgcttccttatctgatggttatgaggagtaaatgtgagttgtacctaattgaaggtcttgtcatgcaatctggtgttcattttgttgaagttagaccttggacgatggttgtcatagttgctgcgagtaagttgaccaaggggggctcatcaagggtgaaccttgggtttcttgagccttggaccggagacgtgtttgccttgggttttgtgaagcctacgaagctgtattga

SEQ ID NO: 70668 - DNA, 243 bp, Glycine max
  Peptide Sequence Number=SeqID_187446
atggagctaaaggcagaaaccaatcaaggtaaaatggtaacgcgaccacagtttgctgagggacatgctacggtggttaaatgtcatttcctactttcagtaaatatcggatacctcatctaccctaaagggggttcgagtaagcgaacaccgacccgtagagagcgcatacttgtgtcttccctaaaaaaaaattgcaggttagctcgcctgggcgagcacccccagcacgagatagtttaa

SEQ ID NO: 70669 - DNA, 255 bp, Glycine max
  Peptide Sequence Number=SeqID_187447
atggcttcaatcaagatagcttttgcagtggtctttcttgctttaatagcatgcaatgggcatggtttcaagaacatacgaagaatgaaagctcttggtgaaaatcatgaaactgatgaatgctggaagactggttgttatcataaaggaaagccacaatgtaatgtaaatcgtgattgctggtttgcttgtactgattattgtgatatcgcgtactgtgatatgagtactcgcaaatgtgtgtgcccttgttag

SEQ ID NO: 70670 - DNA, 429 bp, Glycine max
  Peptide Sequence Number=SeqID_187448
atggatgccaagcacctcacaaggaccaaagaaaggtcgcatgacatcaagcaaaggtccccggacgaaattaggtgcggaccctcaaggcaatcctccattctccacctttttcagagccccatgaatgttattgccaagcgctgttcatgtgtcctccaccttcgagtttggaactatgtttcacgattgcctaatgcgcttcatgtgtcctccaccttcgagtttggagctatgtttcatgattgcctaagtgcggaccctcaaggcaatcctccattctccccctttttcggagccccaagaatgttattgtctagcgctgttcatgtgtcctccaccttcgagtttggagctatgtttcatgatagcctaagtgcggaccctcaaggcaatcctccattctccccctttttcggagacccatga

SEQ ID NO: 70671 - DNA, 393 bp, Glycine max
  Peptide Sequence Number=SeqID_187449
gatggtgatgttgatttgaatgcttcaccccaatcacttgataagctgctgggtcatgaacttgctttcaagataaaggtgcaacccaagttcaggaattctgctgttttgaagtgttcagctgactcgagcttgataaatgttgtgatggatatgctagctgatgctgagacatattcaaaaatggatatcccggtttctgattccaatcattctgctcaacatgaatatcaatccctctctgtgacagcagatcatgatcccctgcttggactccccttgacgcctacaaagcggaagacatttcaggattgtgatgatgaagcagggacctctcaaatttcacatgcgcaactttcatccaacaaattaaaaaaacatgtcggaatttag

SEQ ID NO: 70672 - DNA, 759 bp, Glycine max
  Peptide Sequence Number=SeqID_187450
cgtgactcaaatgtcagtatgacagatcttgtgagcgcggaagatgacgtaaatctccgcgtgtcaacgggcttgtcggccgcgattgacgaagggcgcagaagacgacgtcagtcttcgcatgctatcaggcttttcgtcttacagacagcaaaaaagaatgtttatacggataaccactcgggtatctccgcccgtcagcgtgactcaaatgtcagtatgacagatcttgtgagcgcggaagatgacgtaaatctccgcgtgtcaacgggcttgtcggccgcgattgacgaagggcgcagaagacgatgtcagtcttcgcatgctatcaggcttttcgtcttacagacagcaaaaaagaatgtttatacggataaccactcgggtatctccgcccgtcagcgtgactcaaatgtcagtatgacagatcttgtgagcgcggaagatgacgtaaatctccgcgtgtcaatgggcttgtcggccgcgattgacgaagggcgcagaagacgatgtcagtcttcgcgtgctatcaggcttttcgtcttacagacagcaaaaaagaatgtttatacggataaccactcgggtatttccgcccgtcagcgtgactcaaatgtcagtatgacagatcttgtgagcgcggaaaatgacataaatctccgcgtgtcaacgggcttgcttttcgtcttacagatagcaaaaaagaatgtttatacggataaccactcgggtatctccgcccgtcagcgtgactcgaat

SEQ ID NO: 70673 - DNA, 865 bp, Glycine max
  Peptide Sequence Number=SeqID_187451
atgctggcagcatcccacaagaggcgtggtgccgccggacgtgttcatcccgatcgccgaggaaagtggtatcatcatctcgctcggcgaatgggtgctgcgcgaggcctgccgtcaggcgaacacctgggcgccgcatctgaaaatcgcggtcaatgtgtcgccgctgcaattttccctggccaatctgggccatgtcgtctgcaccatcctgatgcagaccggcctttcgcccaaccggctggaactggagatcaccgaagccgccctgctgaaagaccgcaaggcgacgctgacaattctgacccagctcaaagcgcttggcgttgccattgtcatggatgatttcggtacgggttattcttcgctcagcaacctgcagagcttccctttcgacaagatcaagatcgatcgcagcttcattgccgccatgagcgatgacgacaatgcccgcgctatcgtgcgcgcggttatcggccttggccgcagcctcgatctgccggtaacggcggaaggtatcgaaaccgatgcgcaatatcgcatggtcgtcgatgaaggatgcgcgcaggctcagggctatctctttggcaagccggatgtggcgccggcacaggccgcgggcgcggcagcgcgtggggcgcgctgccggccatctccatgtcggccatccacgctcggtcattcatcctcccagcctgatttcatggaacgagagcctgcgcagatcgttaggattgcgtgtggcgcgccatgttgtccgtgccccttccggcgccggacaaccgctcggacaaagctgtcggatcagcttttcccgggccgcgcgcgacgaatggacaccttttattgggagagcccgcaatga

SEQ ID NO: 70674 - DNA, 606 bp, Glycine max
  Peptide Sequence Number=SeqID_187452
atggcggaagaagaagaagaagaagaaaggcaaagacattggtttgtgacatatgagaagaagtctggtggtaacatcctcatgggtaatgatgtcccttgtcacatgagtgaaaaaggtctagatattatgagcaagcgaggcttacttggaaatcacaaggtgaaacctcttcaattttatgagcattgcgtctataggaagcaacattggatgaacttcccaaaggttgtgcatacaacaaaggccatgttggactacatccattttgattgttgggggtcttcgagattttcatcattgggaggggaaatgtatttcctctccatcatcgatggttactttgggatgacatggttattcataatgaagcaaaaatctaaagctttcaaaattttcaagcattggatgattcttatgaagaatcgcataggaaatatagtaaagtgtcttaggagtggcaacggcttggaattttgttctactaaattcaatgaattctataaagataaagacataacaagacaacatattgtacgttatactccaaagcaaaatggagtagttgaaagaatgaacaagaccttgttggaaatggtcaaatga

SEQ ID NO: 70675 - DNA, 144 bp, Glycine max
  Peptide Sequence Number=SeqID_187453
atggcttttccgaggggtgctgtcaaggaagggatttcgttgcgagggtgtgtcgtcaagggagatgttgtcgcgaggggtgttagggttgagagaaaggagaagggagatgctgcagttgagaaatggttggtgaaaatttaa

SEQ ID NO: 70676 - DNA, 204 bp, Glycine max
  Peptide Sequence Number=SeqID_187454
atgataccgatgacaattgtggtggtgatgacaacggtggaggcaaaggcaatagttgttgtgacgacgatggcaatggtagttgatggtgacgacaatgatgatagtgataacaacaatgataatggtgtcaacaacaatgatgattgtgatagtgagaaagagaagtcacatggcataagatgcacatcttattcttcatag

SEQ ID NO: 70677 - DNA, 342 bp, Glycine max
  Peptide Sequence Number=SeqID_187455
atggggtgtaaatggatcttcaagaagaaatatgggttgtccactaaggaagtcattctttataaagcaagtacggtagctaaaggctatagtcagaaagaaggaatggactgcatcgagatattctctctcgttgctcgacagatatccatacatgttttgttggccctggtgaaaaagaggctaagtcatgaagtgctaaaagtgacatttgagcttagctcattacaattgtcttcatccaggctcaacgcaggactggcactaagctcaaatccacttactcgagctaagcgcaagggtggcactaagtgcaacgtcgcaaattcagagcctatttaa

SEQ ID NO: 70678 - DNA, 321 bp, Glycine max
  Peptide Sequence Number=SeqID_187456
atggctgagtttttaaggacgagtttacacgcagtagtctcattgggagaaaagtttctattccttgcattgggtggcttgttatttggttatgatattggtgccacctctggcgctacaatctcactgcagtcacctgagcttagcggtatatcatggttcaatctttctgccattcagcttggactagtggtaagtggttccctatacggggctcttcttggctcgcttgttgcatttgccagagctgatttccttgggaggaagaaacaactcattactgcaacactgttgtataagtttatagatacttccaattaa

SEQ ID NO: 70679 - DNA, 2436 bp, Glycine max
  Peptide Sequence Number=SeqID_187457
atggtggtttcctggcttgtccactcagtttcaccctcgataaggcagagtatcttgtggatggataatgctagagacatttggaaggacttaaagtctagatactcacaaggagatctactgagaatttcaaaattgcagcaagaaatggcttctatcaaacaaggtgatcaaagaattatcgattacttcacaaaattgagaattatttgggatgaattggaaagttacaggcttgatccaacatgttcatgtgatccaaagtgtgtatgtgatgctcttactagtatgatagaaagaaagggaaagggaactcaaagcaattccggcaaaggaaactttggagcaaaaagaaacaaggtctgcacacactgtggtctttctaaccatactatagatgattgctacaagaagcatgggtacccacttggacacaaattttacaaggtacaaaatccaaacatcaacaatgtcaatactaaaagggaagaaggtgatggttcacccttagatcgaaatcaagagacacaaaatgtagatgtaagattaactactcaacaatataaagccttgatgtcatggctgcaacaacgagctccagctcaaagcaattcacaaataaatcagattggtacaatgactaacaaaggcaatatcttatctgttacttgtagtgttagcaagactagccaagatgagtggatccttgattttggagccatagatcatgtcacaaccttcccacatttgttttctttatgcaagaaaataaaacattcaaaggctgagacacaatctcatctaaagaattttgttgccaatgttgaaaggcagtttgagacaaaagtaaaagtgattaggttagataatggtgcagagtttatcatgagacaattttatgatgatactggtattgtgcatcaaactacttgtgttgaaacaccccaacaaaacgatattattgaaagaaaacatcaacatttgctcaatgtgactcgatctttgttatttcaatcaaatctcccaactgtattctggtcatatgcattgattcactctactgttcttatcaattgcatgccatctccctttcttaataatcatactccttatgaaaaattacatggaaaaatctatgatattgagtctttaagagtatttgggtgtttatgtttttctagtactctaatagctaatagaaagaaactagatcctagggttgccacttctatatttttgggtcttaaaccaaacaccaaaggattcattatgtttgatcttaaaaccaaggccatatctgtctctaggaatgtgatcttctataaggattgttttcctttcattggtcaagacaaacatgatgttgtcactatccttcctattccttcttctcatgccattgatcaacctgatggtgtctcatcagaattaccagttgatcatatcatgcttgtaccaaataatgttgattctgatcccttaactctagagcagtcctctaatacaaccaaaagatctctgagacagacacacagaccaagtaagtataaggacttccatgtttcatacccatcttcaactgtagctagttattctgcagcttctaaggatcctgtctgggtagaggcaatgaatgcaaagattaaggctttagaacttaatgatacttggattttaactgatatgcctcaacataagaatgttattggtcgtaagtgggtgtataaaatcaagcacagatcagatgggtcagtggagagacataaggccaggttagtggccaagggctacactcaagtggaagggcaagattacctagacaccttttctccaattgccaagctaaccacagtgagacttctattggccttagctgctatcaataaatggtatctcaagaaattagatgtgaataatgctttcttgcatggtgatttaaatgaagaggtgtacatgatgcttcctcaaggtatgcaagtatccaagcttgggcaagtttgttttgaagtagccagaaaacctactggtatcaatctttgtcagaggaagtatgccttagacattctcagtgatgatggcatgcttggatctaaaccggtatctactccaccatcaaattatgctactaagttgcatcaacaatcagggactcctctttcattggaagatgcttcctcttttagaaggtatatcaagggatccccaggagcagggattttcctttctactgcaactttgaatccagtatttcatgaaagaacaaagcatattgagattgactatcacatagttctagagaaggtgttaaggggtcttttgaagttgcttcccattccttctacaaatcaattagctgatgtttacactaaagctctaatgtctagtgcttttaaatttatgcattccaaactaggaatgtctgatatccactcctag

SEQ ID NO: 70680 - DNA, 192 bp, Glycine max
  Peptide Sequence Number=SeqID_187458
atgttttgccattggaagttgggtttggccactcctaggggtgggaataggccaggctggcctacaggggcctacgacctgacctacataaagcctggctttgattacaatttagaatcgttcattctacacttgagtgtatcaaaagaacagtcattaggaactcgcattggtgttggagtgggactttga

SEQ ID NO: 70681 - DNA, 1203 bp, Glycine max
  Peptide Sequence Number=SeqID_187459
atgccatatgttcacaatgctggaattcaagccactatttctcctcaagctccccctcaagccaatttagctactgctagttcagcaccctcaaacagctggtatccagattctggtgcatctcatcatgtttctaaagaggttctcctcaagggcttggtgggactagatggtctttaccaatttcctaacttgcttcaacttcccaagtcaaagtcctctgttaataccattgtttgctctacttctagttctgaaactgtaactagttccacaaataatacttctgttggcagttctgccccttgtgcagtttcttcttttgccacttgcaatgctagactagctgctgttgctgactcaccatctttagtatctactcctattttacaactgtactcttcttatcatcccacaccagaacctacaattgacacttctgcttctgtttcacagctgcagtttcctgcacctgagcctatacctgagcctgccaaatctggaattgtaaaacccagacttaaccctacatttcctttgactcatgctgaacctaagtctgttaaatctgccatctcaaaccctacctggtatgaagcaatgaaatctgaatatgatgctttaatcaagctttgtacttggactctagttgaattaccttctcacaaaatggccattggctgcaaacttggacatgactataatgaaacatttttcccagttcttaagcctgtcgctgtaaggattcttcttacccttgctattttaaataactggcctctccaacagctagatgtcaacaatgctttcctcaatgggctgctggaagaggaagtttacatgcagcaaccatctggttttgaacaatctagcaaacaactggcagcttctaggctgtacatcttaatttatgtggatgatattataatcaaaggaaatgattctaaactgattcagctaaacactgtattttccttaaaggatcttggagatcttgattactttctagggattgaggtctctcatcatcttgatgggtctgttactctcactcaatccaagtatcttcgggatcttctagcaaagacaaggatggatgaggctaatcctattgcttctcctatggttgcaggttgcaaactctctaaatctgacagatggttccagaatcagactataatcaatctcgacaggaaccaatag

SEQ ID NO: 70682 - DNA, 208 bp, Glycine max
  Peptide Sequence Number=SeqID_187460
atggggtgttacatgatccacatggtcaacatcctcggcaatagctacagttacccgttttttgtgtcgatgttgtcagccttcgacgatgagaggcttcttcctcatcaccagggaggggacaaacttgcaacacaacagggaagggaaggaggagttgtgtcatggcgcaacagggaagcgagggcagagttcgatcgcgtgaatg

SEQ ID NO: 70683 - DNA, 174 bp, Glycine max
  Peptide Sequence Number=SeqID_187461
atgccgctattgctaccgaaatacacacgtgagcatgatcaaagctttaaaggagggcaaaatggtcatttcatgaaggtttatgaccctaaattcgcccaggctagcatctggctcgcttgggctaaagagaaaacttcagccataagcaagccacttgcctgggcgagctga

SEQ ID NO: 70684 - DNA, 297 bp, Glycine max
  Peptide Sequence Number=SeqID_187462
atgtatggggtagagggtgttacagatcatgctactgatgaggttcaaaaggagcctcacgagctagttacagatcctgtaggtgctaatacagagggttttccaggcgtgctgcatcatacattagtgttgacgtcatatgctgatcatgtgacggctagagtttgggcatgggaggaacatactaagttgaagttggcctctcatgagagaaaggttgacaaatttggaagacttgcacatgagattgaaggcatagtggcttctataggattaactttcgaaattaggaaatga

SEQ ID NO: 70685 - DNA, 477 bp, Glycine max
  Peptide Sequence Number=SeqID_187463
atggaacgccaccaagcagtgttggagtttcagaaggctgctgctaaagtggaatctaaggttgaaaaaagatttgagcagcatttggcagggcgtgagcatgagggtgattttgctcaccgatatctagagtggtccagctccaaacccgaacgactctgcagtacccaacaagaagaagcacagtcgtttagggagaaagagaaaaaaaagctaaagtatagatatagtaacggagacgagtttatttccaagccatgcaacagtggctctaaactattcgggagtaggccaagggtaaagccaaatgacacatgtatgtgtgcatctggagctccgtcctctgcatgtgggctgagatggactacaaggatggtgactgatgtggaggtggtggtggtgcatatgttgctggctgaggttgttgatcttgctctggttgttgtaccttccttggcatgcaatatttttcaataa

SEQ ID NO: 70686 - DNA, 294 bp, Glycine max
  Peptide Sequence Number=SeqID_187464
aatttcaagaagtactgcacccagagacaggctcagggtgatgctccacaggccgcaggcgcaccaccaccacctcatcaggctggcccggctggcatgcagagccagggcttcgcttctttttcatgccctacaccagaccagttcagggcagaggtcgcatggcccggggattggcccgaggcccaagcaggagaggcacccccagaggctcccgacgatggagaggaggcccacgaggacgaggagatggccgatttgcttgacttcttgggagggagtggagctacatga

SEQ ID NO: 70687 - DNA, 264 bp, Glycine max
  Peptide Sequence Number=SeqID_187465
atgtcttttccccaatttatggttccttttgtagcttgtgtctcgctaagcgagacctgtgcgcttagcgagaatcatccgctaagcgagacactcagcccgcttagtgagttgggagaatctggaggagaatctgccatgcatctgtgcgctcagcgcatcatcaacttgcttagcgagtcgtttgtctcttctcgtgctaagcgtgcccagctcactcaacggaatttcattaactcgcgcttagcgcaaaaatggcgctaa

SEQ ID NO: 70688 - DNA, 456 bp, Glycine max
  Peptide Sequence Number=SeqID_187466
atgaccaccgtacctgctgtcttaatcgaccaacaccctttgtggggtctagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaaggggcgcgcgctgccatccacaatcgcgatgatgacgtctccacgagcatatcaacagcccgggcttgggccaccatcgcaacccgcgtcg

SEQ ID NO: 70689 - DNA, 354 bp, Glycine max
  Peptide Sequence Number=SeqID_187467
atgaagtatcctaccataattttgcctcgccttggatacgccactgaggggcaggcagttggtgtccctcctgctatggtggaaagggggaaatttgatcagatagaggagaggctcagggccattgaaggaggtggagattatgctttcgttgacatggaagaattgtgcctagtgcctgacatcgtcatccctccgaagttcaaggtgccagatttcgataagtacaagggtactatgatgaagaaagatgattggagacgccacttcaaggagaagatgagtcaagaagaagctcatcaccataggaagccatggcaaaagatggttgaggatgtctcctacaacctctaa

SEQ ID NO: 70690 - DNA, 411 bp, Glycine max
  Peptide Sequence Number=SeqID_187468
atgtctcctccacctcttgaacctcacaatcactcacaaactcatcttaagctctcaggacgacttcctcttcaagctccattctctataggtggccttgatggtgcttgtgcacttagtgcaactctggaccgcttagcgcgcattagtgaattttggcttagtgcgcgtcttctcgctcagcagatggactcaagcggtgcgcttagcgggatgagcccttgctcagcgaacacgcatagctcatccttcttccagattcttcctcgtgctcaaccaaaggagtggtgcgctcaacggatgactcgcttgttttggcttagtgtgcttgttgttttggctcaaaatttattctataattggtgcctattttataccagtcttagttctgaaatttcaattgaaaattag

SEQ ID NO: 70691 - DNA, 261 bp, Glycine max
  Peptide Sequence Number=SeqID_187469
atggtggacagaggggagggctcgagggaaccaatattgatcgaaaaaatgggaaagaacgaaaaaaaggaggatggggcaattgtagttgttggagtagacactaggttgactacaccaagatcagtgaaagaaacacaagagggcggtatgagtgtgctcaacaacacaaagtctcataactttgtaggtggtgtaactagaagaacaaaaactcttgaattatcgctggtctcaaacacacctctagtcaacagctaa

SEQ ID NO: 70692 - DNA, 765 bp, Glycine max
  Peptide Sequence Number=SeqID_187470
atgcaatcacagggacttgcactgcctctagagcctgaggttgttccctcagctgctcgtgtcagcacaaaggagagttatgttgatcccttaggggacatccaaacacgggtcgatgttgaggaggttaaagatgcagatgctctcgttcctgtacccactgacgagggagccgtgggacccataaaacctgcagatagaccggatcatgaggtcgatgatcccctatatcttatggcattgaccatcccacggctttttttgaagccgttgcaggttatgtgggatgctatcgtgtttggggtgtttaatcaagactttcccttgcatctgactgagacaagtatgcgagcagggaattctgatgtgtatggattcctcgagccacagtccattcagagatctgagcaatcacaatttgaatcagaaagttacatcaagaactggatgcagaattcaaaacgggatgtctacctaggagcctacctgaatggcacacattggcaaatgatcgtcattttgcctaagaaaaatcttgttgtctggttttgttccttgcataataggtcagacaattaccttaaaggaataattaacagtgctttgaaaggacttgatgatactccacaacctaaatccaaggctggtgctaggtggattgttgttaaatattttaatgatgttaaaccattggaagcagagagattgaaggcgcttcgcatccagtgggcacagtattatctcaaagttagaaatcaaacttag

SEQ ID NO: 70693 - DNA, 433 bp, Glycine max
  Peptide Sequence Number=SeqID_187471
gcatctgactgagacaagtatgcgagcagggaattctgatgtgtatggattcctcgagccacagtccattcagagatctgagcaatcacaatttgaatcagaaagttacatcaagaactggatgcagaattcaaaacgggatgtctacctaggagcctacctgaatggcacacattggcaaatgatcgtcattttgcctaagaaaaatcttgttgtctggttttgttccttgcataataggtcagacaattaccttaaaggaataattaacagtgctttgaaaggacttgatgatactccacaacctaaatccaaggctggtgctaggtggattgttgttaaatgtaatagacaaaaaggaagcactgagtgtggctattacgtgatgcactggatgttcactataatcttaggaactttcaggaataattaa

SEQ ID NO: 70694 - DNA, 318 bp, Glycine max
  Peptide Sequence Number=SeqID_187472
atggacaattcaagattgaatacaatgattaatgcaaattgtccgcaagaattattgcattcagtctcaagcaggaatctaagtcacgcatttcgtgcaactctatacaaagggcatgcacatgggaatggaaacataaatgatcaattggatttaccaataacaagtgtccttcagagcacagggcactggtatgaaggtggattatggacaaaccatgcaaagcatcatccattggacaatgaaagacatgttgcaatagtgacaactgctactcttccttggatgacgggaacagttgtaaacccgctattttga

SEQ ID NO: 70695 - DNA, 321 bp, Glycine max
  Peptide Sequence Number=SeqID_187473
atggatgataaagtggttcctccatcaatgactaattttgtgcaccacatgctactcggagttgctgtacataaactcccatatgaaggtccattcagcatttctatagaagtagatcaagctaacctagaagaaaccaatattgaacaacaagtaagcacaaagaggaaccatgaagacatgaagcttacctcgaacccaacaatgacaatgacagcgagactagcagtgagaacagtgagactagcagtcgcgaaaggaagacatacgcgaaggcgcggagttgcgatgaagactggtattaacgcggagttgcggtag

SEQ ID NO: 70696 - DNA, 213 bp, Glycine max
  Peptide Sequence Number=SeqID_187474
atgccacttcatcatggacctctctgcaacgatgccgccgaacgggacacgagggcaaacaacgccacggggtctagccccacctcaaaggcattgagggcaaagatggtgacagcaaagtacgcgagcagcgtgagggggaggcgctctgcggcaagattccacgaagggcggtggcgaggaggtggcggtgctacgttgtggcagagttag

SEQ ID NO: 70697 - DNA, 810 bp, Glycine max
  Peptide Sequence Number=SeqID_187475
atggaggggcaggggactagctttccttctcagttttcactgaatgttgttggctcctcctgcccctcaaattcaggggttaacgattttatttgtctatactctaaggatataatattgacatccttactatctgagactgggttggacattcaagaagcacatgctttttcgacaatagatggctattcattggatgtttttgttgttggtggttgggcggttgaggaaacagagaagttaaaatatgaactagctaagaaagttcagaggctccagttcagtagttcttgctttagtttgagtggaaggtataaaggtacgttctgcaatcaagatgtagccatcaaagtccttaaacatgagagtttgaatgacaatatgctaagagagtttgctcaggaagtgtatatcctaagtaaaattcagcacaagaatgttgtcaaatttgttggcgcttgtacaaaacccccaaacctttaccttgtcacagaatacatgtctggtggaagtatgtttgactttttgcataaacagaagactgtccttgctcttccatctttactcaaagtagccattgatgtttccgaaggaatgaaatatttgcatcagaatgatatcatacatcgggaccttaaagcagctaatcttttgatagatgagaatggggtagttaaggtttccgattttggtgtagctagagtgcatgatcagtctggtatcatgactgcagaaactggaacttaccggtggatggctccggaggcatggatgaggctgtttaaggacacaataggcagcagtttgtga

SEQ ID NO: 70698 - DNA, 198 bp, Glycine max
  Peptide Sequence Number=SeqID_187476
atggaggtgaaatcttttccacaacagagggaaactttgggagatgggaagataagagatgagtcacctactagattttggaaggatatgtggtgtgggagtgagaatttgcaacataaatttgcaaggttgttccttaattcgaaacaaaaagatgcatgtgtagaaacaattggtagttggagaaatgataggtag

SEQ ID NO: 70699 - DNA, 609 bp, Glycine max
  Peptide Sequence Number=SeqID_187477
atgagcttgcaagaagacttttggaggaacactatacttagggaatcccttcttaaacaagagtcaagaatcaaatggcttaaagaaagtgattgtaattcaaagttctttcatatggcagtgaattggcaaagaaggaaaaatatgacaaggggcattaatgtggatggctcttggaataaagatccatttgtggttaaggaagaagcacaaatattctacaaaataagatttagtgaagacttttgggagagaccatgtttagaagaagtgcattttgagtcaatttctttagatgataatgctatgttgattgaaggctttggggaagaggaggtcaaggaggctattttggagtgtggtaattcaaaaagtcggggttcaaatggttacaactttatattattaaaggagtgttggagctttttgaagaaggacatacatgaatttcttggagatttccatgcttccgaaaattttccaagaggagctaatgcatcatttgttgctcttattccaaaaattgaggagccacaagggtggggggtgagggggggggggggatatagggtgatttcattggttggatgcatgtataaaatagtgtga

SEQ ID NO: 70700 - DNA, 501 bp, Glycine max
  Peptide Sequence Number=SeqID_187478
gtgaaagtttctgatcttgaagggaaagtagtgggtctattattcgctgcgaattggtacccaccttgccgtggattcacccaagtcctagctggaatctacgaggagctaaaaagcagagtccctcaatttgagattgtgtatgtgtcctcagatgaggacttgaatgcctttaatagcttctatggaagcatgccctggattgcaattccgttctctgatttggaaacaaagaagtctttgaccagaaagtttgacgtggaagccgttccatgcttaattttgttgcaacctgacgatcgtaaagagcacgcaacagttcgtgatggggttgaacttatttaccgctatggaatccaagcttatccattcagtaaggacaggttggagcagctgcaaaaggaagacaaagtgaagcgtgataaccagactctcactaatttactagcaaaccaccatagagactacgttttgagtcacactcacacgggactcaaaaag

SEQ ID NO: 70701 - DNA, 1014 bp, Glycine max
  Peptide Sequence Number=SeqID_187479
atgatgcttgagcaggtttctttcaatgtcaaatctggggatgagatcaagtgcacaatcgcagaattgcagaatttgagggccgtgccacaaaatatacctttggatatcgtttatgaagatgagcatgttctagtcataaataaacctgcacacatggttgtgcatccggcacctggcaatacatctggaacgcttgtcaatggcattcttcaccattgcaaccttccaaatgttgaattttctaaagacgaagctctttcagatacagaagattctgatgatgagttcaatagttatatctccctggcaagttcttgtgaggggttaaattctagactgtctgtggcatcaaattcaattcgcccagggattgtacacagattggacaaaggcacgagtgggttacttgttgttgcaaaggatgaacattcacacatgaaattgtcagagcaattcaagcaacgaaccattaagaggctttatgtcagtcttactgctggggtacccactccagttgctgggcgtgttgaggttccagttggccgtgatactaataaccggattcgtatgactgctgtaactggaccagttaattctaaaaaggcccgttatgctgctagtaggtacaaagtaattgagatacttgctggggggagttgttcattggttgagtggaagttggaaactggacgcactcatcagattcgcgcacatgctaagtatttgggagttcccctactgggtgatgagttgtatggagggacaaaaagcatggtcttgtcactgctaaggccccgaactcccatcagtttgcatagcaaaatcgtaaaaatggtttctaggctagataggccttgccttcatgcttggactctcgggtttcagcatccccatacaggggagcaggtgcatttttcatgcgaaccccctgcagacttcgctgagattttgagccagcttcgtagaattggtagtgagacggtttctttcacaaagcgttcaaattcatga

SEQ ID NO: 70702 - DNA, 687 bp, Glycine max
  Peptide Sequence Number=SeqID_187480
atggatcctgttccgcgtgacgggtgttgctcatgtacacaggtacctgtagcttccctagtgggtaaaacaattggactctacttctcagcggaatggtgcgtcccatgcgccaagttcactcccaagctgatttccgtttacgagaagataaagcacgagctagccgaaaagggagaggaggacttcgaagttgtgctaatatccagcgaccgcgaccaagcatcctttgactcctactacagcaccatgccttggttggccttgcctttcggtgacccagagatcaagaacctcgttagacactacaacgtgcaaggaattccttggttggtgattataggtcctgatggtaaaacaataaccgtacacgggaggagtttgataaacttgtaccaagagaatgcgtaccctttcaccaaggccaaagtggaggagctggagaaacagctggaggaagaggccaagggtcttccagcattggtgtatcaccaagggcatcgacatgatctgaatttggtgtctgatggaaatggtggagggccctttatctgctgcgtgtgtgatgaacaagggtctagctgggcctaccagtgtctccaatgtggctatgaagtgcacccaaagtgcgtcagaactgtggaacgcgatgacaatgtcttggtggacaccactggttgcttctag

SEQ ID NO: 70703 - DNA, 966 bp, Glycine max
  Peptide Sequence Number=SeqID_187481
atggcgaaaggaaagcattcgcatacccgcgcacaagggaagaagtggtcaacgttctcgctggttctgtgggcgcttttcttcctcacactcatcctcgtcgtgctccttgctctcggcattgtttatcttccaaccaccgacgacgattttccaaccacggagctcagcgccttcaggcgcaagacctctcaaagtggcgagagtttggtggaaaactcggagcagtggaccgagattctctcctgggagccaagagcgttcatctatcacaattttctgtctaaagaagaatgtgagtacttgattgaacttgccaaacctcatatggtaaaatcaagtgttgttgatagcaagactgggaagagtacagaaagcagggttcgaaccagttcaggaatgttcttgaagagaggaagggacaaaatcatccagaatatagagaaaagaattgctgactttaccttcatacctgtagagaatggagaaggacttcaaatccttcactatgaagcaggacaaaaatatgagcctcactatgattacttccttgatgagttcaacactaagaatggaggccaacgtattgctacagttcttatgtacctttcagatgttgaagaaggcggtgagactgtatttcctgctgccaatgcaaattttagttctgtgccttggtggaatgatttatcccaatgtgcaagaaagggtctctcagtgaaaccaaaaatgggtgatgctctgctattttggagcatgaggcctgatgccactctagatccatctagtttacatggcggttgcccagtaattaaaggaaataaatggtcttcaacaaagtggctgcatcttcatgagtacaagactaagtatgagcctattgtgcttttgaaaatagatgtacttcagatgaaaaaattcaaggagaatttcatccctaaaatttccattgtcatgcaaacttga

SEQ ID NO: 70704 - DNA, 561 bp, Glycine max
  Peptide Sequence Number=SeqID_187482
atgaggcttggtggttctgctgacaccattagctataatttcattattgagagtcattgtagggatgagaatcctgaagaggctgtgaaggttctcaatttgatggtcacgaaaggggttgctcctaatgcgtccactttcaattttatttttgggtgcatagctaagttacatgatgtgaatggtgcgcattggatgtatgctagaatgaaggagctgaagtgcctgcccaatacattgacttataatattttgatgaggatgtttgctaagtcgagatctactgatatggttctgaaaatgaagaaggaaatggatgagaatcaggttgaacctaatgtgaatacttaccgaattttgatttcgatgttttgtgaaatgaagcactggaacaatgcgtacaagttaatgaaggagatggttgaagaaaaatgcctaagaccaaatctatcagtttatgaattggttctggagctgctgagaaaggctggacatttgaaaaagcatgaagagttggtggataaaatggttgcgagaggatttgtcactcacccttggtag

SEQ ID NO: 70705 - DNA, 195 bp, Glycine max
  Peptide Sequence Number=SeqID_187483
atggattgcagattccagatgcacacgtacatgcatcatttggctgaccaagacaaacctatttttcaggaggaggcgggacctgtaggtgctcaaggagttgcccaaggagatggagggagagctgaggatgatgaagacatgacgaatttggttaattatttcattggaggagacgaagctcctcagccatga

SEQ ID NO: 70706 - DNA, 186 bp, Glycine max
  Peptide Sequence Number=SeqID_187484
ggaccgctggccttgtcggtcataggatcgatgtggaccactggtctctttgccccaagtggtctaatggccaaggatcatagccgtgtggctttgtgtgtccgcttcaaggtagacaaagacactgatgctactacaggaggaggagaaggaggcaaggcatgtggagtagccatggtcctgtaa

SEQ ID NO: 70707 - DNA, 495 bp, Glycine max
  Peptide Sequence Number=SeqID_187485
atgattgaagagaagatcaagccatgcaagggtgagaaccacgaggatggtgaagcgcgtcatgttaacaattggaacttaacaacattggttgtggcatacaacattgttcgcgcgaaagggaagaacctgcgagatggagctttcggagaagttagaggccaaatccacaacattggagctcaaatccgcaatgttggtgaccagatctacgcctcctctacccagatctgcaacttttgtggggctatgagtgttgtgaggttgggtgtatgttgttggttagtagtaagcggggttggttttgcttgtggttatggtgggaatgagaaggtgagggtcagtgtgagagagctacgtgagagactgaatgtaaaagtgcgagagagaggtcacaagaatgaaaacttttcaaagatggtttttccaaaaactgtcattgaacacttcattcaaagactgtctttcgaaaactgtcatgaaaacttgcaatga

SEQ ID NO: 70708 - DNA, 270 bp, Glycine max
  Peptide Sequence Number=SeqID_187486
atgggaaggttgagacctattaagctcgcattgttgctaagggatatcatcaaaaggaagattcttcttgctatagcaacatactatgatcatgaaatatggcaaatggatgtgaaaacgactttccttaatggtgagctaaaaaaggatatgtatatgacacaacaagaaggattcacatccttgtctgatcataataaagtttgcaagttgcaaacgatccatttatggattgaaacaagcttccaaaagttggaacattcactttaa

SEQ ID NO: 70709 - DNA, 900 bp, Glycine max
  Peptide Sequence Number=SeqID_187487
aggactacacgtcctaacctttagaggactacacatcctcgccttcagaggacaacacgtcctcgccttctccttcgtagggctacacgccctcaccttcaaaggactacacgtcctcgccatcagagggttgcacgccctcaccttcagaggactacacatcctccatttcagaggactacacgtcctcgccttcggagggcttcacgtcctcgccttcagagggctgcactccctcgcctttagaggactgcacgtcctcgtcttcagaggactacacgtcctcatctttagaggactacacgtcctcgccttcagagggctacatgtcctcaccttcagagggctgcacgtcctcgccttcagagggctacgcgctctcgccttcagtgggatccatatccgcaccttaagagaatttaagccaccccctgatattggagggcgctcgactgtgcaagcagaactagagaggaaggctatcatgcagctactatgcataccggggcaagatttcacccgtgccgctgcaaagagacaacgatcgcaatgccgatctccccctgcagatgtatcagttggtctgtgtcatcccgacataggtaagtatgcatatggttcaactgatttcttataccatccactatttgcagggatcgtgcccgcaagacacccagtggacccggagaagtccaacagggtcttggggtttctagctctgattatgggcttctatcagttctacggagtgcctgtcacccccggcaaggtcatcaggtcccctactaatcaagctttcatcaagaagtattgcgcccccaggcaagtgcagggcgaaacaccacagcagcctggggatggctggcagcgggcaacaaacacaccgccaccacctctaga

SEQ ID NO: 70710 - DNA, 3600 bp, Glycine max
  Peptide Sequence Number=SeqID_187488
atggcagaaagcgccaaatttcaccctgccctcactatcaccaatgtgaaatgtcttgttcctgtcacattagataacgagcaggctttgtattactcatgggctgccttgtttaccaaccttactcgggttcacgatctctacgatcatattgtcccacccacagaggaacctgccagagcagcataccttgttgcaaaaacagttgatcctgccatgtggaaacgtcttgacgctgcgattctccagtggatatatggcaccatttcctctgaccttctccttgctatcctacgacgtgatgacacagccgagggagcatggaaacggctccatgctttatttcaagacaataaggcttcgcaagcaaccctcctcaaagaagacttcaccagtgccattttcgaggaacaccataccattgacagctactgcaattaccttcaatctcttgcagaccagcttgtggctgttgatgccccggtgtcaaatgggcggctcgtgttatgtctcacaggttccttgccagaggcgtacagtggtacggttgatttcatccaaaatcaagagcccctaccttctttcgaaagttgtcgatcatggttgaaaatggcagaacgcaccatcaaagcacgtgtcgcacgcgaatccggaacccgcggtggcacagccatggttgcagcaactagcaatgactcctcctctgctcctaaacgcaacaacagtaacaacaaagggcacaacaacaacaaaaataaagggcaaggaaaagcgtccggtcagcaaggatggaccattccaccatgtcctttccctgcctattcttggcagccacaacccaattacacggcccaacgaccacctgctgggcctggcgtgcttgggcccaaacctcaagccttcaatgttatgactccatctactgctagttacacgccaactgatattgaggccgctatgcatgctttatctttctctcaacctgatggaaactactacatggataccggtgccacatctcacatgacggcggatgcaggtattctctcgtcttatttcaattcaagcactaaaaatcataactttgttgttggcagtggtcatttaattccggttgtcggtcatggtagcactaatttagccccacctcatcctccctttgttcttcaaaatgtgttacatgctcccaaactcattaaaaatctgatctctgttcgtaaatttaccactgacaacatggtttctatttcttttgattcttttggtttttcgacttctccaattgccagctcttccgggcaccgttgttatgttctttttcttgatgactatagcaaatttctttggacttttcctattgcaaagaaatcacagttctttgattatcatggcttagtctttcgtctttcttgtcctcacacatcgtcccaaaatggtaaagccgaaagacacataaaatccatcaataatatcattcggaccattcttgctcatgcttctatgccaccgtccttttggcatcatgctctatctatggcgacatatcttcttaatatccttccttctaaggaacggtcttccccttgtgcctatcttggtccggctccaaaccatcgtggctcaaaatgctatgatatgtctagtggaaagataataatttgtcgtcatgtgcattttgttgaaaccgaatttcctttttcaaaattccacaaaaccactcctacaaattatgattttctgagtgataatattgatccatcaatcatgcatgttatttctcagaatttagcaccacaaaatccacagcctgacccaacttctcatgctgctcagtctcggcccactcctcatgtagcaccgacattgcagcagccccctccaacttcttctcctatcttggcctcacccacctcatgtggcccagtcccagcctcaacacctaaccccatgctgcaccgcatgacaactcgttctatgagtggcattcataagccaaatcctaagtactctaccaattgtcacgcgaccaccactaaggacatttctcctattccaaaaaatcccgttagtgcactccatgaccccaattggaatcgtgcaatgtcagataaatttactgctttaattgataataagacttgggaattagtgcctaagccaccggatgtgaatgttattcgttctatgtgggttttgcgccataaatataaatctgatggttcttttgagcgctataaggctcgtcttgtaggagatggaaaaacacaggcgcaaggtgttgattgtgatgagacgtttagccccgtggttaaacctgctaccataagagcagttctcagtattgctgtctctaaatcttggcctatccatcaaatggatgtcaagaatgcttttttacatggtcatcttaatgaaacaggttatatgcatcagccaatgggttttcgagacaaaaatcatccaaatcatgtttgcctcttaaagaaatctttatatggtttgaaacaggttcctcgcgcttggtatcaaaggtttgctgattttgttgctaccattgggttctctcacagtaagtcagattactctttatttatttacaagaatggttctgacactgcttatattttgttgtatgtggatgacattatacttacggcttcatctgatcgtcttcgtaagtattttatgactcttttgggttctgagtttgctatgaaggacttaggccccctgagtttctttctgggtattgctgttactcgtcatgcccatggtctatttttatctcagaaacaatatgctgcaaaaattattgagcgtgccggaatgtgtaactgcagttcatgtcctactcccgttgacactaagtccaagcttagtgccaccgacgatgctccttttaacgatccaaccaaataccgcagtcttgcaggggctcttcaatatcttactttcactcagcctgatatatcttatgtcgtgcagcagatttgtcttcatatgcatgctccgacaaatgagcatatgagtgctctcaagcgtatcatatgctaccttcagggtactttatcccatggtttgcatttgtacaaatccaccattgatagactaatctcttatacagatgctgattggggtgggtgtcctgacacccgtcgttccacttctgggtattgtgttttcctcggagataatccgatatcttggtcttccaaacgacagcctattctctcccgcagcaatgcagaggcagaatacaggggtgtggctaatgttgtttctgattcctgctgtatcagaaacctgcttctagagttgcattgtcccattcaaaaggctactatagtttactgtgacaatgtgagtgcgacatacttatccggcaatcgtgttcaacatcaacgcaccaaacacattgagatggatattcacttcgttcgtgagaaagtggctcatggcgaagtccgtgtgcttcatgtgccgtcccgttaccaaattgctgatattttcacaaaagggcttccgcgcgttctatttaatgatttcagggacagtctaagcatacgagagcctcctgcttcgactgagggggagtgttag

SEQ ID NO: 70711 - DNA, 287 bp, Glycine max
  Peptide Sequence Number=SeqID_187489
tgacttcctttggataccgtaaggatcgaaatggtcaatggctaaagaaagacgcactccctcctcaagatgagcgtactccttcacctcctcctcagcgagatgattcagcactcatgaatgaagtcctttccgaattacaaggacttcgttcttatgctggtgaatgtttcgactcattggatacacgttttgccggcatggatattcgcctcacacagcttgaagaggatgtgggttacattcgtcagagtttcgatcttccaccaccacctccaccttcttag

SEQ ID NO: 70712 - DNA, 225 bp, Glycine max
  Peptide Sequence Number=SeqID_187490
atggacataagccctgcctacagttgcttgttaggccggccttggatccactcggttggggtggtcccgtcaacgctgcaccagaaattaaagtttgtagtggaagggcaactggttatagtatcgggggaggaagacatattgccacgcttatctggtgtcgctttgatggtggctcgggttatgttgagggacggatatgagcccggaataggtttaggttga

SEQ ID NO: 70713 - DNA, 1179 bp, Glycine max
  Peptide Sequence Number=SeqID_187491
atcgcgctgtacagtcgcgaggatgtcgaggcgcacgcggcgcggctgctgcatttcgtgtcctcggcactgcaggctgacgatatcgcagccgtacctctggcgacgaccgacgaggtgcagcaggtgctgcacgatttcaatgccaccgcgcacgccctgccggagacgaccctggtcgagctgctgcagcagggcatggatcgggacccgcacgcgccggcactggtgttcggcgacactacgctggactacgcaacgctggaagcgcgcagcttcgcgctggcggcacagctgcggacaatggatgtcggcccgggcagcgtggtggcggtggcattgccgcgctcgctggagctggtgatcgctctggtcgcggtgctgcgagcaggcgcggcctaccttccgctggacctggcccatcccgatgagcggctggcacgtattttcgcgtcggcacagccggtgtgcgtactggctgcggcggacgtatcggcgcgcgtggccggcgtaccggtgctcgcgccggagcagtggactgcgctgagttttgccgcaccgtgggccgatccggcacctgacgatgcggcctacgtgatctatacctccggctcgactggcgagcccaagggcgtggtcatcgaacaccgtgccatcgtcaaccgcctgctgtggatgcgcgagcactacgacatccgcgccgatgaccgcgtgctgcagaagaccccggccaccttcgacgtctcggtctgggagttcttcctgccgctgctgtgcggggccacgctggtggtcgccgggccggacgcgcatcgcgatcccactgaactggcgcggctgatccgcgagcatggcatcaccacggcgcatttcgtgccatcgatgttggatgccttcctcgctgcaccggcctccgaagggctgcagctgcgacgggtgttcaccagtggcgaggcgctggatgcttcgtcccgcgaccgcttccacgcgcgtgtgcacgccgagctgcacaacctgtatggcccgaccgaagctgcggtggacgtcagctactggccggcgtcggcgcaggatcgttcgcggccggtgccgatcggccggtgccggtgggcgtgcccggtgacctgtacctgggtggcgtccagctggcgcgtggctatctcggtcgcgatgatctga

SEQ ID NO: 70714 - DNA, 543 bp, Glycine max
  Peptide Sequence Number=SeqID_187492
atggtaggtcaaggacaaaaagagttgggtagtacgagcagcccccattgtgtgcaaattaaaaacaagcacgccttcctgccatatggcttgcctcccaactatacaccacccaatgtggcggacactcttgaggagaatgtcaataactccactcccatacctagtaagggccaacaacctcaatttgatcccgcacatatccctcaacccatggaagagacacatggaatacctcaccacaatctagccaacttcgagccttgcctcgaatatgcccctgaggggcaagcaattggtggtgtaccccttccaaacacttgggagggcccttaccttctcccacaaccccaacccttgcattttgtggtgggaagaatccctcctactatggtagaaaagggaaaattggatcgtatagaggaaaggctcatggccattgaaggaggcggagattatgcctttgctgacatagaagagttgtctttagtacccaatgtggtcattcctccgaagttcaagacaccggattttgatgagtag

SEQ ID NO: 70715 - DNA, 805 bp, Glycine max
  Peptide Sequence Number=SeqID_187493
atggcgaaaaccgcggcggctttacatatcctggtgaaacaggaagctcaggcgaaagcgctgctggcgcagctggaaaaaggcgcgaattttcagcaactggcaaaaaaacactcgacctgcccgtccgggcgtaacgggggcgatctgggagagtttcgcaaagggcagatggtgccggcgtttgataaagcggtgttcacctgcccgctgctgcaaccttacggaccgcagtgcggccgccggcgcgaccacggcccccagcgcgacggctgcggcaccacgcgccagcagcggaccggctttgactccggcatccgggtttttgaaggtgccgcgcacatacagcggcgaacgcagcgtaatgatacgaatgcccttgctctccggattgatcgacagatccaagcgctcattagcaaagttagcgttgccggtaacgttgatcaccgcgttctcggtatcgaacacgaacagccgcggcgtcgccagtccctgacggatgttcaggtcggtcgcggcacagttgatgcgcacctcatcgtcgccaaacagtttacccaccacatagttaccaacgttcagcccggcaatctccatcaggctgcggctgatcaggccatcgttcatcaacagtttcagctcgccattactggtgcccagcaggtcggccaccgaattgccggtgccggtcaggctggcatccccgttgagctggccgagactacgctgcatggcggtgacatccgggaacagctgacgcagttgcagcttgcgcgcatgcagtcggcgcggccgcgcatcg

SEQ ID NO: 70716 - DNA, 243 bp, Glycine max
  Peptide Sequence Number=SeqID_187494
ttgggaatggggagtgccttggagactctgtgtgggcaagcatatggtgcgggacagagcacgatgttgggtgtgtacatgcagagatcatgggtcatcttgttcgtcactgcccttattttgttacctctttatatttggtcacctcccatcttgaggctctttggacagacggctgagatctcagatgctgctggtcagttctatgcatcacttcatatcattctaaacttattactttag

SEQ ID NO: 70717 - DNA, 717 bp, Glycine max
  Peptide Sequence Number=SeqID_187495
atggctccaaagaaactcccagccaagaggtccaggaaggatgccactagagaaggttccagtgcggccctgcaggcaaatatggactttgatggacacagggacgaggagtatgctgagttccaagaggagatagcccgtaggaaatgggcccaacttgcatcacccatagctaagttcgatccggagatagtcatggagttttatgctaacgcctggccgacagaagaaggagtcacagacatgcgctcttgggtgaggggccagtggattccctttgatggcatgccatcaatcagtttctggggcatccactggttttggaggaaggccagcgttgtgagttctcctagaggaggattcagacctccagctttaatgaggagtttatcagtcagttgctatgcgttccgggggattacgcctccgagacacccagtggactcggagaagtccaacagggccctaggctttcctgctctgatcataggcctcttccagttctacagagtgtcggaaggtgcagggtcaggcaccctagcagccagaggaggaccagcagtagccagctgcagatgcgccaccaccgcctctagaggtggtaccatctccaaggtccatttccaatcacctgtggaggatagaactctggatgcacaggaccctagtcctttcccttggcctacccccaagcagttcgaggccacgatggcctga

SEQ ID NO: 70718 - DNA, 372 bp, Glycine max
  Peptide Sequence Number=SeqID_187496
atgacaacttcgtcaattactgcacccttcgaaccaacctcaaagataatgactccatcttcaacacaacctccaaacacagataaccctaaagtcccgatttggatgacgaggattaccaccatcacgaagttgtcaaataggtccatgttatctgaagctcgtcgtgcctatgcacgaacccggatccttcctcccaacacaaccaggacgaggacaaagaagaagatgattaggaaggggagatgtttttacctcgacggaacgacgatgaatagtaaagagatgagaaagaacccttgttgtttcttgagtgaagtgaagaggcctagcgcaaccattgttcctggtcacggtagtagaggcatatga

SEQ ID NO: 70719 - DNA, 102 bp, Glycine max
  Peptide Sequence Number=SeqID_187497
gcgcctggctgccctgcgctagcagtcgcgcctgccaaggcgccaggtccctgggccctagcagaggcgcccgtgtcaggggcgcgtaccagggcgccctag

SEQ ID NO: 70720 - DNA, 1083 bp, Glycine max
  Peptide Sequence Number=SeqID_187498
atgaggatccgtaagagacaagtgcctttccctctcttgccggcgacttactcagatcccaacctgatcaaccggtcaccggtgatggtgcaactcaacgatgccaccaaagcttcttcttgcactcatcatcatggttcaaccaccactgcaccctcacccctcttggattgtcctcagccgtccgatcagcctctcccactgattgggaagcccaccaacggctctgatgagtcctccggagaagggcaaaagaagcaagaagaagagtcttcggtgaaagatgggagaaggaaagaagagggagagggacataagggtaatggtgccaggagaggaagcatctcatgttcagaaaagctggctgaaacattttcatctccaacaagccctcctaaacaagatgggagatggtgcgagggagataaagcttttccacccaagaagcgaagaggggccttcgagaatgcaaccgaagatatcaacgtcaatgatgataacaacgataagaagaattcgaagaccaagacgaagagaatgaagaggaagatgaacaagagttcgaggcaagacgatagcaatgaagaagaggtagagaaccaagaagaggcggcaacaaaggaaacgaaacccgaacaagcaaacgttggtaagaagagggtaaggggtagtgcactaatggaaggttcaaggtgcagtcgtgtaaacggaagaggatggaggtgttttcaacaaaccttggtgggttactctctttgcgagcatcacttagggaaaggaaggttgagaagcatgacaagtgtgagaaacaagtccattgggacaacaagtgttgcaccaaagaacaatattgtgcctcaatccgagcattcattcggaaagcaaacaacaaagtctagtagtagtgtcactgaagagtaccctttgggaaatgatgctgaaaacaatgatgagaagaagccagtgattgtcacaaagaggaggatgaagcttggaatggtgaaagctcgatccataagcagcttgctgggccaaaccaacactgaaattgtttccatagccgaggataatgataacaaatag

SEQ ID NO: 70721 - DNA, 1041 bp, Glycine max
  Peptide Sequence Number=SeqID_187499
atgcgcgatacgggggtgtgccggcagctcggccatggcctggccatgttcgctgaggctgtcgcggctgccgggtttgtaggcgttgagccgtgccagcaggtcctgggcctgggcgaacgcggcagccggtggctggtcgagccaacgcaactgctcgggcgtcacgccccagcgtgccagttgcaaggccaggccggccaggtcggcctgcagtatctcggcactgccatgggcggccagttgctcatgctgagcctcggaccacaaccgatagcacacgccgggctccaggcggccggcacggccggcacgctgggtagcactggcacgcgagatgcgctgggtgtccaggcgggtcatgccactgcctggatcgaagcgcggtacccgtgccaggccggcatcgatcaccactcgcacaccgtcgatggtcaggctggtctcggcaatattggtggccagcaccaccttgcgcaggcccttgggcgccgggtcgatggcagcgcgctgggcatcgaggtcgagttcgccatgcagcggacacagcaggatttcgcgccgttctcccagcgcttcctgcaggctctggtgcacccggcggatctcggcctggccaggcaggaacaccagcacactaccggcttgctcggccaacgcctgcaacacgctgtccactacccgtggctcgatgaactcacccggctggaaggggcgtccccagcggatatccacagggtgcatgcggccttggctgctgaccaccggggcctcgtccagcaagcgcgacaggcgctccccctccagggtcgcagacatcagcaggatcttcagtggcgggtcgtcccgcagcaattcgcgaccattcaggctcagcgccagggccaggtcggcgtcaaggctgcgctcgtgaaactcatcgaagatcagcaaccctaccccctccagcgccgggtcggcctgcaggcggcgggtgaggatgccttcggtcaccacctcgatgcgggtgttcggcccaaccttgctgtccagccgaatgcg

SEQ ID NO: 70722 - DNA, 1533 bp, Glycine max
  Peptide Sequence Number=SeqID_187500
atggctctactattcctcttctttgtagctcttatttcctttctcttcacgatccttatagtacaaaaactaggaaagaaatccaagaaaactgatgacacaacttgtgacatgcatatgccccacgggcctagaaagctacctattataggaaatatatacaatcttatatgctctcaaccccatagaaaattaagagacttggccataaaatatggacccgtgatgcatcttcaacttggagaggtttcaactattgtcatttcatcccctgactgtgctaaggaagtgatgacaacccatgatattaactttgccacaagacctcaaatcctagctactgaaataatgtcatacaattccacaagtatagctttttctccttatggaaattactggaggcagctacgaaaaatttgcatattggagcttttaagcctaaaacgtgttaactcataccagccagttagagaagaagagctcttcaatcttgtcaaatggattgcttcagagaaaggatcccccatcaacctcactcaagcagtactttcatctgtttatacaatttcttcgagggctacctttggcaagaaatgcaaagaccaagaaaagtttatatcagtgctaacaaaatcaataaaagtttcagcaggttttaacatgggagatttgtttccatcttctacttggcttcaacatctcactggcttgaggcctaagcttgagaggttgcatcaacaagctgatcagatattggaaaacatcatcaatgatcataaagaggcaaagtcaaaagccaagggtgacgatagtgaagcacaagatctggttgatgtcctcatacaatatgaggatggaagcaagcaggatttttccttaactaaaaacaacatcaaggccataattcaggacatttttgctgctggaggtgagacatcagctacaacaatagattgggcaatggctgaaatgattaaggatccaagagtgatgaagaaagcacaagctgaggtgagagaggtattcggtatgaacggaagggttgatgaaaattgcatcaatgaacttcaatatttgaaactaattgtgaaagagaccttgaggttgcaccctccagctcctcttttgcttccaagagaatgtggtcaaacatgtgagatacatggttatcacataccagccaaaaccaaggtcatagtcaatgcctgggcaattggaagagatccaaagtattggactgaatcagagaggttttatcctgagaggttcattgatagcactattgactacaaagggaatagttttgagttcattccttttggtgctggaagaagaatatgcccaggaagcacatctgctttgagaactattgatctagcccttgcaatgttgttgtatcactttgattggaatctgccaaatggaatgagaagtggagaactggacatgagtgaggagtttggagtcacagtaagaagaaaagatgatttaattttggttccttttccatatcatcctttgcctgtcacatga

SEQ ID NO: 70723 - DNA, 1083 bp, Glycine max
  Peptide Sequence Number=SeqID_187501
ccaatcagagaagaagagctgtccaatcttgtcaaatggattgattcacataaaggatcctccatcaacctcactcaagcagtactttcatcaatttatacaattgcttcaagggctgcctttggcaagaaatgcaaagaccaagaaaaatttatatcagtggttaaaaaaacatcaaaacttgctgcaggttttggcattgaagatttgtttccttctgttacttggcttcaacatgtcactggtgtgaggcctaagattgagaggttgcatcaacaagctgatcagataatggaaaacatcattaatgagcataaagaggcaaagtcaaaagccaaaggtaaccaaagtgaagcagaagatcttgtggatgttctcatacaatatgaggatggtagcaagccggatttttccttaactcgaaacaacatcaaggccataattctggacatttttggtgctggaggtgagacatcagcaacaaccatagattgggcaatggctgaaatggtgaagaattcaggagtaatgaagaaagcacaagctgaggtgagagaggtattcaatatgaagggaagggttgatgaaaattgcatcaatgaactcaaatatttgaaacaagttgtcaaagagaccttgaggttacaccctccaattcctcttttgcttccaagagaatgtggtcatacatgtgagatacaagggtacaaaataccagccaaaagcaaggtcgtaatcaatgcttgggcaattggaagagatccaaactattggactgaaccagagaggttttatcctgagagattcattgatagcactattgaatacaaagggaatgattttgagtacattccttttggtgctggaagaagaatatgcccgggcagcacgtttgcttcgagaattattgaactggctcttgcaatgttgttgtatcactttgattggaagcttccaagtggaattatatgtgaagaattggacatgagtgaagagtttggagtcgcagttagaagaaaagatgatctattcttggttccttttccttatcatcctttgcctttcatattaacttcacaatga

SEQ ID NO: 70724 - DNA, 276 bp, Glycine max
  Peptide Sequence Number=SeqID_187502
atgggattcgtgttcggaaaggaagggctggtcctggtcctggtcttaaggaggtttaggccacatctgaaacctgatgtatttctgtctgcgccacaaattttagtctccgatacggaagacaacagtaggattattatcgggcgaaccaatttatttaatccgtgtaagaatgcaggaaagacgaatccattccgttgccaatgcaaacgtatatggatgaatcttatgcaagatggatcagcccgcttacccactcctaaattattattttag

SEQ ID NO: 70725 - DNA, 765 bp, Glycine max
  Peptide Sequence Number=SeqID_187503
atggtgattagaagggatgcagtgtttgatgagcacttgccagagatagttaatacaactatgacaatgtctgatagagcttcccctggctccatggagtctaggtcgattgcatcaggagtactcttgtcaaagatagagatcgtcgcaccattaaacccattgtttgatatggatccttctacctttcaagaggctatgaacaaccaagagaaagatagatggatgggtgttatggtggaggagattaatctccaaggaaatgatacaaacggtttgattcctacaagtttcggattggttacaagtgatggttatgttgagaaggtgctagacaagttcaacatgagcaatgcgaagcttgtgagtactccattggaaaaacactttaagctttctgtaaatcaatgtctgaagacaaatgctgaggtggagtgcatgtcaaatgttccctatgccaatgcagttgggtatttgatgtatgttatggttacaataggtcatggtattatgtttggtgatcatcaaggtgatccttcttcagttgcgagatatgtgaattttggctatgcaggtgattttgatgacaaaaggtctacaacagggcatgcctttactcttctaggcattgagcaaggtggagttcagttgcattgtgatagtcagagtgctactgacttggcaaagaatcaggtgtgtcatgctaaaaccaaacatattaatgtgaggttccacgagattagggagttgatgacatctggttag

SEQ ID NO: 70726 - DNA, 243 bp, Glycine max
  Peptide Sequence Number=SeqID_187504
atgtctaggatgattggagccaggctagtgtgttcgtggaagtcaatgagggttttggaatggcaacaatggtgtaacggagagattcaattgctggtgcaatatgtagatggagttttgcgagggctcaaaatcaggggattggagtgtatgttgagaagctctcatctcagtagggggagtgcaagttttgggtcagaatggaattatgtgttaattagccaaacttctagtttaggatag

SEQ ID NO: 70727 - DNA, 264 bp, Glycine max
  Peptide Sequence Number=SeqID_187505
atgtggtatagactaacgattcaaactaatacactgagggagatgtctactatagtgagcaagacgtcaaacaattttggtagtgtctatatgggtaacgacaaagcgtgtgttgttattggaatgagacatgtgcagattgctatggataatggtggagtaggaacgttgccaatggttttagttataggactgatgaagattgggataccctcaagcgttgattgtgatgaaggaacaatgaattgtaggaaacatttatag

SEQ ID NO: 70728 - DNA, 549 bp, Glycine max
  Peptide Sequence Number=SeqID_187506
atggcggtttcttctctctctgttactcctctttcgctctcaaattcttccccctctctatcttccaagccaaagtttccatctttgtgttttctctctggcaacaacaccacattgagggtaacatgcccaaaacctctgcactcatccactgttgttcatgttgctaccgaagcgttggattcatcccctgatcccttggacccacctccagaaacccttgatgatgactctgacgccaccacctttgagcatgtgtgtcttattatgtgtgaaataatgtctttgggtttgtacataatgtggagatttgtggagataaggaagtataatggcactggattcaatgtggttaaggttggtgacttggggactcctagcacttcagcaattagcattggtggcgatgcagatacaggtatagaggacccgacaatatcagtttgtaaaaaggtaatcgagttcaaagaatggcctggtaacatccgtaaagccatagtcctaggatgtgctccaattgatgcaaatcaggaaattttttcttcctga

SEQ ID NO: 70729 - DNA, 1176 bp, Glycine max
  Peptide Sequence Number=SeqID_187507
atggcggtttcttccattagaaatccattcctattgttgctcttgttactaacatttttcacagcgatcattgttcctgccaccccacaaccatgcaactcatacaaatttcccaataaagttaactatgcggcatgcaaggacttgccggtgcttgaatcctcactgcactggaactatcacccatcttcgggtgcaatcgatgttgcattcaataaggccaacgtgaatgattctagttgggttgcatgggccataaatcccacctcaaagggcatgcttggttcacaagcattcgtggctgtttatagatctgatggaagtatcaaagcctatacgtcaccaataacaagttatgcgacaatgttgcaagagggtaatctcagttttccggtttatggtgtttctgcatcctacacaaaccggcatgtcatcatcttcgccagttttcaacttcccgggaatacgactttggtgaatcatgcttggcaagaaggcttggtttccgatgatggcactctcagaccacactctttttcacgcgctaatcttcagtcttttggaaccttagatttcttatccgggaaggtttcccaaacaggtgggaatgtggactcaagaatcacgttgagaaaggttcatggaattttgaataccataagttggggaattctaatgccgattggggtaatattggctcgctacttgaaggtatttgatggtttaggacccacttggtttcacttgcatcgagcatgtcaatcactggcattttttattggcattgctggctttggtactggtttgtatattggaaatcattatggcgttcataacgctcctcacagatgtgttggaatcactctgttgtgtctcgcaattatacaagtctgtgttgctgtgtttttgaggcctaagaaggatcacaagtatagaatgttttggaacatttttcattatttagttggttattcaattattgccttggccatatggaacgtctggaaaggttttgagattctcaacgctcagaatatctggaaaaagacctatgtgggctcaatcatttccttggctataattgctatggtattggaggtgataacttggacctgggtgtgcatcaagaagagggtcaagaatcctgagaatcatgttgaaatcgttattagttag

SEQ ID NO: 70730 - DNA, 471 bp, Glycine max
  Peptide Sequence Number=SeqID_187508
atgagaaactttgacaatgaagatgatggaagaatgagaactcgtgtgatgagagagagtgaagaagaaggcaatcattggggctactcaacaaagttgatgctttatgatgacccatggaagatcaagaaattgctcacaaagagtgaccttggcaacttgagtagactcttgctccccaaggaattgatagaggacttggtgctgcctgtgttgagtgttgaatcccaaagagaagctaagactcaaaagggaaccaaaattactatttgggatgtggacacccaatccatgcattatcttgtcttcaagttttgggcttcttcaagaagttatgttttcattgacaactggaacaaagattttgttaatagaaggaacttgcatattaaagatgaaattggacttcactgggatctgtacaaaaatcggtttaatttttccgttcttgtccgtgcccctctaaattaa

SEQ ID NO: 70731 - DNA, 717 bp, Glycine max
  Peptide Sequence Number=SeqID_187509
atggcaatttcaaggtacctttcttcttcttctaccgtttcatcatctctgacctctctctcttctctcccacttcgtttcttcctccgcagtgttcccaccgacccaacctttgccccaattttcacctctggagtagttaaaagcccagtttttctctgcctgttggattttccagcctctggatcagttttcctggagagagatgatcatgcctctttggaggcttatgagattgagaaaaaaggggtctgcacccgttgccattgctttgaaatcaagtgcatatctgccggtgttctgttaactcctgttggtattctctttatggctgtaaacaattgctgtttcgtggaatggaaagagcagtttgtttctcaggagcgcggtaatcgtgtggttcactattacctgaaggattctgctggggaatccgtccttgcagttgttggcactgagaggagtgttaggcacatgtgctatgttgttgctgaggagtttcttgaaatttgtgggatggagggttccattccaaccggtttcaaatggagatctagaagagaggtggtggattggctgacatcgacgctatcaaagcagaacctgcagggagatagaagtggcaactcagccacaagaccacgacacctgatggattttgtgcaaatccattctgttacaagaatgctgagctggcagggagggattggctcatga

SEQ ID NO: 70732 - DNA, 1137 bp, Glycine max
  Peptide Sequence Number=SeqID_187510
atgtcaccttctttttgcacatccctcttcctcttcacactctcccttctcttcttcctattcttctccctctccgtctccgcccacagcggccaccacgacgacggtgacgccgactccgacgccacccccgacctccgtgctcggcccttgattctcgcgaaggtgtggtgcctgatcgtgatcttcatcgccaccttcgtctcgggcgtttccccctacattctgaaatggaacgaggggttcttggttctggggacccagtttgctgggggagtgtttctgggaactgccatgatgcattttctcagcgacgctaatgagaccttcggggacttgactcaaaaggagtaccctttcgccttcatgctggcgtgtgcaggctacttgatgaccctcctcgctgatgccgtcatttcctcgcttttcaacaatatggggcgtcatgcccaggatgtccaaggtcaaggggctgatgtgaacaaattaagtagcaacggcgttacttctcaatcacaacaccggagccatgacgctaatcaccatttagcaagtcctgcacttggatatgtccattcagttggagacaccgttttattgattgttgccctttgtgcacattctgtgtttgagggcttagcaattggagttgcagagaccaaagcagatgcatggaaagccttgtggacaatatgtctgcacaagatatttgcagccattgccatgggaattgctctcctaagaatgattcctgaccgtccccttgtgtcgtgtgctgtctatgctttcgcgtttgccatctccagtccaattggtgtggccattggaatcatattggatgccacaacacagggtcacgtggcggattggatctttgctatatcaatgggtctggcttgtggagtgtttatctatgtatcagtaaaccatctgttggcaaaagggtacatgccccacagaccgacaaaggttgactcggcctatttcaagtttcttgctgtgttcttgggtgtgggagtgatagcggtgaaaagatggcagaaatttgcctcaaatgatagaaaagatgggcatgtattgaaaactaagaggacgtatagaagtcttggtaagaaggttacttcacacagagggtag

SEQ ID NO: 70733 - DNA, 603 bp, Glycine max
  Peptide Sequence Number=SeqID_187511
atggaggacgatgcgtgggccacttggtgcttgttgtcggcggcaagtgaggaacagacatgggaaacggaactggcaatggtggaggtggcggtggcggtggcggaggcggagtcagcagcggaggcgacggtggaggcggcggcggagtcagcggtggtggccccgaaaatggcggaggtggcggcggagtccacgacagaggtggggatggtgcgggacttggttgtatgggtgcaaagcatggagactgcggagggtagtggtggccgggtcgccaaggcagtcggaggagaagggcgcccagttgggagtcgaggcggcgtggaagctccgtacggcgagtggcagccatggaagcttcgtttggtggttgctgaaatgaaggaagggttctctcgggatcgaacaagctcagcaaccgttggcgggtactctcaaaatcaatcccaagggattgagctggatgtacaaagggaggaggggtgtgcggcaacgaaggtgtgtggaaatgggtatggcagccatggaaggcagccatgggctctcaatgaaagcaccaaatgttatctgaaaatcagctcaatgtttcctagcatttga

SEQ ID NO: 70734 - DNA, 1089 bp, Glycine max
  Peptide Sequence Number=SeqID_187512
atggaaacacaatgtcagggtgagaatatccaacctgaaacttcgcttcgaggtataatcaacacaatagctagaggattcatagaggcccacaagaagcctacccccatcgctttcacggatgagaatttcgacgggaaagaccaatgtcacaatgatcccatggtggtcaagatagaggttgctaacttcttagtatccaaagttctacttgataatgggagcttggttgatgtcatgtactgggaaaaagatgccagagtccacaatataactagtagcatgcccctctctcaacaacaacctgagagaaatgaagaatccatagctcaagtactaacaaagaatgtcgatctgtttgcatggtcaacatcagacatgttgggaatcgaccccaagttcaactttcacaggctagtcatttgtccagaggccagaccagtcacacaaagaaagaggaaactcgactctgcaagaagaaaagttgtggataaagaagcaaagaaattgttaagtgtaggattcatcaaagaagtacaatacaccacatggttagctaacatggtaatgttgtatgtaaatggttcatcaaatgaaaaaagtagtgaggctggaatcattttagagagctcagatgaagaaatcctagagcaatccctacggttcaagtttgaaataatgaacaatcaagccaagtacgaagccctcctagtctacctaatattagaaaaagaagtaggagccaagcacttgaagttttggagtgactccaaacttgtcactattgaggatttagataacttaggaattaggcatagagaaacttcagtggaacactcacaaagcaatggacaaactgaaacagccaacaagggtcaagctgagaaacttcaggcaggtgacttggtactaagaaaatatggagaagccctaaaagatgccaaagaaggaaagcttgttgcaaacttggaaggtcctgttagagttgttgaatcactcaaaactggagcctaccgactagagtatttatccaacaaagcaattttgagaacatggaatgccactcatctcaaattctattatagttga

SEQ ID NO: 70735 - DNA, 147 bp, Glycine max
  Peptide Sequence Number=SeqID_187513
atgacaggtcgcatcatcacagggagtgcagattcacgatacataggcagagttcaacttccacaagagaggaaagagtggaggttttacgctcggtttggtttggttttgaacacccctactagcctaggccaccaagatgaatga

SEQ ID NO: 70736 - DNA, 681 bp, Glycine max
  Peptide Sequence Number=SeqID_187514
atgttttcaccgcaagttcatccaataagggaaagttctaacgatgatccctttcaccatcatggtggcaatgatgctaccagtgataatgtttccaacatctatgcttgtaacactacccttattggtggcgtggcttctcttgacgtcgacgttgttgcccctgtgggtggtgccactactgccaaatgggggcttcgtcctaattctagtgtgtgtgagaatccccttcccaatgtaatttatttggacttagaggccactattgtgcacatcatagtgcctcgtcctttcattcttctttctcctccactcagaaaacctagttacaccttggttcatggggagggggacccttggtttcctttctactggaccccttcccctaacaaagatactcgggaacttgttccatatatgtctcattttgatcaagaggccaagacggctaaaagggctaaggctaccaatgctcaagctgggaaggccaaggaagagcaacatgaccatgtcgaagatgaatgggttccttttcctcctcctatcagcttgggtgctgctaagagggtaaaagccatccatgctaaggtgggctccaaaggagatttcaaaacgaaagcactaagtttcaagcaatatcaaacatttggaataacttcctcagtgcaacaagcttcctaa

SEQ ID NO: 70737 - DNA, 777 bp, Glycine max
  Peptide Sequence Number=SeqID_187515
atgagtgtagctagcaaccgagacacaaatacaaacgagatcgaactacctaccaacatgggtaatacttacagtgcaaatctcagaattgagctttacaaatggtcaagtgtggaatttccccaagagcatgctctcatatacacatccctcactgataaatcaaattttagcatttttcgtctgagcgtgaaaccagaaaaggtgctattcagattcgcagactctttgtgcgataatcatccagtgcgacttcacacggaggtcactgctgaaagaaataactacggatctttcaactttcgggtagttagaattgttgaagctggcactaacaatcaagccaaaacaccccttttcgacgaggcatgtttcgattatcactgtgaaaggaaagtttgtagttttcatgtggggcgtcgcactggaatgcttggttcttggaaggttgatcactggtataaggtagattttaaaacctattttacatttaaggtgaacatagtgtgtgataaagtgacgggactttccgcaaagtttaaaggccctttcagaagcgagttcggccagtttgatgaagaatctggttcactgattcagtgccaagtaaatggagagccaccaaaacatattaattcaattgttcagagcatgtttacaggaaatcaatatatcctcttcaagcaagggaaagggaacactctcatcgatgatgatgatgaggaaagtaattgtatttcaactttggtttcaaacttagtcaaatggcatcgttaa

SEQ ID NO: 70738 - DNA, 213 bp, Glycine max
  Peptide Sequence Number=SeqID_187516
atggtcaatgccattctagcaaatgctactgacacattgaattacattaaaaagcatatcaagataactccagacttagaattggagcataaattggctttatgtgctgactcttactccccagttgtgatgtacattctcccacaagcagctgatgccataagccaaggacaatttgggtcattcgagagtaagctagaaaaagtacactag

SEQ ID NO: 70739 - DNA, 210 bp, Glycine max
  Peptide Sequence Number=SeqID_187517
atggcagcttgtggcggccacaggtggttgtgggtggtggagaagaagcttgggacgttggaaatggaaaggaagcgtctcgaacacatcagaagtcatattgcagatcgcaacggtctgatcgtggacacctgtcctatgaacctccagaccaaatttcgagatgatccaacggttaacgaatacaggaggacatttttaccaagatag

SEQ ID NO: 70740 - DNA, 1488 bp, Glycine max
  Peptide Sequence Number=SeqID_187518
atggagcatggtggcaaagaagaccagacgacgacgttcaacaaatatgcctttgcttgtgctgttgttgcttcaatggtatccatcatatctggctatgacactggcgttatgagtggagcaatgatattcatcaaggatgacattggaatcagcgacacccaacaagaggttctagcaggaatcttgaacctatgcgcattggtggggtctttggccgcaggaagaacctccgattacattggtcgccgctacacaatcttgttggcctcactcctcttcatggttggtgcaattctcatggggtatggtccaaactacgcaattctaatgcttggaaggtgtgttggtggtgttggtgtaggctttgctctcatgatagcaccggtttattcagcagagatctcctctgcatcgtcaagggggtttctaacctcgttacccgagctttgcatcggcattgggatcttacttgggtacatatcaaactacttcttggggaaattgactttgaggctaggatggagattgatgcttggtgtagcagcacttccctcgctcgctttggccttggggattctggcaatgccagagtccccaaggtggttggcgatgcagggaaggcttgcggacgcaaagaacgtgttcttgcgtgtctccaacaccgaacaggaggccgaactccgattcggtgaaataaaagttgtgatggggtttaatgattgtgaagtcgaggagaaaaatgtgaagccctcttacaagtctcaaggggaaggggtttggaaagagttgctggtgagaccgacgccaaaagtgcgttggatgctgattgcagccgtggggattcatttcttcgagcatgcaacgggcattgaggctgtgatgttgtatagtccaagaatcttcaagaaagctggtgtcactagtaaagataagcttcttcttgcaacggttggtattggcctcacaaagatcattttcttggtcttggctttgtttttgcttgacaaagttggtagaaggcgtcttttgcaaatcagcactgggggaatggtttgtgggctcacacttttgggttttagtttgactatggtggatagttctagtgaaaagctcttgtgggctttgagccttagcattggggccacttatggttatgttgctttctttaatgttgggcttgggcctgttacttgggtctatgcgtcggagatatttcctttgaagttgagggcgcaaggggctagtataggagttgcagtgaatagaaccatgaatgcagtggtttccatgagttttatttcggtgtacaaagcgatcactataggtgggagctttttcatgtttgctggaatatctatagtggcttgggtgttcttctactttttccttcctgaaaccaaaggcgtgcccttggaagagatggagatggttttcagcaaaaaatccagtgggaaaaatgtagcaatagaaaatggtccaagatag

SEQ ID NO: 70741 - DNA, 336 bp, Glycine max
  Peptide Sequence Number=SeqID_187519
atgggtggtacatacagtgatctcgaggctgagcgttacaaatggtcaagtgaggaatttcctcaagagacagctctgaaatacactcctgtgagtgataaatcaaagtttagcattttccgtttgagcgtgagaccagaaaaggtgctactgagactggcagacactttgtgccatgatcatcccgtacgccttcacatggagctcactgctgaaagacacaacggatatttcaaccctcggttggtgagagtggttgtagagggggttaatactctttctgatctagatgttaacgccttaggggctcatacacatttcagctattcttgttga

SEQ ID NO: 70742 - DNA, 177 bp, Glycine max
  Peptide Sequence Number=SeqID_187520
gagatgacgagagtgatgagcaaaatgacggcgacagcgacgaagtctatttcgttgaagcctttgggaagagacggcacagggaggtgccatttggtggaggagattccgattgtggcgccgccggcgacgggcatgtcaacgacaaactcagtgtagcagaaggcgaagaggagg

SEQ ID NO: 70743 - DNA, 303 bp, Glycine max
  Peptide Sequence Number=SeqID_187521
atggcaaaaatacccttcagcctttttgcgaactttcttccgctgatactcgcagaagaaatgtttcgcgggcatctgcagaagaactttcttccacaattgacggaagatggttcttccgtggatgcccgcggaacatttcttccgcgagtttcagcggaagaagaactgcggaagaaccatcttccatggaacaacgcaaaagaacttcttccgccagagtcaacggaagaaggttcttccttaaatgattttttcctctcacaagttgaccaatggccgattcttgtatgcaccgcatga

SEQ ID NO: 70744 - DNA, 1212 bp, Glycine max
  Peptide Sequence Number=SeqID_187522
atggcaacagcaccagcaacaaaagaccaagaacccacacaaggccgaaaattcaccaccaccaccacaacaacaacaacaacaacgagaccagcgccagaacaaggtgtgaagtgtccacgatgcgattcatccaacaccaagttctgttactacaacaactacagcctcacccagcctaggcacttctgcaagacctgcagaaggtactggaccaacggcggagcgttgcgcaacgtcccgattggcggcggctgcaggaagaacaaaagggtcgttgtcaaaccctcttcctcctcctcctcctcgttatcttcatcaccaagattctctaacgaattcagccttcgtggcctcaacgttccgccctccgtcgaattcaacctcggcgcgctgcccttccctgcctcctcgaggctcaacattccgacaaccttaaacacagggttgttcagcaaccagttctcgtcatctccgttgtctttcggaggcgacgttaactcggtctcggtcactaacaatgctttgtcaggctttcagcttgacgcgactcctgcaactgtcctgtcaaattccttgatgagccttgcgtccaacaacaacactcagaataataataatttctgggcgctgcaggatcggtcgcaaggctcgacactattactgtctgattcattcaacagtagtgcaatgcagtctatgcagcaatctctgaacgttcatagcagtcttgcttcttcgattgagtcactgagctgcgtcaaccaggacttgcatctgaagatgcagcagcagcgttacgccacaatgatgttcggtggggacagctaccaccacaaaggtggtggtggtggtggtggtgatgaaaacaacggcgtttcgttttctcaaacggctaataggttcgagaatcagaagcagttggtggggaaccccgttatgtttcagaacctcgagatttcgaagccacctggcagttccgtaacagaagatccaagtggggctacagttacaacaacagtagcaccacccaccgaatggttctttgggaattcttctttttcctcagcaggtaatggtaatgatggtgccaatagcaacaacaacaacattaacatcaacattaacgatgcaaacaacaattggagtgatgcccttgcttggggagattttcagcagcagcagcagcaacaatacagtgctttgccctag

SEQ ID NO: 70745 - DNA, 589 bp, Glycine max
  Peptide Sequence Number=SeqID_187523
atggaaacggcgttggacggcgagaaggaccacgcggcggcgcggacgctaaccctagacggcgccgttaagtgcgtgcaggggcggttacctccgccgagccttctggagcggttccagaacctgcagcacctatcgatagcgaacgtcggcgtttcgtcgctggagcagtttccgcggctgaggaatttgcagaagctgaacctctccgacaaccggatcgccggcgggctggagtttctcgtgcaggcggggctggattcgctgcgcgacctcgatttgtcgaacaatcggattcagtacattgaggatctcgcgcccctcgcgcaggtgaagctggtctcgctggatctgtacgagtgccccgtgacgcgcgtgaaggactatcgatctagggttttcgggttgatcaagtcgttgaagtacttggacaagatggatgcggaggagaacgagaggcccgagagtgacgacgaggacgaggatgaggacgaggaggaggaggaggagttagaagaggatgaccccgggagcggcgagattgacggaggtgaggaggatcgtccgtttgggattaacaatgggcaca

SEQ ID NO: 70746 - DNA, 1452 bp, Glycine max
  Peptide Sequence Number=SeqID_187524
atgacatttctgtatggactaccatgccccttctcttcccctattctgctggttaagaaacatcactggttctccaagttagacctactacagggataccatcagatcctcatgcacgaagggtatgcctctatcacaacaccattgcacaaattgatcaccaaggatccatttgagaggactcaagcagcccaacaggcgttcacgaagttaaatgaggcccttactactgctcctgttcttatgctgccaaatttttctcttccattcaccctagaaactgatgcatcaggtgttggcatgggtgcagtcctatcacagaatggccaccccattgctttcttcagcaagccttttagccctaaattactacgagcttcggcatatgtaagggaactcttcgcgattactttcgttgttaagaagtggcaacaatatctattgggacaccgcatcatcatccttactaatcatcgaagcctcaaggagctgttgacccaggtggtgcaaactccgaacggaactcaagcgagacatcgtacaaaatctggattcattcaattccgacaagacatactcactaaagcagaggctcatccagactgtgttgtcaaaaaggggtgcatttggctaccaccaggatctagtttcatacagacattgctccatgaatatcactccacacctatcgaggggcatatgggcagcaacaaaaccagagcgtgcttaacagagaactttgattggccagggcttcatagggatgttgagcagttcgtagctacttgtttggattgccaacacacaaagtatgaagctaaaagagtcgctagtttattgaactcgttgccggtaccatgtcagtcgtgggaagatctctcacttgattttatcacaggcttaccatctttccacggtaataccgccattcttgtggttgtcaaaagaactgttcaaactcagtgggactcgcctgaagatgagttcggcgtatcatccccagatggatggacaaactatggttctaaatcgtgtcatcgaacagtgttgtgtgtatttgttcataagaaaccaactttgtgggggaaattacttcattgggttgagtggtcatacaatacttcgaaacattcagggtcaggagtttcaccgtatgagataacctttgggaagaaacccattactctcccacagtatatcacaagcactttgaaagtggatgcggtagatgacatgttcactaatagagaagcagtctttgaggaagttcgcaagaagcttatgaaagcccaagcagttatgaagcattttgctgaccataaacacagggatgtaactttccaggtgggtgatatagtgatggtcaaactcagaccatacaaacagacctcggtagctgggcctcaatcagttcctccgaaattagctaaacgcttctatggcccattctaa

SEQ ID NO: 70747 - DNA, 1129 bp, Glycine max
  Peptide Sequence Number=SeqID_187525
atggggataccgataaggacgcacattaactgggtcagaattagggaggagatgtatatggtggttggaagtggggtgggaactgtttgggttgaagaaagctcggcagggggtggaatcaacattacttttgagttccccaatatgcctactgtgcaaatcgaccaggaatatgaggttatgtatttggattggaactacttcgcaaacccggtggcactggagagaatgaaatctaatttgggtctgggtcgggctatgaatgtcgggtgggtcaagtggttgtataatgggattatctgcctcagtgtcatcatcctcatccatgatgagaaggaaaactgtagaggcacacttgtgtcctcggtggaagcttcaagctttggtggagcaggcaacaatggtggaggtgacgtcgtcaaggctgttaaagggcaacccgaccgcgtgatgttcggcactgctcaagtaacttatcctccagaaggcgagcgagccccaccgccagagcctgtgttaatggctataaggcttggacctcacgacgaatctctggccgccagtgggatcctcatactgagagggggtgaaccgcgattgcagagcttgcaggaatcctgtccaagacgtgagttaaccattgttggtcatccactgaaaccaggagtggaatggtactcgaaaaactggttgattttgaagatccaacagagagcatcactgccatcaaaacaaggaacttccaatttcagacaatgggcatgcacagaagaagcgaaggaaggcagaacaatggaagaagctgaaggggaagaggtaatagagttcttggtgactaggccgtcctctaatcgatcagaagatgcctttaatctagttgattcagccatggtgcagagacaacgagagtaccaaaatgttaggctccctactatctatactggacttcaagggtcagtacctcctgagaaaaatgagagaagagaattagaagatgaagagatttttcattgccatttccttcttacaagagacaggaatgccaactcagcactatgtcgttacacaaaatcctttaggtatgtaggggtattgtgttgtctcttgggtcttgcttttgctattgctg

SEQ ID NO: 70748 - DNA, 649 bp, Glycine max
  Peptide Sequence Number=SeqID_187526
atggcctcgatcacagatgaaattgatcaaattatatcagtaaagatactttcacaacaagatgatccagaactgtattcattagtaaaaaaccatttggttcatggtccatgtggaagtctgaatcctagatatccatgcatgaaaaaaggcaagtgtagtcgtttctatcctaaaaagttccagccgcatactgttttagatgctgatggttttccagtctatcgtagaagaaacaacggtaatgcaattgagaaaaatggtgttatagttgataacaagtatattgtaccttacaatgcaagattgctcagaaaataccaagtgcatatcaatattgaatggtgtaaccaaagcacttctatcaaatatttatttaagtacatcaacaagggatatgatagggtgactactattttgattgatgaagataacgatcaaactgagaatggtggcacccataatgatgagatcaaagaatatctagattgcagatacatatctccttgtgaatctacttggagaatctttggatttccaatacatggcagaaaacctgttgttgaaagattacacttccatcttcctggccaacatagtgttctctatgaggaccatgatgatcttgatgatgtattgtctaagccat

SEQ ID NO: 70749 - DNA, 552 bp, Glycine max
  Peptide Sequence Number=SeqID_187527
atgatgtgtggaagtaatgacttccaagattattttgatgatgccaaagaatcaagagttaagcaaattccaaagattcaagaatcaagtttcaagaatcaagtttcaagaatcaagattcaagaatcaagagaagactcaatcaagataagtactaaaaaagtttttcaaaacattgagcagcacaagaagttttcacaaaatcattaccaaagagttttactctctggtaatcgattaccagaaggaattcaagtgaagggtacatccacttggttgttcaaagagaacaagggagggtacatcccttgtggatctttggcttgtaaaggattttacaaggttgaaagaaatctcaagaatcggttagttgcttggggactggatgatcgtcttgaaatcaagcaaacaaaacaagacgaatttgatcctaaccatgacctgaaagttatcaagaagcgtgatcctaatctcaacctacctatagaaccaaaattatacgagaatgaacaacctaactacatggaaagaggttcattcatctcttactaa

SEQ ID NO: 70750 - DNA, 504 bp, Glycine max
  Peptide Sequence Number=SeqID_187528
atggcaaaatttagtgtcatctcagttgatgaataccaattgttgcaaatcttgcatcaagtagcaagcataaccatacaagttgtaggaatcattgtttcaaatcatggagcttgccaacttgactattccccttcaactagtttggttttgaaagagagtcaagcaagtatttcatgtattgaagctaggagaagagcagatatcagagctctggctctaaacaaggataacacaaatcttttggtttcaactttggataagcaatcgataatcttcactgacccaattgcaggaagacttagtaggatactaatgaggagagaacaagcaaatggaagtaaattgtttgtattgtggtatgtatgtaacacaaatcttttggtttcaactttggataagcaatcgataatcttcactgacccaattgcaggaagacttagtaggatactaatgaggagagaacaagcaaatggaaggcaggaagacttagtaggatactaa

SEQ ID NO: 70751 - DNA, 327 bp, Glycine max
  Peptide Sequence Number=SeqID_187529
atgagcaagcgggagcatgagtcttttaaggaatacgcccaatggtggagggatttggcagcgcaagtggtgccccccatgatagaaagggagatgatcacgatgatagtggacacactgtcagtgttctactatgaaaagttggtgggttacatgccctatagcttcatggatttagtgttcgcgggcgagaggattgaagtgggcttgaagagagggaagtttgattatgtctccctcactgacacaaacaatagaaggatcagagaagctagggaaaaaagaaaggaaggggatgcccatgtcgtcaccttggcacctgcttga

SEQ ID NO: 70752 - DNA, 2166 bp, Glycine max
  Peptide Sequence Number=SeqID_187530
atttgcgacttagctacagtagaagtctctatggaggcgattgcatccctaacccagtattatgatcagcccctgaggtgtttcacatttgaggatttccagctagtctcgaccgtgaaagagtttgaagaaatcctgggatgtccactgggaggaaggaagccatatcttttctctggtttctatccctccacggccagaattactaaggtagtgaaaatctcggcacaagaattggaccgggcaaagcaaaataggaatggagtagtcggagtaccaaggaagtgtttggaggaaaaagcgaacgccttggcaaatcaaggcgaatgggcttcttttatcaaaattttggcgcttttgatcttcggagttgccctctttccaaacgtggaaaggttagtggacctagtagcgattgacgctttcctcgcctttcacaatagcaaggaaagcctagtagttgccattttggccaacatgtatgacacattcgaccagagatgtgaaaagagcggcgccaaaattgtttgttgtacaccagctctctacgtatggttggtctcacacctctttccccaagaaggtaggcccggctgcccactacaaggtcaccacttgagtgacgagaaaggaaaggcaaattgggaccaactcttggctagcatggagggggcatccataaattggttccctcattggaaggaaggaaggatcgggattctttgctcatgcaaaggatttccaaatgttcccttgatgggaacaaggggttgtattaattataatcccatcctctccattagacagcttggctaccccatgagaggagtgccatcggaggaaagcatcgcgcctttcatcgcacggggtttcagtgaccccaacgcaagggtacttcaaggagttcacaaggcatgggatatggtgcaaaggaatgacaaagagcttaggggaagtagtaatgggatcattggcgctatcgccgaagctctgaaagagagtgaggaggtacaagccctaaagggcctgaaaggaagaacacagctgaaaaagttccaaggggcttcatggggcagcaacagtgagctcaaactccgaagagacgaaagggatcagtcacaagtcgaaggcgtgatcttgaaggatgagttaaaggtttgccttaggtcgaaaagaaatttgtcccaacagttaagcgagactgaagggaatatgtgggtcatcatcgatgagtacaaagagaagctaaacctagcagtgactcacaagcaaaggctagaggatgagtatgccaagatatcagcggaaagggaagcaagggaaaggggagtaaacaccataactaagcgcgctccaaggcacccctatcgaacccattctaaatttagagccatgggtgatgtagaggaggtgcaagaacagatgaaagccaacatgttggctctaaaagatcaaatggcttccatgatggaagccgtgctagttatgaaaagattgatagagagcaatgcagccacagctgccaccgccagcacagccgctgaagcagacccggtccatccgtctacaacaaatttagcacatcaactcaccccaaatatggtgggacgaggaagagatactttgggaaatgccaatagcccacatctcgggtacaaccgaagtgcttacccctacggtctacccctcaactttacgtttcctaccatgcatcaaaacatggatcatgccactccccctactttcgaagggcaacctccccagcctacagggggcgtccgcgaagaccatcgggagcgtgcccaaggggacgttgactcctacccccttttcaccactgaggggccgacgcccaatgtgttgcctcagcccaacatcgtaggagtctctcaaccctgcccaatgcaaccgctactcttcttcgtgggaggaccacctctggtagttgaaggaagagaaaaacttgatctcatcaaagagagattaagggctgttgaagggtttggtgattaccccttcgcggatatggtggatttatgcttggtacccgatgttgtcatccctccaaaattcatggtgtcataccctaatttcgtccggggacctttgcttgatgacatgcgacctttctttggtgcttgtgaggtgcttggcatccatcattag

SEQ ID NO: 70753 - DNA, 150 bp, Glycine max
  Peptide Sequence Number=SeqID_187531
atgtgtcatcatgtctctttgcaactcaccacagttcgaaccctagtggtgagttttcctcttttcattattttgaaccctagttttgagaataaggccaaatctatcaccaaaatgcaggacgaaagcttgaagcggcaattgtcgtga

SEQ ID NO: 70754 - DNA, 372 bp, Glycine max
  Peptide Sequence Number=SeqID_187532
atggtgtctagaactccaaatatttccattttagccaaagaagagaaggtgcaaaaagctgctgatgacttgcttaacgagtcaaattggctaagcgagactcatccgcttagcgaggcatccagctcacttagcggatggaaaaccctacaagaggataagtcagagatctgcacactcagtgtgcagccagcctgcccagcgaggatgttgtctcttctcacgctcacgagatatgctcgctcaacgagccttcgggagctgagaagtccaagagactttaaaacactgagattggcggaaaacaaaaggggggatcaccatcaagaaccacaaccagaggctagctacatgaaaaatagagagaaatag

SEQ ID NO: 70755 - DNA, 510 bp, Glycine max
  Peptide Sequence Number=SeqID_187533
atgcccatcttctccccacacatgccttccataaatggtgaaaatgaggaggatgatgtacatgcaactcgtaatgatcatgatgaaggtttatgggagaatatgcgtatgacccatgtcaacacccttaagaggtcccctccaccttcagatgctccttcgccaactacgttaaggaagactagacaaactacctggctaagaagaacgtacaacaatggttgcaatgggggtctcatggactatgcattctcctttatagtggaaaatggtgaactccataaagaggaagactatccatacattatggaggaaggtacttgcgagatgactaaggcacttgcaaaccaaaccctcagtgtggccatggaggcttcgggcagggatttccaattttatagtgggggtgttttcgatgggcattgcagaaatgacttggatcacagtgtggtagctgttggatacggaactgcaaaatgggtggattatatcatagtgaaaaattcatag

SEQ ID NO: 70756 - DNA, 261 bp, Glycine max
  Peptide Sequence Number=SeqID_187534
atggcgacgttttgtgtaaagaaacaacgtcattttcgcaatcccaaattatctccttcgaaattaggttattctcgcaagtccctcacctcgctcaaacactctgacccacttgtgccctcatgctcacccagttttcctgccttcattgagttcgtctctggtgtgctgactctgttcatctactcatcgaccatcgaagctgtacaggtctttgtcgcactgacatcgtgtgtagccatcgtcacacagagctggtag

SEQ ID NO: 70757 - DNA, 186 bp, Glycine max
  Peptide Sequence Number=SeqID_187535
atgagtcatcatcagatgatcatgatgattcaaattccacaaaaatctcaaagaaaaagactttttgctagtggagagtggagtggtttgaaggatgaaatgaaggagtatgagttgggaaaggcttcactattggttgcttggggcttattcgtgaggttttttcattcttctctaatgccataa

SEQ ID NO: 70758 - DNA, 399 bp, Glycine max
  Peptide Sequence Number=SeqID_187536
atggatgaaagtttgaggaaacttttaactaaacacatgaaagagagaagcattttgagtgttaaggtgaagaagcatttgaaaaatgggaaaaatgtttctatggggcttggatttgttgagtttgacgcccctgaaattgctacaaatgttcgcaaagatttacagggacagttttggacaaccatgctcttattttacaaccttgtaatgtcaagaatgatgggcaaaaacaaaagacaactaagaaggataagagttcaacaaaattgctcaagaaaaatgttgcttttgaggcaacagagaaggacctgccacgaagcacttaaaaatatgacttatgtgatgaagcagagctaccagtggccatacatagtacctagtttaagggacttatga

SEQ ID NO: 70759 - DNA, 388 bp, Glycine max
  Peptide Sequence Number=SeqID_187537
atggatagtatcagcgagtctgcaaaagttattaccttttgtgcggtgtcgttttgttcacgctcatctcaaccacccagacaaggaaacctcacttcactggcagcggcggtgcgcgacagagacaacctcatcaaaaccccaaaacccaaatatgtcgagtacaacaacgacagaaagtgtgagagtgacggtgagcgagaccacgagatcgatggtgagggagaccgcgagagggacaatgagggacaccgcaagagtgacaaggagggactaggtcaagttgaaagtaatgagggaagaaaagaagggttggggaggaggagtaggttagggaaagagaagggaagagtttgttgggattggggaggagaagggaagattgggg

SEQ ID NO: 70760 - DNA, 324 bp, Glycine max
  Peptide Sequence Number=SeqID_187538
atggctgagtggttgatagccccgatcttgaaaaccggtatagttcggaacaaagaactatcgagggttcgaatccctttctctcctctttctcggaaaattttgtcatcaagtcacattgaaattggatgtgagtatcaaacaagaacacaaaagtgggttgaagtggaagatccactaaatgatgttggcgtgggggatctaaagactgaaaaggattacgcaatgaaaccatggagtggaatcagatccacagaaaaagatagtggaactcagtccaaattccttgtgcgtggaagtgtgaatagaagcaagagatgttaa

SEQ ID NO: 70761 - DNA, 309 bp, Glycine max
  Peptide Sequence Number=SeqID_187539
atgcaagcgactatgcagttggtgcagtgttgggacagagaaaaggcaggatcatgcagctatcaagtatctgctaatgaagaatttgatctggtcattaaagaaaagaagggatcagaaaacttggtagctgaccacctatcaagattggttaatgaagaagtcaccctgaaggaactagaaatccatgatgcgttcccagatgaatcattgctggttgtgaatgagagaccatggtttgctgaccgagctaattataaggctgcaggaatccttcccaaggatattaattgtcagcagagaaagtga

SEQ ID NO: 70762 - DNA, 336 bp, Glycine max
  Peptide Sequence Number=SeqID_187540
atggggtcatttgcaaacatttttcgccaaggggctattttgcacgtaaattgcatgcatgccctaagcaaaccatcagtcagactggcaagttcgctggcagtgaagaacccaccatccccattggcgatttcatcatgcatgggggaaccggacgcaggaatcgccattggcgctggcgggttgcaggaagaactcgccagtttgactggcgagttgaagttcaaaaaaatttcagcgtataaagcgcaacgcgaggctctcgtgaagtttttaatcctatttgccctgtcctacactgtttggttgttattcttaatacgcgctttgggttag

SEQ ID NO: 70763 - DNA, 246 bp, Glycine max
  Peptide Sequence Number=SeqID_187541
atgggtctgcatgcatgtacgacgcaaaccgccagtggaactggcgagtttggtgtttgggaaggaatcgccagtgccaatggcgatatcgccatgcaaggggaaccgccagtcaaactagcgagttccaagttgcagaaggcaggcttgcttttttcaagtggtaggcttgctttttcaatggtaggctcgctttttcagagatggcaagccaaaggaaagttgcaattgccattggcgagttaa

SEQ ID NO: 70764 - DNA, 150 bp, Glycine max
  Peptide Sequence Number=SeqID_187542
atgtctcaccaaccaaagaaagctcatagggataatgtctatggccctattaacttgaaacaggtgcagaaaaatgatcaatcaacactaaggtctagtggtccctatggaaactcaagcaacttggatcaagaagatgccgcctcatag

SEQ ID NO: 70765 - DNA, 165 bp, Glycine max
  Peptide Sequence Number=SeqID_187543
atggttacctcgaagaaaactgcgaagagaactacggcggttcgtggtggatactggtggttgagggtggtgaacaataagcttgggtcgttggggaagggttttggaagaaaaaagcaaaaaggaatggttgttttccaaggctacacgaaaaataagacttga

SEQ ID NO: 70766 - DNA, 1291 bp, Glycine max
  Peptide Sequence Number=SeqID_187544
gctgagagagttttcaatctcagagaattttctcactggggttgttccttccaaggcttttccaattaattgtagccttgaaaatcttgacctttcggtcaatgagtttgatggtaagcccccaaaggaggttgctaactgcaagaatttagaggttctcaacctttctagtaacaatttcactggtgatgttcccagtgaaattggttccatttctggtctcaaggcattgttcttggggaacaacactttctcaagggatatcccagagacccttttgaacctaaccaatttgttcatcttggacttgagcagaaacaaatttggtggggaggtgcaggagatttttgggaaattcaagcaacttaagtttcttgtgctgcactcaaattcctacactagagggttgaacacatcaggcatttttacattgacaaaccttagccgtttggacataagcttcaataacttttcaggtccattacctgttgaaatctcacaaatgtctggacttaccttcttaaccttaacctacaaccagttctctggacctattccatctgaattgggaaagttgactcgccttatggcacttgatcttgccttcaacaatttcactggaccaatccctccaagccttggaaacttgagttctctcctatggctaaccctttcagataattcgttatctgaagaaatcccaccagagctgggaaactgctcaagcatgttatggctgaaccttgcaaacaacaaactctcgggaaaatttccttctgagctaacgagaattggaaggaacgcaagggccacatttgaatcaaataatagaaaccttgggggagttgttgctggcaatagtgagtgcttagcaatgaagagatggatacctgctgattaccctccattcagctttgtgtataccatcctaacaaggaagaattgtagggccctttgggataggttgctcaaaggatatagtattttccccatgtgttcatctcatccctcttctagaccatcacacataacagggtatgttcagctaagtgggaaccaattgagtggtgaaattccttcagaaattgggacaatggtgaacttcagcatgttgcattttggggataacaagtttactgggaaattccctcctgagatggtagatttgccacttgtagtcttgaacataaccagaaacaatttttctagtgaacttccaagtgatattggcaacatgaagtgtctacaggatctggatttatcttggaacaatttctccggagcatttccc

SEQ ID NO: 70767 - DNA, 675 bp, Glycine max
  Peptide Sequence Number=SeqID_187545
atggttgttaatggggagggccaccgggagaacggttttcgggttgcgcccgtcgagggtgacgacgtggaggaggaggatgacgaggatgattccggggaggagattgatgaggaggagggggatgacgatgatgtggtggaggttcatgagattgaagatagtgatgatgaggatggagtggaggagtacgatgacgaggacgatgacgaggatgatgatgaggaggaggaagaggtggataacgacgagggtgattttgcggaacccgagagtaccgggaggctgacgagtactgagggggagattgatgggcatgagcagggggaggaggatggggatgaggatgataatggggagactggggaggatgagatgggggtcgaagatgatggggagtttgaagatgacgatgaagaagaagactatggtgctgggtatcttgttcagccagttggacagtctgatgctctcaatgctggaggagctgatgtggatggtggaaatgatgacgatggtgaagaggaggatgaagttgatgacgacgacgatgatcaggtgttgcctcctcctgactcttcccacaagaggaagagggatgatgaagaggacgtggacgacgatgacgatgtggcttccatgtgttggaagcagggaaacctcagttttagatag

SEQ ID NO: 70768 - DNA, 774 bp, Glycine max
  Peptide Sequence Number=SeqID_187546
atggagctcactgctgaaagagacaacaacggatcattcaacttagggcttgtgagagttgttgcagatggcattacttctgaacaaacagttcgcgataccgaggcgcatttcgaccatatttgtggaacgaaatcttgcttttttgctgtcatgcgtaaaggtggaaatgttagcgttggttctcaaatgattacgtgggaggttcttcactcctataacgtaagtctcacaacccatgttagatattatgtgaacattgagtgtgataaagtgacaggacttagggccaagtttagaggcccttttaagtgcgagggtcaggttttgagagagggtttgctgaaacaatctgaaggttcttcactgattcagtgcaaggttagtggaaaaccaaaaaaggctttttgtgcttttgttaagagtgagtttgcaggaaaagaatatatccttttccaacaacaaggtgagagagtcaatgtttttaatagcgggagttttcatggtcatggtaatggctctaattacaaagattgcaatattgttatgaaatacgaagctgtggagaacagccatcggaccggatttgtcataaaatggagattcttccctttccttcctttccttatcagagagaggggccccttcttagggagcgggagtgagaggggaaggaagaatggaaagaggggtggggaagatcctgaatgccctcactttattgatggatgggaaatttggatccccttttctttgtatatctttgtcatttaa

SEQ ID NO: 70769 - DNA, 1758 bp, Glycine max
  Peptide Sequence Number=SeqID_187547
atgtcttcccctcataactctgctccccataattccactcccgataactcctcccctgatgatgccactcccgataattccattcccgataactccacccctgatgatgccactcctgataattccattcccgacaatttcacacctgataattctacgcctgataactccacgcccgataactccaatgggtcacacaaaagttcctcaatgtcccctccttcaatggagagacacaatactccaacatcgggaaaagattcgccaaataaatcattgaatgcgaaatcatcgggttcaaacaatgacagtggtgataaagcagcaatgggagctgggattggagtagggtgcaagaagaaaaaacgaaagcaaaagtattattatccagatccttctcaaggaaaagcgagtaactattacaacagtgggcaacaccctctccctagttggcaagcaggttcaggtcctcatgggggtgaccatgttatgagggtacaacaacaacaaggaatgggaatgggaatgggaatggggatgggtatgggaatgggtcctcatagtggtggctggggtgcaccaccacatcctatgatgagcagtggtgaaatgagctccaattactcattgggaatgagttcttcctcaccaggcctttctcttgcactcaacgccaatggtggcacattcacttatgaggaacttgcagctgccaccaaaggttttgccaatgagaacatcataggacaaggtggctttggttatgtccacaagggaattttgcctaatggaaaggaagtggctgttaagagtcttaaagcgggtagtggccaaggagagcgtgagttccaagctgagattgaaatcattagccgtgttcatcatcgccatcttgtgtcacttgttggatattgcatttgtggggggcaaagaatgttggtctatgaatttgttcccaattcgactttggaacatcaccttcatggaaagggcatgcctacgatggattggcctactagaatgcgaattgcacttggatccgctaaagggcttgcctaccttcatgaagattgtagccctcgcattatccaccgtgatattaaagcttctaatgtccttcttgatcaaagcttcgaagcaaaggtctctgattttggattggctaagttgaccaatgatactaatacacatgtctctactcgtgtcatgggaacattcgggtatctcgccccagaatacgcatcaagtggaaaattgacagagaaatctgacgttttctcatttggggtcatgctattggaactcataaccgggaaacgacctgtggatttgacaaatgccatggatgaaagtttagtggattgggctcgaccactcctgaataaagggttggaggatggcaactttagagagttagtggatccatttttggaaggcaaatacaatccccaagaaatgacaagaatggcagcctgcgctgctgcaagcattcgtcattctgccaagaaacgttcaaaaatgagtcagattgtaagagcactggaaggagaagcctcattggaagacttgaaagatggaatgaagcttaaagggagtgggaatgggaatagcagtgcttacccttcttcatatgggagctcagaatatgatacaatgcaatataatgctgatatgataaagttcagacaggcaataatgtcaagccaagaatttaacgacagcagtgagctttccagtaaggagatgagttatcattag

SEQ ID NO: 70770 - DNA, 366 bp, Glycine max
  Peptide Sequence Number=SeqID_187548
atggaaagtccccaaaagctatctattgttaatgcaattgagagggagagaatcattgctaatacaggtggatattttcgtgttaatggtaatggctccatgtacaaaaattgcatttgcatttttcttatgaatcaccacggagctggtacaggcacgaagctgggcaagttgtggctgccgacggttgtggcgacggcgatcgctatggtggtgccaacagctctcaagagcattggttcgatagaaggggcaagaatcgctaaagaaaggttcttggaggtgttcttgaaggagttctttgatggctgcattatctggctcaattcttgcaaatctaccagttctcacaggaaagaactatga

SEQ ID NO: 70771 - DNA, 126 bp, Glycine max
  Peptide Sequence Number=SeqID_187549
atggagaggagtcgtcactggtggaagctgctattgcggattgaatggtttctgaatgagaaaggtgttagggttgagaatggagatactaactcattcaagctacccattacaagttttcaataa

SEQ ID NO: 70772 - DNA, 459 bp, Glycine max
  Peptide Sequence Number=SeqID_187550
atgcaatctcaccatcagcaattgaatgtgatccccaatccagaacctacagagaaagctttgatgcttgctttggaatcttggaagaagattgagaaagctaaagttgatcgaagatttctagaaatttctgttttggccgatgtattttcagcatgtttagctatattgcattttttcaaattttattttcaacaccttccagctttcgagagccataatcggttgctcatcttctcctttccgtcacttccaactcaacacaaatccaagttgaggttatcgcagtttgtcaacaagcaaagtgttgctcacctgaccatttctgatcaagacaaatcatattggcatatacttggagtaccaaagttaagagcaaccagaacagtttttgtgaagataaaggatatcaatgaaaagcggaaaagaaaccaaaacagtttccatttgcatggctag

SEQ ID NO: 70773 - DNA, 192 bp, Glycine max
  Peptide Sequence Number=SeqID_187551
atgggtggtgataccaacattgtagtgtttgagacaacacagttagccagcgtgagcgctgggtctgtggagcatggtaagatagtacatggcatcaagaacatggcctattttcttctggtgcctgacaaggaggagcaagatcagcaagagaagcacttctgcaacggagataaggatctttttggataa

SEQ ID NO: 70774 - DNA, 243 bp, Glycine max
  Peptide Sequence Number=SeqID_187552
atggaaaaatacgtggagcaaccaagggagtggaaaatgaaaaggttagaaaagaagacacatggaacaatacgtggagcaaccaagggagtgggaaatgaaaagacacctccatttgggatgggaaagacaatgagatgtcattgtatggaatatgagttcatagatcctttgaagaatctcatatccacattaactaagtctaggcacaaggaagaagctctcggaattgaggagacttaa

SEQ ID NO: 70775 - DNA, 459 bp, Glycine max
  Peptide Sequence Number=SeqID_187553
atggaccaaaaagttggtccgactgaaattttgaagagggataattttcttgctaactggggtatgttgatagaaggttctcagctactcaagcaaggagactatttatgctttttctctgcattgcaaagtaaagtaaccaatttagatttggaggcacaagattttgataaggatggaactgttggattatttgaagagcttgacattgatcagtctgattcactatttctgaggaactggaatgccaaatttggtgggcatttattgaacgggttccacacccaaatttggtttctcagtttccctagcactggctacatgcagtgtaaagggagaatgtccaacatgttagatttgcaggataacattaatgtcactttccattgctatatcttctgcaaagattgcatccatgattgtttaacttactatgttactcctaccatggcaagctag

SEQ ID NO: 70776 - DNA, 711 bp, Glycine max
  Peptide Sequence Number=SeqID_187554
atgtacctattccctagtcccaagcattatataagagaggccctcatggccttaacacacaaacattcccatctcataacaacctccattcagaaactctcattactatttactcacaccatagacaagaattgcatgtttctcctatgcaatggactccttgtatttgttggcataacaagatctttatctgggtctagtggtgttgctgaaagtgaatcttcttctaagtatgttgaagatggatcacaatctccatactcagatgttgaggctaatgaggcaataatattggaggagaaggaagtcatagagaaaattcatgagcctcatggacagaatacagaagcagaacatgcaatagaaatcaagtactctagtgaagaaggagaagaagaaagcattggaaacataattttggaaggtgaagaacaagaaaaagaaaaagagaataaagaatcagttttgaaagatgataaggaaccagaaggagaaactgcatcatttggggctggagaagaagacaaggagtcagaaattgatgagtttctgattggagaaagtgttgaagaggaagaagttgtagaagaaccaaactgggtgttaagtactgaggagttgaacagaaaatttgatgacttcattagaaagatgaaggaagatttgaggattgaagctcaaagacaattactcatggatttcgaggcctag

SEQ ID NO: 70777 - DNA, 2173 bp, Glycine max
  Peptide Sequence Number=SeqID_187555
ttcaataacatttcgaataatgtttatcaaggtaaaacggcaattgtgaagaatgtgtacaacatgcaagagcaggtaagccttcagaagaagggaacaagctatttcgagttttgtgcatggataaccatgtctgggcctcaagttgatgatcataatatgctgataataaggcagattatagaaaatatactcgagaaggaccccggtgcatcagctacattgcagaaggaaacaacagctatacactctcttataagaaaagtaagagaatacttaaaagataagaggtacctcattgtgtttgatgatgtgcatagttcaaaattttggaatgttatcaagcatgccctaactccaaacagaagcaaaagcagtaaggttattatcactacacgagatgaaaatgttgcaaaatttattggaagtgatgatgtatataaagtagaacctctgtctcaaagtgatgctttgaagctcttttgtcacaaggtatttcaatctgagaaagtagaaaaccctgaattgaatgctttgtcccaagagtttgtggagaaaagtgatggggtgccagtggctattgtgacttttgctggtctcctagcaacaacgagtaaaactaccactaaatggagaatggtactcaacaaactcgactcactattacaaagaaactctctttttgacagtatgaaagaagtgatgttagaaagttaccatgatcttccttcccacctcaagaggtgtttcttgtactttggcattttccctgagggctactccattagttgcatgagactcgttcgtttgtgggtagctgagggttttgtagagaaaagagatgatacatcaatggaggaattggcaaaagaatacttaactgagcttatccgtagatgcttggttcatctttcaagggtcgattttgatggaagacccaaaagttgtcacgtgtatgacctcatgcataagttaatagccaggatttgtgaggagcaaatgttttgtcaagtaatgaaagataaaaccgcaccatcatcatctaactccaacttggattcatcacttcctagacgcttatcaataataaaaagctgggatgctgctgccatgaaaagagctgaaaagtgggagaaggttcggtcttgttttgtttttgatgatgccaagaagtggctggtgacaaaagaattattctcaagttttgagcttttgagtcaattagacttgtctaatgcacgccttgataatcttcctaaaaaagttgggaatctattcaacttgaaatacttgagcctgaggaacaccaacatcaagtcaattccagaatccattggcaacctagagaggttgcaaactctagacctaaagcgaactcaagtggatgtactaccaaagaagattaagaaccttgtcaagttgcgtcatctccttgcttattttatatataatcaaaattccggtttggaccgcttacaaggagtgaaggtaaatgaagggcttaaaaatctaacatcattgcagaaactttcttttttggatgcaagtgatggtagcgtaatagaggaactgaaacaactagagaaattaaggaagctggggattataaagctaagagaagaatatggtgaagaattatgcaaggttattgagaaaatggatcatctatgttccttaagcattggggctatgggaaatgatgatggcaatcatggcatgcttcagttgaaatctataaggaatcctccatcgtcccttcaacgcctttacctatatgggcgtttagaaaggcttccaagttggatatcaaaagttccaaatcttatcagattatgcttgaggtggtctattctaaaggaagatccattgccttaccttaaagacttgtcagaattgtcgtaccttgagttctatgatgcttatggtggtgatgagttgcatttcaagaatggatggttgaagagactaaaggttttgtgccttgagtccttgccaaagttgaagaccataaagattgatgaaggagcaattcctcttcttgcagagttgaagatagggaaatgccatgaaatggtgaaggttcccagagatatacagaacttgacaagtcttcaaaagctttatctctatgatatgcatgaacaatatattaatcgaatggttgatactcaaa

SEQ ID NO: 70778 - DNA, 2118 bp, Glycine max
  Peptide Sequence Number=SeqID_187556
atgtctgggcctcaagttgatgatcataatatgctgataataaggcagattatagaaaatatactcgagaaggaccccggtgcatcagctacattgcagaaggaaacaacagctatacactctcttataagaaaagtaagagaatacttaaaagataagaggtacctcattgtgtttgatgatgtgcatagttcaaaattttggaatgttatcaagcatgccctaactccaaacagaagcaaaagcagtaaggttattatcactacacgagatgaaaatgttgcaaaatttattggaagtgatgatgtatataaagtagaacctctgtctcaaagtgatgctttgaagctcttttgtcacaaggtatttcaatctgagaaagtagaaaaccctgaattgaatgctttgtcccaagagtttgtggagaaaagtgatggggtgccagtggctattgtgacttttgctggtctcctagcaacaacgagtaaaactaccactaaatggagaatggtactcaacaaactcgactcactattacaaagaaactctctttttgacagtatgaaagaagtgatgttagaaagttaccatgatcttccttcccacctcaagaggtgtttcttgtactttggcattttccctgagggctactccattagttgcatgagactcgttcgtttgtgggtagctgagggttttgtagagaaaagagatgatacatcaatggaggaattggcaaaagaatacttaactgagcttatccgtagatgcttggttcatctttcaagggtcgattttgatggaagacccaaaagttgtcacgtgtatgacctcatgcataagttaatagccaggatttgtgaggagcaaatgttttgtcaagtaatgaaagataaaaccgcaccatcatcatctaactccaacttggattcatcacttcctagacgcttatcaataataaaaagctgggatgctgctgccatgaaaagagctgaaaagtgggagaaggttcggtcttgttttgtttttgatgatgccaagaagtggctggtgacaaaagaattattctcaagttttgagcttttgagtcaattagacttgtctaatgcacgccttgataatcttcctaaaaaagttgggaatctattcaacttgaaatacttgagcctgaggaacaccaacatcaagtcaattccagaatccattggcaacctagagaggttgcaaactctagacctaaagcgaactcaagtggatgtactaccaaagaagattaagaaccttgtcaagttgcgtcatctccttgcttattttatatataatcaaaattccggtttggaccgcttacaaggagtgaaggtaaatgaagggcttaaaaatctaacatcattgcagaaactttcttttttggatgcaagtgatggtagcgtaatagaggaactgaaacaactagagaaattaaggaagctggggattataaagctaagagaagaatatggtgaagaattatgcaaggttattgagaaaatggatcatctatgttccttaagcattggggctatgggaaatgatgatggcaatcatggcatgcttcagttgaaatctataaggaatcctccatcgtcccttcaacgcctttacctatatgggcgtttagaaaggcttccaagttggatatcaaaagttccaaatcttatcagattatgcttgaggtggtctattctaaaggaagatccattgccttaccttaaagacttgtcagaattgtcgtaccttgagttctatgatgcttatggtggtgatgagttgcatttcaagaatggatggttgaagagactaaaggttttgtgccttgagtccttgccaaagttgaagaccataaagattgatgaaggagcaattcctcttcttgcagagttgaagatagggaaatgccatgaaatggtgaaggttcccagagatatacagaacttgacaagtcttcaaaagctttatctctatgatatgcatgaacaatatattaatcgaatggttgatactcaaagtgaagactacaagattattaacaaaatacctcttgtggaatactccaaagatgaccatttttcattatactga

SEQ ID NO: 70779 - DNA, 162 bp, Glycine max
  Peptide Sequence Number=SeqID_187557
atgacgggaactaattctcacacaactatgattgatggccctgggtgttgctggatggggagttttgtcctaaaaagtttcaattttttagaacaaacacattcacaggttaatatagaatacctaagtagagttgtgttcaacacaaatgacgggaactga

SEQ ID NO: 70780 - DNA, 354 bp, Glycine max
  Peptide Sequence Number=SeqID_187558
atgggcaccttggatggtataatagacacagtttctgccatccatcctctgccccctctgttaggtatgttgaagtctcaagggaaactcgtcatggttggtttaccagagaagcctctagagctaccaatcttccctttacttgcagggagaaaaataatagctgacagtgtcattggaggaattaaggagacacaagaaatgattgattttgcagctaaacatgatgtaaaacctgccattgaggttattcctataaattatgtgaacacggcattggagtgcctcctcaaagcagatgtaaaatatcgatttgttattgatattgggaaaacactaaagccaagctcttaa

SEQ ID NO: 70781 - DNA, 258 bp, Glycine max
  Peptide Sequence Number=SeqID_187559
atggaggaagtatcatctctggtagctcaaggcaaaaatagcaaaattgaggacacaattgttgaagcctccaaaaagtatcatctcaggcaattcaaggaaaaaatagcaaaactgaggacacaattattggagcctccaaaaagttttggggaggagtcaagagggaaaggcaatttgatggcgtgcgatgtgtgttgttatttggtgcctaacttcctaaggttggggattaatttccaatatcaaactctttaa

SEQ ID NO: 70782 - DNA, 138 bp, Glycine max
  Peptide Sequence Number=SeqID_187560
atgaggttagatgcttattttgtcgaggaatctcaacttgttggtattgatcgtaagaagcgagagctcacaaattggctaacagaaaaggagggtccagtgaaggtggtggttggcccaggagggatagatacctaa

SEQ ID NO: 70783 - DNA, 207 bp, Glycine max
  Peptide Sequence Number=SeqID_187561
atgtacttacggcacgaatgtggacgtgaagaacaacaaagttgtgcctggctatggagacttacacaggcaaggttgcggtggagtgaaggtggagtcaccagtagttgcgatgtcattgatgacattgttgtggattcagtggaggatcagacctcgcttgaaaaagagaaggaccagggaagaggaggtgctaatggagagtag

SEQ ID NO: 70784 - DNA, 684 bp, Glycine max
  Peptide Sequence Number=SeqID_187562
atgtttcttgtcgcactgacaaagaaaaaagggtatcaagatgagaagcagaaagaggagctacacccttcactagaagttactcatactgaggtaaaccaacaaagtgaacctgatgagaatcttgaacagcaagcggaagcacattcagactattcatttccaactgatagtgaaagctgcaatttttctatcatggatgaaacttttgagctcaatgttcaagagcataggctgcaagaagatatgcagtcagattattcacttccatcagatagtgaaagcagtgatgactcaataatgggggaaagttttgagatggatcacattggaaatcaaaatgaggatattatttctgaaagcttgaattctgatgatgattatgaggaggatgaggatgaggaggaagaggataccttgattgaaattaaccttccaagcagccactttcctgacttgattgaagatcctaagcaaaaattgcaaaccaagttgccagatttcctgccagattccattttcaagcagcaaggcctaatggagctcttagaagaaatcaatgacatgaatgaggatgaaaacttaattgagattgatatttccatgggatctatcaataatccagatttcagattgaagcaggggttggcatattttcaagatgaatgtgttcttagtgattga

SEQ ID NO: 70785 - DNA, 534 bp, Glycine max
  Peptide Sequence Number=SeqID_187563
atgaactcaactaaaagaatactcagtgcagcagaaggtaatttgggcgccagattggattttcgtaaaaacgctacaccactttcgttggagcgacaacaaaggtcttcgagcaacaatggttgttcaggcagctcctttgactttcatgatggtgcgatatttggcatgagtttattatgtggttccacaatcagagagaggaaatctctcaatgattttgttgaaggtcctaaagatgcaaaagggaaaggaaaaattgattatgaaggtcaatctaacgatgagagatctctcactagttcgattgaaggttcatctagggttggagatgcaaaaggatctctgaaggtcaatctagacatggagatgcaattgagaatgatgccattactaaagtgtgtagcccgacatgtgtggtatgcaataacacaagacaacatcaatgttgtgtgccaacaacctggtcggttgttagagttagagccagaagaccttcaaacccttgtcccatgggattttatacaaagatga

SEQ ID NO: 70786 - DNA, 556 bp, Glycine max
  Peptide Sequence Number=SeqID_187564
atggaggaaccaaacccgtgttttttcaaccctgcaattttggattctctcactgacgattcggtgcacgaaatcctcgacagctacaatgacttttgcaacgctacgcaatcccttctcgccggtaacggcgatctctccgtcgcttccgacttcgtttctcacgttcacactctctgcaagcaccgcctccgttccctcgttcaagaccatttttttcgactcctagaggagacgtttgaacgaaatggggcatcgagattttggcgccattttgatccttattttcatgttgcgggtttgaacaagaatgatgaccttgatattgatgaggatgagattcagagtgtgttgtataatgctttggaagagattactttggagaaacaatatcaggagaagtgtctgttgatgttggtgcatgctttgcaatcttacaaggaccaggtgtcagaggataagcatggttttgaaggagacaggaattaccttacctccaagtatcaatggattgtctcttctgtacttatggcttcgctttctcggcatttccctg

SEQ ID NO: 70787 - DNA, 2124 bp, Glycine max
  Peptide Sequence Number=SeqID_187565
atgggttcgaatctggaaccagtgccaattacatcccagaaacatgacccggcatggaaacatgttcagatgtttaagaatggggacaaggtgcagctgaagtgcatatattgtctgaagatgttcaagggtggtgggattcataggattaaggaacacctcgcttgtcagaaagggaatgcttcaacttgcagccgtgtcccccatgatgtcaggcttcacatgcagcagagtttggatggggttgtggtgaagaagaggaggaagcagagaattgaagaagagattatgagtgttaatcctttgaccactgttgtgaactcacttcccaataataataatcgggtggtggatgtgaatcaggggctgcaggccattggagtggaacacaattcttctctggtagtgaatcctggtgaaggaatgagtaggaatatggaaaggaggaagaaaatgagagctaccaagaatcctgcagcagtttatgcaaactctgagggtgttattgctgtggagaagaatggattgtttcccaaaaagatggacaaccacatttatatggcgattggtcggtttttgtatgacattggtgcgccttttgatgctgtgaactcggtctattttcaagaaatggttgacgcaattgcttcaaggggggtgggttttgaacggccctggcatcatgaacttcggggttggatcctgaagaattccgtggaggaagtgaaaaatgatatagatagatgcaagatgacttgggggaggactggctgttccattttggttgaccaatggaccacagaaacgggtaaaatactgataagttttttagcgtattgtcctgaaggcctagtctttttgagatccttggatgctactgagatttcaacttctgcagattttctgtatgacttgataaaacaagtagtagaagaagttggagctgggcaagtggtgcaagtgattacgtcgggtgaagaacagtatggtattgctggtagacggctgacggatacttttcctaccctttatttgagcccttctgctgctcattgcattgatttgattcttgaagattttggaaatcttgagtggattagtgcagtaattgaacaagctagatccgtaacaagatttgtgtacaattacagtgcaattttgaatatggttaaaaggtataccttagggaatgatattgtggatccctctttctcacactttgcgactaactttaccacattgaaacggatggttgatcttaaacacaatttgcaggccttggtcacttctcaggagtgggcggatagcccatattcaaagcaaacagctggtcttgaaatgttagattgcctaagcaatcaaacattttggtcctcatgtgacatgattgtttgtctaacagctcctctcttaaaagttatgagaatagctagtagtgagatgagacctgcaatgggatacgtttatgctggaatgtaccgggcaaaagaagcaattaaaaaagcacttggtaagagggaggaatatatggtgtactggaatattatacatcatagatgggaaaggctgtggcatcatcctcttcatgctgctggattctaccttaatccaaagttcttctatagtattcaaggagatatacatggtcagattgtctctggaatgtttgactgcatagagagattggtacctgatacaagaatccaagataaaattatcaaagagataaacttatacaagtctgcttcaggagactttgggagaaagatggcagtcagagctagagataatctgcttccttctgaatggtggtcaacatatggagggggctgccctaacttgtcacggtttatgagtaaagagcaagattttagtgatcccctatcatttgacaacattagtaatgttgaagaatggattaggccgagggatttatacatagacgatgagtgtgggaactcagattggatggctctggatccatcttctgttaacacaatgcttttgaggcctttgaatgatgaagctgaagatttgggtgaaggttatgatgattatgagattttcagttgtgggaaagatagtgaggatgaaaatactggagacaagttgttagagcaatag

SEQ ID NO: 70788 - DNA, 756 bp, Glycine max
  Peptide Sequence Number=SeqID_187566
atggctacttcctcacattacttcattttcttcagcattctggtctccatctccctcacagatggaacacaactcataatagtaaacaattgcaaagaaagtgtatggccaggaattctcggcaatggaggacacccttcacctaaacatggtggattccacctcggtagcggcgaagagattgttatccatgtccctaaggtttggtcagggagaatctggggcagacaaggttgttgcttcgaccaaaacacagccaaaggttcatgtcaaacaggtgattgtggaggcctattacaatgcaacggaattggtggagtccctccagctacactagtagaaatgacccttggaacctctcaatcaccattgcatttctatgatgttagtttggttgatgggtttaaccttccagtgtcagtgaagcctgtggaaggtggtggtggtggtggtgcaggttgcggcgtggcggcgtgtgaggcaaacttgaacgtttattgcccttcttctttggttgtggagaggaatgggaaggttgtggggtgcaagagtgcttgcttggctgcaaagtcagataggtattgctgcactggtgagtttgctggtgggagatactattgcaagccaactgtgtttgctcgtcttttcaagactgtttgccctaatgcttatagctatgcttatgatgatgattcggcagtgctcaagacttgtgtggcacctcgctatgtcatcacattttgccctccacactga

SEQ ID NO: 70789 - DNA, 1536 bp, Glycine max
  misc_feature (1221)..(1221): n is a, c, g, or t
  Peptide Sequence Number=SeqID_187567
catgtcggcatcaacctcaacaacttggcatccaacaaatccgtcgaagccgcgttttttacctccacaaataataagcagaagctcaatttgaagagtggtgaagtgactcaagcatgggttgattacgattccttaaaaaacaatttagaagttcgactctccacaacttcttccaaacccacttcaccaattttgtcatacaaagtagatctctcacaaattatccaagattccatgtacgtggggttctcttcttcaactgggttactctcaagctcccactatattttaggttggagcttcaaaataaacggagacgccaaaactctctccttgaaaaatcttccttcgctctctgcctccagcaaacctcaaaagcgattaatctttgcactttccctttcactgatcattccaacagtactcgcagcaactgctctagcatgttattatttcctcttgagaaagatgaggaacagcgaggtgatcgaagcttgggagatggaagttgtagggccacacagattcccatacaaggagctacacaaagccacaaaaggattcaaagacaagaacctcattgggttcggaggattcggtcgcgtctacaaaggggtgctccccaagtccaacatcgaagtcgcggtgaagagagtctcgaacgaatcaaaacaaggcatgcaggagttcgtgtcagaaatctcaaccataggaaggctacgtcacaggaacctcgtacagttgctaggttggtgtcggaaacaaaacgaccttttactggtctatgatttcatgcgaaacggaagcttagacaaatacctattcgagcaaccgaaaagaatacttagttgggagcagagatttaagataataaaaggtgtggcttcggggttggtttatttgcacgaggagtgggagcaaacggtaattcacagagacgtcaaagcggggaatgttctgttagataaccaaatgaacggaaggttgggtgattttggtttggcgaagctttacgagcacggttcgaaccctagcacgacacgtgtggtgggaacgttggggtatcttgcgccggagctcacacgaaccgggaagccaacgacgagctctgatgtttatgcgttcggggctttggtgttggaggtgctgtgtgggaggaggccgattgaggtgaaggcgctgccggaggagcttgtgctggtggagtgggtgtgggancggtggcgcgtggggaacgtgttggcggtggtggaccccaggttgggtggggtgtttgatgaggaggaggctttgttggtggtgaaggtggggttgtcgtgttctgcggaggcgccggaggagaggccgagtatgaggcaggtggtgaggtacttggagagggaggtggcgccgccggaggtgctggtggaggggaagaaagaaggtggtggagatggggagtttaagggttatgcgcattcgtattcgacggcgtcgttttttgacgtggagagtgaatctgcgtcatctctgtcactttccggtggccggtag

SEQ ID NO: 70790 - DNA, 299 bp, Glycine max
  Peptide Sequence Number=SeqID_187568
aggaaccagcacgcacgcttcagcgcaccgtggagtggatattacctacacctactccatatcgactagtggagccagtccaagtgatagaggtgacatcatcagaggaagaccctgaggaggacccagaggagctacctcctgagcctgctgtggatgctcttgactttccaaagggtgatgaggacccattccctgaggtggattctcccgaggacgtcatgtcggcatctgaggcagactctacggaggagagcggtcttgaggggatagtgactagtggaggttcttcatcatag

SEQ ID NO: 70791 - DNA, 1884 bp, Glycine max
  Peptide Sequence Number=SeqID_187569
atggccatggaaatgatcgaagagagcaacagtcataatgaacaatcagataatcaagaacatgtaaaaccaaaagttgaggcagagaagccaaagaataccagggtgactagaccagcccctttggaaatacttgatcgagtgcatttcaaccacaactatgaaactccacgttcaactataaaaggtgttctcaatttccatagcaatacagaactagttaatttcagcagaaaaaatctgaacaaagttgaggaacaacttaaaaggacattcattgaattctaccgcaagcttaggcttctaaaaagctatagtaacttcataatgcagatcacatcaagagatggagcaaaagcttatatggaaatggtggacaactcctaccttggaagctctgatgtggtgacaaaacttatggatagggttgaaaaaacattcactaagcacttttacaactcgaatcgtaataaagccatgcgtatcttaagaccaaaaacaaagagagaaagacatagagttacattttcaatgggtaagcaccatcatattcatattgactctaatttaggggctaaagaggacaaatttttattcacatttcttctttctcccgacactgtggacacattctcaggtttcttcgccggatgcacaacagctctagtgttagcccttattctaatcattcgtactcgtaacatattcgacaactcagaaactaccaagtacatggaaaccttgttcccactgcacagtctgtatggattcatagttctacacttgttgatgtatgctgcaaatgtatacttctggaggcaatatagagtgaatcactcattcatatttggttttaagagaggcactggcttgggatacaatgaagtccttcttctcggttttggcctagcagttttcgcactcggcagtgtgcttgcaaacctagacatgcagatagatccagagacaaaagattacaaaacattgacagaacttattccactcattttgcttcttgttgtgattgctattttattgtgccccttaaacatcatatatcggtcaagcagggttttcttcctcatatgcttgtttcactgcatatgtgctcctctttacaaggtcacattcccggatttcttcttggcagatcaatttactagtcaggtgcaagccttgagaagttttgagttctacatttgttactactgcgggggggatttcaaacaaagagaaaacacttgcaactctaacagtgtattcataactttttcattcatcgttgctgttattccctactggtgtcgtttcctccaggtgactatacttgttaattcttcccaacttttagaactgtgtttgttggagtgtcttaggcgtctgttcgaagagaaagatccaatgcaaggatataacggattgaaatatttcctcacaattattgctgtttgcctaaggacagcctatagtcttaacaattcaatggtgtggatggtgctggcaatgattttctcaatatttgcagcagttgcttctacatattgggaccttgtaattgactggggccttttgcaagggcattccaagaatcgttggttgagagacaaacttgcaatccctcataaaagtgtatattttatagcaatggtccttaatgtcttgctgagatttgcctggttgcagacagttttgaattttaagtttaccttctttcacaaacaagccgtgagtagcatcgttgcgtgtctagagatcattcgtcgtggcatatggaacttcttgagagtggagaatgagcacttgactaatgttggcaagttccgtgcattcaagtccgtgcctctccctttcaattacgatgaagatgaagataaagatgattga

SEQ ID NO: 70792 - DNA, 267 bp, Glycine max
  Peptide Sequence Number=SeqID_187570
atggtcgtggtcacagcagacttcggcaagagtgagggttctgacgacgttggtttggatggtctcgactttgtgggactcgcaccagttgacattggggcgacccatgatgctggcagcattgaagatgtgggtgggcttaagctaggctatgtcagcttcgagggaggcccggttctcgaggcaacccgagccgtactgggcccggcagagggagccgaggtggccgccaagacagcccgtgtggccatagatgagaaagtttag

SEQ ID NO: 70793 - DNA, 420 bp, Glycine max
  Peptide Sequence Number=SeqID_187571
atgatgattaaattcttggcatgcaacaacaaatccatgtttgatctttatttcgttccctcactggaatgccagacttgcggaaggccaaaagttatgtcaagacaacatatttggacacttgaaatcacacaatcaatgcttggtgcaccaggaccactgagactccctaactgtgccatgacacatgtaaatgcctgcggtcaacacatgaccattctcagaagatttggacctccattacaatggaatgttgtggtggttgatggtggagttaggtgcaaatatgttgtacaaccatggtatcaattccttgcagataatgatttctcccacgatgatgaagtctccttctattacaggaccatcgataaaacatgggaaattgtcatccgtcggaaaaagaattgggattattag

SEQ ID NO: 70794 - DNA, 306 bp, Glycine max
  Peptide Sequence Number=SeqID_187572
atggccttttcacctgcaccaatgctcttttggcatccttttcaattacgtgaggaagtttctctcaaggttcctgttgaaccaaattctgacttatcaaggttgattccttatggtgtcaccgtgacttatcttccatctctggaagtggcgaccctcgtcgtcaacattcctgtatcaaacgttccgccccgtaaggttcacttcaggtatgaattacaaccaatctttcagttgatgtggaaggttgacactctatataatcaatttcaaaacctaagtcccccaattgatcactcccactga

SEQ ID NO: 70795 - DNA, 4264 bp, Glycine max
  Peptide Sequence Number=SeqID_187573
atggaccatcgagtcgaagctttggaggaaggactgaatgaagtacgagcttcgattgctggcgtacaagccacgatgcgggagagttacgcgaacatagtcgcgttgctggagaaacacctgggaaagtcgatagcgacggagggaggtacgtcggagaagaaggacaaaccggaatctagtgaggtgaaaaacaatgtaacactagagttccgtcagtcagccaagaaggtggagctgccgtcgttcgacggtgacgatcctgctggttggatctcgcgtgctgaggtgtactttcgagtacaaggaactacgccggcggtaaaggtgagtctagcccagttatgtatggacgggctgacgattcattttttcaactcgattctgcgagaaaatgaggatctgagttgggaggagctgaaggaagctctgcttgaacgttacggaggccatggggaaggtgatgtttacgaacagttgacagatcttaaacaagaggcgattgatgattacatcacggaatttgagtatttggtggctgaaattcccagattaccggagaaacagtatcgaggatacttcctccatgggctgaaaccggagataaaaggaagggtgaggagtttcgctgccttgagtgaaatgaggcgaacaaaactcttacaggtggctagagtagtggagagggaggttgaaggaggaagtgagcttaagcccaatcgtgggcctagatttggatttggtagtggatctcataaaaatgggtcacaatcagattgggtcatggtgaggaggagagaaggaagcagaaatgagggtgtgaaaagcaacactgatgggccaaaaggagatagaaagagaattgggcctcgtgatagggggtatacacaactcacttacaatgagctgatggactataaacaaaagggtttgtgttttaagtgcaaaaatccctttgggccaatgcaccgttgtccggccaaagaactaagggtgctaatagtagacgatgtggaaaacgaggaagatgaggagaggattttggctgtggaggtaggagaggaagaagacgagaagggggagatgagcatactcaatttacaccacattactcatgagactcaccacaccatgaagtttcaaggcacaatacgaggggtggaggtactaatcctagttgatagtggtgccatccataattttatctcacagaagttagtccaccaaatggattggcccatagagcccacggccgaaatgaatgtcaagctaggtaatggatttcaaatctccacacaaggggtgtgtagagggttggagatgtgtattggagacttgaaaatgaatccagaaatgcacttgtttgagttgggaggtattgatgtggttttaggcattgattggcttaagactttaggagacactatcaccaattggaaacaacaaaccatgagcttttggaaggacaaatcatgggttactctcaagggacacgaggggtgcaggagacaaactgtggcgttacaaagtattttaaataggcccaaacccacttctcaaggcctgctatgggaaatggacaatgtaaaacacaaagggaaaggggtaaatgaattatccatacaacagcaagcagagatggaggtgttgtttaataagtttgagcacgtgttccaaacaccgaccggtttgcccccaaagcgaaacagagaccacgctatcaccctcaccgacggacatggaccggtgaatgttcgtccctacagataccctcatcatcacaaaaatgagatagagaagcaagtcaaggagatgttaacggcagggataattcgtcacagtaccagctcgttttccagccccgttattcttgtcaaaaagaaagatggtacatggaggatgtgtatagattatcgggcattgaacaaggctaccattccggataagttcccaatttcggtgattgaagaattgttggatgagcttcacggagccaggtatttctccaaactagatctgaaatcagggtatcaccaagtgagagttaaagactcagatgtaggaaaaacagctttcagaactcatgaaggccactatgagtttcttgtaatgccgtttgggcttaccaatgcgccggccacgtttcaaggtctgatgaacgatatcttccgtcccttattgagaaagaatgttctggtgttttttgacaacattctagtttgcagcaaggactgggagacacatttgcatcacttagaggaagtgttaaggttgttagcagctcacagtttggttgctaaccagaagaagtgttattttgggcaaagaagtattgagtatttggggcatatgattacggaagaaggagtagcagtggattccaggaaggtggacagtgtgctcagctggcctcaacctaaaaacgtaaaacgggtacgggggttcctaggcctcaccggttattatcgtaagttcattcgtgattatggaaaaatagccaaacctctcactgaacttaccaagaaggacggattcaaatggggggtggaagctcaaaaagcttttgatgaattgaagaagagactgaccaccgcgccagttttgaccttgcccaatttttctaaagaattcgtaattgaatgtgatgcttcagggagtggaataggcgcgatattgatgcaggacaaaaaacccatagcatacttcagtaaagcgctgggggttagaaacctaaccaagtcagcttacgagaaagaattgatggttgtagttttggcaattcaacattggcgtccttacttgcttgggaggaagtttgtgggaaggctaaacaagggtgctgatgccttgtctagaatacatgaaacaggggaattgcaggttttacactcccaaattaagtggctgcaggaagatcaaatcaaggcagaaaatgataaagacgaaaggttgcggaagattatgtctgaagtgcaacaaaacccagataagtggccaggttatgagtatcgacacggggtgttgttatatgaaggaaggttagttttatccgctcattcaatcgtgattcctacacttctggaagagttccattccacaccacatgggggacactccggattctacaaaacctatagaagattggctgccaatgtttattggattggtatgaaaaatcacgtgcaggagtttgtgagacggtgtgacacttgccaacgacagaaatacatggcaacctcacccgggggcttactacaacccctacctgtacccaaccagatttgggaagatatatccatggatttcatcaccggattaccaaaatctaagggatacgaaactgtctttgtagtggtcgatcgtttgtccaagtatgtgcacttcattcccctcaagcacccgtacacagcaaggagtgttgcagagggcaccaaattgagaatgagtacggcgtatcacccggaaacggatggacaaatggaagtgcctaagacgtggatatcttggttgcactgggccgaatattggtttaacactactttccatagcgcaaccgaaaagaccccctttgagatagtctatggaagaccatccccatcattgtacaggtgggtgcaaggggaaactagagtggaagctgtacaaagagacctggtggatagagatgaggctctcaaacaactaaggaaccaattgttgagggcgcaagagaaaatgaaagctcaagccgacaagagaagaagtgaccggagtttcgtatgtggtaaatggatgtttgtcaagttgagagcacaccgtcagcagtccgtagttactcgtatcaatgcaaagttggctgcaaggtattatggcccctatcctattgttgaaaaaatcgggcatgtggcatataagctgaagctaccagaaggatcaagagtacaccccgttttccacgtctcgctgctcaaaaaagttgtgggtacctatcaagatgatgctgagcttcctgaactgttagaagagcccatagaagtttacagtccggaggcggtattagccacacgaaaggtgaaacatcagaatgaggaggtccgacaagtcttgattcattggaaaggaaggactgcagaagaagcaacgtgggaagatgaaattatgattagaagtcagtttcccagctttgaccttgaggacaaggtcaatattgaaggaggggctgttgataggacccacgtggcagcagaagataggacaccagaacaattaattcatcacaccacag

SEQ ID NO: 70796 - DNA, 171 bp, Glycine max
  Peptide Sequence Number=SeqID_187574
atgaatctaagagggagacaagtagagataagtgacccaatgtgcccgttatgtaacaattcggaggaggttgcagcacaccttttcttcaattgctgtaaggagcaggaaaattccacggtggtgcggaagaggtttctaaaggaacaacatgaggaaaagacaaaatag

SEQ ID NO: 70797 - DNA, 441 bp, Glycine max
  Peptide Sequence Number=SeqID_187575
atgcagctgtcttctcaagaggaggctataaaacaaaaggatgtcctggctacagaagtttcctctcttagaggagagttgcaacaagtaagagatgagcgagaacggcaattatctcaagtacaaactttaagttctgaattagagaaagttaaagaatctaggaaacactcctccactgaattggacagcttgaccttaaaagctaatgatctggaggaaaaatgttctttgaaagataatcagataaaggcattggaagagcaactagcaactgcagagaagaaactgcaagtgtctaatatatctgcatacgagacaaggacagagtacaaaggacaacaaaattttgtgaatgcattacaaagacgcttagcagatgcagaatataaacttatagaagaggagaggctgaggaaaaaattacataataccattttg

SEQ ID NO: 70798 - DNA, 917 bp, Glycine max
  Peptide Sequence Number=SeqID_187576
atggtttttgtttctcagattgaaccaagaaacatagatgaagctttgtatgatgagcattggttgctagcaatgcatgaagagttaaatctgtttaaaaggaatgaagtgtgggacttagttcctaaacctatcccccacaagtcaatcgaaactaaatgggtgtttcaaaacaaacttgatgaatcaagcatcatagtaaggaacaaggccaaattggttgcaaaaggatacaaccaagaggaaggcattgactattatgaaacctatgcacctattgcgaggttagaagccattaggttgctgcttgattttacatgtattatggatttcaggttattccaaatggatgtgaagagtgtttttctcaacggatacattgaagaagagatatatgtagaccagccgccagatgtctatgatgggagagttgaactttttccttggacttcaagtcaagcaaatgaaacatggaaccttcctatgtcaaaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 70799 - DNA, 267 bp, Glycine max
  Peptide Sequence Number=SeqID_187577
atggccaagaatcttcacccataccaagtaaagttgcaactgcccgatacccacaatgaccatctgatcttacatctacaatgtttgaaatgtacggatgaaggtttccatggaattgatctaacatgggaatctttctctttcatgttggttgttgggatgaggtaccaagtgacttccatgaagattgttagagatagagggagcaacatgaaaaagctttggaacttgaagaagttttatctttttacatgcccaagtctttaa

SEQ ID NO: 70800 - DNA, 288 bp, Glycine max
  Peptide Sequence Number=SeqID_187578
atgtcaagaatgttattccggaaggggtcttctgaaaagcaatactgggcttatagaaagactactctagaagaagcacctgcactccagaataggctttttggaaaggattttttcctttcggaaagttggaacctttggcgctggaaagcaggtgtgctgcgggaagaggaaaagaaggaatggaaaggtctgtgggaggaagaaggggaagaaaatgaagaagatacaaggggtaggggtaggttaggggttttcaaaagaatgggaggtgcaagatgtgattag

SEQ ID NO: 70801 - DNA, 435 bp, Glycine max
  Peptide Sequence Number=SeqID_187579
atgactcttgcattttctgctttagtggcatttaagttatctagaaggaagactgatgataccttcaaattgctccatacaattctctttggaaggagagggaaggcagttgagatcaagagtaatatattaaggttttctggtttcgtgtggcgtgacaatgaggaaaagcaaatgattaaagtaaaagaaaaacttgacaagtgtaataaagagaagttactggaattctgtgatgtgcttgacataacaattaacaaggcaacatcgaggaagcccagtaagggaacaaagcgcaagcgtgttgtaaaatggggttcatcaagatctgggacaacttcaagacgttctgtgaagtggagtcatgtgcgggagtcatgtgcgacagtggagttagaagaggtatttgtggataagagaaaagcagtgttgtag

SEQ ID NO: 70802 - DNA, 432 bp, Glycine max
  Peptide Sequence Number=SeqID_187580
atggaggatgattacttcaaccaaatgtttggtgaagttgacatggatatggatgataccgttaaaaatgaagattgtagcaacttttttacaactaggaaggtaataatatcatcattattgatgcaatcctaccccgcaagggcattgggtagaagactccaagtagattgggctagagatccaagggaaggccctagggttctcatgagccttagggtttttgatactcgcgatgaattattgaaatgggttcaggaggttgcatttgagttgggttttgttgttgtcattttgaggtcagacataagaaatcaacctggaaggaagacatttatcgtcttgggttgtgagaagggtgacaaatataatataaaaaagatgcaaagacagtcactgggactagaaaatgtgattgcccttttaggttga

SEQ ID NO: 70803 - DNA, 2781 bp, Glycine max
  Peptide Sequence Number=SeqID_187581
atgccgtcattgccgatcaatgctgttccggtgactgggggtctagtcaactcctcctttggtgttgtcaataattttgcgtattatgttacggctaaacttacggatgataattttttgctttggaagcagcaaattgaaccagttctaaaggttcatcatcttcagcgtgttgttgtcagtcttcttattcctccaaagtatcttatacaagaagatgcagacatgaatatagacaatcatgatcttagcgttgaagtgttgaagtttctcgtaatctccatattaggttcacagtattgtttttcttttttctgttcgattttgcatcctacatttgctatgttgtcattgccgatcaatgctgttccgatgaccgggggtctagtcaactcctcctctggtgttgtcaataattttgcgtatcatgttatggctaaacttacggatgataattttttgctttggaagcagcaaattgaacctgttctaaaggttcatcatcttcagcgttttgttgtcagtcctcttattcctccaatgtatattacacaagaagatgcagacatggataaagaaaatccagcttatgcaacctgggaatatcaagaccagaataccagaaaaggggaatgctccataggtgaatttctcactcgtataaagacaattgttgattctttactagccattggacagcctgtttctgttcaggaacagatagatgttattcttgaaggtttgccaagtgaatatggtggaggaaaagatagagtgaatatgattgaggagatccaatctcttcctttggctcaagaacagaggcttgaaaaaggaagaggtggcaggtctggctatgggtatagaggagacaggaattatggtaacaatgataacaaaaactatggaaataacgagaacaaggtttttggaaatggtgaccacaggaattatggaaatactgataggtataaaatacagtgtcaagtctgctacaagtttgaccacgatgcagctgattgctatcacaggtttaatccaaattatgtagctcagcagtataatcagaatcagtcgttgaatcagcacagaaactactcttatcagaggtctaattgtcaggctctgaacaataagtctcagtcacagcaaaatgcacaagctcctcaggcgtacttagccaatgctaatcctactcagcaatcacagaattggtacattaactatggagcaactcatcatgtcactgcatctcctcagaacttgatgaatgaagttccaacctcgggcaatgagcaagttttccttggcaatggtcaaggtttgcctattactggttcaacagttgatggttccatccttcttagaggtgctcttagtcaagatggcctctatgtcttctcaaatcttctgaactcttctttcaagttcactgttggaaaggctgctgccaatgttcatatgtcttccctttcagatttgtcttctcattgtaataatcttgttcccactgaacaagctgcatcctctactccagtgaatgatgagtcttctcactctactgctttatcctctcatcctccttctcaacctccaaatacacatcccatgcaaactagatcaaagttaggtattgtctgccctcggttacatcctactttacttctaactactgctgaatctacttctgttaaacatgctctctcatctcttgagtggaaggaagctatgcagcaagagtacagtactcttatggccaataacacttggtctctggtccccttaccctcaggcagaaaagccattggctgcaagtgggctttcagggtaaaacagaatcctggtggctctatcttgaagtataaagcttggttggtggccaaggggtttaatcaaattcccggtcaggattattcagaaactttttcacctgttgtgaaaccttatttggaagaagaggtctacatgacacagccacctgggtttgctggttctgataaaagtatggtctgcaaactcaagaaagctatctatggcttaaaacaggcacctagggcctggtatgaaaggttaagcaaaacacttctgatttttggctttgttcaaagcaagtgtgatccatcccttctagtgttcaaaactgtttttgactgcctttatctgttgatatatgttgatgatattaccatcacagggtcatcttctgttcttattcaaaaattaattaccaaactacatgctgtctttgcccttaaacaactagctaaatacattcgtgatctacttgaaaagctaagatggttggatgccaaacctatcctcactgctctgccctctgatcttaagttaactaaacatggcacaaccaagattgttttagtccctgttgctgatgctattctctatcgaacccatggaggaacattggaaggctgccatgcgtattttaaggtatctgaagtttactatagactatgggttgtctttaaaatctgctcctcaaggagaacctatactttagaagctttttgtgattctgattggcgaatggatatggttgacagaagatcaatttcagggggctgtattttctttggtcctaatcctgtttcttggtggtcaaagaagcaaacttctgttgctcgatcaacgatagtagctgaatatcgaagcctgactgttactgcatcagaacttctatgttcaatccttactaagagaactctattaaaatcactactccagctgtctactgtgataatctcagcactgttgccttga

SEQ ID NO: 70804 - DNA, 225 bp, Glycine max
  Peptide Sequence Number=SeqID_187582
atgaccaggtatgtgaaaagagagcatcttattgatgttactgaggtgtttagggtacttaatgccgagaagaaatatcggatagccaaacttgctttatacttaacagttctcattgttactatcttcaggccttccattaggattcttgctgcaggaagagtaatactctacagttccaagtttgaagaattagacattcggttgaatcctatagggttctag

SEQ ID NO: 70805 - DNA, 1497 bp, Glycine max
  Peptide Sequence Number=SeqID_187583
atgggtgaggaagaaccagcgaatgaagtttccaagactgattcaaatggaaagagcttgcaggagaaaactttggatgaaactactgagaaaaaggacttggaaactgatggaggaaaagtcttggagaacaatggaatcaaagagaatattgtaaaagaaattgaagataagaaagctgatggtgtggaaaaggtagaagaggacaagaaaattgttgttgtgaaagaagcaaaagaggataagaaagaagatggggtgaaagaagctaaagaggataagatagaagaaggggtggaagaagtaaaaaaggataacaaagaagatggagtggaagaagcaaaagaggatacgaaagaatatggggttgaagaagtaaaggaggataaaaaagatggggtggaagcagtaaatgaggataagaaacaagatagggtggaagaagtagaagaggataaggaagttgatggtgtgaaagaagtcatagaggataaggaagttgatgatgtgaaagaagtcaaggaggataaggaaattgatggtgtgaaagaagtagtagaagataaaaaaggtgatgagttgaaagaaatagaagaggataagaaagatgatcatatatctgagactgataaaatggatgaagacaccaaggttaaggaaacaattgaaggtaaacaagaaaatgaaaaagtgcaagcggagaaaccagaagtagatgctatggaagtagagggtggcattcaggaggaggagagcgatgaaaaggagaaaaaagacgtggcgatggaggaggatgaagatgaggataaggataatattgataagtcaaaagaagaagagaaggcagaagatagtaagggtaagaaaggatcaaaaaaacgtgggatagggaagatcgatggggagaaagtgaaagaaaaaagaacggaaccaaagaaaacagagccaaggactcctactattgaacgccctgtgcgggaaaggaagtcagtggagaggttggtagcatcaattgataaagatgcaaccaaagaatttctcattgaaaagggtcgtggtacacctttaaaaaatataccaaatgtggcatttaagttatctagaaggaagactgaagatacgttcaaattgctccatacaattctctttggaaggagaggaaaggcagttgagatcaagagtaatatatcaaggttttctggtttcgtgtggcgtgacaatgaggaaaagcaaaggattaaagtaaaagaaaaacttgacaagtgtaataaagagaagttactggaattctgtgatgtgcttgacataacaattaacaaggcaacatcaaggaaggaagatattattgctaagcttatagattttttagttgcccctcatgcaaccacaactgtgttacttgcggaaaaagacaagcccagtaagggaacaaagcgcaagcgtgttgtaaaacggggttcatcaagatctgcaacaacttcaagacgttctgtgaag

SEQ ID NO: 70806 - DNA, 927 bp, Glycine max
  Peptide Sequence Number=SeqID_187584
agagtaaagtttcctgttcaaaaagagaacagaagctgtagtggcatagagagccagaggggtcaaaccattcatgagatctcaaagagaaaagggagatcgagtgttttggagaggctgagacaacttggatttagggattcaggttctgaaatcactggttgtggatcaagtgagagtcagaagaaaaatgaagattctaccgtagtgcggagaaagagtgcatctgacacagatgagtcagaggaagacaagaaagatgaagaaaacgaggaaaatgaaaatggtgttgctgacaaatctgaggatgaaacaccagagaaatctgaaagtgaagacaaaagtgattctgggagtgaatctgaagatataaaagaaaagaaaaaacattctaaaacatcatccacaaagaaagaatctgctaagaaaagtaaaattgagaaaattgcagttcctaataaatctcgctcaccaccaaaaagagcacctaagaaaccatcattcaacctctcaaagtctgatgaggatagtgatgaaagtccaaaggtattttcaaggaagaagaaaaatgagaaaggaggaaagcaaaagacgtcaacaccgactaagtctgcctccgaagagaaaactgaaaaggttactagaggaaaaggcaagaagaaagagaagtcgaggcccagtgataatcagttgcgtgatgcgatatgtgaaattcttaaagaagttgacttcaatacggccacatttaccgacattctgaagaaacttgctaaacaatttgatatggatctcactccgagaaaggcatctataaaattcatgattcaggaagagctgacaaaactagctgatgaagcaaacgacgacggagaagaggatgctgagaaagatgaagccccatctacaggccaagaggttgaagcctga

SEQ ID NO: 70807 - DNA, 927 bp, Glycine max
  Peptide Sequence Number=SeqID_187585
agtcagaagaaaaatgaagattcttcagtagtgcggagaaagagtacaagtgacgcagaagatgagtcagaggaagaagagagagatgaagaaaatgaggaggaaaatgaaaatggtgttcctaacaaatctgaggatgaaacaccagagaaatctgaaagtgaagacaaaagtgattctgggagtgaatctgaagatacaaaagaaaagaaaaaaccttctaaaacatcatccactaagaaagaatctgctaagaaaagtaaaattgagaaaattacagttgcaactaaaactcgatcaccacataaaagaacacctaagaaagcatcattcaacctctcaaagtctgatgatgacagtgatgaaagtccaaatccaaaggtcttttcaaggaagaagaaaaatgagaaaggaggaaagcagaagactgatgatgatagtgatgaaagtccaaatccaaaggtattttcaaggaagaagaaaaatgagaaaggaggaaagcagaagattgatgatgatagtgatgaaagtccaaatccaaaggtcttttcaaggaagaaaaatgagaaaggaggaaagcagaagaggtcaacaccaacaaagtctacatccaaagagaaaactgaaaaagtcactaaaggaaaaggcaagaagaaagagaagtcaagccctagtgataatcagttacgtgatgcgatatgtaaaattcttaaagaagttgacttcaatacggcaacatttactgacattctgaagcaacttgctaagcaatttgatatggatctcactcctaaaaaggcatctataaagctgatgattcaggaagaactgacaaaactagctgatgaagcagatgacgaggaggacggagaagaggatgctgagaaagatgaagccccatctacaggccaggaggttaaagcctga

SEQ ID NO: 70808 - DNA, 216 bp, Glycine max
  Peptide Sequence Number=SeqID_187586
atggtcaaacaaatatttcatcaagtaaaaacaaagcaagttaaatatacttgtcaagcatgcaatggctatgatttaccgatcagtgagttccgaactgagtttggaaagaatcttatggtcttgacccttgagattgaggcagcaagaaaaagccagggcagttctctgcaactccaaacttgtttgcggttacaaagagacttcactaattag

SEQ ID NO: 70809 - DNA, 1512 bp, Glycine max
  Peptide Sequence Number=SeqID_187587
ggttggtggaatggtgttgggaacagtgtgagtgctgttagtggtgttaatactggaggagttggaggtggtggtggtggtggtgctgctggtggttctggtggtactatactgtttgtgggtgatttgcattggtggactactgatgctgagcttgaaactgagcttagtaagtatgggcctgttaaggaggtgaagtttttcgatgagaaggcgagtgggaagtcgaaggggtattgtcaggttgagttttttgacccttctgctgccactgcttgtaaggaagggatgaatgggcatgtttttaatgggaggccgtgtgttgttgcgtttgcatcgccttttacagttaagaaaatgggggaggctcagataaataggaatcagcagatgaacccttctgctgttcctcagggaaggagggggcctgctgatgcaggggctaagcctggcgggagtaatatttcgacagttggtaattaccaaggtggagaagggaatagaggttatggaagaggaggaggtaactgggggagagggaacaatcctggtatggggaatagagggcctgttaatccaatgaggaatagaggtggtgggatgggtggtagaggtataatgggccatggtggaaacggatttggacagggtatgggtggtacccctccaatgttgcatcctcagtcaatgatgaatcagggttttgatcctgcatttggtggtcccatgggtagaatgggtggctatggaggctttcccggtgctccgacgcctccattttctgggattttgccttcattccctggtgttggaggtgttggtttgcctggagtggcacctcatgttaatccagcctttttcggaagagggatgcctgttaatggtatggggatgatgcccggatcaggcatggatggtcctaatatgggaatgtggtcagatccaaatatgggtggatggggtggtgaagagcctggtggtgggaaggctggagagtccagttatggggaggaagctgcatctgaccatcagtatggtgaggtgagtcatgatagagctgggtggcctatgagggagaaagatagaggctcggaaagagactggtctggtacttctgagagaaggtacagagatgatagagatcaaggatatgaaagagatgcacctaaagaagaagacatgggccatgaccatgaatggtctgaaagaaggcatcgtgatgatagagaaacgggccgagaacgatctcgtgatcgtgaccgtgaacgatctcgagaccgtgatcgtgaccgcgaaagggatcaccgtgagcgtgacaggcacagagaagatagggacaagtatgcagatcatcataggtacagagaccgggaggcagagcatgatgatgagtgggagaggggacgatcatcaaggatgcacagcaagtcacgattatcacaagaggaagaacaccattctaggccaagagatgctgattatgggaagaggcggaggcttacctctgaataa

SEQ ID NO: 70810 - DNA, 324 bp, Glycine max
  Peptide Sequence Number=SeqID_187588
atgtcctcctcactcaatctgccattgaggttcgtgttcgagttcgcacaggctccacgagttcccgttttagacatagtcttggctcctggttggtgggttcgtgagttcgtgagttggtgggttcgcaagttcctaagttggtgggttcgtgagttgatttatgttggtgcttccttggtgctgaatatcggcacgctaccttggtgttgcttcaagtctcgtaatcttgcagggatagcatttgatagctgttacaattacatcaattccatagcctttaccccttctcctatcaattatgttattaagggtagtccttag

SEQ ID NO: 70811 - DNA, 198 bp, Glycine max
  Peptide Sequence Number=SeqID_187589
atggcagtcgctaagctccattttgaggtttgcggtggcaccaccgcaaagttcgtcgacggtgttgacgacttggacctctgcagcagtggtgccttgggcgtagaggtagccctcaccgaagactttgtcgaagggggagacgatgacatagcgaaagttgggggtggggggaggtgccatttctcaaatatttga

SEQ ID NO: 70812 - DNA, 666 bp, Glycine max
  Peptide Sequence Number=SeqID_187590
atggggatattcttagctattgaggaacacacaagacttccatggaataaattcttaaacaaatcgcatatctctcttctctacgctgcgtttacattttcacatgcttgcactccattctttgtctcactcctcactgcaaaccctaatttgaagaagctaaaggaaagagacccaaaaatggacgaggccgagggagggtacggtgagagcggcgatcccatggatcagttccaccgtaacgaagctatatccgccgtcgccgacgacggtttcttgggcgaggaagaagacgacgattacgaggatctttacaacgacgtcaacgtcggcgaagggtttcttcaatcgttgcgcaagaacgacgattcggggtttcgaaacgacgacgtcgaggaaaagaagcctccgccgccgccgccggcggttccggatgccactggggtctcgataccgggtgacggtggcggtggagagggtgtcggtggtggtggaagcggggttgtggaatctagggtttctgggagtgttgatgggtttcagaatcaagggtttagagggaacgatgtgggttccaaaggcgggattagggttgaattagggaaccaatctaggaatttaagtgaaattgaggatcaggatgggaatgatggtgatgtagtgtag

SEQ ID NO: 70813 - DNA, 609 bp, Glycine max
  Peptide Sequence Number=SeqID_187591
atgccactagtgcctacagattgtataatcttgccaaacaaaaaaattgaaattagcaaggatgtggtgattgatgataaaggaaatagagaggaactaaatgagactgaagagaataccactcctcaaggtgttcagtttcctaaactaccaccaaacaagaaggcaattgatgttaaatgggtttttaagcttaaattgaatcttggtggatctatagcaagacataaggtgaagaatgaatttgaaatgatagatctgggcaaattggcttatttcttgggaatggagtttgtgacagtcccaagtgggatcattctggatcagaagaagtatgcaatggatgtcttgaagaggttcaatatgaatgactgtaagccttcaattactctagttgaagtgggactgaaattggataatacaagtgaagatgatgagcttgttgatccaactttgttcaagttcatggttgaaccaaggaagtcacatttcatggttgccaacaaaatattgagatacctaaagggaactatgaagtatggtatgttgttcccaagtgaatcaaatcaaggagaagctgaattagtaggatacactgatgttgactag

SEQ ID NO: 70814 - DNA, 315 bp, Glycine max
  Peptide Sequence Number=SeqID_187592
atgggatatattggaaagatgcttcattggtggagacaagatttgaaaggtgtggcttcaatcgttgctaagatgagaggatgtagtgaacaaatcacagacgtgataatcatggaaaatatcatgttcatggtgactcaaagcattaaccacatcattgtagccattgaagaatccaaagaagtagaaaatatgaagattgaagagcttcaaggttctttggaggcacaagcattaaaattgattcaaaggaatcaagcaaaagtggttgatcaagctttgcaagcccaagtgaaagaaggattagagaggtag

SEQ ID NO: 70815 - DNA, 462 bp, Glycine max
  Peptide Sequence Number=SeqID_187593
atggacaataaaggctctaagctaggggtggagagccctgggagaactggagctgctactgaaggaagagcagatgaagatggagctgatgctttactaataagttatgagaaagtaaagaacataaacaataacttagacataagtaaaggagaaataaaaagtgcactgcggaaaagtaaagagcgtagggaagaagaaagcaaacacaagttttatactggttcggcaacgacccgtgcctacatccagtccttaagcaacctcttgagatttcctttccttgtaaaaatcctttacaagcaaagagccacaaaggatgtaccctcccctgttctctttgaacaaccaagtagatgtaccctctacttgaagcgaaccacaaaggatgtaccctcccttgtgttcactattacaaccaagaagttacccgcttcttacacaaaattctcaaacggttag

SEQ ID NO: 70816 - DNA, 252 bp, Glycine max
  Peptide Sequence Number=SeqID_187594
atgagcgttgaagagttcattcagacggtggcctggccaggagtccagccttctccttcgggagaggttattgctcaggaggatgtggtatcaccagagcccttccctcagtcagagccatctccatctccatctcctgagcctgagccatctgcaacagcaccaatgcttgaccagtctacttctcaggacccaccatctgcaccgatgttcgatctaaatgagcatgcccaggatcactcacaggattag

SEQ ID NO: 70817 - DNA, 2082 bp, Glycine max
  Peptide Sequence Number=SeqID_187595
atggacgaaggtgagggaggcgatcccatggatcagttccaccgtaacgaggctatatccgctgtagctgacgacggtttcttgggcgaggaggacgacgattacgaggatctttacaacgatgttaatgtcggcgaagggtttcttcaatcgttgcggaagaacgaggattcggggtttcggaacgacgtcgtcgaggacaagaagccgctgcagcagcctgatcaggatcccgttgtcggggtttcgataccgggtgtcggtggtggcggtggaagtggagttgtggaaggcagggtttctgggaatgttgatgggttacagaatcaagggtttagagggggtaattctggtggaggaggtggatcaggtgggcttaaggttgaattagggcagccatctgggaaattgagtgaaattgaggagcagggtgggaatgatggtactgatgtgcaggggattgggcagcaaccacatggtggagttgttgggagtgtcgggaatgagggtttggtgagacaaggtcaaggtggtggaggaggagcagggaatgttaatagggttggtggaaatggtgttgggaatagtgtgagtactgttaatagtgttaatactggaggaggtggaggtgttgttgttgttggtggtggtgctcctcctggtggtggtgggggtaccatactatttgtgggtgacttgcattggtggactactgatgctgagctggaagctgagctttccaagtatgggtctgtgaaggaggtgaagtttttcgatgagaaggccagtgggaaatcaaaggggtattgccaggttgagttttatgaagcttttgctgcgactgcttgtaaggaagggatgaatgggcatgtttttaatgggagacattgtgttgttgcatttgcatcgccttttacggttaagaaaatgggggaggctcagataaacaggaatcagcagatgaaccaaactgctgttcctcagggaaggaggggacctgctgatgcaggggctaagcctggtgggagtaatatttcgacaggtggtaattaccaaggtggagatggaaatagaagttatggaagaggaggaggaggtaattgggggagaggaaataatcctggtatgtggaatagagggcctattaatccaatgaggaacaggggtggtggcatgggtgggagaggtataatgggtaatggtggaaatgggtttggacagggtatgggtgctactccaccactgttgcatcctcagtccatgatgaatcagggttttgatcctgcatttggccccatgggtagaatgggtagttacggaggctttcccggtgctccgacaccaccattctctgggattttgccttcattccctggtgttggaggtgttggtttgcctggagtggcacctcatgttaatccagccttttttggaagagggatgcctgttaatggtatggggatgatgcccggatcaggcatggatggtcctaatatgggaatgtggtcagatccaaatatgggtggatggggtggtgaagagcctggtggtgggaaggctggagagtccagttatggggaggaagctgcatctgaccatcagtatggtgaggtgagtcatgatagagctgggtggcctatgagggagaaagatagaggctcagaaagagactggtctggtacttctgagagaaggtacagagatgatagagatcaaggatatgacagagatgcacctaaagaaaaagacatgggccatgaccatgaatggtctgaaagaaggcatcgtgatgatagagaaacgggccgagaacgatctcgtgatcgtgaccgtgaacgatctcgagaccgtgatcgtgaccgcgaaagggattaccgtgagcgtgacaggcacaaagaagatagggacaggtatgcagatcatcacaggtacagagaccgggaagcagaacacgatgatgagtgggagaggggacgatcatcaaagcctcacagtaagtcacagttatcgcaagaggaggaacaccattctaggccaagagatgctgattatgggaagaggcggcggcttacttctgaataa

SEQ ID NO: 70818 - DNA, 360 bp, Glycine max
  Peptide Sequence Number=SeqID_187596
atgtacaagccaaaattagttgtcttttttggacacatgcaggttgctcctgcagagttagaggccatattgctaagccattcatcagttgaagatgcagctgtagtgccattaccagatgaagagacaggggaaatcccagctgcaagtgttattttgagcccaggtgcaaaagagagtgaggaggacatcatgaactatgttgcctccaatgctgcacattacaagaaagtgagagtggtgcactttgtggatgccataccaaagtcaccctctgggaaaataatgagaaggcttgtcaaagagaagatggtggaaaagatgaagactaagtccttaacaaaatctaagaacatctaa

SEQ ID NO: 70819 - DNA, 393 bp, Glycine max
  Peptide Sequence Number=SeqID_187597
atgacgcaaaagatcaaggaccaattggaggagtcgatcacagaaaaagatgttcgaatgaaggcacaggccattcaaaaacaaaacactacccctcacgtgttgtctcgtgagggttatgaattactagaaaagaagttaatatatgagaagaaaaagaaacaactagaggaagttgctaaatttggaagtactaacaccttgattgatcctccctcttccatcagacgacacgtgaagtggaagatggcccgcaccaagaaaacttaccaaatgacatgtgaggcaacaaaggaaattggtgacaagattaattccttggaggagcaggtctcacagggttcctttgtctcctatggatgtcaggatgtattgactactgccattgggtga

SEQ ID NO: 70820 - DNA, 486 bp, Glycine max
  Peptide Sequence Number=SeqID_187598
gctattattgcaagtgcatttgcaagagatgattacaaaaaggttattgcatctgcctcacgtgtgctgcagcttggattgattcttgggctggtgctctcagtccttcttttaagtctactaccatttgcttctaggttatttactaatgacattaatgttctgcaacttatcagtattggcattccatatgttgctgccactcaacccatcaacgccctggcatttgtttttgatggagtcaactatggagcttcagatttcacatattctgcttactcaatgtttatttctccctcatggcatatgcacttgctgttactcccagattatggtagcattggtgagcatattgagtttatatatgctgtcctcaagccttggctttaccggtatctggattgcgttgttgatttacatgactctaaggatatttgcaggcttttggaggattggtactggatcagggccttggagcttccttaa

SEQ ID NO: 70821 - DNA, 216 bp, Glycine max
  Peptide Sequence Number=SeqID_187599
atggctggtgatgttgcatgtttcaacattaaggctaacattataattaggcaatcagaaacaggaaacttggtaaatgacaagccagagtggaagtcacaagtgaagtttaactgcaatagatttcaaacaactaaagatgtgaacccatcaattttgagcatttctgacgatgtatgtcttctaaaaaacgacaaaggcatttctcgctcttaa

SEQ ID NO: 70822 - DNA, 186 bp, Glycine max
  Peptide Sequence Number=SeqID_187600
atggctgcatttcaaatctgcttacagatttggatggcgacctctttgcttgctgatggattggctgttgcggcacaaatgtgtgcagctgtaatcctgcaagcaactagcaaaataaatacaatcagtgcatctatggagtatggcataatgtcatctatgaaccttggaaaggaaacaaaatag

SEQ ID NO: 70823 - DNA, 579 bp, Glycine max
  Peptide Sequence Number=SeqID_187601
atgctaaatatttcccatgaactgctagatctattgtgtcctgtggagcttgctgctgtgggagtctcaattgctattttcaatcaaatctcaaaaattacaataattccactagtcagtgtcacaacctctttggttgctgaggaagatgctgttgatgaacaaaatcaacagtcagaaagagaaatgttgatgaaggtctctaatgaggatgtaaagttggatgtacatgaccatgcagagaaagctggcaactcttcatcagcaaatgttggcagagtagctaaacttgaccatgacaaaagctatattccatcagcatcatcaggaatagttattggtggtttgcttggggtcttacaagctctctttctcatttttacagctaaaccaatgttgagttacatgggcgttgattcaaattctcctatgtttaaaccagcacaacaatacttgacattgaggtcatttggtgcaccagcagttattatttctatggcaattcaaggagtttttcgtggaatcaaagatacaaaaactcctttatatgctacagttgagtctctactaaaagaataa

SEQ ID NO: 70824 - DNA, 372 bp, Glycine max
  Peptide Sequence Number=SeqID_187602
atgaacatggattaccggatgaagatgcacaggggaacttcttcaacgacggtcgttaacgcacccgtcgttatattactaacatttttacgacgtgcctttatatcactgacgttgaaatgctcacgaacaaagacgggtgaaacgtccaccccgacgttgaaatattcaaaaacaacgacgggtgaaatataccccgacattgaaatgaaaaaatacaacaacggcttttatgggtacccgacattgaaatggatccaaacaacgacgggttcttcgataaagtgtgtcgttcaatcgttttatataatgactattcttaaatgctcactgatgttgtcttctcatattacaaagacgactctggggtga

SEQ ID NO: 70825 - DNA, 300 bp, Glycine max
  Peptide Sequence Number=SeqID_187603
atgtatgcattccttgagtcacagtcattggtggtttcaaaggatagacgcagcgagtgccaacaatatcttgaaagatggcttaaggaatctgaccgagaggtgtacgttggaccttacttccatcatgtaatgacgaaattaaagacaagcttgtctcctgaaagtaaggcagctgcacctaagtggattgaagttaagtggtttgctgatgcgacatcgttggacatcgacaacatcacaacaattcaaaacaaatgggcaagatattttttaaaggctgcgtgtaaaaagggctaa

SEQ ID NO: 70826 - DNA, 186 bp, Glycine max
  Peptide Sequence Number=SeqID_187604
atggcgaaactgatgacctatccaaaatgcccgagccaagaaattttgggactcatgttccattcacttcattggccaaatcaattaaagagattgattgtgttgatggaatctaagtgctgtgccagccaagccataggtcttttggataaggactactctaacctcaacaagtggacaaaataa

SEQ ID NO: 70827 - DNA, 171 bp, Glycine max
  Peptide Sequence Number=SeqID_187605
atgaccatccctctatggcctctaaacgctactgatgttccacgctctggaatcggtgtttgtcgaagcctgtgtcggcttgcggggtcgcattggaaccctcttcaatggtgcccttcctggacctcttcgtggggagcttctttgcagccaattctaggttgcctccta

SEQ ID NO: 70828 - DNA, 180 bp, Glycine max
  Peptide Sequence Number=SeqID_187606
atgacgaagatcctctcctctacatttgtattaggaaacatagacaagggattcgaagagaagttgaagcctgaggattcatgcttagcgtgtcagactcacttagcgagctctagtcgcttagcaagaagatccccatatagcatgaagaagctgcttagggagcctgaagtcaggtga

SEQ ID NO: 70829 - DNA, 1065 bp, Glycine max
  Peptide Sequence Number=SeqID_187607
atgccgtcgtctccggaatccatctttctggaagacttcggccagacggttgatctgacgcgccgcatccgcgaggttctgctcaactacccggagggaaccaccgtcctgaaggagctcatacagaacgccgacgacgccggcgccaccaccgtctctctctgcctcgaccgccgctcccaccctgccggctccctgctctccgactccctcgcgcagtggcagggacccgcactgcttgccttcaacgacgccgtcttcaccgaggaggatttcgtcagcatctccaagattggcgggagcaccaagcacggtcaggcctccaagaccggtcgcttcggggttggcttcaactcagtataccatttgacagatcttccctcttttgtgagtcacaaatatgttgtactgttcgaccctcagggtgtttatcttccaagagtttctgctgcaaatcctgggaagcggattgattttactggttcatctgccttctccttctacagggaccagttttccccatattgtgcttttggttgtgacatgcaaagtcctttttctggaactttattccgttttcctttaagaaatgctgaccaggcagccaaaagtaagctctcaaggcaagcatattcaccagaagatatttcctccatgtttgttcagctcttcgaagaaggggttttgacgcttctctttctaaagagtgtgctgtgtattgaaatgtatttgtgggatgctggagaacctgaacctaagaaaattcattcatgttctgtcagttcagtaactgatgatacagtttggcatcgacagtcactgctcagattgtctaagagtttaaataccattgctgaagtggatgcatttccattggacttcttaatcgagagaataagtggagatgaagctgaaaggcaaacagagagattttatgtggtgcaaaccatggcctcaacatctagtaggattggttcttttgcttctactgcatcaaaagaatatgacattcacttgctgccatgggcatcagttgcggcatgcatttctgataattttctgaat

SEQ ID NO: 70830 - DNA, 360 bp, Glycine max
  Peptide Sequence Number=SeqID_187608
atgagaaatggtgaggaaaaacatataaaaagtgtggttcataaaactgagttattaatctgtgttgctttgtcagacacagtctggcctcgggcactctcttctctgtgttccggcaccactcggttcagaaatggtgtgaagagaaagatgtctttagggctagaagccatagtcatgtcctctgttgaaacggcccaaggggtgctacaaatccatgaccaatatcatgaaagaggaacagatacagtagaatgggcaatggctgagttaattcacaacccaaacataatgtcaaaggcaaaagctgagctagcgaagactcccttacttgcaagcaatagtgaaagagacttttag

SEQ ID NO: 70831 - DNA, 1458 bp, Glycine max
  Peptide Sequence Number=SeqID_187609
atgactctgagcagtgttgtcttcatctttattgttctcctttgttgttcttcccaaattcagaatgtggcctctgctgctgattaccgagaagcactcacaaaatctttgttgtattttgagggtcaacgttcagggaagttgcctcccaaccagagactcaagtggagaggagattcgggacttcaagatggccatgatgctggaattaaccttgtgggtggatactatgatgctggagacaacctgaagctagggtttccattggcattcaccataaccatgctttcatggagcacaatagagttcaaggaccaactctcacaacaaaatgagctgcaaaatgcactcaacgccattaaatggggaacagactatttgatgaaagcacaccctcaaccagacgtgttgtatggagaagttggcgaccctaacacagatcattcgtgctggcaaaggccagaggacatgactactccccgtggctccttaaggattgacgaccagcatcccggatcggatctcgcagcagaaactgcggccgctttggccgctgcttcaattgcattccgatccgtgaataaaaaatatgcatccagtatgctacttcatgcaactcagttgtttgactttgcaaataatcatcaaggcatgtattcagatagtatcacaccagcaaagcaaatatattccagtagcggatacaaggacgaattactatgggcagcagcatggcttcaacgtgccaccaaaatgcagaagtaccttgattacttgggtggagcaggcgacactggcggagtaagaacagtatttagttgggatgacaagtacgtaggtgcccatgttcttgctgcaaagcttgttttggatggcgaagtgggggcctcagggatctgggctcaatataagtcacaggcagaggaatacatatgctcatgtgcgcagaaatcaaaccaaaatacggataaaacagcagggggtctcttatggtttttgccatggaacaataatcaatatgttgctactgcaacatttgtaatgtctgtttattccaattatctgtcttcaaaaggtgcttcccttcagtgcagtgctggcaatgttactcctgatgatctcacttctcttgtccgttctcaggttgactacattttgggttccaaccccaaaggtataagttacatggtgggatatgggccaaactttccgcaacaaattcaccacagaggagcatcaattgtatcaataaatataaatcataacccagtatcatgtcaaggtggctttcaagagtggttctacaaaaatgcaccaaaccctaatgtattggaaggtgcagttgtgagtccagatagaaatgataactatgaagatagtaggaataactatcaactagccgagccagcaactgttactcttgcacctttagtgggtgttcttgcacatctagcttaa

SEQ ID NO: 70832 - DNA, 582 bp, Glycine max
  Peptide Sequence Number=SeqID_187610
atgtgggtgaatgttgtccctttgaagattttttctatatggcaagctgctcaggatagaataccatctttgcaaaatcttgtgtataggaaagttttgcgtgaggaggatgttatttgtaaaatatgtgaggatgctacagaagacactactcatattctgatggaatgcaagaaatcatggaatgcatggagtagggttttggactggtgggtattgagtgcatctttgcacactgatgaacataacttctttcagttcagggggctcattgatcaaagtattaaacagaggtggcactggtgtttagtttggtatgcagtgctttggatcatttggaaatctcgtaatgatttgattttttcagaatctgaaagaggtttgaaagagatgttggagaaaatacaagtcgccttgacatgggaatggaacaaagctgctggaatgcattgggttcatctaacagttttgagcacttttggacatgaggaggtttggaagtggcttcaggttttgttagaggaagatgatcaaacaattggttttatcttatttgaagcagtaatgaaaaagaacgaataa

SEQ ID NO: 70833 - DNA, 987 bp, Glycine max
  Peptide Sequence Number=SeqID_187611
atgaacgtggatctggaatcattggcagaggcaacttctggggccataggatcactgatcagcaccactattctctacccacttgacacctgcaagaccaagtaccaggctgaggctcgttcctcaggtcgaataaaatacaggaatctcactgatgtattattggaggcaatatctaaccgtcaggtgctttcactttaccagggccttggaacaaagaatcttcaatccttcatttcacaatttgtctacttctatggatacagctattttaaaaggctgtatctagaaaaaagcggttataaatccattggaacaaaagcaaacttggttattgctgctgctgctggggcttgcacagccattgcgactcagcccctggatacagcctcttcaaggatgcagacaagtgaatttggaaagtctaaagggctactgaagacccttacagaaggaacctggagtgatgcatttgatggcctcggtatttccttgctgctgacatcaaaccctgcaattcagtatacggtgtttgatcagctgaagcaacgagcactgaagaataaacaaaacaatgctgataaaggaacatctccagcatccctttccgcatttatggcctttcttttaggtgcaatttcaaagagcattgctacctgtctaacatatccagctatcaggtgcaaagttatcattcaagctgcagactcggctgaaccaacctccaaaacaatgataaaatcacagaaaacagtgtctagtgttctctatggaatatggaaaagggagggcttactgggatatttcaaaggattgcatgctcagatcttaaaaactgttttgagctcagcactgctcttaatgatcaaggaaaagatctctgctactacctgggtgcttatccttgcacttaaaagttactggaggaagaagcttcaattcgttgcggataatgaatgtggttggagtgcaaagtgtgcactttaa

SEQ ID NO: 70834 - DNA, 373 bp, Glycine max
  Peptide Sequence Number=SeqID_187612
atggtgtggggcgtggggaatgaggtggtggggaaggcggaaccaaggctgggtttgggactggcagagcaggtcttggtcgcggtggaggacgactgtccaagagtttctcttcttggaggcacgccaaccctgcagcttggaccagaggtgagcccggagacgaagcaactgagcaagaacggcgggggaaggccaatggttcaatttgctagttcttcgaacttggagaggagacgaaaacatggtggtgacccgagtcagaaggtcgtcaatcttctgagtgagggtattcatggattcaccaaggagggcctgatggttagagaggcgaagcagagcctcatcaagcttattcgaggaactcatggag

SEQ ID NO: 70835 - DNA, 1632 bp, Glycine max
  Peptide Sequence Number=SeqID_187613
atgggccaactttccggccaccctgttgtggtgcttgtggacggtggcagcacccacaattttattcaacaggagctcgtcactctattgcaccttccctatcagcccactccttcaccactacgtgttatgatgggaaatgatcagaatcttcaatgcaccagcttttgcgaagccatcattcttgacattcaatccactccgttcacccaaccaaacaccctacccacggaacgtgaaactaaccatcacattcatcttcttcctcactcagctcctgtcaatgtctggccatacagatatccccactttcagaagtgtgaaatcgaaacacaaatgctccaaaagggtctgattcaaccaagcaccagccccttctcttccccggtgttgctggtgaagaagaacgatgacacgtggcatttctgcgtggattaccacgccctgaatgcaattacgattcgtgatcgtttcccaatcccaacgattgatgagctcttggatgagcttggtggtgctcgctgcttctctaaacttgatttattgcagggatatcatcagatacgcatgcattccgacgacatcccgaagactgcctttcgcacccatcatggccactacaagttcagagtgatgccattcgggttgtgtaacgcgccttcatccttccaggccatgatgaacgctattttccgcccttacttgcgtcaatttatcattgtgttcttcgatgatattctcatatatagtccctgctttgctgaccatcttcttcacttagaactcgcatttcaggtactctctgctcaccactttgttctgaaactcaccaagtgcttctttgctcaagatcaggtggagtacttgggccacttggtgtcctaccgtggtgtggagcccctcgcatcaaaagtggcggccatccataactggcctataccttggacaactcgagcagttcaaagcttcttaggattggctggattctatcggtgttttatacgagggtatgcttctagtgcagctcctttggtgcacatcactaccatgaatcaatttgcgtggtcacccctggcgcagaatgcattcgatcagcttaagcaagctctttcccacgcacctgttttggccttaccagacttaaccatgtcgttcaccgtggaaatggatgtctcagggattggaatggggccctttcctccaaaactgctacgggcttcagcgtacgtccacgagctcttcgccatcacagccgccgtgaagaagtggcggcagtatctgctcgaccatcgtttcaccatcattactgaccaccgaagccttaaggagctgctaactcaagtcatccaaacaccagagcaacacatttacttggctaggttaatgggatatgattatcaaatccaatatcggtctggtgcccacaaccaagctgttgatgctctctcgcaatgctttgaccaagattccactctgcttagcctttcaatgccttgccccttgtttatgactgaattgtacaaccaattggatgctcaccaggaatataatcaactccaacaggaaattctgaagaatcttgagaaacatgccggtctctccctcgctcagaaattgatccttcgcaaatga

SEQ ID NO: 70836 - DNA, 535 bp, Glycine max
  Peptide Sequence Number=SeqID_187614
gaattgccctacgattcatcagcagatgaagtcgctgactctctggctgagtacacgttggaaggaaaatgggaaaaggttatcaaaatgtacaatgaagtggaagtgtgtcacaccgcaatgatcaacgagtccatgggcactgcactgcacgtggccgtagatttggacgaagaaggtgtggttgaagagcttgtgaaggcaattattcggcacaggcagggagagcaaagtgtgaagatcaaggctctagaaatggagaacgaccacggagatacccctctgcacgtagcagcgtccagggggttcgcaaaaatatgtaagttgatcattggaaccaacaatgaaaggatgtatttggtgagtcgaaaaaacaaacatggggagacacctctttttcaagctgctatcaactggaagaaacaggcttttgcttatctctctcacatttccaaccacagcgccaccttgcaagatcttgaaaggggcaatggtgacactattcttcactgtgctattaggagagaatatttcg

SEQ ID NO: 70837 - DNA, 435 bp, Glycine max
  Peptide Sequence Number=SeqID_187615
atggagattgtaggcaaaatccatggcctaccaagaagcttggtctctgaccgtgacccgctatttgtcaacaagttttgccttttaaaggtaatcctgaacaaggatccgaagttgctctgcccaaatgcttcactcagcaccaacctgtcatctcccctatggccatccttgattatcgccgagcataagagcaagctccctgggaagttctggtgcaatgggagggattatcaccttgaggacaaggtgagttttcaagggcccacgactgatacaaagactgaagcaagcacaagcaagaaggaggtgaaaatagcaacaacagatcaagaacacgaaacaagggtgcagtcacaaaacacatgggtgcagtcagtaggaaagcccaagaggttcatcacaagaccttcttacctcaacgattacatatga

SEQ ID NO: 70838 - DNA, 402 bp, Glycine max
  Peptide Sequence Number=SeqID_187616
atgacaaccttggatgatttcaagttgttgattgtagagccctgtaacgccgatgaacgtgtttttatgagggcggtgaaagggagagaagtcatgaagggctacgactacaagaacttgaacagtttggtggttaatgaccaaatggaggttgggaagacgaaaaagaggaagtgtgctaaggattcctcaaagtctgaccttatgaagaaatcaactaagtcggtgaaggggccaattaagggcaacaatgccaaggtggaggtcactcacttggatgagcccgaggtggtagacaagggattagaagagaacaaagtggttgaaggtgatgctgagtctttagagaagaaaatgaggggaaaaaaggccgagaaggaaagagaaatggagcttgcatga

SEQ ID NO: 70839 - DNA, 197 bp, Glycine max
  Peptide Sequence Number=SeqID_187617
tgtggggacttgtacactcaaaattagaagcacagtggagccttcacatacaatacaatggcccaagagagaggaaacataatatatactactttgagtttggggcagggaaggctgggcaaaaatattggcatagagagaggccagggaaaaagttgcaacagaagattttggtcgctagggttgttgttgcatga

SEQ ID NO: 70840 - DNA, 452 bp, Glycine max
  Peptide Sequence Number=SeqID_187618
atgaacaatgggcaccaaattacccacaagaggtccggttcaaatacaatggagcaacctacccaatacgaatccaacaacaccgaggcagatattttttttgtagatggactcgcagatttcagagcagatttaaaaatctacgagtctatcatcatcaacttctttgcctgcgatgataacaccattttttatctacattttacacctcccctaaatcaacagacatgtggcagaccaatacttcattcccgtcaacatatctggacaacagaaataacccaatgtatactgggtgctccccaaccgctggaaatcccatcacatgcaaggaaatatctgaaagaatgtgacaatcacttgacaattttaaggaagaatgcacctcctctgcaatgggacgtggttacgctcgaccgcggcattaaagataaaagtatcatccggccatg

SEQ ID NO: 70841 - DNA, 168 bp, Glycine max
  Peptide Sequence Number=SeqID_187619
atggcaatgatccagtcatcatctgtaagagcttcatcattggtcttggattctatcccagacactagagcacatgaagcaagatctttgaatgaggatcggatcttgactcttcctggcctagagaacactacacaagtccaaatggaacatgtgagcagtctctaa

SEQ ID NO: 70842 - DNA, 126 bp, Glycine max
  Peptide Sequence Number=SeqID_187620
atggaggaaagggtcccaaccagcatgtgctcgcgcgaagtgcacatgcaaagtccatctgacataagtgaatgtgcgttaagccgcaaggtgcaggctaaactgcagatgcgtactaagccgtag

SEQ ID NO: 70843 - DNA, 246 bp, Glycine max
  Peptide Sequence Number=SeqID_187621
atgagtattgagtacttaccctccaagatatattttttctgcaaggatgaaggcacccatgatggctacgataatcatcatcaaagggctgaaagcagtaaagaaatcttattagttaataacatgcaggaaatcttattagttaataacacttcatttgttcacttaactgctgcagtggcaagatgcaatgcagtagaagggggtaaagacaatatattactacaattatatgaaattgagtag

SEQ ID NO: 70844 - DNA, 222 bp, Glycine max
  Peptide Sequence Number=SeqID_187622
atggtatggacagatgttctctaccgaacaatgtttctatgttctatgatgtctcctggattgctaaaccccgatgtctcatgcatgtttagcctaatcctagccaagcgtcatcctcagatccctcttgttggactaaacttgaccaaagctgcattaagacatacataccaacaactaggttaccgtaccccaatccctcgtgaaaatacgataaactag

SEQ ID NO: 70845 - DNA, 636 bp, Glycine max
  Peptide Sequence Number=SeqID_187623
atggcattcttaggagaaacttcatctcagacgatcgtcaactcatggttggcattcatttttccaaatggagtcgtcattcacaatgagtgtggggtttattttcaaagttctactccagtgcccatgagagtaccaaacctatgcgatttttcaactcttaaaagcataatacataacacccttcaactaaacaacaatcaagttgtggatgaaattcattaccggcgatcgcttgaagatacaggtaacaacattcacttccaatgtatgcaattgaaacatgacatggatgtgaaaaccatgttaatgtgtaatgatcaattttcatgtgttggaccgattgagttgttatgcaccattggtagaacaccagatgcaattttaaacttacttcaatgccccagcatccttactcatgatgcggttctgtattacaacggaaggtggaacatgccacgccaaaacaactttatgggttacacgttcacaggaataaatccccaaaaatttgatattcctaaaggatgtaccatagatgaactgaaggatttgatcaagcaagtagcacctaaagggaatcctcctcatgggattcatgaatcccaacttgtaaggcgtttgttttatcgataa

SEQ ID NO: 70846 - DNA, 405 bp, Glycine max
  Peptide Sequence Number=SeqID_187624
atgacgggcaaaagaaaagttttaggaaaaaataatgagaaaacaagaagttattttacatggaatttggagatggaacatgtattggctgatgtactaagagatcaaaggaatttgggcaacaagggtgacggaggttggaaaaggtcagcattgaatgctgcagcagtgttgtctacaagcttcaatattaatgtcacatcagataatgccaaaaaccgtatcaaattatggagatcatggtatggtatttcgcataaatcggctaaaccatttcgattcaaggtgcttcaaaactgggatgatatagtggatttgtatgctaaagatagagccattggtcatgaagctgagactgctatagatgtaattcatgaagattttgatgatgtcaagaagaattaa

SEQ ID NO: 70847 - DNA, 922 bp, Glycine max
  Peptide Sequence Number=SeqID_187625
atgtcgcggaacttcacggattgcctaacgatgggcgtcaagtacctcgaagtgatcaagcgagggtcgcatcccaacaaacagatgtcttctcaagaggaggctataaaacagaaggatgtcctggctacagaagtttcctctcttagaggagagttgcaacaagaaagagatgagcgagaccggcaattatctcaagtacaaactttaagttctgaattagagaaagttaaagaatctaggaaacactcctacactgaattggacagcttgaccttaaaagctaatgatctggaggcattggaagagcaactagcaactgcagagaagaaactgcaggagttaaaagggaacattcgtgtattctgtcgagtgaggcctttattagctgatgaaagttgtagcacagaaggcaagattttcagttatccaacatcaatggaaacttctggacgagtcattgacctagcccaaaatggtatatctgttgtgatcatgccaaaaaagtcttttacatttgataaagtttttacaccagaggcatcacaagaagaagttttcactactacaaaaagcggattcaacatcgcttccatgctgtcttcttcttctaatctccgtctagcgaaaccgtccctgtgtgcatctgagcatcgtgttcgtcgcactcgagcatcgtcacaagtctctgcttcttctccttcgccaccatacctaggtatgtttcgtctccttcgcgttgtcttgtccttctctctgtcttcttctccatctaagctttcttgctctctttgttctccatctaccttgaagctgtatgttctccatctgaccatcattttgtctaaggtcgagcatcgtgttcgtcgcactcgagcatcgtcagaagtctgtgcttcttctccttcgccacctcacgtag

SEQ ID NO: 70848 - DNA, 540 bp, Glycine max
  Peptide Sequence Number=SeqID_187626
atgataaagaggaacaactatgatttagttggtgtttctagcaagaagatagcaagtggttttggcaatgaggtatataagaatggcacaagaggttggaagtatgagtgttttgaagttgaaagggacaacgattcttatgattcaatagatgatgagagtaatgaaaacagttcagagactgaatcttttcctgctccaaggtatcaaacttttgatatcactaggttgacagatagcactctattccttggtgttgtatctcctgaattgtcaggacccccttttatgtattatgtagtacctctagttaaaagtttggtgaataatgaatgcactgaaaatggtcgacaaccagatgaagatcagactgttatggcaccagatgcagtctcttacttccaagacatgcagagaaggatcaatgcaattgcaaggacagttaagcagttaaatgaaagtcttaaaccaaagaatgaagagaacattcaagcaagcaagcatgttactcaaccagatcaagcaaggccatctatccca

SEQ ID NO: 70849 - DNA, 2121 bp, Glycine max
  Peptide Sequence Number=SeqID_187627
atggccaagcagctcaaactctgcaggccagaaatatatcaatcaaaatatggtgaaagaaacaaagggggggcagagatagcaaccatgggcataaaccaaacccatgtgcagaacaaaaagcaaaaagctctgtctaaacctataataggggagattttttctgtcatttacaaatacgaggagatattgccaagagtagacatctttgtgtgcacggcagatccagggattgagccagcagtgatggtgatgaacacagtgctatcagttatggcttatgactatccaactgagaagctgagtgtgtatctttcagatgatgctgcttcagatattaccttctatgctctcttagaggcttccctctttgccaaacattggcttccattctgcaagaaattcaaggtggaacccacctcaccagctgcatatttcaaaagtattgcctcatgcactcatccaaataatcatgtcaatgaattggtccccatcaagaaattgtaccaagatatggaaagccgaatagaaaatgcagctaaggtgggtcaagtacccgaagaagtacgcccaaagtataaaggattttctcagtgggattcatatacttctcgacgtgaccatgacacaattcttcaaatattacttcatggaaaggactcgagtgccaaagatgtagatggaaatgttatgcccatattggtgtatttggctcgcgagaagagaccccaagttgcacataacttcaaagctggagcaatgaattcattgttaagggtgtcatcaatgattagcaatggggaaattatccttaatgtagattgtgacatgtactcaaacaattcccaatctctaagggatgcactctgcttcttcatggatgaagttaaaggccatgaaatcgcttttgtgcagactccacagtgttttgagaatgtcacaaataatgatctatatggtggtgctctacgagtaatttatgaggtggaattccatggtttagatggacttggtggacctttttatattggaactggctgctttcacagaagagagatactatgcggaagaaagttcaatgaccaatacaagaatgattggaaagagtataagaatattgatcatatgaaagaaggcagcttgcatgaactggaagaaaaatcaaaggctcttgctagttgtacctatgaggaaaacacattatggggaaaaaagatgggactgcaatatggttgtgcagtagaggatgttataacagggttgtctattaaatgccgaggatggaaatcagtgtactataatcctcaaaggagagctttcttaggtgtagctccaaccaccttgccagaagcactagttcaacataagagatggtctgaaggaggctttcaaattgtgctttctaagtatagtcctgcatggtatgcttatggattgatcagtccaggcctccaaatgggatattgttactataatctatgggtgcttctttcctggccaactctgtattactgcatcatcccttcactatatctcctcaaaggcattcccttgtttccacagatgtcaagtccatggttcataccttttgcatatgtcatacttggcgattcctcctactgcctgttggagtttttgtggtcaggaggcacaatccagggttggtggaatgacacacggatgtggctttataagagaataagctcttacctctttgctttttttgatatcatcttgaagtttttcgggttttcagaatcagcctttgttatatctgcaaaggtagcagaagaaaatgtttcccaaagatatgaaaaagaagttatggagtttggaaactcatccccaatgctcactttacttgcaacacttgcattgctcaatttgttttgtcttcttggaatgttactaaagcaagtattcataagtgaagggggtctcagaatttatgaaacaatggcattgcaagttctactaagtggagttttggttcttatcaatgtacctgtgtaccaaggcctctacctaagaaaagacaagggaagattaccaatatctgttgcagttaaatcaacaacattggctctaagtgcatgtgtcctctttattgccataagttaa

SEQ ID NO: 70850 - DNA, 339 bp, Glycine max
  Peptide Sequence Number=SeqID_187628
atggtgaccgaatatacaagttgttacagttttctgactagtaggacaaatccaacattctcaaaaagatgcaagagagtctataccatagatcttaaaccactgggtgaaaagggtcggccacttcccaaatttggtgaatgggatgtcaatgatccagcctcagctgaggggttcacagtgatttttaataaggccagggatgagaaaaagacaggtggcaacccagagtcaccaggaaagactgctactgatcctcatagcaaacctgcagtagagcctggcaaaactcagactgagccagggttgcttcctgttttgccttgtcttgcgctatga

SEQ ID NO: 70851 - DNA, 732 bp, Glycine max
  Peptide Sequence Number=SeqID_187629
atgatgatggaaaatggtacaattttaaagaattttaatagcatactactcacttgtgtcttgttgaatgtgtcaattagtgaagagatgaaactggggctatcaaattttgccactgcagttgtaatcttttccagcctggatgcagtgcttgggatcagatttgtgattgacaaagaagattttttctctcataatgttcaatatgaaggggatagagtccatgcttcatttgttgtgatcaaggttgatacatcttggcaacatactcatgagggtgtagacctttcggtgaaaggaccttctggtgaaccaattaaagattttcatgacatgacaagtgaaatattcgaatttgtggcacgaaacagtggaccctatcgcttctgcttcatcaacaagtctccctatcatgaaacagttgattttgatgtccattctaaccacattcatttcactgatcagcatgcaaaagatgagcatttaactcctttgttggatcagatagtaaagttagagcaagctcttttcaacattcagtatgaacagcattggcttgaggctcagacagaacgccaggcaatagcaagcaatgcaatgagctccagagcaattcacaaggccttacttgaatcaatgacactaatgggtgccagtgccctccaagtttatcttctccgtcgcctctttgaaagaaagcctgcctatagagttcaagtacctgaacgttga

SEQ ID NO: 70852 - DNA, 195 bp, Glycine max
  Peptide Sequence Number=SeqID_187630
atgggccttacggagtggcgtaacgggattcgtcgaacgtcgttacgtgttccgcgggaacggaacactgtgccgttagatttagcgtcacacgtgacgtggggtgggggatatgcgtggggaagggttcgtggaaaagtgacggaacggcaatggtgttgtcataggaagccacctttaaaaagatgtaattaa

SEQ ID NO: 70853 - DNA, 1677 bp, Glycine max
  Peptide Sequence Number=SeqID_187631
atgtcaggaatatcttatttatccagagaacaagaaagggaagcattaaggagtttgaattctacatatgatagtagtgagtggtcagacattggtaaattaaaaaatgttagggacataccactgctcagcacggcggacattttgttcactgcaagaatgaaaaataaattcggtgaatggcgtgatgggttatttcaggagcaaaatcaagaagaccaaattcaaggaatttcaaaagactcaaaatttcaagtgactttttttgagatgcatccagctcttaggcttaatggattcacgtctcaccagcttaaattgattcagttggtaatcagaaaacacttcaaagatctatcatatgtcagtgtgaacagtgagacttctggttcacaacaattagttgtatatacagactcaaaggatgaattaaacttacttctgaagaaggtgaaagaagaaaatcacagggcagaagagaagaagatccaagctgccgtgggatttcgccatgttattgatctcctttcatcagaacagaagttgatagttggttacaattgttttttagatattgctcatgtctacagcaaatttattggccctcttccggggagtcctgatgagtttgttgcctctgttaacaagtgctttccacacattgttgacaccattatactcctgaacactaatttgatgttccaagaaaagatgaaaaggtccagaaaatcactggcctctgcattcactttattttgtccacaaattgcagctggctccagaagcactgatctaggttcactgtcacatgtgaaagtggatgttgaggttgatggttcgagatcatgcagctggaaccctggaggcaagcatgaggcaggatatgatgccttcatgactggatgcatctttgcccagttatgcagtgatttaggtattgattttaaactccgtgattcttcaaaccaattagccctcaatgagaaactgcagaagtacgttaatcgtctatatcttagttggatacacggggacatcattgatctaaatactggtaataaggttgcagattcttcacccagtcatagcctgaagaagcggtacccaacaattttgtttgagaacattgttattatttggggatttccttctaagctgaaggcaaatgaagtaagagagtgcatatctaaagcatttggaccaacttctgtagtttctgtcttccacttggatgcaactgcagcattcgttcagtttagcaaaactgaattagtttctgattttctattagtgaaggattccttagagagaagtgatggtgcaatctcggttttgcatccactgtcaaaacttttggaaggtggaaatacatgtgctgccaattatgatacttacaacgaaatatgtggttcacccttatcagaaggtctgtttgctgatcaggcaaagaaagttggtataaagtggaagaccaaattaacagaatgcaaggtagcatccaggggtgaagaacatgaaaatccaagtttacaagctaatgatgtaaatacagctatgaagaatgtagaaaagaccaagccaaacacaattgatcagttaggaaatgcttcatctcgtggacaagtctcaacttttgaaattgaagattcttctcgtgttgcagaagccaacttgtga

SEQ ID NO: 70854 - DNA, 1641 bp, Glycine max
  Peptide Sequence Number=SeqID_187632
atggaaaaacgcattgaagatgcgaccaaatttggtgaagtagccaaagaagcacgtttaaagcatatggggttttctcagtgggattcatattcttctcgacgtgaccatgacacaattcttcaaatactacttcataaaaacgaccataataattcaaaagatgtagatgggttcgttttgccagctctggtgtatttggcccgcgagaagagaccccaatatttccacaacttcaaagctggagctatgaattcattgttaagggtctcttcgaatatcagcaatgggaaaataattctaaatgtagactgtgacatgtactcaaacaactcacaatcagtgagagatgctctctgctttttcatggatgaagagaaaggacaagaaattgcctatgtgcagtttcctcagacttttgagaatgccactaagaatgatttatatgggggtagtctaacatcaatattagaggtggagttccctgggttggatggttatggcggtcccttgtatgcaggaactggttgctttcacaagagagagtctctttgtgggatgaaattcagtgatcaatattgcaatgactggaatagtgaagatgatcagtttaaagaagcaaacctgcaagaactagaacaacaatcaaaggttcttgcaagctgcaactatgaggaaaacacactatggggaaaagagatgggtttaaaatatgggtgtccagtggaggatgtgataacaggattgtctatacagtgccaagggtggaaatcagtgtactacaacccaccaaggaaggctttcttaggtttagctccaactaccttgcctcaaacacttgttcagcacaagagatggtctgaaggagacttgcaaattttgctttctaaatacagccctgcatggtatggttttggaaggatcaattttgggctccaaatgggatatagtgtttattgcttatgggcacctaattgtttagcaacactatactattctatcatcccttcactgtacctccttaaaggcattcccttgtttcccaaggagaaagaaaaagtagaaaaaggaagtagtataaaatggaatatatcaagtccatggttcataccttttgcatatgtcattgttggggaaactacttatagtttattggagtttttcttctgtgggggcacatttcaaggttggtggaatgaccaacgaatatggctatacaaaagaacaagctcttacctatttgcctgcattgacaccattttgaagctttttgggttctcagaatcaacttttacaatcacaactaaggttactgaagaagatgcttctaaacgccatgagaaagaaataatggagtttggaacctcctctccaatgctcactgtattagccactcttgcattgctcaatttattttgttttcttagtgtattgaaggatgcaatcctaggtgaaggtgacattggagcttatgagacaatggggttgcaagttctattgtgtggttttcttgttttcatcaatttgcctatataccaaggacttttcttaaggaaggacaatggaagattgcctagctctattgccatcaaatcaatagtatttgctctaggagtattcatatccttcatctttacatga

SEQ ID NO: 70855 - DNA, 345 bp, Glycine max
  Peptide Sequence Number=SeqID_187633
atggcagaggaagagtcttatccattgtttgagacaaggagggccaaaggaagggtcatttacacaatcttctctttatcactttttgtgggcattttgttcatctgggtttacagagtgagtcacatacccagagaaggtgaagatgggaaatgggcttggattggtttgctttgtgctgaactatggtttggtctttattggctcctcagacaccctttcagatggaaccctgtgttcagggaacctttcagacacaaactctctcaaaggtaccacactcatcatcatcatcatcatcatggcataacactgttgattattgttgagattcattcacttgtg

SEQ ID NO: 70856 - DNA, 1941 bp, Glycine max
  Peptide Sequence Number=SeqID_187634
atgtggacacacaagcatgacagcgcctgtgtttccactagtacccttaaggacagtgctgcatattggttaatagataggattggctggagcacaataacccgtgagaaatttgaagagctctgtgaagacatttgggaaaaatcactcttacctgtgaaagaggtgcttgagcattctggcctgtcattggaacaaatatatgcagtggagttgattggaggtgccaccagagtgccaaaattacaggctaagcttcaagaattccttgggagaaaagaacttgataggcatcttgatgctgatgaagcaatagttcttggtgcagctctgcatgctgcaaatttaagtgatggaatcaaattgaaccgcaaactaggaatggttgatggctccttatatggatttgtggttgagttgaatggccctgatcttttaaaagacgaaagctctaggcagatacttgtaccacgaatgaagaaagtcccgagtaagatgtttagatccgttaatcataacaaagattttgaagtttcactagcttatgaaagtgataattatttgcctcctggtgttacctctcctgaaattgctcaataccagatatctggtttgacagatgcaagtcagaaatactcatctcggaatctgtcatcccccatcaaggcaaacattcatttttctcttagtagaagtggaattctttctctggatcgggcagatgctgttattgaaataacagagtgggtggaagttcctaggaagaatttgaccatagagaattcaaccatttcatcaaatgtttcggctgaatctgctgctggtaatagtactgaggaaaacaacgaaagcgtgcaaactgatagtggggttaataaggcatccaacattagtgcagaggagcaagctgccactgagcctgctacagagaaaaagctgaaaaggcagacttttagggtaccattaaagatagttgagaagataactggatttggaatgtctctatcacaagattttcttgctgaagccaaaagaaaattacaagtactagatcaaaaagatgcagacagaaaaagaacagctgagttaaagaataatttagaaggatatatatatactaccaaggaaaagattgaaacgcttgaggagtttgaaaaagtttctacaagtgaggaacgccagtccttcattgagaagcttgatcaggtgcaagattggttgtatacagatggtgaagatgccaatgcaacagagtttcaagagcatctagatcagttaaaagctgttggagatccaattttcttcaggttaaaagagcttacaactcggccagcagcagttgagcatgctcataagtacattgatgagttgaaacagcaagagagaggggagagaagagcaagggaggcaacagagatgggaaaagggagagaaggggatgaaaggggagaaaaagagaagagtgagagaggaaatagagatgggaaagattgttcaagagtggaaagcaaagaagccttggcttccacaagaaagagtagacgagctggtgttaccttcagaaaaatcattgttttttggtacctaacttgcaaggtcataaaaagttctgaaaaattgaagaattggttggatgagaaagaagctgagcaaaagaagacttctggattcagtaagccagcatttacatctgaagaagtatatctgaaggtgcttgatctgcaaaccaaggttgccagtattaatagaattcccaagcccaaacctaaggttcagaagcctgtaaagaacgaaactgagagcagcagtgcgcagaatacagagacttctgattctaactcagctgatagttcctcttcaagtgattcatctgccaacagttcagaaggcacaagcaaagagacggttactgagcaatctgaaggtcacgatgagctatga

SEQ ID NO: 70857 - DNA, 228 bp, Glycine max
  Peptide Sequence Number=SeqID_187635
atggagaaagatttagaagtcaagatttcctcaaagaaactacgaaagaaaggatttgaggaactgttctccaccgaatccttgaggtggattctgaggattcagctccaattaaaacattcctctcagagtggtggttcggtggcaagcaatggcagctcgtggtggccatcgatcgtcgttggtggtggaggaagaggtgttagggcttgggtgggcatttgttga

SEQ ID NO: 70858 - DNA, 615 bp, Glycine max
  Peptide Sequence Number=SeqID_187636
atggggagggttgagtactccccattgtttgagacaagaaggtgcagaggaagatttagccacataacaaagggtgaagatggaaactgggcatggcttggtatgcttgcttcagagctgtggtttggcttttactgggtccttactcaagcccttagatggaaccttgtgttcagacaacccttcaaaaacagactctctcaaagatatgagaaaaagttgccaagagtggacatatttgtgtgcacagcagatccagatattgagccagcaatgatggtgattaacacagtgctatctgttatggcttatgattatccaactgaaaaattgagtgtgtatctctctgatgatgctggatcgcaaatcacgttctatgctctgctagaggcttcaaactttgcaaaacattgggtcccattctgcaagaggttcaaagtggaacccaggtcaccatctgcatattttaaaagcttagtctcatcaggttaccctacagacccaagccaagccaaagaactgggaaatattaagggtgaaaattcaacatggatcattgatccatttctggtggctacagcccacattattgcttatattttacagggttcttag

SEQ ID NO: 70859 - DNA, 189 bp, Glycine max
  Peptide Sequence Number=SeqID_187637
atggttaacaataaaaggcaaaatgtaggccaaactgtggaaattacatcaccgtgtcccaaaagacaaaaaccaaacggattatgctaccgaacatggatggtgtctatacggaagacaaactccgggcaatgctactcggcgacaataggcataacaaaagcttctgacttcttagttctaccataa

SEQ ID NO: 70860 - DNA, 720 bp, Glycine max
  Peptide Sequence Number=SeqID_187638
atggatttgtacagagccatacggaattctcaactcataggaatgtctggttactcaaaggagggtctacctgtcattgctgttggtgttggtctcagtacatatgataaagcatctccaacagctacaaggaaacatggacgatacattggcacctgtgtgaaagtcttggatatgactggtttaaaattttcagcattgaatcaactgaggttgttgactgctatatctacaatagatgacttgaactatccggaaaagacagacacatactatattgttaatgtgccatatgtattctcagcgtgctggaaggttgtgaagcctcttttgcaagaaagaacaaggagaaaaatccaggtgctgcaaggttgtgggaaggaggaattactgaaggtaatggactatgcatccctcccacacttctgcagaaaagaagattccaagtcttccaaacatcatgcattaggaaacattggaaattgtttctccttcaatcacgccttccatcaacaactctacaatcacatcaagcaacaatccatcattgtggagtcaatttcaccaatcagacaagggtccttctatgtagacataccagagccagaccctgatgatgccaaaatagccaagaccatagaaactgagttccacaaattggagaatcagaagaatggctttaccaactcactaaatggtcttagagttaatggccattga

SEQ ID NO: 70861 - DNA, 963 bp, Glycine max
  Peptide Sequence Number=SeqID_187639
atgtcagcagtcgctcttggtaatattcatttttatggatcttcacctgtttcactcagagtctggtttaattgtcaaaagattgcatttcaggtgcattcttctaagtgtataaggaaaaaagaatactcttttgctaaggatttgggggctataagtgctgagaaagacaatcttgacataacccagcatgactgggccttaccgaattttgagcagcttgctgaagctgtgttgaggcaagtcggtctacctgtcattgctgttggtgttggtctcagtacatatgataaagcatctgaaaaatactgtatacaatcacacatccaactgaatgaatatagggatcaagtgatcttgccaacagctacaaggaaacatggacaatacattggcaccactgtgaaagtcttggatatgactggtttaaaattttcagcattgaatcaattgaggttgttgactgcattatctacaatagatgacttgaactatctggaaaagacagacacatactatattgttaatgtgccatatgtattctcagcatgctggaaggttgtgaagcctcttttgcaagaaagaacaaggagaaatatccaggtgctgcaaggttgtgggaaggaggaattactgaaggtaatggactatgcatccctcccacacttctgtagaaaagaagattccaagtcttccaaacatcatgcattaggaaaaactggaaattgtttctccttcaatcacgctttccatcaacaactctacaatcacatcaagcaacaatccatcattgtggagtcaatttcaccaatcagacatgggtccttctatgtagagatacaagagtcagaccctgatgatgccaaaatagccaagaccatagaaactgagttccacaaattggagaatcagaagaatggctttagcaactcactaaatggtctgacagttaatggccattga

SEQ ID NO: 70862 - DNA, 150 bp, Glycine max
  Peptide Sequence Number=SeqID_187640
atggataatgtgttagaaagtacttattacactatcaaagctgtgtggctaggttgcggcagagagtgggtcgcggacgcaacgaagagtgggttgaggcgtgactgtgttaggtgtcaagctcaagctgtcgtgacgaagagggagtga

SEQ ID NO: 70863 - DNA, 915 bp, Glycine max
  Peptide Sequence Number=SeqID_187641
atggaagggcttcagccccatacttggggaagtaaatgtaaaacctgcttaacaatatgtgaggggcatgatgggactgaaacatcaaatggagatgtattaatttttccagacatgatcagatataggagattaacccattttgatgttgagacatttgttgaagaagttctagtcaaagaaggagaatggcttcctggaaatcctgaatcattaaaagcttcatatgttttcgtgtgttcacatggatcccgtgatcgtaggtgtggggtttttggacctatcttggtcagtagattcagggaagagatagaattacatggtcttcaaggcaaagtgttgattagctcgtgctcgcacattgggggaaacaagtatgctggaaatgtcattatatttggatcaagtaacaacagagaagtcactgggcacttgtatggatatgttactccagatgatgtacctttattgtttcaccagcatatcattaaaggggagatttttgactcactatggagttccatccttcaaaagacactagcaaggattgctctcgtgctggtcttttggagcagaaactgggtctgttgggtaatggactatgcatccctcccacacttctgcagaaaagaagattccaagtcttccaaacatcatgcattaggaaacattggaaattgtttctccttcaatcacgccttccatcaacaactctacaatcacatcaagcaacaatccatcattgtggagtcaatttcaccaatcagacatgggtccttctatgtagacataccagagccagaccctgatgatgccaaaatagccaagaccatagaaactgagttccacaaattggagaatcagaagaatggatttaccaactcactaaatggtcttacagttaatggccattga

SEQ ID NO: 70864 - DNA, 876 bp, Glycine max
  Peptide Sequence Number=SeqID_187642
atgtctcaggaagaaaacaagaatgccattgagttccttgatgaacaagctttctattatgacgaggaagatgagcagtggtttaaggaaaaagatgatcagtgggcaaagaacataccatgctacaaagaagacgcagtaaaagtagtcttgaattcagtcaacttcgattttgacatgcaagatttagatgagttcttgaaggttcttggcactgaagattcttcccctgagagagttcctgatcctgttattcatgttacttctcctatttctggacgggttcaggttccttcccctccgagagttcatgctcctgcacctcagagggtttatacttttgccaatttggtttctgctacatgtgcccctacagctcgggttccagcaccacacgagtcaccggaggagacattcaatggcattgcatctggtcaggtccatgcactgatcagccaccaacaccacttgcttccgcagaatatggagtccaatcgtgtcatgttagccggtgactcatcccgatcgaaatttgttccatcaaaaaatccatttcaagttgcaagtcatgctcaaaaatacttcaaacgcaagaataacccaaagaaagagaggaaaaggaaaagcattcatgacataaccttagaggacattaacacgattgttactccctgcattgatcaacataattgggttcctcctccaccaaattttgcagcgcaaccacatgaaatacgacatgcacaacccatgcagcagttcaaccaacataatccgtttcatcaaatgcagcagtttcagcacaatatgcctagtcaaatgaacatatatggatattctaataattggcctcacgacagtgaacatgccaattga

SEQ ID NO: 70865 - DNA, 999 bp, Glycine max
  Peptide Sequence Number=SeqID_187643
atgtctcacgaagaaaacaagaatgccattgagttccttgatgaacaagctttctattatgacgaggaagacgagcagtggtttaaggaaaaagatgatcagtgggcaaagaacataccatgctacaaagaagacgaagcaaacgcagtcttgaattcagtcgacttcgattttgacatgcaagatttagatgagttcttgaaggatcttggcactgaagattcttcccctgagagagttcctgatcctgttgttcctatttccggaggggttcaggttccttcccctccgagagttcatgctcctgcacctcagagggtttatacttttgccgatttggtttctgcaacatctgcccctgcagctctggttccagcaccacacgagtcaccggaggagacattcaatggcattgcatctggtcaggtccatgcgccgatcagccaccaacaccacttgcttccgcagaatatggagtccaatcgcgtcatgttagccggtgactcatcccgatcggttccttgcaagaaatacacacattggaccagagaagaacacatttcgtttctccttgggcttgagaatgttggaaaaagttggacatatatttcacagaaatttgttccatcaaaaaatccatttcaagttgcaagtcatgctcaaaaatacttcaaacgcaagaataccccaaataaagagaggaaaaggaaaagcattcatgacataaccttagaggacattaacacgattgttactccccgcattgatcaagataattgggttcctcctccaccaaattttgcaacgcaacctcatgaaatacgacatgcacaacccatgcagcagttcaacctacataatccgtttcatcaaatgcagcagttcaacctacataatccgtttcatcaaatgcagcagtttcagcacaatatgcctagtcaaatggacatatatggatattctaataattggcctcatgagagtgaacacggcaattga

SEQ ID NO: 70866 - DNA, 285 bp, Glycine max
  Peptide Sequence Number=SeqID_187644
atggagaaaaatccaggtgctgcaaggttgtggaaaggaagaattactgaaggccctgataacagcatcatgatgcctgtaatggactatgcatccctcccacacttctgcagaaaagaagattccaagtcttccaaacatcatgcattaggaaacactgaaaattgtttctccttcaatcacgctctccatcaacaactctacaatcacatcaagcaactatccatcattgtggagccaatttcaccaatcagacaagggtccttctatgttgacataccatag

SEQ ID NO: 70867 - DNA, 363 bp, Glycine max
  Peptide Sequence Number=SeqID_187645
atggtacttttggatttcatcttgagacttgagaatgaagtaatggactatgcatccctcccacacttctgcagaaaagaagattccaagtcttccaaacatcatgcattaggaaacattggaaattgtttctccttcaatcacgccttccatcaacaactctacaatcacatcaagcaacaatccatcattgtggagtcaatttcaccaatcagacaagggtccttctatgtagacataccagagccagaccctgatgatgccaaaatagccaagaccatagaaactgagttccacaaattggagaatcagaagaatggctttaccaactcactaaatggtcttagagttaatggccattga

SEQ ID NO: 70868 - DNA, 138 bp, Glycine max
  Peptide Sequence Number=SeqID_187646
atgagcggtggttggccgcctgctggcaaaccaagtgctatagataacgctcgatgcctagtgatccagcaggaccggcctgatgaggtggtggcggtgcgtctgcggcctgatctgcatcaccctatgcctgcctag

SEQ ID NO: 70869 - DNA, 609 bp, Glycine max
  Peptide Sequence Number=SeqID_187647
atgattttaggaggagtgtttatgcaaaaaggtcagatgacagagcacctctgtgttgctgaaagtgcatatgagttgtgcctagtatgccagtgctctcattcgaccactcccacaagaactccagatttgatggttggacatagatttgatgacagtactgtagaagcaaagcttcatgatgaatcaagattgattcaaagatgttttgatgataacaaagatgatgacaaaggtgatgacaaaaagctcaaaggtcaatcaaagaataagttcaagatagaatcaagaacacttcaagattcaagaggaaagttgatttcaagaatcaagaatcaagattcaaggatcaagcttccaagaatcaagatcaagatccaagaatcaagatcaagattcaagactcaagattcaagaatcaagagaagacttaatcaagataagtatgaaaagagggtacatctacttgggttgttgactgagaacaagagagggtacatctcttgtggatcagttctagtggagggtacatccactaggttcaaagagaacaagggagggtacatcccttgtggatctttgcttgtaaaaggatttttacaaggttga

SEQ ID NO: 70870 - DNA, 606 bp, Glycine max
  Peptide Sequence Number=SeqID_187648
atggaagatgcaaagaggatagggagtggtatagacgtgagaagaccttatgctatggtggtaaaagggacatatcaacgacccacaatacaaacactagaggtagaaaaaggaaggaggtggagtgtgaagggatacccattcaagtatgggggagagaaatgcttctcaatagtgattagcctctttggaacatatattgccatggatgaagagacgaaaaagatggagagactagacagagccaaaatcctcatgaaagtcacattctccttacctatagcaatttgttacaatgttaaaataaatggaaatctacatcgtagaaatcaagagaaaaatagtgaagacaactctgatcatagtgtgcttagggtagaggggatctcatcctcgtcaaagtgcttctacgaagactatgaggaaggtggtcatggccacattggcccaaggaggaaggaagacatagtggtagggcatgggtattgtttagagggtagtaaatcacattacacaaaggattatgctaaaaaggtagagaaacaaccaatagaaatttatgggagcattgggtcaagccattgtctaccaaagaatcagacctag

SEQ ID NO: 70871 - DNA, 981 bp, Glycine max
  Peptide Sequence Number=SeqID_187649
atggtatctatccaaaggttcgctcacttgtcttcaatttcccaaattcaccctgcaccatccttgaatcctccaattgacacgccttttggatccatttttctccgtgaggccgtgacgcatcgcgattttgttttgggaacccgcgaaactgaatcagatagtgcggcacggaaactaggaattagagcaatggcagaagatctggtgctggatactgcaatcagagactgggtgctgatccctctctctgtggttatggttctcattggggtgctccgttattttgtttctaagcttatgcactcttctcaaacccctgacgccaaaattgttaaagaagggcaagtgatcgttagagctcggaatttacgtgctgcggcgaattttattccttccaaggcttttcgtgctcgcaaaatttatttttgtaacgaggaaaatggtctgttgtttgttccaaaaggccagggccagaatccgcaagcacagatgttctctgatccaaacatggccatggatatgatgaagaaaaacctttcaatgataattcctcaggagatgcctcactggcttttacttatgttgttttctattttcccacagactcttacttttgcttgggtgaactttttcttttctggatttgtagcagccaagataccctttccattgacacagaggtttaggtcaatgctacagaacggaatagaccttagcacagtagatgttagctatgtcagcagtcgctcttggtacttcctcaatctgtttggattaagaggattctttagtctcatcttgggtgaagaaaatgctgtagatgatacacaacgtatgatgcaaatgggtggatttggatttgatccttcaaagggtctaagtgctgagaaagacaatcttgacataacccagcatgactgggccttaccgaattttgagcagcgggctgaagctgtgttgaggaaagtcgtcagttaa

SEQ ID NO: 70872 - DNA, 915 bp, Glycine max
  Peptide Sequence Number=SeqID_187650
atggaagatgagcagtggtttaaggaaaaagatgatcagtgggcaaagaacataccatgctacaaagaagacgcagcaaacgtagtcttgaattcagtccacttcgattttgacatgcaagatttagatgagttcttgatggttcttggcactgaagattcttcccctgagagagttcctaatcctattattcctgttactcctcttatttctggacgggttcaggttccttcccctcctagagttcatgctcctgcacctcagagggtttatacttttgccaatttggtttctgctacatctgcccctacagctcgggttccagcaccacacgagtcaccggaggagacattcaatggcattgcatctggtcaggtccatgcactgatcagccaccaacaccacttgcttccgcagaatatggagtcatatcgtgtcatgttagccggtgactcatcccgatcggttccttgtaagaaatacacacattggaccagagaacaacacatttcgtttctccttgggcttgagaatgttggaaagaaaagttggacatatattttacagaaatttgttccatcaaaaaatccatttcaagttgcaagtcatgctcaaaaatacttcaaacgcaagaataacccaaagaaagagaggaaaaggaaaagcattcatgacataaccttagaggacattaacacgattgttactccccgcattgatcaacataattgggttcctcctccaccaaattttgcagcgcaaccacatgaaatacgacatgcacaacccatgcagcagttcaaccaacatattccgtttcatcaaatgcagcagtttcagcacattatgcctagtcaaatgaacatatatggatattctaataattggcctcacgacagtgaacacgccaattga

SEQ ID NO: 70873 - DNA, 1335 bp, Glycine max
  Peptide Sequence Number=SeqID_187651
atgggtagcggcgacacgtcttcttcttcggacttcttctgccgccgccatgtgttcctctgctacaagaaccccgccgtgtggccgccgcgcattgaggctgctgaatttgatcgcctgccaaggttgctccacgccgccatcaatgccagaaagcctcatatcaagaaagagggagagaaggagagtgagaaaggttgttcttgtttgttctaccaaggggcaatgactatttatggatgtctaagtgtgattggaatggaatggagtgtgattgaaagtaatggaacaggatggaatctagtcaacattctgttgagattaacccattttgatgttgagacatttgttgaagaagttctagtcaaagaaggagaatggcttcctggaaatcctgaatcattaaaagcttcatatgttttcgtgtgttcacatggatcccgtgatcgtaggtgtggggtttttggacctatcttggtcagtagattcagggaagagatagaattacatggtcttcaaggcaaagtgttgattagctcgtgctcgcacattgggggaaacaagtacgctggaaatgtcattatatttggatcaagtatcaacagagaagtcactgggcacttgtatggatatgttactccagatgatgtacctttattgtttcaccagcatatcattaaaggggagatttttgactcactatggagttccatccttcaaaagacactagcaaggattgctcttgtgctggtcatttggagcagaaactggcatagaccaacaaaggttgtgcctgaggtggaaattttagctatgttcataaagctctttgactgggtctgtggcaattttaagagggtgagccctagtacagcagtaaagttgtacttgtaccttggtgactgtttggtcattggttcaaatcaggaaacagcctctttgtatatgcaagggggtcaaattggtttatcagaagatgaacagaagaaaaagcaagaacaaaggcttcagctgaatggtggaagaaatttaggaggcatggttgctggccgctgtcaaacagatggagagagctgttgccaagacaatgaagactcttgttgttgtcagaatgatgtatttgaggaaatgaccgagctctcaactgataataagagggagaatgtgaatgtgatttctcggatcaacaagggcaaaggagcattacgcaagtttagttccatgccaacatggcttgacagctgggagcaggaggatacttatgctgctcttgctgttgtctgcgctgctgtgtcggttgccatcgcctatagctgctacaaacagctgagatga

SEQ ID NO: 70874 - DNA, 213 bp, Glycine max
  Peptide Sequence Number=SeqID_187652
atgcagaggaattcatgctggcagacatgctactgcattgtgtggcatgtatatcatgcatcttctgttagggttcaacatccaccatctagagcagagattgaagcccatgagaaacagtgtggtggcattcctttgaaaatttgccgggtcagagagggaagggtcaatttattttcctctgacaaggtggagcttcctgttctaccctga

SEQ ID NO: 70875 - DNA, 144 bp, Glycine max
  Peptide Sequence Number=SeqID_187653
atgtcaatgcacagtagtctctcatcttcgtcactactccacgatcctatctgcgacgccgctaatatcaaagtggggagattcgtatttcgtagcgctatccacctcctctttcgttcatggttcatgaatcttagggtttaa

SEQ ID NO: 70876 - DNA, 1014 bp, Glycine max
  Peptide Sequence Number=SeqID_187654
atgtctcacgaagaaaacaagaatgtcattgagttccttgatgaacaagctttctattatgacgaggaagacgagcagtggtttaaggaaaaagatgatcagtggacaaagaacataccatgctacaaagaagacgcagcaaacgtagtcttgaattcagtcgacttcgattttgacatgcaagatttagatgagttcttgaaggatcttggcactgaagattcttcccctgagagagttcctgatcctgttgttcctgttactcctcctacttctggacgggttcaggttccttcccctccgagagttcatgctcctgcacctcagagggtttatacttttgccgatttggtttctgctacatctgcccctacagctcgggttcctacaccacacgagtcaccggaggagacattcaatggcattgcatctggtcaggtccatgcgccgatcagccaccaacaccacttgcttcagcagaatatggagtccaatcgcgtcatgttagccgatgactcatcccgatcggttccttgcaagaaatacacacattggaccagagaagaacacatttcgtttctccttgggcttgagaatgttggaaagaaaagttggacatatatttcacagaaatttgttccatcaaaaaatccatttcaagttgcaagtcatgctcaaaaatacttcaaacgcaagaataccccaaagaaagagaggaaaaggaaaagcattcatgacataaccttagacgacattaacacgattgttaatccccgcattgatcaacacaattggattcctcctccaccaaattttgcaacgcaaccacatgaaatacaacaagcacaacccatgcagcagttcaacctacataatccgtttcatcaaatgcagcagttcaacctgcataatccgtttcatcaaatgcagcagtttcagcacaatatgtctagtcaaatggacagatatggatattttaataattggcttcacgcaatggaacacggcaattga

SEQ ID NO: 70877 - DNA, 1056 bp, Glycine max
  Peptide Sequence Number=SeqID_187655
atgaccaaagagaaaataaaaaaagaaaaaacactacacacacttcacagtgttcactctcgcaagttgcaaggtgcaatcacttccacactccctcacttgccgtcattctcgttctttttcttcttcaaaaaagcttcgagctttagcgtttgtacgatgatgggtagcggcgacgcgtcttcttcttcggacttcttctgccgccgccatgtgttcctctgctacaagaaccccgccgtgtggccgccgcgcattgaggctgctgaatttgatcgcctgccaaggagattaacccattttgatgttgagacatttgttgaagaagttctagtcaaagaaggagaatggcttcctggaaatcctgaatcattaaaagcttcatatgttttcgtgtgttcacatggatcccgtgatcgtaggtgtggggtttttggacctatcttggtcagtagattcagggaagagatagaattacatggtcttcaaggcaaagtgttgattagctcgtgctcgcacattgggggaaataagtacgctggaaatgtcattatatttggatcaagtatcaagtatcaacagagaagtcactgggcacttgtaaggaggagatttcccctgcatatcattaaaggggagatttttgactcactatggagttccatccttcaaaagacactagcaaggattgctctcgtgctggtcttttggagcagaagctgggtctgtggggtaatggactatgcatccctcccacacttctgcagaaaagaagattccaagtcttccaaacatcatgcattaggaaacattggaaattgtttctccttcaatcacgccttccatcaacaactctacaatcacatcaagcaacaatccatcattgtggagtcaatttcaccaatcagacaaggggccttctatgtagacataccagagccagaccctgatgatgccaaaatagccaagaccatagaaactgagttccacaaattggagaatcagaagaatggatttaccaactcactaattggtcttacagttaatggccattga

SEQ ID NO: 70878 - DNA, 732 bp, Glycine max
  Peptide Sequence Number=SeqID_187656
atgatgtgtcgtaggacggagttatatagagagctgaagcagcgtataacacattttcgacatttctgcgacacgcatcaaaaacatcttcaagatctcgaattgctcaagtgcttcaaatccgagattcaattcgagcttgcctccaatcactttcagaatgctcaaagtggttccttaggggactttgtggtggaccccacctcacccaattccaaagatgtggttttgcgaagaaaattcgattcgggtgaggaagttgcaatctctgctattctgggacctcccaactatgtgaaagaccttatttttccgagggatgcttttatgaaaaaactgataagggctctgattttgacatctacaatgcttattatctcaaatcatctacatgtctcagcacttccatttacagaggccctttattccgggagcaagtccaaatcctactctgttaaggaaggttatgagacattgcaacagcaaagtaacaatgaggaatctgatttctttaagaatctatggtctataccagcgccttcaaaagtttggaagagcatttataagtgggcaaatctggaaatagctatgccaataggcactaaggcacattttagtcagcatactggtatatgtgtgggaaggaagaaaaatacagcatggtgggacagtatggacggcagtgatatgggcatcatggttgcacaggaacaacacagttttgaatgctga

SEQ ID NO: 70879 - DNA, 912 bp, Glycine max
  Peptide Sequence Number=SeqID_187657
atgcttacactttttgacaaattggcacatgttggtgtcaatagactcaatactataaaaaaccatatcattgtgggtacaggaatttgggtaaaatcactctacaatgagattcacatgaagcctatccccatggatttgtacagagccatacgggattctcaactcataggaatgtctggttactcaaaggagggtctacctgtcattgctgttggtgttggtctcaggacatatgataaagcatctgacaaatactatatacaatcacacatccaactaaatgaatatagggatcaagtgatcttgcctactgctacaaggaaacatggacgatacattggcacctgtgtgaaagtcttggatatgactggtttaaaattttcagcattgaatcaactgaggttgttgactgctatatctacaatagatgacttgaactatccggaaaagacagacacatactatattgttaatgtgccatatgtattctcagcgtgctggaaggttgtgaagcctcttttgcaagaaagaacatggagaaaaatccaggtgctgcaaggttgtggaaaggaagaattactgaaggtaatggactatgcatccctcccacacttctgcagaaaagaagattccaagtcttccaaacatcatgcattaggaaacactggaaattgtttctccttcaatcatgccttccatcaacaactctacaatcacatcaagcaacaatcaatcattgtggagtcaatttcaccaatcagacaagggtccttctatgtagacataccagagccagaccctgatgatgccaaaatagccaagaccatagaaactgagttccacaaattggagaatcagaagaatggctttaccaactcactaaatggtcttagagttaatggccattga

SEQ ID NO: 70880 - DNA, 316 bp, Glycine max
  Peptide Sequence Number=SeqID_187658
cacattggatgatgagttgcaagatgctctcaaggaatacctgatagccaagggcattggacttggcagtggaatagccctcacagtgaaattaattactgctgtggaagattgccaagaattgtcttgtgaccaaagaatccagttgctgaagaattttttctttaaaggattaagatattggtttgagagcaaaccaaaatttggaacaataaaagtcaactatgatgatagtgcttcaggagataacggattagctgggtgtggaggagttattcgtgaccattttggttttggtcaatttcattatggctaa

SEQ ID NO: 70881 - DNA, 501 bp, Glycine max
  Peptide Sequence Number=SeqID_187659
atgaatgtgtgccaatacttttcattttccttttttaccctgcctgctaggattggatttgtgatacaagaggatgtgctttacccacaattaactgttgaagaaactttagtcttttccgcactcttgaggctgccaacccatatgagcaagcagcaaaaatatgcaaaagtggataccactatcaaggagctagaccttgaaagatgtcgccacacaaaaatagttggaggatatctcaaaggcatatcaggaggagaaaggaagagaacctgcataggctatgaaattctagttgatcattcactgttgctacttgatgaaccaacttctggccttgattcaaccgcagcaaacaaactccttctcacacttctaggacttgctgaggctagaaggactataattacaacaatacatcagccatccagcagaatctttcacatttttgacaaacttctaatatcagaaaggctatcctgtttgctatggaaaggctaa

SEQ ID NO: 70882 - DNA, 276 bp, Glycine max
  Peptide Sequence Number=SeqID_187660
atggtggcacatgttttatatcctacttttttcatggtcatcttgtacttcatggctggctttaagaggactgttgctagcttcttcttgacactattcactattctgttaattgtcataacaagtcaaggagcaggagaactatttggagctgcaatcatgagtgttcaaagagcaggaacggctccttctttgatactactgttattccttctcacaggtggctacaatgtccagcaacaactagaatgtatgtatgttctgcaattaatgtaa

SEQ ID NO: 70883 - DNA, 468 bp, Glycine max
  Peptide Sequence Number=SeqID_187661
atggcagctcaaattcctagtggtgatggttatggtggtggtgttgtagaaactgttgttgatgctggtggtggtgttgctgggaccgcaccatttccttctgccttcgcagctccagcaccttgcgtgcaagcacctgcgcccgtccccaccactgccgtttccgtcactgctgctactgtccttcttcctcggcccgacctttgccatttttttcgccggagtcggacagggttcggcagtggcgggagatggaacgacgacctcgttatccgaggacgacgacgttggggacaggaccaggaggcgcgatgcccagttgcaagggggcccacgggacctcttgctgcgggccttggctggaaccgacacttccgaattgaatattgggctgtttctggtgggctctggggtgtgggacccgcttctagtggtggtgggctcgtagtggaactcgcgggcctctga

SEQ ID NO: 70884 - DNA, 162 bp, Glycine max
  Peptide Sequence Number=SeqID_187662
atgggaaagcttgaaaatgcagatatgaaaattgggagaggcaccaagatgtgtacaccatggcatgagaaattggacgattgggttagccaagatggtgattttgatgaggaattgcattataggccagtttgtggagccatgttgagccacaaagggtga

SEQ ID NO: 70885 - DNA, 744 bp, Glycine max
  Peptide Sequence Number=SeqID_187663
atggcgttcactgatgaaagcttatgcaggttaaaagatggattcaagtttagactacgacgaggaaatgcgtctttgttctatgagaagtggtttaatggggacctactttgtcaacatctagaggagcgtggctacgcagaagaagacttccttcacttaatccgagattgccctcgggctttggttatctggaaacatttccacctagacttcgatcgggctaggaatgcgcaagctattcaaggagatgtttggacaacgtggtacacgaccaaccagattcaagtgctcaagaagattatctctacaacaactaccttaacaacccttgggccacctagagaagttgtttggaagccacccactaatgcaactttgaagcggactgtgggtggcagctcaatagggaactcaggaccttttagctttggagggattattaggaacaacttgataaggagattgggacaccgtgatgttgtttgcgaatcaaattccaaggccacccatcatctgatttatgatgcaaataccgggtatcttcctcatgctgctattattaacaagatcaaggactacaagtctaaaccatggatacttcacttttgccacatcttgcgggaaggtaacaagtgggccaatgcattagctaggataagatcatctcatgaagacaactttgttcaatgggatactcctcctcaacaacttcactccttactattagcagatgttgttggg

SEQ ID NO: 70886 - DNA, 1968 bp, Glycine max
  Peptide Sequence Number=SeqID_187664
atggaacttgttccatactccgacccatcctctgccaccccagcatggcaggatatgttccgatccgcctcctcccgccaccctacctccgcccctccatcccacgcgccgccctccccctccccccccgcgccgccgaatccgccattcgacgccgacccagatggaaaaaacacattttccggcgatccccaggtgcgcctggccctctatatcgccatggcccatgcgggtctcgccttcgccattttcattctctacactttctcgaagcttctagaacagtatttgagaccccttcaatgggcagtgttgtgttctattcccctaaggggtattcagcaaaccctcgttgcgttttggtccgaaccccttcatctgggtctcacggaaaccgttctcgctgttcccgttgctgttttcagggcttttgctggcacactcgttgagattcgcgaagcttcttttagagtcattttgaggaaaccgaagcctcagcagaatcgccctttgaggaagcgaagtgggttttacaagttgcttcgtttgcttgtgagttttgggattttcatcattacttatgagaggcttggtgggtttggggcattgtcacttttggggttgggttttttgtttagttcgaagaatgtggattccactatgcacgctttgtcctcttttaggagccttagtttcaggcgtagtgctattagtgcctttttcactagagggatattgaggaagttgaagattattgtggcaattgggctaattgtttgcatgattgtggggtttttgagtggggtgattttcttctcttataagattggtgttgaagggaaagatgcaatgatttcattgaagttgcatgtggaggagaacaattatgctgagaggattggtgtgaagaagtggatggatgataatgatgttgctggggtggtggatagttacactacaaagatatatgagactgtgtctgatcagattgatgggttggctgtgcagtataacatgactgaatttgtgactggcattaagcattttgtgatatctactccggttaactcttcagcgccttcgaaggcgttgatgactccctcaccgtatgctgagaagttcttgagcttgaaaacccgggttaggaaccgcgagtggagccagatttatacagaggctgactcgattttgcgcgagcttgtgatcactcgcgaggatttggttgagaaggcaaaagggtttgccttcaaaggaatggatgtgtctcagcggattttcgccagtagtagaactgtgcttggaagcagtactaagtttatgttctccatcgcgaattccataatctctggagctgcagaggttttcaattttgtgtcccagtcgatggtatttatttgggttttgtattacctcatcacatcagagagtggtggagtgacagaacaagtgatgtacatgcttccaatttcaaactccactaggatcagatgtgttgaggttttggataaagctatttcaggagtccttttggccactgctgagattgcattttttcaagggtgtcttacttggcttttgtttaggttgaacaaaatacatttcttgtacatgtcaaccgtgcttgcattcataagtcctctcctgccaatatttccatcttggcttgcaacaatcccagcagcggtgcaactagtgttggaaggcagatacataatggccattgtgttgtctattgttcacctttttctcatggactacggtgcatcagagattctagaagacgtgccggggaatagtgcatatctcactgggttgagcatcattgggggaatgacattgttcccatctgctctggagggagcaattatggggccattaattaccacagttatgattgcactgaaggatttgtatgctgaatttgttttgcaagaacctaaggacaagtccaagcagaaagccagctag

SEQ ID NO: 70887 - DNA, 513 bp, Glycine max
  Peptide Sequence Number=SeqID_187665
atggcttcatttccttcaaattctgcattggaacatagcatggccagtgcacaacaaaacagtaaccctcatgcttcctcaccttctttcatgactagagtggccatgagaatatctagatcaagatggttcactttcttgagaagagtattccattaccaaaacggaccaagatccaatctcggctccaaccctttcaattccagcacttggatgatgctggagttgattgctttgttggtccaaatagcaagcacaacattcactttggccatttcgaagagtgagaagccaatttggcctatgagagtgtggatagcaggttatgatattggttgtgtccttaatcttctgctactttgtggccgctaccatcaacttcatgtgactcaagggaataatgctcttagcctctctgaattggagcagcagagaaacaatgaagaatcaagtaccaaaaagttacaatttatagggtacttattatgtgaatgtgctgaaaacattggttag

SEQ ID NO: 70888 - DNA, 261 bp, Glycine max
  Peptide Sequence Number=SeqID_187666
atgggatgcgatatatttgtgtcgcaacatgcccttttgcaggcgagcgagacgaggctctcgggtgcgttttccaaaggaggaaaatgcgcggagtcaccaccaatgtttatttgcggaaaacgtcggaaaaaccgaaggaaactggtcaaaaagaatattccaagtttgggagttgtatttacgtttgacgaaggtcgacaaaagcggggctcttactcctacgtaccctccatcgaagaggaaatcagacctacgtag

SEQ ID NO: 70889 - DNA, 588 bp, Glycine max
  Peptide Sequence Number=SeqID_187667
atggttaaggaggagtgtaaggaggtaagtgtctcctccaagaggttagctaagaaggaaagtcattttgaaataaagacaaacattaaagaaatttcccctcttagacaacctccacatcttctcctttgtaaaaagacacttgtaagcacttccacacctcttaggcttgaggttattcctcaagtaaaggagttattggatgagggtttagtttgtaagagcttaaatccttgtgctttgttggtgcccaaaataggtgttcccatagaccctaagagaataaaggtcattcctgattggcccactccaccaagtataagggtaatctggaactgccatgacttaacaaacttttacaaaaggcccacttgggccttccagattcttcctccagaaggctgttgcttatggaggaaccaacctcgcctgggcgagctgggtggcaagctcctcccctattttgctataaatagggggaggagtgaagggagaaggggttcagcgttcttggcacttcttattctctcgaaattgctgaggaaaattatttccgtgaagaaaatccaagccgaggcgcttccgtaa

SEQ ID NO: 70890 - DNA, 1396 bp, Glycine max
  Peptide Sequence Number=SeqID_187668
atgccaaacaatcccttatcactctcaacaacttgcaaacgccgcaacgtgttcagcgaagaattcaacggaagcgtggcagaagaggagagtttcagctccatggacgacaagcaattcgtgcgttggttccgcgagacgtggccttacttgtgggcccaccgtggcgctaccttcgttgtcattatttccgggagacagcctaagtatgttggtccatataggataactgatgatgagtctctagcagctgcaatggaagcagctgggagaataagattgatgattgaagcaaagctttctcctggaccctccatttacaatattcgtcgacatggtgacaatagccgtttgcatgaagttggtgtcagtgttgcaagtgggaactttcttgcagccaagagaagaggggttgtcaaaggaattgattttgggtcaactggggaggttaaaaaagtagatatttctcgcatgcgtgagaggcttgatggcaactgtattgttattttaagcaacttgggctactccagctctggagaagtattaaattgcaaagcttatcctaaatccattgttggactacctgcatttggcatgctccaggctggaagtcgtcttggtgcctatgaagttgcgacagcttgtgccttggctgtacgagctgacaagcttatatgcattacagatggtccaatactggatgaaagtggacaccttattcgtttcttgcctcttcaagaggcagacatgctaattcgtaaacaggttgaggaaagtgaaacagctgctaactatgtgaaagctgttgctgaagaaagtttcaagtctcttaaaaattttaatggggcagtccattctccacggaacggaaaaccattttcagaatatcataattcaacctttcataatggtgttggttttgacaatgggaatggcctatctgggaagcatggttttgctattggaggtcaagagtcactaagtcgaacgaatggttacctgtcagaactggctgctgcagccttcggtggtgttcaaagagttcatttgttggatggcactattagtggagttctgttgttggaactgttcaagagagatgggatgggaacaatggtggctagtgacctttatgaaggcacccggatggctcaagtaacagatttttctggaataaaacaacttatccagcctttggaggaatctggtatattagttaagcggactgatgaagagctgcttcaatcattaggctccttcattgttgttgagagagaaggacagataattgcttgcgctgcactttttcctttctttgaggagaagtgtggagaggttgctgcaattgcagtatctcctgattgtagaggccaaggacagggagacaaattacttg

SEQ ID NO: 70891 - DNA, 2886 bp, Glycine max
  Peptide Sequence Number=SeqID_187669
atggggaaaagaaaagagcgtcgtcgcctcgccgctatcagcaacgccggtcgcagagtcaaactcgatcttttcgcggaaccctctggagagttgggtggctccactctacaaggtgatgctggaggagatactgattctcaacatcgtgatgggttacccaattcaccctcttcttcaggtcaacaaccacagaatcccctgctgttacttgggcaatatagtgatgatgaaggggatgatggatcaagcaaagggcttaatgatgcaaatgtgcaaagccccatgcttaatgaagaggctaagggtatatttgatgaaggatccaaagatttggacatcagtgtcccagtagatcttgttgctcagaataatggacagcaaaatacaatacaaaattctacttcacttgatgttgggtacagtgaaagaaatgaaagtgatggtgctgctggtaatttgcaaaatgaaatcgtttccaaagatcaaatatatgtttctgaaagttttgatgaacaagttctcactgatgttggtttgggatggaagatggtgatgcacgaggaaagtcaacgctattattactggaacattgaaactggggaaacttcatgggaagtgcctcaggtcctggctcatgaagatcagttggctaatgactcaatacctcatgcttctgtcaatgataaaacagagagtgctgctgttggtgataattccaatgtgcactcggctgtgttgcaggacacttctgctgctttcataatcgatggttcattggaaaccacagtgacttctcataaagaattgtatggtcacaggtcccaaattaatggagatagtgttgaatgtacaaatcaaaatcagatttctgatgttaatggaaatgaattgacaagaaatgatggtcatatgagtttatctgatgagggacaccattcatctgtttccaagtttggtgatgaagaacaacagcaattggacattgattttccttctagtcttgtcaaacaaagtgagagtttgttagagaggctgaaatcactgaaaaatttgaaaattttatttcttcccgttccagatttaactaacagaatactacacaggtcaaaggagaatttgctaggccaggacttcttgtcaaagtatatgctagagattgagattaggctctctgatattaggtctcttgcatcatatggatcatctttgcttccattctgggggcattctgacagaaagataaaattgcttgaaagtttaatcaccgatgatttgatgcaaattggtaattcttcacatgatgaagttgaggataaacatgtccctgtctctgaagaattggctgaccaactgaatggcatgggacatgagtcagaggtagataataataagaacgaagggagccctcttacttctgatgtttctaatgaatctcaggatgatgcttcggctgcagttctaaaagatatcaacaataaaatttctgccaatggtcagcatgttgcattgtctaattctcctggtagtcacatggaaacagatgtagaaattaattcaaaagttgaagcaattattaatcctcaggaaccaattcataaacatgggtataacgttggggaagatgttgatatggatgtggacatggaagttgaagatatgaattcctcaggcaatactactgtcatcgatgtatctgttgcaaaggattccatgcacatagatcaactggttcagttgaatccacctgttgactaccattctgtgttgcctgaggagggtgaatttgttcctcctccaccagatgatgaatggattcctcctccaccccctgataatgagcatgtgcctccaccaccaccgccagacaatgatcaggtgccccctccacctggtgatccactagcaccttcttatagtgttctcccatcttacacagagacagggcaacccctttcttatgctcaatatagtctatcttatcctggtgttgctcctgagtattatgggcaggcagctgctgaagtcccaagcagtaatatctatggacaaattgctatgccacctgctcatatctactataatagtgcaattcctaacatgtatagtgaaaatcctcaagttatgatcgatccagctggcactgttgcttattatgaggttcaagatggagctgtttcaaagtccattcccgctatcaattttaatgattctggtgttggtggggctgactgggcatctagtgatggtccatctacctcatctagcatccatgcacctgcaactgtttcagttgacgaaggtgtctcattgcctcctgctactgccgaatctgctgcagaaaacaatgcatcgtcattagttcctaaagcccaaacaaaagctggtaaagttgaggtttttggcaacctaggggttcttaaactcattcttaggttgttagttgtacgcaataggaagcgagcagttgcagttggatcctcattaaaatctaataagaagtggaaggcagctaaagaggagttgctcgaagaggaggaagaacctgatagtgtgtatgaggtcttagaaagaaagcgtcaaagggaaatagaggagtggcatgccaagcaaattgcaagtggagaggccaaagataatgctaattttcagcctctaggtggtgattggcgagagaaggtcaaacgcaggagagcacaagcagcaaaagaatctgttagtacaccgcaggatgcaattgagcataaccagcagcaacctgatccgagtgaacactcaaagggtctcccaactaattggcaggcttactgggacgatagcacaaagcagatttattatggtaacactgtaacgtcggagacaacatggactaagccaacaagatga

SEQ ID NO: 70892 - DNA, 587 bp, Glycine max
  Peptide Sequence Number=SeqID_187670
atggaggatgcaaatctcaactatgctgagtccaacagagtctccatattaacagtggacaaattttcaagaaggatggttcttcagtttctgggatttaatcacgtgatatgttatgcttctcctgctttggctgcacctattatgccagacattaaggaacctgaagtcatacgcacagtggaccagttcagtggagaaagtaatcctgttatacttcctttggatgagaaccagatgatagtgggcttaaaggaggtcttgactggcatgagagttggaggaaagagaagagcactgatcccaccttcagtaggatatgtaaatgagaatttgcaaccaatgcctgaagagtcacgcaagcagcaaggatcgcaattgcattttgtgggaatcggcggcgagaaaatgcagggttggttctcggggcagagtagcgaggaggaggcgaagccggcgtcgtcgttgctcgccgattggaactcctacgcatccgcccaaacctctgaagattcatccactttccccttcgatatcgaatccgccgttaggtctgccaacgacaccgtttccggcactttcagcgt

SEQ ID NO: 70893 - DNA, 237 bp, Glycine max
  Peptide Sequence Number=SeqID_187671
atgtggctgaagttgtctttgttgggaacagtaggtgcacccatcggagaacaagagataattaactatcttgaagctcatttaacgtacttcaagctgacgttgcatatccagccaagggccacaatgggtagtggggaagacaatgtaacaaaaaaccaaaaagcacctttcaaagggacacatccaagtagaggtcaaatggaagagaggaccagagatccaaatagaggataa

SEQ ID NO: 70894 - DNA, 420 bp, Glycine max
  Peptide Sequence Number=SeqID_187672
atgccgcgatcaaatcacagaactgcggaattgaaagggaaatctaagaaaaagattgattcgcccaaattctgcaccagtggaaaacaaagtgcgagattctggggaatcgtaaggttcaaaaatgaaagaacggcggtgaaagaatggaaagggagaaaaaaaagtgacaccgccaccggaaatcacctccgacagcagcgtacggcggagacggactgtggagaagtcgggaaagagatctgggtttctaaaggtgtgagagatctacctggcaacttccagtctgccactagtaatgtgccttctggcaaagcgctttttgccctatgctttacacttgggtgtggatttattattggatcattctttgctctcaagggtccaaagagtcagcttgctcacatgttgtcaaaggag

SEQ ID NO: 70895 - DNA, 216 bp, Glycine max
  Peptide Sequence Number=SeqID_187673
atggtgctggaatcttggaatgtcaacttgttgggtgagcctttagcattaaattttgttgtatctatggctgacaacttagccatggagctaaggcagaaggaatgtactgagccagtcaagctgattaaagttatatggagtccacccttgtccctcccaccaccgaagccatcggacctcagtttgcatgcagcggcagtgggtcgttcctag

SEQ ID NO: 70896 - DNA, 3279 bp, Glycine max
  Peptide Sequence Number=SeqID_187674
atgcctggaagcttaaggaatctgtcactttttcccaaaatcttctccttcaccttgcttctcatcttattaaactcccttctctttttcccatgctgttactctcttgatgagcaaggccaagctcttatagcatggaaaaacaccttaaacatcacttcagatgtgttagcatcatggaacccttcagcctcaagcccatgcaactggtttggggtgtattgcaactcacaaggagaagtcgtagagttaaacttgaagtcagtgaacttgcaaggctcattgccttcaaattttcaacctttaaaagggtccttgaagattcttgtcctctcatcaaccaacctcacaggaagtgtaccaaaagagattagagactatgtagagctcatctttgttgatctcagtggaaattctctctttggtgaaatcccagaagaaatttgcagcctaaggaaactgctgagtttgtctctccatatgaacttcctccaaggaaacattccatccaacattggcaatctaacaagccttgttaacttgacactctatgacaaccacctcagtggtgaaattccaaagagcattggctccttgagaaagctccaagtcttcagagcaggtggaaacaagaatctcaagggtgagattccatgggagattggaagctgcaccaacttggtcacgctaggccttgcagaaaccagcatttcaggaagccttccttcttcaatcaaaatgctgaaaagaatcaataccatagccatatacacaactctattgtcaggtcccattccagaagagattggcaactgcagtgagttggagaacctgtacttgcatcagaactctatctcaggctcaataccaagccaaattggagaactcggcaagcttaagagtctacttttgtggcagaacaatatcgtaggaacaatcccagaagagcttggaagctgcacagagatcgaagtcatagatttgtcagaaaatcttctcacaggtagcataccaaggagctttggcaacctttcaaatctccaagagcttcaactaagtgtcaatcagctctcaggtataatccctcctgagatttcaaattgtacttctctgaatcaactggaacttgacaacaatgctctctctggtgagattcctgatcttattggcaacttgaaagacttgactcttttctttgcatggaagaacaaattaacaggaaacatcccagatagtctttctgagtgccaagaacttgaggcaattgatctctcttacaacaacttgattggtccaattcccaaacaactatttgggttgaggaacctcaccaagcttctgcttctttttaatgatttatcaggctttataccacctgatataggaaactgcactagcctctacaggctgaggttgaatcacaatagactagcaggtagcattccaccagaaattggcaacttgaagagtttgaactttatggacatgagcagcaatcatctttcaggggagattcctccaacgctatatggatgccagaatcttgagtttctagaccttcattccaacagtatcactggttctgttccagattctcttcccaaaagccttcagttgattgacttgtccgacaacagactaacaggtgcattgagtcacacaattggttcattggttgagttaaccaaactcaaccttgggaacaatcagctaagtggaagaatcccatcagagatcttgtcttgcacgaagctacaacttctggacttgggaagcaatagcttcaatggagaaattcccaatgaagttggtctaattccttctctggcaatatctctcaatcttagctgcaaccagttttctggtagaattccttcccagttctcgagtcttaccaaactaggagttcttgatctctcacataacaagctctcggggaatttagatgctctttccgaccttgagaatcttgtttccttaaatgtttccttcaatggcctctctggtgagttgcctaacaccttattcttccacaagcttcctcttagtgatcttgctgaaaatcaaggtctctacattgctggaggtgttgcaactcctggtgacaaaggtcatgttagatcagccatgaagttcattatgtccattctcttaagcaccagtgcagtactagtgcttctcacagtctatgtcttagtcagaactcatatggccaacaaggtgcttatggaaaatgaaacttgggagatgactttgtatcagaagctagatttctccattgatgacattgtcatgaatttgacatcagccaatgtgattggcactggaagctccggagttgtgtacaaagttacaattccaaatggtgaaacattggctgttaagaagatgtggttagcagaagagtcaggagcattcaattctgaaattcaaacattggggtcaataaggcacaagaacatcatcaggcttcttggatggggatcaaacaagagcctgaagttgttgttttatgactacctgcctaatggaagcctgagctcattacttcatggttcaggaaagggaaaagctgaatgggagacaagatatgatgctatattaggtgtggcacatgcacttgcatatttgcaccatgattgtttgcctgctattattcatggagatgtcaaagccatgaatgtgttactaggccctggacaccaaccttaccttgctgactttggcctggcaagaactgcaactgaaaatggttgcaatactgattccaagccacttcaaagacattaccttgctggttcatatggatacatggctcctgagcatgcatcactgcagcctataactgaaaagagtgatgtgtacagttttggcatggttctacttgaggttctcacaggaaggcacccattagacccaactctaccagggggtgcacacttggttcagtgggttaggaaccacttgtctagcaaaggagatccttctgacattcttgacacaaagcttagagggagggctgatcccaccatgcatgaaatgctacaaactctagcagtgtcctttctatgtgtaagcactagagctgatgagaggccaacaatgaaggatgttgttgcaatgctcaaggaaattagaccccttgagacctcaagggcagaccctgatgtattgaagggaggtttaacagcacatagttcaccaccacctcctaagaatgtggtctcacatggatcttcgacatgttcctacaatttctcggataactcaatcaattga

SEQ ID NO: 70897 - DNA, 2640 bp, Glycine max
  Peptide Sequence Number=SeqID_187675
atggaacctctccacctgcatcttcagggccaccccgcggctcaattccgaccaaacaccgacaaaatccgccgcagactcatcgaaaagggcgtccaaccaaccccaaagatcgtccacactctccgcaagaaggaaatccaaaaacacaaccggaagctgaaggcccaacccgctcctcccctcacccaggcccaggcccaggccgcggcggaggagcagcacctcgaaacaatcaagcgcgagttccgaagagtcatggcggggaaaccctgggaggggattcagaaggtcgagttcttggagaaggcgaggaggccagaaagggactgcggaggaggagaaaagcttaggagagagagcttgacggagcttaaggagatgttcgaggcgcggaagatggatgaattgaagtgggtttttgatgctgatcttgagattgacgaggtttggtttgatgaagggtatggggcaaggggcaagactcagaaacgcagcgaggttgaggttataaggtttctcgttcataggctaagtgacaaggagattactatgaaggattggaagttttcaaggatgatgaagatgtcaggattgccatttaccgagggacaattattgaggattgtggagctgcttggttttaaacgttgttggaagcaagctctttctgtggttcagtgggtgtacaattataaggatcacaggaagtttcaaagcagcgagattgatgccatggaatggcttttgttaacccattgtgttaatgaatggaatgggaaagaaattaaaaagaatgagataggttttaagcactctgctggcaggccgaatgaggcccttcaaattttcaatatgatgcgtgaaagcatccatatatatcctgatatcgctgcatatcacagtgttgctgttacgcttggtcaagctggtcttctaaaagagttgctgaatattgtggaatgcatgagacagaaacccaaagcatttatgcatcgcaagaactgggatccagttcttgaacctgatgtggttatatacaatgctgtgcttaatgcttgtgttccatcaaagcagtggaaaggtgtgtcatgggtttttaagcaactgaggaaaagtggtctaaaacctaacggagcaacttatggacttgcaatggaggtaatgctggaatcgggcaattatgaccttgtccatgagttttttggaaagatgaagagaagtggggaagttccaaaagcccttacgtataaagtgttggtaaaaaccttctggaaggaaggtaaagtgaatgaagctgtgaaagctgtcagggacatggaaagaagaggagttattggaacagccagtgtatattatgaactagcttgttgcctttgcaacaatgggaggtggcaagatgctattctggaggttgacaatattagaagtcttcctcatgccaagcctttggaggttactttcactggcatgattaagtcttccatggatggtggacatattaatgattgtatatgtatatttgaatacatgaaagagcactgtgttcctaatataggggccataaacacaatgctgaaagtttatggccaaaatgatatgttttctaaagccaaagttttatttgaggaagtcaaagtagccaaatcagaattttatgccacccctgagggtggttatagctctgttgtcccagatgtgtactcatataactcaatgttggaagcttcagctactgcacagcaatgggaatactttgagcatgtgtacagagagatgattgtttctggctatcaactggatcaagataaacacttgtcattacttgttaaagcttcaagagctggcaagttgcatttactggagcatgcatttgacatgattctggaagctggagaaattcctcaccatcttttcttttttgaattggtgattcaagctatagcccagcataattatgagcgagctgttattttaatcaacaccatggcttatgcaccattccgggtgactgaaaaacagtggacaaacctgtttaaagagagtgaagacagaattagtcttgaaaatctagagcggttgctggatgctcttggtaattgtgatattgtttcagaactaacagtctctaatttaacaagatcattgcatgttctttgtggattaggtacatccaggaacttctctagtataatcccttttggaagtgaaaattctgtcaatggtctgaatgaaggaattgatgatgatggaaatgtgccaaaaatttccagaagaatgatgattgaaggtgttgaatctaagaatgacattcttgttgctagttaccacactgaaccggaaactattgcctttagtcgtgatcaggtcaatggaggtgataatagtgatgtgatggttttcaggcctcaaaactcttatattgaagatggaaaaagtttatatgctgatagtctggaatgcactgataatctggcccttgacaagtcttcagatgaattggatgaggagctctgggatgatggaagctctgaagatgatgatggcgagggagtaattgacaagccctcagcatatgaaatattagaagtgaactgtaaacagggagaggaagatgcaacaattttcatcgtaaattag

SEQ ID NO: 70898 - DNA, 192 bp, Glycine max
  Peptide Sequence Number=SeqID_187676
atgtttcatgaatcatcctgcatattccagatttacaagccgaaaattatgtacagttacgaaaaaactggccggaagcatagccagcagcagaactatcatctcaaagctaagtctgctgatgatgaacatgaagttttgttccaccttgataaacctatttggaaagtccaaactccctctgaaggttaa

SEQ ID NO: 70899 - DNA, 342 bp, Glycine max
  Peptide Sequence Number=SeqID_187677
atgactaggggctatccaggtgatttacaaaccttttatcctgaaatagatagaacctttcatagattagttaggcatagtgtgcatcttgatcattctgtgcattttgagcattctgagcattccgagcattatgtgtattctgagcattctgtggccggtgattctgaacattttgattttgagcattcggcgactaattttcatactgagaacatggctcaacctccaccttgtgagaggactgtcgcaacctacccttttgcgggagagcgaggcaaggttcacgggtgcgtcttccataggaggaaaatgcgcggagtcaccaccaacgtttattga

SEQ ID NO: 70900 - DNA, 246 bp, Glycine max
  Peptide Sequence Number=SeqID_187678
atgtcgccacacgggggcgacatggatgggggtggaaaaaggaaagagagggatggggtttttcttgcttttggcatagtgagcctcggcgggaggctcccaggatgggctattagctctgtggtagagtgtacccctgataattgcatcgttgtgcctggactgtgggggtgcgatgatttaccttacgggcaaggtctctggttcaagtccaggatggccaagctgcatcaaggaaaagaatag

SEQ ID NO: 70901 - DNA, 286 bp, Glycine max
  Peptide Sequence Number=SeqID_187679
gggccgctgtcgtcgaggatgtcggagtttctgctcggatcgggattcgacggactgctacaatcaacaacttgggtaaggtggagaatctgccggtgttgaatgtggcgctagagtcaatgccaacggtggaaattactgagtctctggttgcgacggagacgcacagcgccgtgtgcaaggaacattggcgcgcgagatgtcgtgcaagcacctctaccactctaattgcttgtgtccagtgtgctgccgtcgaagtaggccatgtcgaaaaagagagtcgtcg

SEQ ID NO: 70902 - DNA, 1190 bp, Glycine max
  Peptide Sequence Number=SeqID_187680
atgctgccagtacagcggcacatcgagccagcggcggggttccagtaccaccacgcggccggcgcgcacggcgggtgcgaccagcgtttccggggccatgccccagccgagtccgcacgcggcggcttcgacgaaaccggtggaggagggcagggccgcggcctgcatgccgtcactgaagtactggcgggcgaagccgggcgaggcgatggcgtggtagcgcatcgcgccgagcgggtgtacgttgcagcccttcaccggctggccttcggcggtcactgcacccagcacactgccgtcgcgcagcagctgcagggtgtggtcctgatcgtccatgcgcaggtcgaacaggtagccatggcgttggtgcaggtcggcgatggccggcacgaaccaggtatcgagcgagtcgtcgttgaccgccaaggggatcggcgtacgtgcggcgtcgctgccgcgttcgggcagcagttcggccactgcctcggcctccagcgcctgcatcggccgtacccggcgcagcagtgcctcaccggcggcggtgggccggcacggtgcctggcgcaccaccagcacctggccaagccggtcctccagggccttgatccgctgcgacagtgccgacggactgatcgacagccggcgcgccgcagcctcgaagctgccttcttccagcactgcggcaaatgcggacagttgcggatgtaccaggtccaccagtacctcttcagtatttctgcacaggataaagaaaaatcagtttgtcttaacgtgtgccggcctgatcatcgccatcggtgcgcagaacgccttcgtgctgcgccagggcctgcagcagcgtcatgtggggagggtggtgctggcctgcgccggtacggacatcgccctgatccttgccggcgttggcggcatgggcgcgctggtgctgcagtggccgctgctgctgcaggtgctgcgtttcggtggtgcggccttcctgctctggtatggcctgcaggcaggcctgcgcgcgtggcgcgggggcagtgcgctggccgccgccgaggcgcagggcggcagtgggcgccaggtgctgctgacctgcctggccttcaccctgctcaacccgcacgtctatctggatacggtggtactgctgggcagtctgtccacgcgctacccgggcgatctgcgctgggcctttgccgccg

SEQ ID NO: 70903 - DNA, 702 bp, Glycine max
  Peptide Sequence Number=SeqID_187681
atgtctcttggttggtatcattttacatttttctttcttttggcgactttaggagtagtgttagcgcatgtcaatcaccgccatcattttgttcggcatcaccaccaccaccatgattacaacaaacaaactactaagaaaacagtccattattcttccaggacaattattgtggaccgattggggaatggacacttctctacgatacaatctgccattgattcagtcgcttcctacaacaagaattgggtttatatctatgtgatggcaggcacctacagggaaaaggtgaagatcacttctgacaagcctttcatcgtactaaaaggagagggacaaaagaacacttttgttgagtggcatgaccatgattcaagtgcagagagtcctacgttcacaaccatggccgacaatgtcgtcgtcaagtccattagctttagggatctaagaatcaggaaaaagatagcgaatacatacaataataacagaaatgctaactcaatggaagctgcggtagctgcaatgatatttggcgacaggtcgtacttctatgacgttggcttctttggtttgcaagacactttgtgggatggacaaggaagacattacttcaagtcttgtacaattcaaggtgctatggattttatcttcggcactggccaatctttatatgaggtactaataatgatcttaagctgttga

SEQ ID NO: 70904 - DNA, 966 bp, Glycine max
  Peptide Sequence Number=SeqID_187682
atgcaagttggagacccaacatggaatgcacaaaacgtaaacgttcaatgggttgatttggacttagtcaatactgacagagtgttgacatggcgggctgatcatcagcctaggtggcaggggtgcatacatggaaaggtggtgttgctaaaaaaagtaaggtctgacaatgtgaagaagaaggatgaagatgagatttcaatggaggaatgcaagactctaattctttcttctaatttgaatgatgggattaattcttattgtgatggtgtcaagtccttgagttttgagattaatgcacattatttggaattctataatcatgaagagtcttcctctatgtggtttgttgtttatgaaaaaattgaaaattatgagttctttaagcatgatcagggtatgttgaaagatgttacattttgtgtgcctaaatcttcattgcctaattctttgattagagaagctcatgatgaaagtgtaatgctgcatggattttcctttggaatttacatggaatatgaaacactcaagtgttttgttagatgtattatgcataaaagggataaatttaaagatgttgttcatggtatgaagatgtccttgcttgttcataattttcattgggttcgattggctatgaaatttgttctaaagtgcccaagatccaagagaggaaagcattttcatttaatattgtatggttgtttccttgtccttgtatttgatacaggaggatggataggtaaagaggatttcaattcgaggatgaattctctcaaagaaggaggggatgatgaccaccaacttaggagcatggaccttgaagcaaagtatggatttgatggaccaatcacaagagtacttgctaagcaaatggtgaatgaagcccaatctaaaatggaaaacgtgaagcacaaacccaaattggtcaactgcttgaggaataaggaaaatgagctaacttga

SEQ ID NO: 70905 - DNA, 336 bp, Glycine max
  Peptide Sequence Number=SeqID_187683
atgcaaaaagtttatacggataaccactcgggtatttccggccgtcagcgtgactcaaaagtcagtatgacagatcttgtgagcgcggaagatgacgtaaatctccacgtgtcaacgggcttgtcggccgcgattgacgaaggtcgcagaagacgatgcttttcgtcttacagacaacaaaaagtttatacggataaccactcgggtatttccggccgtcagcgtgactcaaaagtcagtatgacagatcttgtgagcgcggaagatgacgtaaatctccgcgtgtcaacgggcttgtcggccgcgattgacgaagggcgcagaagacgacgttag

SEQ ID NO: 70906 - DNA, 263 bp, Glycine max
  Peptide Sequence Number=SeqID_187684
atggcttcgacaataattaaggggctccgcccgctgtcgtcgaggatgtcggagtttctgctcggatcgggattcgacggactgctacagtattcaatgccaacggtggaaattactgagtctctggttgcgacggagacgcacagcgccgtgtgcaaggaacattggcgcgcgagatgtcgtgcaagcacctctaccactctaattgcttgtgtccagtgtgctgccgtcgaagtaggccatgtcgaaaaagagagtcgtcg

SEQ ID NO: 70907 - DNA, 828 bp, Glycine max
  Peptide Sequence Number=SeqID_187685
atggccatgaagccctcaacttccacaagtgggtctggcaagaagattagaaagccttatactattaccaaatctagggagagctggtctgaggaagagcacgacaagtttctcgaagctcttcaactaaaaggtgcacaacttaacaaattcgttggtcatcttgctggttcagttctttttagtcctagatatgaagcctctttgcttttgaatgttcgagagaaatttgacagagattggaagaaaattgaagattttgttggttcaaaatcagttattcagattagaagtcatgcccagaagtacttcttgaaagttcaaaagagcgggacagtagcacatgtgcctcctcctcggcctaagcgcaaagcttctcatccttatccacaaaaggcatccaaaaatgttttgttgccaatgccagcttccatggtttatgtttcttccactagtacccttccaccagggtatgtcacatgggatgaaaattccttgctcatgaattctggatccaacaaatcagtgccttctgatattggatcaaaggggataacacgaattgaccacagcagtcttagtggtgttgggaactctactagaaatctgcctgctactgagatgccaaaacaagggaaacaggctcaggttattcatggtttgccagattttgctgatgtttacagcttcattggaagtgtttttgatccagacacagaaggccatgtccagaagctgaaggaaatggatcctataaattttgaaactgttttgttgttaatgaaaaacctcactgtcaatttgtctagtcctgactttgagcccgtt

SEQ ID NO: 70908 - DNA, 159 bp, Glycine max
  Peptide Sequence Number=SeqID_187686
gcgaatggtaatgctaccgaagatggtcctggcacctcaatagctagtgctgatgttgacgatactgacgatgttgatggcgaactggacatggacgagttggatgaattaagcaagcttatcaaagatatcaattcaaataaaggagtaaggagctga

SEQ ID NO: 70909 - DNA, 354 bp, Glycine max
  Peptide Sequence Number=SeqID_187687
atgtggctccgcatgccaccggtctcttgggacacgcatttcgtttctaaacgaccatttagaggagacactgggtccaacaaagataggagaaaatcactcaaagtgtatcaatctcacacagtgcgtggcgagaaagtcgcacaggattttgttggcaaccaaagggagaggaccactttaggtcgtgggcaaggattgacattctcaccctgggtcaaggtttatgataagttgggattttggctcaaggcttgtagaatgggtggtcatgatatatgtcagggtttggccagcggttcgaggataaaggggatgtcctacattatttccatgatacacatgcaacaatga

SEQ ID NO: 70910 - DNA, 192 bp, Glycine max
  Peptide Sequence Number=SeqID_187688
atgtcagtgaaaaacctcgtcgggtgcctaggagtgcatgacaagacaaatcacacactagtaagtcaggtcactctcactaggtttaaaggagcactcaaaccgggtgtatttacccccaaggcctacactccgaagagtctgtcagggcttctccccactgattcaggtccaacccaaaaaacattttag

SEQ ID NO: 70911 - DNA, 381 bp, Glycine max
  Peptide Sequence Number=SeqID_187689
atgatcattacacaagtattatgcaacagacatactaagactcaaacctatgtgcaatgtggtaccatgtcagtgaaaaacctcgcgaggcgcctaggagtacatgacaagacggaccacactctggaagttaggtcactcacactaggtgaaatcatagggagactaattagggtcactctattttgcgagaatgctccaaccatatggaatcagcatagcataggcttgaaggaacattcaaaccgagtgtatttatccccaaggcctgcacttcaaagagtaggtcaggacttctccctcataattcaagtccaacccagaaaacattttaacacgcagactctatctatgaacaatacaacacacacaactccttaa

SEQ ID NO: 70912 - DNA, 330 bp, Glycine max
  Peptide Sequence Number=SeqID_187690
atgtccccagtggagtcgccaactatcgcaacgtgcccttttgcgggcgggcgacgcgtgactcgcgggatgcgtgttccacaaaaggaatacgctcggagtcgccaccaacgtttatttgaggaaaaacgtcggaaaaaccgaaggaaaaccggtcaaaaagagaattctaagttcgggagttgtgatcattttaaggcgttggaccttgaaaatgatccattttacttagtaagaaacataaatgataaactttcaaaatcctattttttgtggacgagcttgaataggcgagtcgattttagccttagtttcactttagtcatttag

SEQ ID NO: 70913 - DNA, 402 bp, Glycine max
  Peptide Sequence Number=SeqID_187691
atgcgttttgataaagttggattaggatataatcctgaaaatcaacaaaagatgtataaaaatttctttgcctccactcaaaagaacagttctcccttcttaacatgcttttattgtgataagaaaggtcatagtgcatcaacatgttatattagaaagaatggtagtagcattagaaaaatggtatgggttccaaaaggatccttagtcaaaaccaacattcaaggacccaagaaaatttgggtaccaaagtcaaaatatgattatatgaatgaaggactccttgaagcaatgttgaatcctgaacataagggaaagggatccctaggtggttcagaagttgtaaaagaattttataaggatagtggaaatctaagtgggttgcttgaggactggacgtag

SEQ ID NO: 70914 - DNA, 492 bp, Glycine max
  Peptide Sequence Number=SeqID_187692
atggcctccaacaaccatcatgttgtcacacccctggccattgtggcgtctaaggtcattccatcgaagacagggcccaagcatatggtactggttcaatggcgtggattaccaccagaagagaccttatgggaggaatggacaactttgaagagcacccaccaccttgaggacaaggtgttgcttgaagggcacgggagtgttacggaaaaggatgtggaggaggtgccgatagcaaggggggtgcaagaagaaacgagagtaaggccacatagggagaagtccactccagcatatctgaaggattacaaaagaagccatgcagagtggagatgtatccagaagcttccaaccacctataaataccatgtttcttgggcctcgaataccaagtataaaggtctatgtcctgcaaaaattgcaaaaacagtttacgaggaagcaataatgttatccttgagattgaagcctgcctgtaggggtcatgtttga

SEQ ID NO: 70915 - DNA, 495 bp, Glycine max
  Peptide Sequence Number=SeqID_187693
atgagctcaacatcatcaacagcgtcgagcaggttgaggaagtactcaaatatctacgagtcagttactatcaactttatggcctgtgaacacagatggaattttgatcttcatttcattccttcgctcgaacaacaagcatgtggcagacccctaccagcatttagaatgcatgtttggactattgaactcactcagtccctgctttgtgatcctgaaccactgatgcttccacctcttgcagcaatacaccttccttcttgtggtttccatatgaccattttaagaaagttcgtgcctccattacaatggcttgtcgtcccagttggccctggctttcacggcaagtatgttgctgacccatggtaccgatttcttgttgaaggtgattttgttcatggagacgaacttttattctattacaaaagtcgtgaggatatttgggaaatggttattaggaaacagaggaattggggtgacaacgatgattggtga

SEQ ID NO: 70916 - DNA, 1881 bp, Glycine max
  Peptide Sequence Number=SeqID_187694
atgttctcttgtgtcaggatgaggtctgttaggagaacacaaacctttaacatcaatcggactatacctttctcttcaaatccagcgatcaactgtgtaggcagaaatttggagaagtatcaacttggtggggtcatatttggttgcaagaatagtactttaaaagaatgtcaatcaaaacaactctttggcttaccaacaaaccacttttcctatgtgaagaatattgatcctggtctgcctatattcttattcaactatagtgacaggaagctccatggaatttttgaggcatctagcaaggggaaaatgtacatagacccttatgcatggattgatgataattcagatttggatagaacacagtatcctgcacaggtgaaagttcgtgttcgacttcaatgcaagccactgtctgaagatcaattttcacgagtaattgcagaaaactattacaagaataatcatttctggttcgaattagaccacagacaagcaaacaagcttacttcattgctggcttcttttgcatttgcctctggttgtcatttgaggcaaaaaactatatctcaatctctttcatcaactctgaaagaaggtgaagcattcgaaacacatgaatcagagacaaagtctttaactagcttaagtaagacaacaattgccactgaaattacttctttagatggagatatcaagtcattggatgtggtgagggtggagactgaggagatgaacattatatatgagaaactaaaggaatgggctcacgaaagtcaagatctccctatttcagaccatctggatgacactgaagatgagactgagatgttcactctggaaaagcatgagaatgatgagaatgagatggacattgaggaattaatggaattgacccttgtccatgaaaacccagacatctctgtgtcagaccatacaaatgacactccacatgagaatgatatatgcaccataagaaatgattatggagaggtgccaacaggttcagaggaaaaggagaagagttcaagtcctctaattgatcatcaaaacaccatcatctttgacgagttgatgcaagaagttgaagaactaaaaactttcaagaaaatacaaacccagacaaattgttacctagacgatatgctggtactccttttccttgttattgttgttgatagggaagcagaattgaaaattcaacatctaatagatcgttgtacaatgttagaattagcatttaatcttcctccgccacatgctgagaagacaagcattacatcatatgctgagcagcgtgtagaccctacagagacgtcatttttaaaagggaattttaatgaagaagcatggttatcaactatagatttgtattgtcctgccgaacgtgtgataactctttatcctgtgaactcagctcactcatgtgcttcaatggtacaactaaatgttggatcttatagtccaattttcgacaagcggaccttgtgcccctctttgaatcaaagcaaaggaaacttggcagtgctgtctttgaacgatcaaatgtttgccgtagattgtgccaatggaattgacagcttttctgatattgaggtgtttgatttagacaacggaaggtggatctctgcacattcacattccatgatagacaaggcatttgccattgctgctgcggaattcaacaattggtttcatactacttttggaaatggaattaactacttgaagttttttcttggtggcttcgatggaaacaaaaaggttccaagtattaaggaatatatgtggttgcggaaagtcaaagttaataaaaacattatagatcggcaaagggatgacaagaaacttcacaatccattgttggcaaatgggacttaa

SEQ ID NO: 70917 - DNA, 168 bp, Glycine max
  Peptide Sequence Number=SeqID_187695
atgttcgagatttgttgttcacagtgtagaagcaaagactttgactttgatgttttgatgatgccatatgatcatgatgttttgatgccatatgaacatgcgcttctcaagttaagatcaagacaaaaatccaagagattcaagatacatcatcaagaagaactctag

SEQ ID NO: 70918 - DNA, 975 bp, Glycine max
  Peptide Sequence Number=SeqID_187696
atgttatcagaccttacaaagaatcacttactagggaaagtcgttgcattagagataccttcacaagaagatgatccagaactctataaattagtgcaaaatcacatggttcatggtccatgtggaattttgaggcctgcatctccacgcatgaaggaaggtaaatgcagtcgattttatccaaaaaaatttcagctcacaactcttatagatggagatggttatcctgtggatcgtagaagaaacactggtcagacaataaccaagaatgagattataattgataatagatgtattgtaccctacaatccaaaattgctgaaaaaataccaagcacatataaatattgaatggtgtaaccaaaacacttctatcaaatatttattcaagtacatcaataaaggatatgataaagttacggctgtcatggttcatgatgacactagaacagttccccatgcaaacactctgaatgatgaaatcaaggaatatctggattgcatatacatttctccatgtgaatctacttggaggatctttggttttccaatacatggtagaaaaccttctatagagaggctacagtttcatcttccaagacaacatagcgttctctaccaagaccatgatgatattgatgatctcctctctaacccaagcatttctaaatcaaaatttatagcttggatgaatgcaaaccaagcttttgttgaaggtcaaagcctgacttattctgaatttgttacaaagttcgtgtataaccaaaaacaaagatgctggcaacttagaaaaaagggttatactattggcaagcttcaatgggttcccccaactacaggagaattattttatttgaggatgatgttgactgtctctagaggaccaatctcatttgaagatatcagaatagttgctggtgttgaatatcctacatatagagaagcacgttttgctatgggattttttacaggatga

SEQ ID NO: 70919 - DNA, 279 bp, Glycine max
  Peptide Sequence Number=SeqID_187697
atgaagatgacactcttatgtctcgtgttgaatcaaaacatttcaataaagggattaaggctacactgtggaaatggtagtgataagatactcccattctatgaattaatgttgaatccaactcagtttcaggccaaagaagagaaggttcaagtagctgatgactcgctcagtgagccagatccgctcagcgagtggcttctgctaagcaaggcatacaacttgcttagcgggttgggaaaccctagaagaggatcatttagagatgtgctcgcctag

SEQ ID NO: 70920 - DNA, 402 bp, Glycine max
  Peptide Sequence Number=SeqID_187698
atggggtgttacaagaagaagggagttaaaccatttactattagagttgagcataggcaacacaaatcaccaactccaatatgtggtcgcaaagttaccgacaaagacatgacaaagagagacacaatttgtcatgcttttatggtcacgactgtgagatctagcgtatttcgagggagaataaggggacgaagatgtagggttttagttcgtggtggcggcgaggtcgcaatgaaggcaaggtggtttgggtttgtgatggagctacagggtcatggtggtggtgtggtttccaagaggcaacaagtttcaaggtggtggtatgggttcacggtgaagcaacgagtttcattgtggagtggaggaggcaagagggatcgagagagaaagttaggtttgtga

SEQ ID NO: 70921 - DNA, 506 bp, Glycine max
  Peptide Sequence Number=SeqID_187699
gtgagggtatatcctccccttgtgcagaaggttctgaagtagcctcaagggatcgctcaggtgtggcagcagctacctgtctcacctgtgtctcctctgcctcttctcttataacaaatggctctgggatggctaccatctcagtgaactactccactgaaggaatagatcctcgaggtgccaccacctgggctgctgaagtggatgctggagtaggagttgcagaagtagaaggaagctcagctggccttgccctcgcccttctagcccctcagatagaaactgttagatcctcggggttccaacaattcttcctgatagcagggaacctaagtctagaagtgttagaatgggctatagagatcatctggcctgagatcatcgcccctatgttcatatccaagcgagaaactaggccaaagatcagcctagctctatccactgtcaagccagaagtgtgtgatgtgggggccaagttggagtatgagaggacactccacacctga

SEQ ID NO: 70922 - DNA, 738 bp, Glycine max
  Peptide Sequence Number=SeqID_187700
atggtttctggaggtatcatccccttcgaaaaacatattgcggcagtaaggactactagcaacaatatgttatcaaagagaaaaactctagctgagggttcactgttatcaagcaagtcggagacccagcatgaccatagattcaccttcactccttatgctcccatggactcggtgatgtcaccaactgtcgcaacctacccttcggcaggagggcgacgcagggctcacgggtgcgtcttccaagaaaggaaaatgcatggagtcgccaccaacgtttatttgaggaaaacgtcggaaaaaccggaaaggtgtggtctacgaactttaatcgtgaaaggttcaggagttgttttcatgcacggggaagaccgaagaacgacgaagaacgaacgaagaacggtgaagaatcttcacgaaatcgctcacggaaacgtctcggaagcggaggtgggtgccgcccagctctcccaggcgagcagggttgcttccatcagaaggcaccgccttctgttggaacaccctagaaggtccaagtggtcaagcgaaggttgcatgccaccaaacaatggtccccgaatgaaattagggtatgacaccagggaggcatttttatggttgtggcctatacaaggtaggaaagggtgtaattattttgagtgtcacaatccaattgcaagcagtcgtcaaaagaggatcattgtagcattgatgaacaaggggaatgcgatttattag

SEQ ID NO: 70923 - DNA, 244 bp, Glycine max
  Peptide Sequence Number=SeqID_187701
cactaacacactgagatgtagtgcgcttgatccctccctattttgggattcaactcctcttgggttcacttcaacaagatcgcacctgtgctatgtgagatttgcaagcaaagccgatggcattgcgcatatcgacaaggcgtcagaaatcacctctgacagtgagatgcaagataacatgaggttcacggggaagagagttggagaaggaatgacaaggtgtgggaagtccaatataccataa

SEQ ID NO: 70924 - DNA, 300 bp, Glycine max
  Peptide Sequence Number=SeqID_187702
atgtcaatccttaccctcggaagcaaaaaaaaaagaaggaaaggaaatttccaatcaaagagaaagaaaagaagaggaaaggaaattcccaatcaaagagtaggagaaagaaaaaagaaaagaaagaaaattcccaaccaaagaatgggagaaagtaaaaaggaaggaaagaaagctcctgatcaaggatcgaaagaaaacagaagaaatgtgcagaaaggtctttggaccagacaatatctgaacaatacagaattgtcaccaaatgaacaaaaagaaggaaaggaaaccacgacctaa

SEQ ID NO: 70925 - DNA, 348 bp, Glycine max
  Peptide Sequence Number=SeqID_187703
atgccaatctccccctgcagatgtatcggttgggatcgcacccataagacgcccagtgggcccaaagaagtccaacagggccctggggtttccagctctggttacgggcctctgccagtcctacagggtgcccgttcccccaacgaggaatcgcacccacaaagacaccaaatggacccggagaagtccaacagggccctggggtttccagctctggttacgggcctctgtagtcctacagggtgcccgttccccccggcaaggtcacgtcatcatagggatcgcgcctgcaagacacccagtggactcaaagaagtccaacagggtcttggagttgtcaagctctaa

SEQ ID NO: 70926 - DNA, 1014 bp, Glycine max
  Peptide Sequence Number=SeqID_187704
atgcacccgcgtataggcgatagcgaccggctgcacatacaccagcttgcccggaacctgttcagccgcagtggaagccgcgccgaacaacgaggatttgacggcgagcatgcggttgccatccgaggtggtgccttcggggaacaggacgacaatctcgccatcggccatgcggctggcgatctcgctcacctgcgcgccggtgctgcgcttctgctcgcgctgaacgaagatgcttttctgcagcctggcaagccagccgaaaaccggccagtcacgcacctccgtcttggcgatgaacaccacgtcggcaatgctgcccaaaacgaggatgtctttccacgaggcgtgattaaccgccagcatcaacggtttcgcgcgctccacatccccgtggacgtgaacgcggatgcccagaacatggcaggcgatgcggtgccagaggcgcggaatgcggcggcgaagccgccagtcgaaggcaaggcccagcaattgcagcggcagcaagacgagcgtgacgatcaggagaacgatcgcaatataggctgtccgcagccacatcatgatgggaacgcccgcttgctcaccggcgtctcagtgttcgccgggcttcaatggcacgccgtaaagttccagccggtgatccacgagcttgaagccgtgttcgcgggcgatcttttcctgcagggcctcgatctcggccgaatgaaattcgatgaccacgccgttcttcaggtcgatcagatgatcgtgatgctcttcgggcacggtttcataacgcgagcggccatcgcgaaaatcgtgacgctcgatgatgccggcatcctcgaacagcttcaccgttctataaacggtggaaatcgagatgcgcggatccacggcggaggaacggcggtaaagctcctcgacatcggggtggtccgcagattcctgaaggacacgggcgatgacgcggcgttggtcggtcatccgcatgccgcgctcggcacaaagctcctccagcgttttcgaaag

SEQ ID NO: 70927 - DNA, 228 bp, Glycine max
  Peptide Sequence Number=SeqID_187705
atgacccaggaaacgcttggccttgacgccacacccatgatcgcccccgagggctcgaacaaccgtaaggttttcatcaagacctatggctgtcagatgaatgtctacgattccgtccgcatgagcgatgcgcttgcgaaggatggttacgttcagacggaggatatgggcgaggcggatctggttctactgaacacctgtcatatccgcgaaaaggcggctgaaaag

SEQ ID NO: 70928 - DNA, 2061 bp, Glycine max
  Peptide Sequence Number=SeqID_187706
atgctaggtgcacttagcaacactcaagaaagaatcacaccaacgatgagaatcacgttggagccgagctcggagccgagcccaagccgctcccaaactcccaaagaagaactccagtgggtcccacttcccaaacaccctctcttcaccgctcacggcggtgccaccaccgccgctgattcccggaacctccttgcctgggacggagcctcgcgcctctacttatgggactcaaacaaccgctgcctccaccgcctctctctccgtctcggcgaccccgatccctcttccgtcctcgccgcttctccctctaaggtgttgcaagcggacgcggtgcttgatttcgatgtccgcaaaatctcaatcaacaggaacagaacagcgatactccttttcggttccgagacactctctgttatgtacctctacggacgcgcctctaagaaggacgtgaacttgatttgcaggactattactgttggttctcagatgtattccaccggtggcaatgatattcgtgtgctacaagcattatggtacccttacagtgatactcatttgggaatcctttcttctgactccgttttccgacttttcaactttgccgtggatcctttgcaacctgagcaagaatattatttacagcctgttgagcctggtagatctagaaatgcctcatcattgtgtccagttgatttttcttttgggggagaccacttatgggaccggttcagtgtttttattttgtttatggggctttctatgtactttgcccagttgttccatttggaagatatttctaaattcgtgactgttttctctgcttatccacagtctcttcaaatgagacggcctgtctttgctaaagctcatgcttatgctttatttgatgcacctcttgtcttgcagggacctctgcgaagagtaggtcagggtgggaatgaagattcagttggtcgtagtgcagaatgtgaaggtcgtgcagttagttttctctacaatttagtcagcaaagactctattttggtgactgcctggagtggggggaaattacagattgatgctctagccgatgagatccaacctgtctggagtgttggtagtccacctcgtcttcgtgttgattcccatgaccaaattcttggccttgctatgatttgtgagtcaattgccagcagcagtttgtggaagcttgatcataatgcctggttgggtaattcaccccctttgctgagactggctattgttgatttggctctgccacaaagagcagaaagtggttatattatttcattgttcattgatacacttatgccagaaagaatatattcccttcatgacggaaggattgactcaatagttttacattttcttccatttacaagtcagacaaatggcaaggatgatacaatgaaaacaccatctgtgcaccctgttctaaatacttgccagagtggattcacctcagaaccgtcactttgtggctttgtgtcattatcagattcatttggatattcatggattgtagctattactctttctctagagtgtgttgtgcttgagatgaaaagctggaacctcttgcttccagtaagcattgatatggagaagaaaaccatttcatcagagggggaaccaaaagagagagatataccaacaataattagcaaggaactacttagagggaccagggaggtacttgttcctcaggcctctccaagtttacaatctgttgcagctgattcaattgaaggtcgatcaacattacatcagtatttcaagctgtttcatgaaacctatgtggagtatgcacataaggtgtacctggagctcaagcatcacgcacctcagttgaagaaaatcattaatgaccaacattctcgattaggtgatgcacaaaagaaacttttgaaaattgaggagcaagaggctatattaccgaaaaggatagatcgtgcaattcaaactcaattctttggaagagcgcttgcaacatttaaggaacttaccttatgctcacaaaaaaccactgtccagagcagagcgacagtttcaatctga

SEQ ID NO: 70929 - DNA, 168 bp, Glycine max
  Peptide Sequence Number=SeqID_187707
atgacgcttccattattccaatttgatctttctcttttgcagccttgcaggggtcgatccgttccattttttagttttcagaattatcaaagacgtgctgatgcactcacgctgtcggcgaaaggtagacagatcaggttgctctggcggtgctcaactgcgccatag

SEQ ID NO: 70930 - DNA, 650 bp, Glycine max
  Peptide Sequence Number=SeqID_187708
atggcaaggaaactgacgaaagcgcagaagaagatagcatacgatgcgaagctgtgcaagcttctggacaactacacccaaattctggtggtggctgcggacaacgtcggatcgaaccagcttcagaacattcgacacggtctgcgtggcgactcggtcattctgatgggaaagaacaccatgatgaagcgaactattaagatccatgcccagaacaccggcaacaccaccatcctcaaccttattccccttcttgtcggtaacgtggggctgattttcaccaaaggtgacgtcaaggaggttaaggaagtggtttccaagtacaaggtggcagctcctgctcgtgtaggtttagttgcacctattgatgttgttgttcccccaggcaacacagggctggatccctctcagacctctttctttcaggtgcttaacatccctaccaagattaataagggtactgtggaaattatcacccctgtggaactcattatgaagggagacaaggttggctcttctgaagctgctttgctttccaagcttgcgataaggcccttctcatatgggcttgctgtcgtttctgtttatgagaatggttcagtttttagccctgaggttcttgatctcactgaagatgacctcgttgtgaa

SEQ ID NO: 70931 - DNA, 840 bp, Glycine max
  Peptide Sequence Number=SeqID_187709
atggctgtgatacccacgaaagcggagaagaaggtgtcgtacgatgtgaagctgtgccaacttctagaggattacacccaaattctggtagtggctgcggacaacgttggatcaaaccaacttgagaacattcgaaaggatctacgtggcgactcggtgtgtaatttgaaggaggttagcgaagaggttgccaggatgtcattgcggttaaggatgacaaagggaacccggatactcacaaatatatttttggtagctcctgctcgtgtagggttggttgcacctattgatgttgttgttcctcctggcaacacagggctggatccctctcaaacctctttctttcagattaataagggtactgtggaaatcatcacccctgtagaactcattaagaagggagacaaggttggctcttctgaagctgtgttgctttccaagcttgcgataaggcccttctcttatgggcttgttgtcgtttctgtttatgacaatggttcattttttagccctgaggttcttgatctcactgaagatgacctcattgacaagttttctgttgctgcaccacacatgtttggcaatgcttataagaacgtccttgctgttgcagtggcaacagaatattcattcccagaagcagacaaggttaaggagtacttgaaggatcctaaatatttgctgtggctgctgttgccgcacctgctattgattctagcactgctccagctactgcctccaaggaggaggaaaagaaggaagaaccagcagaagaatctgacgatgacatgggtttcagtttgtttgattaagttgtttaaagttatcgagttagtttaa

SEQ ID NO: 70932 - DNA, 1740 bp, Glycine max
  Peptide Sequence Number=SeqID_187710
atggccgaaaatggaatgtttctagcaagaattcagactcctacaccattagaacttgaagaactagaagcggtggtattaactgaatttacaaagatgctttctgcaacacttccaatgtcccttacgtctgcaaaggccttctccagccgcatggttcctttcggccaccgtctctctccggcgacactcaccggcgtttcactctcacgctctcctctcacgttgaggtgctctccactctcaagcaccccttcctatgttgaggaaggagcaaagtttgtagaggcttcaaagaatgggaacttgattcctctttgtcagtgcatattctctgaccagcttactcctatccttgcttaccggattttggttaaggaagacgatcgggaatctccaagctttctttttgagtctgcagagcctagttatcatgcttcgagtgtcgggcgctatagtgttgtaggagctcaacctacaatggaggttgtggcgaaagaaaataaggttacaataattgaccatgaatctgggaatttaactgagaaaattgttgatgatcctatgatgattcccagaaaagtctcagagggttggaaaccctatctcattaatgagcttccagatgcattctgtggttatttctcatatgacactgttcgttatgtggaaaagaaaaagctaccattttcaaatgctccagaggatgacaggaaccttgctgacatacatctgggcctctatgagaatgtgattgtgtttgatcatgtggaaaagaaagcatatgtgattctttgggtgagggttgatcggtactcctcggctgagagtgcttacaaggatggaatggaaagattagaaaaattagtggccaaattacaagatggccaacccccaaggctggctccaggttctgtggatttacatactcatcattttggtccatctttaaagaagtcaagcatgacaagtgaagcatacaaagaggcagtccttcaggcaaaagaacatattaaagcaggggatattttccagattgctaggggatgtattctggttgcttcaagtccagagattcttacgcgtataaagaagaacaagattgtgaaccgtcccttggctgggacagctaaaagggggaaaacacctgaagaagatgcaaggttagaagcaatactgctgagagatgaaaagcagtgtgcagagcatgtcatgttggttgatttgggacgcaatgatgttggaaaggttgcaaaaagtggttcagttaaagtggaaaagcttatgaatattgagcgatattcccatgtcatgcacataagctcaacggttactggagagttgcaagatcatttgactagctgggatgccctgcgagctgcattgcctgttggaactgtcagtggagcgccaaaggtgaaggcaatggagttgattgatgaattggaggttaaaaggcgaggaccttatagtggaggatttggatacatctctttccttggtgagatggacattgctcttgctcttaggactatggtgtttccaacaggaactaggtatgacacaatgtactcatacaaagacgtcgaccaacgccatgagtggattgcttaccttcaagccggagctggtatagttgctgacagtgtccctgatgatgagcaccaagagtgtcaaaacaaagctgctggtcttgctcgtgccattgatttggctgaggcagcttttgttgataaatga

SEQ ID NO: 70933 - DNA, 744 bp, Glycine max
  Peptide Sequence Number=SeqID_187711
atgagagatgctattgtgacgagaggatctgcaatagccgcaagaggttcgacgccttccgcagtcgacaacaacgctttccttcggagtgttgctgctgctactcgccatttcttcttcttcagagcgctttcttctatccatgtttcttcttggagagttcactgtgtagggaacaaactcggttattggctctgctgtgaggtgaacgagaaacaaactcggttaggttttgcggtttggggttttgaggaatttagggttcgcgtggtttgggttttggggatgaatcggagtttcagggctcaggaatcgcaaatgctcgctgctttaaagcagagggagcagcaatttgggggtttgagggcttccgtgatgaaggagaaggaggaggaactcgcattgtttctggagatgaagaagcgcgagaaagagcgcaatgaccttcttcttaacagctccgaggagttcgatgcacctctcgggtcaaatgggggtgctaatcccatttttaacatttcgtcttctacgccggctcctgtacggaagactggcgttgatgattttctcaattcagaaaatgataagaatgactatgactggcttctaacgcctcctggtactcctctttttccttctttggaaatggaaagtcgaaagactgttatgagtcagcttggtactccaaccacacgtcctgtagcattaaaatccagggtaagcattttcaatgaagctttctga

SEQ ID NO: 70934 - DNA, 1854 bp, Glycine max
  Peptide Sequence Number=SeqID_187712
atgaaatgctatgtaacggaagcagcattagagtttgaagagctagaagcggtggtagtaactgaatttgcaaagatgctttctgcaacacttccagtgtcccttacatctgcaaagggctcctccttggccttctcccgccgcatggttccttccggccaccgtctatctccggcgacactcaccggcgtttcactctcacgcgctcctctcacgttgaggtgctcttcactctcaaacaccccttcctatggcaaaaatgacaattgggtagttgaggaaggaagaaagtttgtagaagcttcaaagaatgggaacttgattcctctctgtcagagcatcttcgctgaccaactcactcctgtccttgcttaccggattttggttaaggaagacgattgggaggctccaagctttcttttagagtctgcagagcctagttatcatgcttcgagtgttgggcgctatagtgttttaggagcaaacccaactatggaagttgtggcaaaagaaaataaggttacaataattgaccacgaatctgggaatttaactgaggaaattgttgatgatcctatggtgattcccagaaaaatctcagagggttggaaaccctatctcattgatgaactaccagatgcattctgtggttatttctcatatgacactgttcgttatgtggaaaagaaaaagctaccattttcaaacgctccagaggatgacaggaaccttgctgacatacatctgggcctctatgagaatgtgattgtgtttgaccatgtagaaaagaaagcatatgtgattctttgggtgagggttgatcggtactcctcggctgagagtgcttataaggatggaatggaaagattagaaaaattagtggccaaattacaagatggccaacccccaaggctggctccaggttctgtggatttacatactcatcattttggtccatctttaaagaagtcaagcatgacaagtgaagcatacaaagaggcagtccttcaggcaaaagaacatattaaagcaggggatattttccagattgtattaagtcagagattcgaacgaagaacatttgctgatccttttgaaatttatagagcattgagagttgttaacccaagtccttatatggcctatttgcaggctaggggatgtattctggttgcttcaagtccagagattcttacacgtgtaaagaagaataagattatgaaccgtccattggctgggacagctagaagggggaaaacacctgaagaagatgcaaggtttgaagcaatattgctgagagatgaaaagcagtgtgcagagcatgtcatgttggttgatttgggacgcaatgatgttggaaaggttgcaaaaagtggttctgtcaaagttgaaaagcttatgaatgttgaacgatattcccatgtcatgcacataagttcaacggttactggagagttgcaagagcatttgactagctgggatgccctgcgagctgcattgcccgttggaactgtcagtggagcaccaaaggtgaaggcgatggagttgattgatgagctggaggtgacaaggagggggccttacagtggaggatttggatacatctctttctctggtgagatggacattgctcttgctctcaggacaatggtatttccgagcggaaccaggtatgatacaatgtactcatacaaagacgtcgaccaacgccgcgagtggattgcttaccttcaagccggagctggtatagttgctgacagtgtccctgatgatgagcaccaagagtgtcaaaacaaagctgctggtcttgctcgtgccattgatttggctgagtccgcttttgttgataaatga

SEQ ID NO: 70935 - DNA, 408 bp, Glycine max
  Peptide Sequence Number=SeqID_187713
atggcggaatggcatagcagattttttgccaactgccataggcaatttgtgaagggagcatatttatgtggcagaatcttggccttttgccatccaccattgataacaatgatgacaagacaattgcattattgctatcagttttatgaactgtctagtgtgaatgtttctattggcgaaatggaggacagaccgatgatgactgggttacataccgtggctgacattttctgtgtgggttgtggatcaatcgtgggttggaaatatgagactgcctatgaaaaaaaccagaagtacaaggaaggaaaatcagtgcttgaacggtacaaagtgtcaggtcctgatggaagcaattattggatcagcaatgaggcacatgttggtggaagtgatgcagatgatgcttag

SEQ ID NO: 70936 - DNA, 165 bp, Glycine max
  Peptide Sequence Number=SeqID_187714
atggatattcaacttaacaaattggtacagcaatggcttctttgccagctttgccaacactcctcctctcgttcgccgccatcttcttcaccgtcctcctcctcctcctcttcctccgccgccggcagctccgcctcccgccggggagctacggcttgccgttga

SEQ ID NO: 70937 - DNA, 625 bp, Glycine max
  Peptide Sequence Number=SeqID_187715
acaatccagagccgttcatcgacgagcgcgtggagcggtacgggtcgatcttcacgacgcacgtgttcggagaggcgacggtgttctcggcggatccggaggtgaaccggttcattctgcagaacgaagggaggctgttggattgcagctaccccggttcgatatcgaacctgctgggaaaacactctcttctgttgatgaaaggtggtctccacaagagaatgcactctctgacgatgagcttggccaattcctccatcatcaaggatcatcttcttcaccacatcgaccgcctcgtctgcctcaacttggacgcctggtccaaccgcgtctttcttatggaccaggcaaaaaagcatgtgattgcgatgtacgtgatggaaatggggatggtgactcagattccatggttcggtacaatgtgtccaatttccttgcacatgagcctttacatcacgttaacttaaatgaaaagataacatttgagctaacggtgaagcagttgatgagctttgacccagatgaatggactgagaatctaagaaaagagtatgttcttgtgattgaaggattcttcactctcccttttcctctcttctccaccacataccgcagagccatcaag

SEQ ID NO: 70938 - DNA, 816 bp, Glycine max
  Peptide Sequence Number=SeqID_187716
atggcgaatcgatggtggactgggaatgtgggaatgataagagagcaagagttgatggagaacagcaacaacaacaacgctactactacaccgacgaatagcagcaacagccacactaatgcggaacacaaacacgaccgaggaagaggctcggagccaggaagcagcggtcggaggccacgtggcaggccacctgggtccaagaacaagcccaagccgcccatagtcataaccaaggaaagtcccaacgcactccgaagccacgtcctggaaatcacctccggcagtgacgttgctgagagcatcgccgcctttgccaaccgccgccaccgcggcgtgtcggtgctcagcgggagtggcattgttgccaacgtcactctccgccagcctgccgccccggccggcgtcataacgctccatgggaggttcgagatactgtccctctcgggagcctttttgccgtccccctcgccgccgggagccacgggactaactgtctatttggctggcgggcaggggcaggttgtcggtggcactgtcgccggctcgctcgttgcctccgggcccgtgatggtgatcgccgccacttttgctaatgccacctatgagaggttgccactggaggatgaacaaggtgaggagggaatgcaagtgcaacagcagcagcagcagcagcagcagcaacaatctcaaggtttgggtgaacaggtttcaatgcctatgtataatttgcctcctaatttgctacacaatggtcagaacatgcctcatgatgtgctttggggagctccacctcgccctcctccttccttctaa

SEQ ID NO: 70939 - DNA, 162 bp, Glycine max
  Peptide Sequence Number=SeqID_187717
atggcaggaagggaagatagagagaagaaagcggtatttgtatatgggggagtggagtggtattgggttgtctccctggggatgaaattaccgttgtgccccggtacttgtttggttggtcagtactttgtagcatggtggctcgagcgacgcgtggggtga

SEQ ID NO: 70940 - DNA, 795 bp, Glycine max
  Peptide Sequence Number=SeqID_187718
atggaggaatcacagtacttgctgtggatcaggagaaaacaaatgttgaagtcacatattcagcaaccatttggaaccaacaacaactcatcatcatgggaggaaagggcctttgcagaagatgctgctaggatacttggtgggtgcatatggcctccacggtcttactcatgcaatttctgtaaaagagagtttaggtctgctcaggctctagggggacacatgaatgtgcacaggagggacagggctagactcaaacaaagccttagtcaccaccataatgaattagcccttcaacatcatcacaaaaatgattgtacagttgcaacaagcaaagtctcatcttctaggccttcaactatatctatccaagaaaattgttatcatcatcagcctaccatgtcttcttattcttcctcaattgggtggggacaccatcatcacaacatggggtcttctgattcagaaccaaaagagcaagtgactgcaagggaagagtttttaaaaggtttgggttgtaatgatttttttgaaacaagtttgtctgtgggacaaagtgcagtagtgtttggccaaaaattgccaacaacaactgatcattcatgtggggacgaaggcatcagttataaaagatcaaaaacttctatggctcctttgcctgctgttttcctcaagccatgttcaaatgatagaaacctaacttttcagtccgctgaatttgtacttggagtcaagcctggaatggaagacttggatcttgaactcaggctggggaagccacagaaagttatttag

SEQ ID NO: 70941 - DNA, 360 bp, Glycine max
  Peptide Sequence Number=SeqID_187719
atggaatgtgctggcgtggatttctcgatatttgcagcagttgcatctacatattgggaccttgtaattgattgggggcttttgcaaaaggaatccaagaaccgctggttgagagataaacttgcagttcctcataaaagtgtttatttcatagccatgactgtcttgaatttcaagtttagcttcttgcataaacaagccttgactaccattgttgcatgtctagagatcattcgtcgtggcatatggaacttctttagagttgagaatgagcacttgactaatgttggcaagtaccgtgcattcaagtcagtgcctctacccttcaattacgaagaagacgaagataaagaggagtga

SEQ ID NO: 70942 - DNA, 183 bp, Glycine max
  Peptide Sequence Number=SeqID_187720
atggctaacgttggaaacaaatctgattccaatagctcttactctcttcaccatttcgatcatcctggaatggtcccatcaacacatgttcagccccttggcaatggagcatctcaatcagttgctcccaaggcaaataatgtaaatttttcttcaggatttgatgatgaggatgatgattag

SEQ ID NO: 70943 - DNA, 927 bp, Glycine max
  Peptide Sequence Number=SeqID_187721
atggaggtgattgaggaaagtagcactcatcatgaacaatcagatgatgatggttctaatgatgatcaagaagaacaagtaaaacaaactgtgaaaccaaaagttgaggtacagaagctaaagaatatcactggtactagaccaactcctttggaagtacttgatcgtgtgcaattcaaccacacccatgaaactccacgttcaactataaaaggtgttctcaatttccctggccatgcagaattaaatttcagcagaaaaaatttgaacaaagttgaggaacaacttaaaaggtcattcattgaattctaccgcaagcttaggcttcttaaaagttatagtaagtacttcttgatgcagatcacgtcaagagatgcagctaaagcttatatgaaaatggtggataactcccaccttggaagctctgatgaggtcacaaagctcatggatagggtggaaaaaacattcactaagcacttctacaactcaaatcgtaataaagccatgagcatcttaagaccaaaagcaaaaagagaaagacatagagttacattttccacggggttcttagcaggatgcacagcagctctaatcttagcccttattctaatcgttcgtacccgtcacatattgcaaacgcctgggagtactaagtacatggataccttgttcccacttaacagaataacaggaagaaagagtaggtatggattatccgaacatgtacctagtaaccatgttcaactttcttttttgcagtctgtatggatttgtagttctacacttgctgatcaaggcattgagttaggctacaatcacgtccttctcctaggttttggtctagcagtgttggcactcggcggcgtgcttgtaaacctagacatgcagatagatccacaggacaaaagattaccaaacatttactga

SEQ ID NO: 70944 - DNA, 210 bp, Glycine max
  Peptide Sequence Number=SeqID_187722
atgaagggtccagcgctgaaatacactgaatgtgtttcacctctccggggagcaatcatcactattcatcacgcgaatgaggtgttcgccgacgcggagagcctaagacaatgccttgcggcgttgactgaatgttgtggtcaagtgtggtggggtacaccgtcgtgtcccggtcctgccctcctgccttttgtggttaccatagtgtga

SEQ ID NO: 70945 - DNA, 852 bp, Glycine max
  Peptide Sequence Number=SeqID_187723
atgctgaaaattctgcaatgctgtagttccttagtgcttttgatatttttcttcgatcagaattggagtttcaccacacttaccaagtgcatatgtgcaaatggaaatcctgcttacgtgactataaagatagacagccagaagtttgcaaaaaccagccaagaaagcaaccgtgtgtggaaccaaacttttcagattcaatgtgctcatccagctgattcatgcatcaccattacccttaaaacatcgcgttcttccgtattgggaaaattccatattcaggctcagcagctattgaagaaaggaggcttgatcaacggcttcttccctctcctcatggataatggaaaaccaaacccaaaacttaagttgaagttccagctatggttcaagccggctgaattggaaccgagttgggcaaagatgttgagcaatgactgggaatttcaagggctgagggaggctaccttcccactaaggtcaaattgtcatgtcaaactttatcatgatgctcaccattcttctgcttttcaacctccatttgatctatgtggagctccaaaaaagctatgggaggatgtctataaagccattgagggtgcgaagtacttagtttatattgcagggtggtccttcaatcccatgatggttctggttagagatcctcacacagaaatcccacatgccagaggaattaagttaggtgaactattgaagaagaaggcagaggaaggagtggctgtgagggttatgctttgggatgatgaaacatctttgccctttgttaagaacaaaggtgaactgaacaaccaagacgaagaagcttttgcttattcaaccacacaaaagtaa

SEQ ID NO: 70946 - DNA, 1443 bp, Glycine max
  Peptide Sequence Number=SeqID_187724
atggacccttgtcgtggcgttatgatttgccgtccctactccctacaggcggatcaaggccgggctggggatgcggcggccgtggaaggcaatgttcaacttccggtcgctgaaggttcccggcggcggcttgccggaggcactatcgcggattcggatcaatgtgtcgtatttccgcatgaactacgcaatggtggcgctgctgattctgtttctgagcctcttgtggcacccgatctcgctgatcgtgttcctcgtcctcatggcggcgtggctgttcctctacttcctccgcgacgagccgctcgtggtgctgggccacctcgtcgacgaccgcctcgtgctggtcgtcatggcggtgctcacggtggcgctgctgctgctcaccgatgccaccgtgaacatcctcgtggcggtggcggtcggggtggcggcggtggtggcgcacgccgcgttcaggaggatggaggatttattcttggaagaactagcaccgttctgcggcggtcccctccgtcatcgtctttacagagcttccccggtgaccacaatcgccattcgccgccgcagacgacggcgctcatggctcagccgccgttcgatccgttctacctttaccaacatgatgagcagagcaacatcaacacgctatttgtctccggtctaccagacgacgtgaaggcgcgtgagattcacaacctcttccgccgccgccccggcttcgactcctgccaactcaagtacaccggccgcgccaaccaggttccattccttctcgtcgtagcgtttgccacgtttttcaaccaccaatcggcaatggcagcgttgcacgccttgaatgtgagtaccgtcagagttaggaatttagtgcatgtttggtttgcaattggaaatgctgcggcacacggtgtgaaatttgatcctcaaactggatctgttttacatattgaacttgccaggtcaaactctaggaggaagcgtaaaccaggtagtggagcctacgtggttatagataaaaggtccaaaggagagcctgatcttcagggatcatcaagtgaggacggtgacagcgaccctgatgaaccatcagacagtggcgacaaccagggtgatttagcaatcatgacaagtgatgaaacggctgttggttctgacaatgctgtatctgtggagcaacatggaaagggcagtactggaggactgtgttccactctctttatcgcaaatcttggtccaaattgcactgaagatgaattgaagcaggctttttctgcatatactggattcaacatggtcaaaatgcgttccagaggaggaatgcctgttgcatttgttgattttgaggaaactcaccaagctgctaaagtcatggaggagcttcagggaagcttgctgccgtcatcagatcggggtggcatgcatatagagtatcttctaacctga

SEQ ID NO: 70947 - DNA, 537 bp, Glycine max
  Peptide Sequence Number=SeqID_187725
atggcttcgagctctgcggcggaaggagtatcaatggacgatgattacgaaaccttgattgcaaccaccgacgtggagcttctgaagagagcgtggcgcaacgagaaggcggccccagagattctccgctacgaatctaaattggtttcccgcgtcaacaaagtcattcaactcatggaagaaattgtggaggaaaaatccagtggcggtactgatcctctttcggtgtctctatatcagatggacttggatagaactctctttttgttaagatcctatctcaggattcgcatccagaagattgaaaagtacgtgttccacatccaaaaaactgaagaacttaggaacaggctatctaaatacgagaaagattttgccaaaatgtgtgaaaatgacctagagcaacatctggatgagagtgttctgtcgaagttgcctaaagattataagtctgttctgaggcaatcttcaatgagtgaagaggatgacatggtcaaatttgctttgcctgaaaatcaccagtctgttatgagataa

SEQ ID NO: 70948 - DNA, 516 bp, Glycine max
  Peptide Sequence Number=SeqID_187726
atgagggtgtgcggtggtttcttggagaggattggtttaatgatcttcatgttctgcagtacaatatctgcttctgaggatgagagtggggagccactcagtgagaaacatgatgtgcaagcactttatcctatacatgatttagttaataagatagattggaaaaggtctaaaaatcaaagatattggactgatgattgtctgaactctgtagcttatttgtttatggggacaaagaagaaagatactggtgaggaggaacaagatgctactcctgtctcaactaaggatgctacccctcatgttgttgagactcctgtgtcatcaccatctattacaaatcccgtgatcaatcgagagccaattccagaaaaccaacaacgtgaactcttgaagtggatattggaagagaagaggaaggtcaaagcaaaagacgcagaggagaagcgaaaaattgatgaagagaaagctctgcttaaaaagcttattcggtcaaaatccatcccaagtgtctaa

SEQ ID NO: 70949 - DNA, 903 bp, Glycine max
  Peptide Sequence Number=SeqID_187727
atggaacttctaaagaaacattttcaggaatttatctcaggcctcatgtctctaccaataaaactaccaggaactaaactctatcaatctttgcaggcaaaaaagaaaatggtgaaattagtgaagagaattatcctagctaagagaagtagtggcttctgcaaagttccaaaagatgtggtggatgtccttcttagtgatgctaatgaaaaattaacggatgatttaatagcagataatattattgatatgatgattccaggggaggactcagtgccacttcttatgactctggctacaaaatatctatcggaatgtcctgctgctttgcaacaattgacggaggaaaatatgaagcttaagaaaattcaagatcaggttggagaatccctgagttggagcgattacttatcactgccatttactcaaacagtcatcactgaaactttgaggatgggaaatattataattggagtcatgagaaaggccttaaaagatgttgaaataaaagggcacttaataccaaaagggtgcttaagtgatggattggtcaacttcaggacaaagatacgagcagttgcaatttcactccttttggagggggacaaaggctgtgccctggccttgacttggccaggctggaagcttccatcttcctacaccactttgtcactcaattcagatacgagtttgactagtgacaatggttcattcacaatctcacaacaagtacacgattataccgacatagacagaaagaatttattttcactagagaaatggcatgctgaaaaagatgcaatagtgaacttccctacagtaagaatgaaaaagaggatgcctgtgaagccacttctacctaagggtacagaacaacaattctatgaaaaatacaaaatgtga

SEQ ID NO: 70950 - DNA, 1377 bp, Glycine max
  Peptide Sequence Number=SeqID_187728
atgttccccacactctttgctcaccatcagaagactataacagtggacacaaaagcacccaaatctgtcggcgacagagaacttatgagctttctgggtggattagatttgtgtgatggaagatatgacacagagcaacattcattgtttcaaacactcattagggaatctcattgttatgacttctaccaaacaagcattgaaggagctagcctcaacaaaggaggaccaagagagccttggcatgatgctcatgcttgtgttactggtgaggctgcttgggatgtgttaacaaattttgagcaaagatggacaaagcaatgtgatccttcttttctagtcccttctagcaccttggcaaatcttatgcctaggacaagctcaagcactcttatggagaggaattggaaagttcaagtatacaggtcaattgaccatgtctcagttagtgagttgtctacaaagttaaatgtggagaggagcatccatgaggcttatgttgaagcaattaggcgtgccgaaaggtttatttacatcgaaaaccaatatttcattggggggtgccattggtggaagaaagataggcacagtggctgcactaatctaattccaattgaaattgcgctcaaggtggtaagtaagattaaggcaaaggagagatttgctgtgtacatagtcataccaatgtggccagaaggagagcctgaaagtgaacctgttcaagatatactgcattggactagagagaccatgacaatgatgtataggttgattggagaagctatacaagaaagtggagaaccagcacaccctagagactacttgaatttcttctgtcttgcaaatagggagcagaagggacaaggggagtatcttccactagattctccccaacctgaaactcaatactggaatgctcaaaaaaataggagattcatggtttatgttcactccaacttcatgatagctaatgtaaaccaacgatccatggacgggaagagggacactgagatagccataggatgctaccagtctcaagatggagatgatgataccaaccaagtgaacctagatgatattcaagcatatagaatgtctctatggtatgagcacactgttagtgttgatgagttgttcttagagccacaaagattggaatgtgtggagagaatgcgctcaataggagatgaaatgtgggaaatctacagcagtgaagaaattgtggacatggaaggggtgcaccttgtaacttaccctgtgagagtcacacaagaagggtatgtgaaaaacctcactgatggagttcattttcctgatacaaattctctagtgaaaggaaaaaggtctaaaatattgccccctatctttaccacttag

SEQ ID NO: 70951 - DNA, 675 bp, Glycine max
  Peptide Sequence Number=SeqID_187729
atggcatttggtggtggtggatttgcaatcagttatgcattagcaactcaactagcaaaaataatggatggttgtctaagtagatatttctttttttatggttctgatcaaagagtctgggcatgtattcatgaaattggggtgccccttaccagagaaaatggattccaccagtttgacataagagggaatccatatggttttctagcagcacaccccttggtaccacttgtatcactccatcaccttgaccaattgagctccttgtttcccaaccagactcaaataaactcaatgaaaaagctcatcagtgcataccacattgaccctgcgcggatagtgcagcaaatcatatgctatgatcataagcgcggatggtcgatatctatttcatggggttacactatacaaatctatacagcattgttgatagcagcagacttgcagatgccattgcagacatttcagacttggcgaagttcgatgaatggtcccttcatattcaatactcgacctatgagctctgatccgtgccagcagccaactatgtttttcctggaccaggctacaaaggtgggaaaaagtggaagtatcactatctacaagagacatgaaggcaatgaatcaaagtgcttgagatcaggcaccaataatttggccttgcaaagaattaga

SEQ ID NO: 70952 - DNA, 1185 bp, Glycine max
  Peptide Sequence Number=SeqID_187730
atgggaaactatgattcccaacctgagattctcaggaaactaaaaatgattttaaggatcagtttccatatttcattatatttcacaattctaaatagcatgcttagcagaacagtggagtggagcaaccctagtgattctgggctaggtgcacctacagggtttggtggttctgtacaacactcttcatcaaacaggagggattatgatgatggtgggtcaccaaagaggaacctcagtttggatggtttacctcattttgagaaaaacttctacattgagtcaccagctgtaagggcaatgacagatgctgaagttaatgagtatcggcagcagagggaaataactgttgaagggcgagatatcccgaaacctgtcaagacctttcacgatgctggttttccagtttttctttgcaccttcttcagcttaaagtacatgactcttctctttattactttgttttgcacaaaactgtgtcaagagctgccttggtttaatccagaatatgtactgcaagaaattacaaaagctggctttactgaacctacacccattcaatctcaaggttggcccatggctttgaaggggcgtgatctgataggaattgcagaaacaggatcagggaagacacttgcttacttgttgcctgccattgtgcatgttaatgctcagccaatactaaatcctggagatggaccaattgtgctagttttggctccaactcgtgaacttgctgtccaaatacaacaagagactactaaatttggtgcatcatctaggattaagagtacatgcatctatggtggggttcctaagggacctcaggtgcgtgatctccagaaaggtgtcgaaattgtaattgccactccaggaaggttaattgatatgcttgagtcaaatcataccaacttgcagagggtcacataccttgtattggatgaagctgataggatgttggatatggggtttgatcctcagctacggaagattgtctctcagattcgtccagatcgtcaaactttgtattggagtgctacctggccaaaggaggttgaacaattggcaaggaagttcctttataacccatacaaagtaattataggctcttcagatttaaaagctaaccatgcaatacggcaatatgttgacattgtttcggaaaagcagaaatatgataagtag

SEQ ID NO: 70953 - DNA, 4422 bp, Glycine max
  Peptide Sequence Number=SeqID_187731
atgggacatctaaagatgcaaatgcaaactggtcttaatcccacagaggatgaatacatgcaatgtgatgcaggatatccaaacaagactaccatagtatgcatgatcaatgcagaaattggtgctgttttggctgtcatgcgaagaaatgttagatggggagttcattacatgtcggatgatgaccaatcagagcactttcttgttcagtctttaaagaaattaaggaggcaggttttctcatggcaaaaccaatggcatgccatcaaccctgccttgtatctccagccctttttggatgtgatacgatcagatgaaactagtgcacctattactggcgttgctttgtcatctgtttacaagatcttaactctagatgtgattgatcaacacactgtcaatgttggagataccatgcacttggtggttgaagctgtcacaagttgcagatttgaagttactgatcctggatcagaagaagtggtattaatgaagattttacaagttcttctagcatgtgtgaaaggtaaagcatctgtaatgctgagtaaccaacacatttgcaccatagtgaatattagtttccgtatagttcatcaagcaggaaccaaaggtgagctgttgcaacatatagcacggtatacaatgcatgaactggttaggtctatattttctcaccttcagaatattgacaacacagagtctgcattcataaatgggacagctaccttaaaacaagagaccaatggactaaataatgagcatgctttggcaagcggacaattggaaaatgggaggctgaattctgcacgcgatgctcaaccattatctacaggcattgcttccagtactgcaactgatgtgacagcagttgtaattgatgaaaacacagctattgctagcagtggcaatgagattgatccacaggaattacagctcctgaccgaaccatatggggttccatgtatggtggaaatatttcacttcttgtgttctttgctgaatgttgctgagcatatgggagtgaatcctagatcaaacacaatagcatttgatgaagatgttcctctttttgctttaaatttggttaacacagccatagagttgggagggccatcctttcgctgtcacccaagactcctgagtttaattcaggatgaattattccgcaatcttatgcaatttggtttatcaatgagccctcttgtactttcaatggtgtgtagcattgttctcaatttgtatcaccatcttcgtacggaactgaaattacagctagaagcatttttttcttgtgttattttgaggcttgcacaaaggaaatatggggcttcatatcagcaacaggaggttgtgatggaagcacttgttgatttttgcaggcaaaaaacattcatggtggagatgtatgctaacttcgactgtgacataagttgcagtaatgtctttgaagatattgctaacttgttgtccaaaagtgcatttcctgtgaacaatccattatcttccatacatgttcttgccttggatggtcttattgctgtaatgcagggaatggccgaaaggattggtagtagatctttaagttcagaacaatctcctgtgaattttgtggagtatactccattctggatggaaaagtgtgacagttttggtgacccaaatgattgggttccttttgtccgccgaagaaagtacataaagagaagattaatgattggagctgatcacttcaatcgggatgataagaaaggtctcgagtttctccaaggaacacatcttttgcctatcaaacttgatccccatagtgttgcctgctttttgagatacactgctgggttggataagaatctcattggcgatttccttggaaatcatgatgaactctgcgttcaggttcttcatgaatttgctaggacatttgatttccgagatatgaccttagacacagccctgcgtgtatttttggagacttttaggctgcctggagaatcacagaagatacatagggtgcttgaagctttctctgagagatattatgaacaatcaccacatatccttgctaacaaggatgctgctcttgtgttatcatactcgattatattgcttaatacagatcatcataacatgcaggtcaaaaagaagatgacaaaagaggattttatcaggaataataggcatataaatgatggcagtgatcttcctcgagaattcctgtcagagatttaccattcaatttgcaaaaatgaaatccgtaccactcctgaaccaggctttggatttcctgaaatgaccccaagtcggtggatttctctgatgcacaagtcaaagaaaactgctccattcattgtatctgattctagagcatacttggattatgatatgtttctgttattgtcaggcccaacaattgctgccatttctgtggtttttgataatgctgaaaatgaagaggtataccaaacatgtatggatggattcttagctgttgcaaagatatcagcctactatcatcttgaaaatgtacttgatgatctggttgtgtgcctctgtaagttcattaccattttggatccgctatcagttgaggaatctgtcctggcctttggagatgacacaaaagcaagaatggcaactgagacagttttcactattgcaaataggtatggcgattacattcgcacagggtggaggaatattcttgaatgcatcttaatatttcacaagttaggcctccttcctacttggttggccagtgatgcagctgacgaatcacatgtaactacagaaactggacatgggaggtctaattcaaattctttatcctcaactcatcttcaatatattactccaaagagaccctttggattaattagcaggtttagtcaactcttatatcttggggctgaagaggcaggatcaataccgaccgaagaacaactggttgctcatcagcaagccacacaagcaattcataagtgtcacattgacagcgtattcactgagagcaaatttctacaagctgaatctctattgcatcttgcaaaagcactcattagtgctggagctcaacatcttaaagggagcagaatatctgaggatgaagtcacttcagttttctgtctggagttattggtgacaatcactctcaataacagggatagagttggacttctttggaaggatgtttatgaacacatatccaatattgttcagtcaactgtgatgccttgtgcactggtagaaagagctatttttggacttcttagaatttgccatcgcttacttccctacaaagagaacattactgatgaacttttgaggtccctgctacttgtcttgaagcttgacgcacaggttgcagatgcatactatgagcagattacacaggaagtcaatcgccttgtgaaggaaaatgcttcacatattagatctcagtctggatggcggacaatttcatcactgctttccatcactgctagacaccttgaagcatctggggctggatttgatgcgctgatattcattatgtctgatggagctcatttgctccctgctaattacgttctatgtgtagatgttgcgagacagtttgcggagtctcgtgtaggactggtagatcggtctatagttgcactagatcttatggcaggttctgttaattgtttagaaaagtggtctaataatgctaagaaggcagtcaaagaagatgaagtggaaaagatgttgcaagatattggggaaatgtggtttaggctagttcagggactgaggaaagtatgtctggaccagagagaggaggttagaaatcatgcagtgttatctttgcagcagtgcttgacaggagctgttgggactcacatcccacgcaagttgtggttaacttgttttgatcaagtgatcttcaccgtgctggatgacctgcttgaaattgcacaagcacactctcagaaggactgcaggaacatagaaggaacacttgttatttccttgacgctcttgtctaaggtttttgtccagttactccaagaactattgcaattggaagccttctgcaaactatgggagggtatgctaagccgtatggaaaaatgtgtgaagatgaaaattcggggaaggagaagtgagaagcttcaggagcttgtgcctgatcttctgaagaacactttgcttgttatgaaagctgggggcattctagtgcacagcagtggctcaggagataatagtttgtgggaactgacatggcaacatacgaagaatattgggccctcattgcagtctgaggtgttccctgagcaagattcagagcagttacagattcagcacaaacagattgaaccagttggaagcttgggacctgatgcaaacatttctgttccttcaaatgaaaaagtgggccaagatggtgctatgatcagttaa

SEQ ID NO: 70954 - DNA, 1572 bp, Glycine max
  Peptide Sequence Number=SeqID_187732
atgggacgtctgaagctgcaagctggtatcaatgcaatagaggaagaggaacctgaggaatgtgatgctgcctatcctaacaaaactactttggcatgcatgatcaattcagagtttggtgctgttttggcggtcatgagaagaaatgtaagatggggaggtcgttatatgtctggcgatgatcagctggaacactctcttattcagtctttcaagacagtaaggagacaaatctttttgtggcaccaccatcagtggcaagctatcaacccttctttgtatctacagccatttttagatgtaattaggtctgatgaaactggtgccccaattactggtgttgctttgtcatctgtttacaagattttgactcttgatgtgatcgatcataatactgtcaatgttgaggatgccatgcacttggtggttgatgctgtcactagctgcagatttgaggtcactgatccttcttcagaagaagttgttttaatgaagatactacaagttctcctagcttgtatgaaaagtaaagcatctataatgctgagtaaccaacatgtttgcaccatagtgaatacttgtttccggattgttcaccaagcaggaagtaaagaggttggcaacacagaccatgcattggttaatgggagcactaatttgaaacaggagctggtggggaaaaaattcatacaaaggggaattggagcaggggagaggacaatacttttcataaccggaggcctagataatgagtatgcatttggaagtagacaattggagaatggcagcatgacttctgaatatgataatcagtcattatccacaaactctgctcccaatgatgcaagtgttgtgaaagcaactgtgatggacaaaaacacagcgataactattagtggcaaggagggtggaccatatgatatgcacctcatgactgaaccatatggtgttccttgcatggtggaaatatttcactttttgtgttctttgctgaatgttgtcgagcatacgggaatgggtcctagatcaaacacactagcatttgatgaagatgtgcctctctttgccttaaatttaattaattcagctatagaacttgcaggaccttctatttgtcgtcacccaaggttgctgaacttaattcaggatgaattgtttcataatctgatgcagtttggtttgtcaatgagtccccttatactttcgatggtgtgtagcattgttctcaacctgtatcgtcatcttcgtacagaactcaaattacagctagaagcatttttttcttgtgtcattttgagacttgcacaaagcagatatggggcttcataccagcagcaagaggtagccatggaggcccttgttgacttctgcaggcaaaagacatttatggtagatatgtatgctaattttgactgtgacataacttgcagtaatgtctttgaagaccttgctaatttattgtccaaaagtgcatttcctgtgaactgtccattgtctgccatgcatattcttgctttggatggtcttattgctgttatacagggaatggctgaaaggatagccaatggatct

SEQ ID NO: 70955 - DNA, 552 bp, Glycine max
  Peptide Sequence Number=SeqID_187733
atgggaacacgactgtggttgcaaggcccaaccccaagccaaaggacggtgaaggtggtggcgacgacggtgaaggaccaagaccaagccaacggcttgagattatcttcgataggtctctctctttgtttcccctatttttccttttcgctaataggaaaattacgagtctgtgcatcaagagtaggagatttcagattggcaaatgttcttgcctggcaaattttttatcgacttattgtttaccctagagggcaatctcaaccaccatgcaacctttcaatgtttcttgaagttatagattcaagaaatacttccagtgattggagttgttttgtaagtcatcatttgtcagttgtgaaccaaaggatggaagataaatttgatttcaaggaatctcaaaatcggtactctaaagctgcgaaggattggggttggtgtgaatttgtgacacttaccagtctcttcgatcaagatttaggttttcttgtccatgacactgtcatattgtctgctgaagttcttatattgaaagagacatcaataatgtag

SEQ ID NO: 70956 - DNA, 168 bp, Glycine max
  Peptide Sequence Number=SeqID_187734
atggcgaatagttctatatattcgacatattacaaaaaaatctgcacatcaatgagcaaatttggggcacctggacatgcactttggggtatattttgggctactgttaatatgaaagcctattgccctattgtaagggttgaacccctggtgcttgtttcttgttaa

SEQ ID NO: 70957 - DNA, 735 bp, Glycine max
  Peptide Sequence Number=SeqID_187735
atgaaggtgcatcagttcgcacgtggattctgggagcacgaaccctccctcacacttggatgcaaacgcttacgcccccttgcccccaagctttccaacaccgacgacaccatttctccacctcatcatcatcctgttacaaccttagacctcaagagcttcatcaaacctcaaagtgcctccagaaaacttggaattggatcctcctccgatgataataataataataataataagagagacccatcttcacctcatggccaggtggaaactcatattccaggagggacacggtggaatccgacgcaagaacagatagggatattggagatgctgtatagaggaggtatgcgaactccgaatgctcaacaaatagagcagatcacggcacagcttagcaagtacggcaagatcgaagggaagaacgtgttctactggttccaaaaccacaaagcacgcgagagacagaagcagaagcgtaacaacctaggccttgctcatagtcttcgtactactcccaccacaatagtgtcacacccctttagttgtagtgtaataaccactctcgacacgacaaaacggggtgaaatagtagaaagagaggaggaagatagcccgttgaagaagtgtaggagctgggcatttgagtacttggaagaccaaagagaggaggaacatagaactctggagcttttcccattgcacccggaaggcagacgaaggggtttgttttaa

SEQ ID NO: 70958 - DNA, 801 bp, Glycine max
  Peptide Sequence Number=SeqID_187736
atggttagatccttgtctgcaacttacactgtacaagaaatacaacagtggcgtgaagcacggaaaaagaatcacccttttaataacaacattcagaagaagcacagtgaatgcccaaaagacagcaaggccattaatagggaggtcttacaaagagagctcaaggaggtattagcaaagcaggctgaattgggagttgaagttgctgaaataccatcatactacctgaagaattctgacaatcaaggtcttcagagtgaagcgaaaaacaaatatactgacaaaagaaaattccaaaacaagttcaacaagaaatcagacagaaaaggtcggttcgccgagaagcagaagtttgctgacaaagatttttcagaaagcccctctttgaagaagaggaagccaacattattgcagaaacttttgagttcagacgtaaagagggataagagccacctgcttcaagttttaaggttcatggtaatgaattctttcttcagacatattcctgataaggcgctgagatatccgtcggttgaggttaaagaaaaagggtctgaagtttctggtgaaaaaaaacacttgcacactggaaaagatgttcttaaccgagggagtgaggaaacagttcaaaaaattgtgatcttcaataatgataatggccatgattgtgatgatgacgagaatgactctattgttgataataatcttcataaagatccttcttccttggttaaaagacagtgtgatggtggagaaggaattaagaaatctgatgaagaggagggagaaattttagaatga

SEQ ID NO: 70959 - DNA, 153 bp, Glycine max
  Peptide Sequence Number=SeqID_187737
atgggtgacatgggctcgcacattgagcaatccataactatatggaagtggtgcaacgcgaagcgtaaaggtttgtgggtcaagtggtcatggtggtggtggttgggtggtggcacgatggtggcattgggtggtggcaatagtggtgtttga

SEQ ID NO: 70960 - DNA, 237 bp, Glycine max
  Peptide Sequence Number=SeqID_187738
atgcactcaatgtttcgttcacattatggcaagtttgttgtccagcaggatgtgatggtgccaggaactggcattttggctgccatgattcctaaaagtagtgaacaaggaagtgttcccattggaaaaaagccatccttgtttggcataaaatctgctgcatctatggcttgcccacatgtgacagctgcagtggcactcattaaatcagacatgaaaaatggagtccttcaatga

SEQ ID NO: 70961 - DNA, 4242 bp, Glycine max
  Peptide Sequence Number=SeqID_187739
atgtatgtgcattcactaacaaagataattatctgcagcaagatgataaacgaagaaacaagccaatctattttagttagtggagaaagtggtgctggtaaaactgaaagtacaaagatgcttatgcattatcttgcatttttgggagggagagcagcaactgaagggaggtctgtggagcaacaagttctggagtccaatcctgttttagaagcatttggcaatgcaaagactgttaggaacaataattcaagtcgttttggtaagtttgtggagattcagtttgatcaaaaggggagaatttcaggagctgctatcagaacatatttgctggaacgatctcgtgtctgtcaagtttctgatcctgagagaaattatcattgcttttatatgctttgtgctgcaccacaagaggatgttgataagtataaattgggaaatccaagaaaatttcattaccttaatcaatcaaattgcattgagcttgatgggttggatgattctaaggagtaccttgcaactaagagagctatggaggttgttgggataaattctgatgagcaggatgctatatttcgaatagtagctgcagtacttcatttaggaaacattgaatttgttaagggaggggaagatgaaacagattcctctcagcccaaggatgaaaaatcccatttccatcttaaaatcgcagctgagcttttgatgtgtgatgagaagtcccttgaagactctttctgcaaacgtgttatggtgactcgtggtgacaccataacaaaatcacttgatccaaatgctgcagctcttagtagagatgcattggctaaaatagtttattcaaggctttttgactggattgtggacaagattaacaactctattgggcaagatccagattcaactaacttgattggggttctagatatttatggatttgagagttttaagacaaacagctttgaacaattttgtatcaatttgacaaatgagaaattacaacaacatttcaaccagcatgtcttcaaaatggagcaagaggaatatacaaaggaagagatcgattggagttatattgaattcgttgataatcaagatgttcttgatctcatagagaagaaacccggtggcattattgctctcctggatgaggcctgcatgtttccaagatcaacacatgaaacatttgctgaaaagctatatcaaacctttaaagacaataaacgcttcagcaaaccaaagttgtctcgcactgactttactattaaccactatgccggtgatgtcacttatcaaactgattttttccttgataaaaataaagactacgttgttccagaacatgctgctctactcagcaattcgaagtgcccctttgtttcagggcttttcccacctttacccgaggaaactacaaaatcaacgaagttctcttctatagccactcagtttaagcttcaactgcaatctttgcttgaaacactaaatgctaccgagccacactacattcgttgtgtaaagccaaataatcttctgaagcctggaatgttcgagaacaataatgtgttgcagcagcttcgatgtggaggagtaatggaggcaattcggataagttgtgctggatatcccaccagaaagaactttgatgaatttgttcagcggtttactatcctagaacctaatgttctaaaagcatgccctgatgagatgactgcttgcaagaggcttctagatagagcgaaccttaaagattatcagattggaaagacaaaagtgtttctgagagccggtcaaatggcagaattagatgcatgtcgtgctgaggtcttgggaagatctgcaagcattattcagagaaaattgtctgccatagaacttcaaagggttgctagaggtatcaattatgtgaatcctctagggatgtttatggttgtttactatgtaatcaatgaaagactgaattctgattgtacatgtctattttatgaatttaccataggacaacttgcacgacatcagtatgaatgcatgaggagggaagctgcttctttgataattcagaaaaacttccgcatgcatatttccagaaatgcttacaaaactatttatgcccctgctatttatattcaaactggtatgcgagggatggctgctagaaatgaccttagattcaggaaacggacgcaagctgcaattgttattcagggtcactacagaggttattcagctcgtacttatttcaaaaaactaaagaaatcagcaattgctgcacagtgttcctggagaagaacattggcacgtagagaacttcgaaagcttaaaatggcagccaaggaatcaaaggcacttgaagcagctaaaaataatctggaaatacaagtcaaagaattaacttcgtgtctagaaacagagaagagaatgagggaagccaagacacaggaaaatgaaaaactacaacatgcattgcaagagatggaacttcagctccaagaaatcgaggaagccaaaaaacaggaaaatgaaaaactacagcatgctttgcaagagatggagcttcagtttcaagaaaccaaggcagcgctaattcaggaacgagaggctgccaagaaagtagctgagcaaactccaactacacaggagaaccctgttaatgttgttgacagtgaattgatcaataagctgactacagaaaatgaacaactcaaggaactagttaattcgttggaaaagaaatctgtacaggagtttcctgttaatgttactgacaatgagttgatcaataaactttcttcagaaaatgaacatcttaaggaactacttaattcatcggaaaataaaactatacaggagtttcctgttaatgttactgacaatgaggtgatcagtaagatcactacagaaaatgaacatcttaaggatcaagttaattctttggaaagaaaaattgatgaagctgagaggaaatatgaagaatgtaacagggttagtgaggagcgcatgaatcaaattatagagacagaatcaaagatgattgagacaaagacaaatatgcagaggcttgaagaaaagctatctgatatggaaactgagaaccaagttttgcggcagcaagccttgttgagttcatcatcccggagaatgtcaggaaagcttgcacctgctacaactccgcctttggaaaatggtcatcaggcactacagggttctgtttcttcaaaaacatttggtgcagaggataaagtaaggagatctattatggagaggcatcaagagagtgtagatgctcttttcaaatgtgtgacaaaagatcttgggttctctgaaggaaaacctgttgcagcatttaccctttacaattgtctgctacattggaaatcttttgaagctgagaaaacaagcatattcgatcgtcttatacagctgatcggttctgaattagagataagggtgatacatggttctttaatatggtctcacaaggtattccacttaacatttttgcaggatcctgacaacaatgattgtatggcttattggctatccaacacatcttctttgtttttccatcttcagcgatgtctaagagtacctacaacacggaaaccacccacccccacttcgttttttgggaggatgacccagggtttccgctcatctaatagtctttccagcaatgcttttgatgtagagcatcaggtcgatgccaagtatcctgccttgcttttcaagcaacagcttgcagcttatgtggaaaagatatatggaatcattcgtgaaagttttaagaaagacttgtcacctccactttcttcttgcactaaggcggacaaaacatcaaatgacagcagccaaccatctggttcttggaacagcatcatcgaatgccttaatagatatctcaagattctgaaagaaaactatgtgcctcctgttctggttcagaagctatttagtcaaatttttcaatacatcaatatgaaactcttcaatagccttcttttacatagagaatgctgcacatccaaaagtggagaacagataagatcagggttggctgaactagaattatggtgtactgaagcaacggaagagtatgttggctcttctttcaatgaactcaaacatgcaaagcaagcagttagattcttggttgcactaaaaaaggaagagctatcctatgatgatcttacaaatgacctctgcccagtagatgatgcacatgaagagtcaaggagtgtcacctaa

SEQ ID NO: 70962 - DNA, 408 bp, Glycine max
  Peptide Sequence Number=SeqID_187740
atggaggacatctcagatctgaaagatgaggaagaagaagggacaaagagagaaaaaaacaaaccaagggcaagaattaaaaacacatataaacctataatatgcaaagcaagtgggttcaatgtcctaagtgctcaacagctttatagaatatgtacactttacagtgatgacgatgatgacaataagcaaagtgtatcaacagacgtcactactagattgaagcttctaatgacagatgatgcagatgaagatgacaaatctttcttgttggaggacaacacaagtcatcctattatcgttgaagagatctctacttctgctctagataaaaccattccaaaaataaaacctcctgcagaacttctggagaatgcaaacttccaatttttacatgattattgttag

SEQ ID NO: 70963 - DNA, 792 bp, Glycine max
  Peptide Sequence Number=SeqID_187741
atgtgcaatttgggccttctagaccgtctagaactgaaagagagacatggtaactacgatcacagtccacctagtcaggcacaccatgatctgcttgattcatttgaatccctgagaataaagtcatcagagcggaaggtctccccagccatgaactcattacagggctactatggacttaaagggaccccaagtccctcagaagatggtccattccccagaaacttacctatgtctgaccgacgtctgagtcgtcaccggaaatccagaagtttggtcaatgtaattttggaagagattatgcaaaaatcagatgatgcaccagctgcagaaaccagggaaattaattccaataaatggaatgacaaacttggccagggacatcagaaatccgtagctgactttaccaggataccagagttgcttttgagggaggataatagcagcagtggtgttctttcgtcaagaataggaaagggtttagctctgagacagaaagcagctaaccgaaccgcagcgacaattgattctgaaccaattggtttgaatcctgcggtgttgggcatgggggatacttctcttaatgatggttcatatggggtgaggaaatcatcaagcacttcttgtttacaggatcaagataccagtggctcctcatctatttggccaacctcaatgtggagtttgaaaccagacttacaagcactctcaagtgcagccattggaaaaccaatctttgatggcttgcccaagccaataactggtcggaaaaataaagctgcacttgattaa

SEQ ID NO: 70964 - DNA, 336 bp, Glycine max
  Peptide Sequence Number=SeqID_187742
atgaagattgaggtggggttgggcggggtatggaatgaggaagagaaagcgacggtggtggaggttctgggtcgaggggcgttcgattacttggtggcaaattcaatttcgaacgagaatctgttaacggcggttgggagtggccagaatctaaagaacaagctgtcggatttcgtggaacgccgaacttcagttggaactacgtcatcttctgaaatgttctttcttgcttccatgtacttctcttttccctgggggcttgggggtctagaggtagaagctcggaggggaccagaggattggagcgaggagaggccggatttgagggacggatga

SEQ ID NO: 70965 - DNA, 627 bp, Glycine max
  Peptide Sequence Number=SeqID_187743
atggccaaacccaaaggctcttcaaaacccaaaacctctatttttctatgctgctttgggtcctcttcccgttccagtaaggaatcatcacccacaaaaggatcttatgatcctattatctcaaagatgaagaagaaaagtacttctactagttggttttcatggcgaaggattcgattaatcaacaagaactcagctacttacaaaacggtgccgcttgaagcctcaaatatctctgataatcatgctcattattccaagtccaagtcaaagtcaacccttcaccataaacctcaagctccggctaccaatccgccccggccgccgtcgccacagccggctccagtgccagcacacagaaaagggcctgtggttggcgtgtcggtggtggtggtcactttggtaattatgctattttggggtcgtttatgcgcaatcctatgcatttcggtgtggttatattgtactcggcgttttaggaagaacgatgaggatcttcaaaggaggaaatcgaagagggtggatttggatttggatttggattcggaggagtacaagaaaaaagtgataatggagggtcttcttgggagaaatcacagacctattctatcaactccaattaggtag

SEQ ID NO: 70966 - DNA, 1146 bp, Glycine max
  Peptide Sequence Number=SeqID_187744
atgttcagaaacctaaccgcagagtcactcttcgagctcgtccacaaaagactcttacccttgttagagtcatgtgtgaacaaatcacgtgtcatagaccttcaagatattttgttaaggctcactttcgacaacgtgtgcatgatagcgtttggtgttgaccctggttgctcacagccccacttgccagagattccattcgctacagcatttgaggatgcaacagaaacctcaatgaggagattcatcaccccagtgtggatgtggaagttcatgaggtatctcgatgttggtgctgaaaagaggttgagggagtcaatagagaaggttgatgagtttgccgagagtgttattaggacaaggaaaaaggaacttgctttgcagcatgagaaatctgacctattaactgtgttcatgaggcttaaggatgagaatggaatggcttattcagataggtttttgagggacatttgtgtgaatttcattttggctgggagggacacttcttctgtggctttgagttggtttttctggcttttgcataagaatcctaaagtggaggagaggattttggctgagatttgcagggtggttatgagacacagggaagggttgaagaaggaagaggttgctgggaattgtattgcatttaggcctgaggagataaagaagatggattatttgcatgctgccctttcagaagctctcaggttatatccttctgttcctgtggatcacaaggaggtggtggaggatgtgactttcccagatggaacagtgctacagaaagggacaaaagtaatgtattcaatttacacaatggggagaatggaaagcatatggggcaaggactgcaaggaattcaagccagaaaggtggctaagagataatggacacttcatgagtgagtctgcttacaaattcactgccttcaatggaggacctcgtttgtgcttaggcaaagattttgcatactatcaaatgaaatatgctgcagccagcatcattttccgctaccatgttaaggtactggagaaccaccctgtggtgccaaagcttgccttgactctctacatgaagcatggcttgaaagtcaaccttcaaaggcgcgatgcttcagaaattgagaagtacttcaaagtttag

SEQ ID NO: 70967 - DNA, 381 bp, Glycine max
  Peptide Sequence Number=SeqID_187745
atggatgaaactcttgaggcatccaatgcaaccatagctgatgaagttgaacacaatgctatagaacctgcgtccaagcagtcaacaacatcaaatgaggctacttctaaagacacgggagaacttgatgtcatcatcatctactccaccattttaggccttgctcctctaaactatgggcaacctactattgttatcggggaacaagtgctagtcatgatagggaaatttgttgttgcacctatacccattcctcaacatccacctgcacatcaacctcttgaacctccaccaccattagaggtgggtaaacaggctcaagtccatggactggcccacaaagccaacagtccacatgggccacaaaccaaaatattttaa

SEQ ID NO: 70968 - DNA, 606 bp, Glycine max
  Peptide Sequence Number=SeqID_187746
gacatcccgcatcagtggacccagctttatcgggccgcgaggcgacttattgctgcggggatgaatgactatatcaggctggagacaatgtcgtcatttcccgaggcagagcggtggctggagttaatcggctttgaatatgagggaacaatgcgcagggctggccctgatggtgaagatgcgaaaatgtacagcatagtgagggatagagatgcaggatacaccgccgctcgcaacagcaattacaacgcagccttgctggaccagcaagctgccagtgttgcgctgcaaaccgggtcgcaaacgtctcagatacgccggcagggctcacaggctctggccggccagtctgcatcatttgctgataatggcactggctctggtggcagcaacgcgcttattcagcgctcaacagccattgatacagagatggatgccactaccgccgattacaacggcaggcagcagatggctgagctacagaatcaggctgcagcgcaaagagctcaggctaaagctcaacgcccggggctggtcagtttacttggcggtgtcagcagcgcagcaggaagctattacaacacttcggcattaactaaacggtag

SEQ ID NO: 70969 - DNA, 705 bp, Glycine max
  Peptide Sequence Number=SeqID_187747
atggcaccccttgattttgttgcacttaaagacttgcacaattcagcaaacaaccttctccattctccaatagttcaacaagctattgtccatcaaacagaagaaaaatggtttgatgatgtgtcagagtcatctctgaggatgttggaggtgtgtggcatctcaaaagatgttctcttactagtaaaagaacacctccaagaacttcaattcacttttcgtagagcaagcattggtgatccaggaattgaagaaaaaatcgcagcctacaattgctataggaagaaactgaagaaagaaacattgaagtggttgaagtggttgaagaagggtatgaagagtcaaacagccaccatgcaccctccaatgtttaatgaacaaaagctagtgttggttgttgatgtgctaagagaagtgaggatgaccagcatttgcattgtggaatcacttttgtcccttgtttcctcaccttggttggatacaaaatcagggaaattaaggtccttcacatcaaagcttgtgcgtgtgagtttgcattgttgttcagatgatatgatctattatgatgccatggtgcttcaaagtgaaaacaaaaggttagcaggggttaggatggccatagaagatcttgaggtggagttggagtgcatgttcagacgtttgatccacacaagagttttgcttcttaacattcttaccaaatag

SEQ ID NO: 70970 - DNA, 1047 bp, Glycine max
  Peptide Sequence Number=SeqID_187748
atggttgcaggtttgttgaaaaatgggagagttgaggatgctcgggcactctttgatcggatgcctgttcggaatgtggtttcttggaacgcaatgatcatgggtcatgcacagaacaggaggttgcatgaggctctggagttgtttcagggaatgcctgagagggacatgcattcttggaataccatgatcacgggtttcattcagaatgggaagttaaattatgcagagaaattgtttggtgaaatgcgagagaagaatgccattacttggactgcaatgatgatggggtatgtgcaacatgggctaagtgaagaagcattgaaggtatttaacaaaatgctggctaacgatgggttaaaacccaacactggaacttttgtgactgtgttaagggcttgtagtgacttagctggtcttactgaaggacaacaaattcaccaaatgataagtaagacagtttttcaggatagcacatatgtgatgtttgatgatgggttattgagccaaagggatttgatatcttggaatggtatgattgctggctatgcccaccatgggtatggcaaggaggcaattaatctatttaatgaaatgcaagaattaggtgtttgtgctaatgatgtcacctttgttggacttctcagggcttgcagtcatactggaaggctgaaagaagctttcaatatcattgaggggcttgggaaagagtcaccattgactgtttggggagtgctgcttgctagatgtaatgtgcacggaaatgttgatattgggaagcttgtagctaagaaaattttaaaaattgaaccacagaatgcaggcacccattcattactttcaaatatgtatgcttcagtagggaaatggaaagaagctgccaacattaggatgaaaatgaatgacaaggggttaaagaagcagccaggttatagttggattgaagttggcaatacagtgcaagtatttgtagttgatgataaatcacgttctcagtatgagctgctggggcatttacttcatggtctacgtacagagatgaaataa

SEQ ID NO: 70971 - DNA, 447 bp, Glycine max
  Peptide Sequence Number=SeqID_187749
atgggtcaacttcaacggcaagccttccgcaaagcctatggaattagaccgccaaaggcaagtcgaaaatggggtggtcggaataccgagaaaatatttggagcgatcgacgcttttctcgcctatcataaccacaaggaaagcccggttgtcgctatgctagccgacctatatgacacgttcgaccggggatgtgaaaagagcagcgcaagaattgtttgttgtgcactggctctctatgtgtggttagtttcacacctttttctccaagaaggtaggcccgtctatccgctacaaggtcaccgctcgtgcatcgaaaaaggaaaggcgaattgggaccaactcttggctagcatggaggggcgtctgttaatttgttccctcgctagaaggaagcaagaatcaggattctatcttcatgcgaaggatgtccaaatgttcccttga

SEQ ID NO: 70972 - DNA, 459 bp, Glycine max
  Peptide Sequence Number=SeqID_187750
atgcagcctttgccacagggattgttacgtagcttacttgctgtgcaagtgctcaaatcccagtggccctttgccttaacttggcctatctttcagtccccagatcataaactctcttctaaattatataaagagaacagcatagaaagcaaaaaaaatccactgaccaagaagaagcaactgtccatagaatgcccagcatcagcaagcgataggcatagactagagggcaacataagaacagataactcgcttttgtcacataacaggacaagaaagctcataaaactaaagtttctgattggtatttcatccacaagaatcagacaatggattcaacttaatagagaccccactaaggttctcacaaatcggttagaaggaactataactacaactaacaaaaatcatggctgcactgcggctttacaggttgagatgaaatcataccaaaagtaa

SEQ ID NO: 70973 - DNA, 174 bp, Glycine max
  Peptide Sequence Number=SeqID_187751
atggaatcaaaggtgcaagtaggggttgacagcatatcaggcacagaggcagcaaacacaggggtaagcagaaacagtggtgcaaacagcaagcctcaaggattttgtctgaagactacgtctgaaggtgcaaagctgagctggcaatatgcactgattcaaattgtgttgtga

SEQ ID NO: 70974 - DNA, 1758 bp, Glycine max
  Peptide Sequence Number=SeqID_187752
atggctcttggtggtttggtttccaacagaaacttcacttgtttcattggaccaggaagtgtatatcaattgggaaaggatctatcacctcaaagagggggaatttcttgcgcatttgttgcacgttatggtggtcagattgcaaaggatcctttctcaagatgctggcatgggatgtgttttcatgctaaagaacctttgaatgagaaagtttcaaaaccaataccaacatttcatgatgaagtgcagcattgttctccactatcccagaaatccattcactgcatgaacatgaaacttaaggccagcagaagatgtcagtacttcctctcttcagatccctatagcagtagccttattcaacaaagagcagtatatggactaggtttaaacaaacttggtaaggcaaatacggctcgtgttcattacaagtctgaggagcatgatataacagaagcaaaggtggatcctctggaatcaactgaagggacaggtgaatccattctcctggaaggaaatgttccacaagtatcttcttggtggcagcagtttcctaagcgatgggttattgtattgctatgttttgcagcatttctgctgtgcaacatggaccgtgtgaatatgagcatagcaatacttccaatgtcacaagagtttaattggaacagtgcaacggttggcctaattcaatcatcttttttctggggctatctacttactcagatccttggtggcatatgggcagacaaaattggtgggaagctagtgctaggttttggtgttgtctggtggtcaatggcaacagttttaacacctattgctgcaagaattgggctcccttgtttgcttattatgcgtgcctttatggggattggtgagggtgttgccatgcctgctatgaataatatgctttccaagtggattcctgtttcggagagaagcagatcacttgccctagtatatagtggcatgtacctaggttctgtggttggcttggcattctcaccattgctaatccaaaaatttggttggccatcagtgttttactcctttggatctcttggaagtatctggtttgccttgtggttgagaaaggcatatagctccccaaaagatgaccctgatcttggggtagaggagaaaaggctcatactggaaggcaatgtatcaaatgcacctgtttcttccattccttggaaattaattttatcaaaagcacctgtttgggctcttataatctcccacttctgtcacaattgggggacatttattcttttaacctggatgcctacttactataatcaggttctaaagttcaacctcatggaatctgggctcttatgtgttcttccatggttaaccatggcagcttttgcaaatattggtgggtggattgctgacacactaatcatgcaatcaatcgggtttctgggtccagcctttttcctttcacagctgagccatgtcagaacacctgccatggctgtactgtgcatggcctgtagtcagggatctgatgcattctcgcaatctggtctgtattccaatcaccaagacattggaccacgctatgctggtgtattgcttggactatcgaataccgcaggagtgcttgctggtgtctttggtacagctgcaactggattcatactccagcgaggttcttggaatgatgtttttaaggttgctgttgcattgtacataataggcacattggtgtggaatgtcttttcaactggggagaaagttcttgactga

SEQ ID NO: 70975 - DNA, 1176 bp, Glycine max
  Peptide Sequence Number=SeqID_187753
atgaagaatctccacctccccaccgccgccgacgccgaatccctcgccttcgaactccacaccgacggggaccaacccgaatccgacatctcctacggcctcaacgttcgtgccgacaaaaatccagaaggaaacaacaaagacgacagtgatggtgctgccccacggcgtcgagttccgctggaggccacggcgctgcagaagctgaaaagcgacctggagaggctgccggaggaccaggggatggaggagttcaaggatgtcgccgtcgagggctacggcgcggcactgctcgccggctatggctggaaggaaggaatggggattgggaggaacgccaaggaggacgtgaaggtggtggagatcaaacggagaactgccaaggaaggattagggtttgtcggtgatgctcctgcggcgctcgttctgagcaacaatgagaaggacaacaagaagaaggagaagaaggagaaggttgttaggattgttgggggaagagatgctgggttgaagggtagtgttgtgtctaggattggggatgattatcttgttttggagctttcaagaagtggagagaaggtgaaggtgaaggtgaaggttggtgatgttgctgaattgggttctaaggaggaagagaggtgtttgaggaaattgaaggagttgaagactcagcgtgaggataaagtgtcaaagagtaagcgcggtagggatgaggtggaggagaagagaggggatgttaataggagaaaggagaagagagttgatgttggtaggaaagaggagaggagagtggtggatcataggaaggtttcctggcttacaagtcacattcgtgttagggtgattagccgggatttgaaaggggggcggttgtatttgaagaagggggaggttctggatgttgttgggcctactacttgtgatatatctatggatgagaaccgggagattgttcaaggagtgtcacaagatgttctcgagacagtgataccgaaacgtgggggaccggtgcttgtgttggctggtaaatacaagggtgtgtacgggagtatggcagagagggatttggaccaggaaactgccatagttagggatgctgatacccatgagctgctcaatgtgaaacttgaacagattgcagagtatataggggacccaagcttattgggacattga

SEQ ID NO: 70976 - DNA, 831 bp, Glycine max
  Peptide Sequence Number=SeqID_187754
atgaatatgttgctctggctcccagcatacccaacaatccaacctggctgggacctagatgatgaaatccatgccacattcttcaaatgcatcagttggcaagtggaggaaaccttggatacagtcaattgcccttaccattatttctgtgataaaacgtacccttcaaactaccctcttgttgttgatatcttggtccttctcttcacagcagcttcttactttgtgactcttgccatattggtaatggacatgagttcaggaagaggcagaatctttttgtgtcaatcaaaaagattccttctgccctcaggtcctatatccctccctctaataatattagcctttgcaaagggtcctcaaatcaacacaatattcccactcaattgcattggtcctgcaattcttctaatggttctcatttctgcattgtcctttgacaatgcagctgataaggacttcaagaaagaggccttgtttgtgggagggaaactagtgaggtataggggttggtcaatgaccacattttttgttgtgggggttttgtgtttgaggattgtgtgcaaaatctcaggagaaaactatgcagggaaatttctgttcatcaaagccttgatggaaaggtttagctggatcttaataactgtggattgtgtttacctcacactaaactcaccaccagaaagagtgatgttgagagttgcagcttttggaggcattttccttttgattttcctccaacttctcaaagaggcatgcagccaaatttactcaatggcttgtgtagcagaaaaattgagatgggtatcagcaccatcgcatacaatatga

SEQ ID NO: 70977 - DNA, 753 bp, Glycine max
  Peptide Sequence Number=SeqID_187755
atgggacgtggaaagattgagataaagaggatcgagaacaccaccacaaggcaagtgaccttctccaaaagaagaggtggcctcttgaagaagacaaaggagctttctgtgctttgtgatgctaagattgggattatcatcttctccagcaccgggaagatgagggaatggtgcaccgaaccctttaggatggagcagatcatagagcagtaccagatatcaaaaggaactcccatagcggaacgtggacatgatcatccccgagaagaatttttccataatatggcaatgctgaggcagcaaactatccgtcttgaattggaaattcaacgctatcttggagaggacatgaggggtttacaatatgaagatttgactaaacttgaacaagaattggagaactctgtggcaaggattcgaaaccgtcaactagccttccagaatgagctcttgcaacagcaaatggagaatctacgaaggaaggaaaggatcttggaagaggaaaacaatcatttttccaactgggaacaccaccaagcagtgttggagtttcagaaggctgctgctacagtggaagcaagcaaaccaatgtatgtgatggatcacttctcattctttgaagagcaacctgctgggagcatccttcaactagcttctcctatgcttccacactttcatccatatcttcagctggcacagcccaatatccaagactcagtcaggggccaaagctataacaatggtataaattaa

SEQ ID NO: 70978 - DNA, 1086 bp, Glycine max
  Peptide Sequence Number=SeqID_187756
atgggtgcaccaaaagcttcaagatgtggaagaagaacaacaacaatgactggtatatgcaaaattgtttctccaattgcagcctctaacccagctgcttttgtcttaatgaaagagaaaaaagatttcaagtttgaaacaaatgtacagcctcttcgtctttctaaatggattgatgaaaaggatataatatccttttctctgagaggcagaaaatatacataccatgaatttgaggatcttgcagacaaggcttttttcagtagatttcatagttcaggaggtcttccttcttcatatgcggaaaaggagttctggcatgagatgggctctggagaaagggaaacagttgagtatggagtcaatgttgaaggtagtgccttttcatgtgatcctaatgacagacttggaacaagcaaatggaacttgaagaatttctcacggctgccacaatccctgttacgtttagtcgacagggaaattcccggaataactgatcctatgctttacattgggatgctgttcagtatgtttgcatggcatgtagaagatcattatttgtacagcataaattatcatcactcgggtgcaaataaaacttggtatggcgtgcctggttatgcagcctctcaatttgaaaagactgtcttacaacatgtgtactctaataagatcttaacaaaacatggagacgatggagctttcaagtttcttgcacagaaaacaaccatgttcccaccaaatgtcatgttacaacatgatgtggcagtttacaaagctgtgcagaagccaggagagtttatcatcacctttcctagagcatatcatgctggatttagtcatggttttaactgtggagaagcagtaaactttgctaatggtgattggtttcaacttggggctgcagctagcaggcgttatgcacatctcagaatgatgcctttaattccatatgaggaacttctttataaagaggcaatgctggtttacaagtcctcaagagtcagaagttacaagaagaagcctgaagacacagcatcttatcaagctattatgctgcctttcttgcatcttatgcaatcttaa

SEQ ID NO: 70979 - DNA, 228 bp, Glycine max
  Peptide Sequence Number=SeqID_187757
atggatgatagtgattttgatggagacgctgtgacattcaccatcatcatagacgttggagtggctctcctcaccaatggtggcagcggagtgaaggcctaccttacccccatgaggcaaagttcaaagtgtgagtttgaagaaaccaaatctgggatgtttggaagaatgacactgtttatgaggttgaaagagaaagtaggtgaagggatggtggatgactcataa

SEQ ID NO: 70980 - DNA, 996 bp, Glycine max
  Peptide Sequence Number=SeqID_187758
atgcgcgtgatcgctgccgccctgcttgcctgcctgccgctgcctgccctggctgcgccgacctatgggccacgcctggaaggcttcgactacggctatccggtgaagaccttcgcactggaatcgcagcggcagccgctggaaatggcctacctggacatcgcgccgaagaaggcgcccatcggtgtggtggtgctgctgcacggcaagaacttctgcgcggccacctggaaggaatcgatcaagccactggttgccgccggctaccgggtgatcgccccggaccaggtcggcttctgcaaatccagcaagcctgaacgttaccagtattcgttcgcgcagctggccgccaacacccatgccctgctgcaacaactgcaactgggcgatgtgccggtgcacctggtcggacattcgatgggtggcatgctggcggtgcgctacgcgctgatgttcccgcaggacctgcgcagcctgtcgctggtcaacccgattgggctggaagactggaaggcgttgggcgtgccgtggcgcagcgtggacgcgtggtacgccggcgaaatgaacatcagctatgacagcatccgccgctaccagctggaggtgtactacgacggcaaatggaaaccggcgtatgaaccgtgggcgcggatgcagtcgggcatgtacgaaggcccgggcaagcaggccgttgcatggagccaggcgctggcctcggacatggtgttcaaccagccggtggtctacgaactgaagaacctgcaggtgccgaccacgttgttcatcggccagaaggaccgcaccgcgatcggccgtgacctggcaccacctgcagtaaaggcgacgctgggcaattacccggtgctcggcaaggccgcggcctcagcgatttccggctcgaacctggtcgagttcgccgaactggggcattcgccgcaggtgcaggacccgaagcagttcaacagcgcactgttgaaggcgttgaagtctcgctga

SEQ ID NO: 70981 - DNA, 228 bp, Glycine max
  Peptide Sequence Number=SeqID_187759
atgttgaaaaagtatcgtgttggtttatggggtcagtcattgatcctggaagcaaataaagctgattttcaaggtttcgaaaggggctacctacgaaagcgagaattcgctaagcgcaaccttcagtggctgagcgcgaggaagaatccagaagaagatgagttgtcaagttcgctaagcgcaccactccagctcatcaagcgcaccacttcaagttctctaagctaa

SEQ ID NO: 70982 - DNA, 147 bp, Glycine max
  Peptide Sequence Number=SeqID_187760
atgaatctggggatcccacggtcatgtggctccgcatgccatcggactcttgggacacgcatttcgtttctaaacgaccatatagaggaaacactgggtccaacaaagacaggagaaaatcactcaaagtgtatcaatctcacacag

SEQ ID NO: 70983 - DNA, 780 bp, Glycine max
  Peptide Sequence Number=SeqID_187761
atgggccccgacgggtgcagagaaacgcgagggactggaaccagagaagcggcacacaaaccaaggcaggattttagcattcaaaagagtcaaaatttttctctccttgtggctgagtatgagtcacatcaaggggaagaggtagaaaagtgtgagattttgagggctagagaagctaaatttggggttagtgtaaattggagtctaaagacttgtgggaaggcttgggctgagcaaatgagaaaaatgagtgacaaagaaaatgcttgtgcattgctggttatgggaaaggtagtacatattggggtctggagtttggcctctggaaatcgattaccaaggatcgcgatggcagcgcaattaatccatgatcgcgtggagatggagtgcctaaagggagtttgggagaccctcgaaggcaatgagaggtgccgattccgtggcactattcgactcactactacttcattggtacatccagggaaacccacacgcacgcttcatcgaactgtggagtggatactacctacacctactccatatcgactagtggagccagtccaagtgatagaggtgtcgtcctctgaagaagaccctgaggaggacccagaggagttacctcttgagcctgctgtggatgctcttgactttccagaggatgatgaggacccactccctgatgtggattctccagaggatgtcatgtcagcatctgaggcagactctatggaggagagcggccctggagggacggcaaatagtggagactcttcatcatag

SEQ ID NO: 70984 - DNA, 1183 bp, Glycine max
  Peptide Sequence Number=SeqID_187762
atggtagcagagtcacaacaaagcagtagcagtagcattaacagaggagcaagatggtctctcaatggaatgacggctcttgtcactggcggcacccgtggaatcgggcacgccatagtaaatgacttggctgcgtttggcgctgcagtgcacacttgttccaggaaccaaacagagctcaataagtgcttacaagaatggcaaagtcaaggcttcgaggtaacagggtcggtgtgtgacgtgtcctcaccaccgcagagagagaagcttattcaggaagcagcatccaccttcaatggaaaacttaacatctatgtaaaccattgccccattgtggtcaaaaacaaagtttatggttggggttctaaaccttttaggattctaaatggttggtttcaagatagaagattctttgaggtggtgaaggaagcttggaagaagcaagatgttgaacaaggggatttaaatgaagcacaattcaaattgaagctccaactccaagaggactcttggatagtagcaacattcaatgaatccttgcttctacaaaaatcaaggggtatgtatatggatggtatgtggctagaggagcccataaaggtgaaggaggaagtgaagaatttttttgaaaatagattcatggaagacaaatataagagacctaaacttgacggggttaatttcaaaagaatcttgaatgaagacaatggcatgctcttggaggagtttgaggaagatgaggagttttgggagatgatgaaacttaatattatgatattcttgaaggagtttcatagacatggagtacttccgagtggtacaaactcttcttttactgctttgatagccaaagttgctttggagttattggggtggagagccattgagaggtgtgctaatgtgttgaattgtaaagttctcactttgcctttcatttatcttggtttactaatcggtgctaatcataggagggatagtttgtggggtcaagttcttacttctaagtatgggggttggcatggtctaatgggaaatagtgctttatcttggaaatctctttggtggaaggatttgaagaaactttgtgggagtgaggtggacaatccatggtttgatgagaatattctgtggaagattggaagaggagacaagtgtaggttttggaaagatgtatgggttatgg

SEQ ID NO: 70985 - DNA, 645 bp, Glycine max
  Peptide Sequence Number=SeqID_187763
atggctcttgttctcaacgtctcattgtgttccacttgtaaaccccatctttctctctcaacctccaatcccaacaaagcttcttctacttttcctcttcctcttcctcttctgggactcaacataaagaaaagtctccaaccatctcagaaactcacattttcattgggtgaatccgtgtctggtgccaccctcgttgctctcctctctgcttctttcatctttgttgatcccgcacttgcattcaagggtggagggccatacgggcaagaagtgacaaggggacaagatctcactgggaaggacttcagtggcaagactctgatcaaacaagacttcaaaacgtccatactgagacaagccaattttaaaggtgcaaagttaataggtgctagcttctttgatgctgatttaacaggtgctgacctttcggatgctgatcttagaaatgcagatttttccctggcaaatgtgacaaaggcaaatttaagcaatgctaacttggaaggtgcacttgcaacaggaaatacatcttttaagggatcaaatattacaggcgctggtgcaattggtcttgggtttcaatcaacctatttaggaaaactatgggaaaggttaataagagggaaagaagagagcatttaa

SEQ ID NO: 70986 - DNA, 891 bp, Glycine max
  Peptide Sequence Number=SeqID_187764
atggcaggaagcagcattaacagaggagaaagatggtctctcaatggaatgactgctcttgtcaccggcggcactcgtgggatcgggcactccatagtgagtgacttggctgcgtttggcgctgcagtgcacacctgttccaggacccaaacagagctcaacaaatgcttacaagagtggcagagtcaggggtttcaggtaactgggtcgctctgtgacgtgtcctcaccaccccagagagagaagctcattcaggaagttgcatccaccttcaatggcaagcttaacatctacgtgaacaatgttggaataaacattagaaagccaaccattgagtacactgctgaagaatattcacagattatgacagttaatttagactcctcattccatctgtgccagcttgcatatcctcttctgaaagcatctgaaaagggaagcattgtgttcatttcatctgttgctggtgtagtgagtttaggtactggagctgtctttgcagcaagtaaagctgcaattaatcagcttacaaaaaacctggcttgtgactgggccaaagacaacatacggagcaactgtgttgtaccatgggcaaccagaaccccggttgtagaacatacccaacctaacctagcagaattgtttagtttttctgcttggaaattatatgcctattatattgagactggtgcagcgttgttcaaagaccaaaagtttgtggatgatattatgtctcggactccaattaaacgtatagcagaaccagaagaagtgtcatcgttggtgaattttctttgcttgcctgctgcttcattcatcactggacaggttatttgtgttgatggaggattaactgtgaatggatttcaacccagcatgagaattacctga

SEQ ID NO: 70987 - DNA, 384 bp, Glycine max
  Peptide Sequence Number=SeqID_187765
atggttcttggaccaagataccctgcatttaaaaaccatttgaaaaagcaagtgcagggaatccaaattccaaatgcgtgtttgagtgaaagcagtagcagtagcattaacagaggagagcaagatcgtgggatcgggaaccaaacagagctcaacaagtgcttacaagaatggcaaggtcaaggctttcaggtaactgggtcggtgtgtgatgtgtcctcaccaccccagagagagaagctcattcaggaagtctcatccaccttcaacgctgagcttaacgtctatgtaactactactcctaagtcattatgcctaaggctatgctgtgcattacattgcatttataagcttaacatatgttgggagagatcaaccctttaa

SEQ ID NO: 70988 - DNA, 615 bp, Glycine max
  Peptide Sequence Number=SeqID_187766
atggcagatgcagcgaagggtacctacagagcctcaagatggtcccttaacggaatgactgctcttgtgaccggtggaactcgtggaattgggcatgccatagtggaggacttatgtgggtttggtgccactgtccacacttgttccagaaaccaagctgaattggataagtgtttgacagaatggcgtagcaaaggttttttggtttctgggtctgtgtgtgatgtctcatctcaaccccacagagagaagttcattcaggaagtcacttccatcttcaatggcaagcttaacatctatgtgaacaatgttggagtaaactataggaagcccacaattgagtacactgctgaagtatattcacaaattatggcagtcaatttagactctgcttaccatctgtgccaacttgcatatcctcttctgaaagcatctggaatgggaagcattgtgttcatttcatctattgctggagtggtcagcttaggtactggatctgtctatgcagcatgtaaaggtaagtcaccgtgctatgaaacatgcacatctttcttgtttgagtgtcttcatgtcggacatgtttccgacaccgatatttgttcaatacttgtctga

SEQ ID NO: 70989 - DNA, 519 bp, Glycine max
  Peptide Sequence Number=SeqID_187767
gtaaacaacgttggagtaaactacagaaagccaaccattgagtacagtgctgaagaatattcagagatgatgacagttaatttaaactcggcattccatctgtgccaacttgcatatcctcttctcaaagcatctggaaagggaagcattgtgttcctttcatctgttgctggtgtgaccagcatgggtactggatctgtctatgcagcaagcaaagctgcaattaatcagcttacaaaaaaccttgcttgtgaatgggcaaaagacaacataaggagcaactgtgttgtaccatggacaaccagaaccccacttatagaacatttgctccaaaatcaaacgtttgtggaagatgttatgtctcggaccccgcttaagcgcattgcagaacctgaagaagtgtcatcgttggtggctttcctttgcttgcctgctgcatcttacatcaccggacaagttatttgtgctgatggaggagtaactgtgaatggatttcaacccagcatgagaattacctga

SEQ ID NO: 70990 - DNA, 906 bp, Glycine max
  Peptide Sequence Number=SeqID_187768
atggaagaccacgcgcatgctgcactacctcccggttaccggttctacccttccgaagaggttctcgtcggttactacttaaccaagaagaacgagaaccgggaggagggtttctacggttctgatttgatcagagaacttgacctctacgatcacgatcccttcgaattaccggacgctgctgcttgcttttcgtacggttacaaagggaggaagaagcattggttctgttacgctaaagagaccaaacgcaagaaacagaagaaaggtgaaaagcgggttctggctccggaagggaaaggttcgggatatttccgaccacaacggcgacgacgtcgttttgggcacgaggacgcgtttcgttttctacgtcggcaattccctgaaaaacgctgccagaaccgattggattttgcttcgtttgtgctttgtcgtgtggtgaataagcctcctcataagaatagtccgtcggagatcggtctgagttgttgtgctgaggagagtgttgtggcggtggtgcgtcacgttggtgttcagtgtgatggatgtgccgaaagtgatgttgttgaagctaaggtgtgtgatgaaggctttgttaatagagagaatgagattgctgagaatccaattagtggtgaacatggtgatccagctgcacctgtttcagttgctcagggaagtcagccgttgtcaattgcaaacttctgcatcagcaattgcctgaaaaatttattcagaattagggtcatcaatacagggaatcagtcaaaatgtttgttgcaagttcaggaaaggctttctaaacttcccagtggcagtgcattgttcgtaggagctatgacatctcagcaacttatgctttccattctagaggaggatttcatagaattggatgatattgcatga

SEQ ID NO: 70991 - DNA, 210 bp, Glycine max
  Peptide Sequence Number=SeqID_187769
atggcaaaagtaatgctgcttcgcaacaagaagtatgtagaagaaatgttatctcgaactcctcttgggcgcatcgcagaacctgaagaagtttctgccttggtggcttacctttgtctgccagctgcctcttacatcacaggacaggttgttcttgttgatggaggattatcagttaatggatttcaaaccagcatgagaataacatga

SEQ ID NO: 70992 - DNA, 165 bp, Glycine max
  Peptide Sequence Number=SeqID_187770
atgaaatcagagaatcgtgttttgcaagctttgttcactctcccgccggtgactgtgagtgtggggacatggcgcgttttaattggctgtgacgacgccattgtgttggccacggtggagcgcggggtggacggagcatgccgcttgttctgcgacatagcttag

SEQ ID NO: 70993 - DNA, 252 bp, Glycine max
  Peptide Sequence Number=SeqID_187771
atgcagacctcctatgagccttttgcatttataattaggggaaaaggccatgtactgcttgtagtagtgttatatacccgaaacagaaatgaaatttctgaaaaagcaaaaatggaaacactgctagccaaggcattaaagagaggcttggtgactcccatcatttccccactcactcctttctcacacctttctgttgaagaatctcccatagaattttatgctccctgctgtcatgtgtacagcgaataa

SEQ ID NO: 70994 - DNA, 696 bp, Glycine max
  Peptide Sequence Number=SeqID_187772
atgtatgcagaaacttgtgatgctaacataaaccggttcatatcaaacagggcaaggtcaattaacagaaaatctgtggcggaactttttgttgatttcgtagggaagtttgctaagatggattcaatggccgtggagatgggaatctgcccctatactggaaaatgggaacagatagaggacaatatgatttggttgcccaagacttacgcaatatttgttgaggatccttttgagcagccacaaaatactgcaagatccgtcagtgcaggacaactgaagaagataacagagacatttgcaaggacgcacgacttgcttacctcaacaaatcagaatcaaatttcacttttgtccaacttagcaccagcacatgtaataagatgtatcacaaggccttacggtggaggttacattcacccaactcagccacaagtgcagaggggtgttgcttactttcacccaactcagccgcaagtgttccgcccaactcagccacaggtgcagagggccatacgcccgctgcaaccgcagtcgcaacatcattttcaaaatgccagtcaaggaacaagctccaacagttcattttcaactggacaaatacaagcgcgtaaaggagtgagctccaacagttcatcttcaaaaggacatacgccggtgcatagaggccaacagatgtggaggccaaagagttaa

SEQ ID NO: 70995 - DNA, 372 bp, Glycine max
  Peptide Sequence Number=SeqID_187773
atggattcaagagcaactgttgagccatatggatcatttgtgtctaatctcttcacgcgatggggtgacttggatatttcaattgagctatcaaatggtggagggagtaacttgcagttcatctccaatgctagagtgcccattttaaaatttaaaagctaccggcagggtgtatcttgtgacatttcaattaataaccttccaggccaaatgaaatccaagattttgctttggatcaacaagatagatggccgttttcgtcatatggttttactggtcaaggaatgggccaaagcacacaaaatcaataactcaaaagctggaactttcaactcctattcgctaagtttgcttgtgatattttattttcag

SEQ ID NO: 70996 - DNA, 1796 bp, Glycine max
  Peptide Sequence Number=SeqID_187774
atgaccggcgattttctccggacacccctcactttgaagatcgccactttcttcttcatcgccgtcacattcttctacttcggcaagcattggtccgatggctaccagcaactcgtcttcttcactcagcgatccgactcggatccgaactccaacccggtcgtttccacgtccccgaattacgccaaaccattcaacgtctccgccctaattgagaacaactcccaaccggcgccgccggaaaatgttcctccgccgccgccggaggaggggtcgatcgagaaactgggggtggtgaacgagaatggcacgatgtccgatgagttcgaggtgggggatttcgatccgggaatggtggaacagtgggtgaacgagactcaggttgatgagagcgagggttcttcttcttctccttcttctacttctgattctgatgtgggatttgggatcaagaagttcgggttgtgcccgcgcgagatgagcgagtatataccgtgtttggacaacgaggacgcgattcggaagcttccttcgacggagaaaggggagaggttcgagcggcattgccctgagcaaggtcgagggttgaattgcttggttcctgcacccaatgggtaccgtacccctattccatggcctagaagccgagatgaggtatggtacaataatgttcctcatacacgtcttgttgaagataagggaggccaaaactggatttctagagacaaggataagtttaaattcccgggaggtggtacacagtttatacatggggcaaatgaatacttggaccatatttctaagatgattcctgatattacatttggcaagcatataagggtggttcttgatgttggctgtggcgttgcaagttttggtgcgtacttactgtcacggaatgttgtcaccatgtctgttgctcccaaggatgttcatgaaaatcagattcagtttgctcttgagcgtggcgtaccagcaatggcagcagcatttgctactagacgcttgttatatccaagtcaagcttttgacttggtacattgttcacgctgtagaattaattggactagagatgtcaataggatgctaagagcaggagggtactttgtctgggctgcccagccggtttataagcatgaagaagttttagaagaacaatgggaagagatgcttaatcttaccactcgactctgctggaattttttgaaaaaagatgggtacattgcagtatggcagaaaccttctgacaatagttgctatctagaccgtgaggaaggaactaaacctccaatgtgtgacccaagtgatgacccagacaatgtttggtatgctgatctaaaagcatgcatctctgaattgcctaagaacatgtatggagcaaatgttactgaatggcctgcacgtttgcaaagcccccctgataggcttcaaaccataaagcttgatgctttcacatccagatcagagctttttagggcagaatcaaaatactggaatgaaataatagcaagcaatgttcgtgttttgcactggaaaaaaatcagattaagaaatgttatggacatgcgagcaggttttggaggggcgagccctggtgcagcggtaaagttgtgccttggtgacttgttggtcatgggttcgaatccggaaacagcctctttgcatatgcaaggatttgcagcagcattgattgatcagaatcttgacagctgggttatgaatgtggttcctgttagtggtccaaacaccttgcctgttatatatgaccgtgggttaattggagttatgcatgactg

SEQ ID NO: 70997 - DNA, 360 bp, Glycine max
  Peptide Sequence Number=SeqID_187775
atgtacaccaagctcacattggcgtgtgtggggaacgtgtcgtttgatggcatcttaatgatgtgcttcttgtcgtcacacccagtgctcttctcgacgatgtcgagggcgccaaggcagtccttcacaatatttcaatgtgtgggcggtttcctcaccaaatttctttgtggtggcatagaggcaagagagttggccagtgcatccgagaaagggttttgggtgttaaggacatcattgcagtgtgtttttgagagcgacaaaacaatgagtgccaacaaagccaacgacgataatggtgaggccattggaagcgacgtgaggtgttggagtggcttgcttgcttctcccaggtgctga

SEQ ID NO: 70998 - DNA, 408 bp, Glycine max
  Peptide Sequence Number=SeqID_187776
atgaataatgggtgcgagtcaaaatgcctcctttcgatgcaagtgcttcttcactatgttgccacttctgagatgaacaatagggcaaccacacagaaaacgaaccagatcggagtcgaggtatataaccctctcgacgtagggttcgaggaggtcagtgagataattgctgacgtagttgaggggttgttcgagggtttgtctgacggaggtagagatcaggttgcggacgatctctggatcgaagtaatagaccttgaagttcaattgcgggaaggtggatttgacgagggactcaaggttggtttcgcagacgaggaagtggaagatgttcttcgggcagtgggagtgttggaggattgtggacggcggcgatggagccgcataggtactccacgtcaagggtga

SEQ ID NO: 70999 - DNA, 414 bp, Glycine max
  Peptide Sequence Number=SeqID_187777
atgcatgaacgacaacattccgttaccacctcgacttccctcgacaccaatccatttgctaatgtcgtttctggcaaatcaacctatttaactcgaaagtgtaaccattgtggttgcctcggtcacaccagtgatatttgttatcagaagcaagggaatgtcgttcctaaatgcgagcattgcacatgttttggccatacgatggatgtctgctacgcaaaattcagatacccacttggtcacccaaaatatttgggtcgacctcgccttcccaacaagagtgggaattttagcagtaacaacagtggcactgtcaacaacgttgcaagtgatggaagcagcataaatctatttggtgaagaacgcaaggatgggtatgtaccagcacccaatcccaacattacacaggcctaa

SEQ ID NO: 71000 - DNA, 1131 bp, Glycine max
  Peptide Sequence Number=SeqID_187778
atggcggaattggaggaggagcggatgggaggggatttcaagcccttctcggagggctcttcgtgctcgcgttcgatcagcgaaaccgtgaacggctcgcaccaattcacaataaagggttactctttggccaaagggatgggcgcgggaaagtacatcatgagcgacactttcaccgttggtggttacgattgggctatttacttctaccctgatgggaagaaccctgaggacaattccatgtacgtttcggtctttattgcgctcgctagcgacggaaccgatgttagggctctcttcaagttgacgctggtggaccagagtgagaaggggaatgataaagttcatagccatttcgatcgccctctagagagtggaccttataccttgaagtataaaggcagcatgtggttgggtgttatcgtgccacagtcagacatgggccgagattttaaggacttgttggaatctgaggttggttgtgacatagttttcaaggtcaaaagtgaaagcttcaaagctcataagttgatacttgcagcccgatctcctgtgtttagagcgcagttttttgggcttgttggggatcctaccttagaggaagtagtggtagaggatattgagccctttatcttcaaggcaatgcttctcttcatctactctgacaaacttcctggcatatatgaggttatggactcgatgcccctgtgctcatacactgtcatggtgcagcatctcttggctgctgctgatctctataatcttgatcggctcaaactgctttgtgaatcaaaattatgtgaagaaatcaatactgacaatgtggccacaacacttgcgctggcagagcaacaccactgtccacagcttaaggcaatctgtttaaaatttattgcaaatcctgcaaacttgggagctgtaatgcagtcggaagcttttgtgcatttgaaagagagctgcccctcaatgctgttggaattgctggagacatttgcatcagtggatgataactcaggccagacattaagcagaaagagaagtggcagtagcatatatggtcaagatttagcagatggggcagctgctgaatcagttaatccgaatggcaggcgagtaaggaggcggacataa

SEQ ID NO: 71001 - DNA, 1041 bp, Glycine max
  Peptide Sequence Number=SeqID_187779
atgacgttgttgaagttccatcaagtgtggaagccagctttggtgatgattatagttaacttagctctggcttttgtcaatatatttctgaagaaggttcttaatgaaggagtggactacttgaccatcctaacctatcgacaagcaatttcagccattttcttgacacctattgcttgtttctatgaaaggaaaaggaagctggagggccacataatatgtctgcttttcctaagtgctcttgtgggggtaacactcactcaatgtctgtatcttattggactagaatatacatctgccacgttcgcatgtgctttcctaaatatggtacctgtattcacctttattatggcgctgccactggggatagagaaggtgaacatgaaaaatctgagtgctaaggcaaaggtgttgggaacttttgtgtgtattggtggagctttgatgttgatcctttataaaggagtgcccttaatcaaacaacaaccagagcacttagcagacaaaggcacaataacatcaccagcctccaagttaaagaaatggatcataggttcactgcttctaactgcaggatgcctcttgtggtcttcatggtttctaatgcaagcaaggattagcaaaaagtatccatgtcaatactctagcactgccattttgtcctcttttgccgccattcaatcagcaatattaactttggtcatcgatagaagtaatgccaagtggattctcaaagggaagttagagataatgactgttgtatatgctgggctggtaggttcaggcttgtgctatgtggcaatgtcatgtattgcaggatcagtcttggttatttctggcacgtatattctactttggggtaaaagtaaagaggaagaacaaagtgccgtgaagggtactcaagaaagtcaagaagatgaagaaagtaagaataatttgggggccagtcctaatgtaccttcaaagctaaggccaaatggggaacaaggattctctgaattacaagtgaagcagttagctattacagtaactaaaagttga

SEQ ID NO: 71002 - DNA, 165 bp, Glycine max
  Peptide Sequence Number=SeqID_187780
atgcggaaattgattaaggaaaggatggaaaataaggtggttaatttcgtgggtcttaataaggtggttcttggcataaaatggatgaatgggatgaacaagggtgaagatgaaaggaaggaaagaatcactctttccagtgagggcaacacacaaaggttgtga

SEQ ID NO: 71003 - DNA, 207 bp, Glycine max
  Peptide Sequence Number=SeqID_187781
atgccttgtcacctcaagtttggtctcttcttcttattcgctggctttgtggtgatcataaccatcttcattgcaatgcttttaccagagaccaagaatgttccaatcgaagaaatgaatagaatatggaaggcacattggttctggactaagattgttcctgctgacgttgacattgatggtagtagtaaaaaggcggttgcatga

SEQ ID NO: 71004 - DNA, 600 bp, Glycine max
  Peptide Sequence Number=SeqID_187782
atgcatcgtccgttgaagaaatctatagtgccacgtcaatttgctccagtgctgaagaactcggaagaaatgggcgaagagtgtaggctccatgcggcggcaacactcctctgtgactttcaccggggaggagacaaagtggaggtggaggggatttgggtatataacaatgccaacaatggtgataattgggctgagaagtttgtcaaggcaatggtgcaaatgagttctatagaagtccttactggctccaatatggaggagagatatgttcgaatgggagagggagttgattttacaactaaagtttgttacaaaatgtacaggtacaaagagccaacttggatgctaggatttggttgtatagaccttcagattcccaagaaagtggcattcttaatttggagagcaatgaggaatagactgcctaccaaagataatttgagaatgcatggaatcattgttgaagaatccgaagcggcagattacaaattcagaaaagggatagttgggtgggatgtttatagcatttgtgggtttggagaaagcatttggcctttggaatcttttgttcttgttgggtcgtggtgggaagcgtag

SEQ ID NO: 71005 - DNA, 468 bp, Glycine max
  Peptide Sequence Number=SeqID_187783
atggtttcctgcttggttctgattctaggtgtttcatcattggcttcagcatatctgaaagtgggtttctacagctccgcgtgtccatctgccgaggaaatagtgagaagcacagtaaacaaagcaatttcagacaacgcgggcatagctgctggactcattagaatgcatttccatgattgctttgtgaggggttgtgatggttctgtgttactagcatctgcaccgggtaatccaatagccgagagagacaatttcgtgaacaacccaagcttgcatggcttcgaggtgatcgaggaggccaagacccaattagaggctgcatgccctcaaacggtgatgaagtgccccagaatctgcctgcaccaacctccagtgcagatgaaatgcaagtactatgaggggttgatcaaccaccgtggcgcacgccagtcaaaccacaagggaaatggttcaaagcaatgctaa

SEQ ID NO: 71006 - DNA, 282 bp, Glycine max
  Peptide Sequence Number=SeqID_187784
atgttaataaatttaattaacaaggcagcggtgcatccttatctcactattggagccagcttaaatcgtgaatcctatctttctctccatcctatcccttcaaaccccaaatcccctccacctccactttgtctcctccccggtgaaagtcacagaggagtgttgccgccgcatggagcctacactcttcgccctaagtcacacccaattcaaacaaccccgaaatcccaatccgcaagaacgactttgacggcagatttggggatgaaggctaatttctag

SEQ ID NO: 71007 - DNA, 807 bp, Glycine max
  Peptide Sequence Number=SeqID_187785
atggagagagaaagggaaaaagggggaccggggcacatgcttgtttcaaagggagaggcagcaaaagccaatgacatagcgaccacgaggctcgtcgtcccgccggccggaattcccgtggccgccgccggacaacgaggcaagcaaattgaggtggccggggaggtaattcccgagcctggcggccgaggcctctcccatggcggcctgctggtggtggtggtggtggtggtggtgaaacaaggaattctgcggcgacaccgacacgagttcgggggcggcgaagctccagacctggccgaagtcggggcggggagggagggcccacagggagggcggcgtggggggaacgacgagcgagacggtgtcgtctttggcggagttgtcgtcgtcggggcgaatgcgtttgccgaggatgaagggggtggggggagggaggaggggcttgtggtcggagacggtggagaagctcgccggagtggtgccggtgccggtggcggcgatgatggagggctcggcctgacggaggagccactcgatggtctggccgtcggacttatgaccgagctcgcgcgtgagctggaagacgcgcgcggcgcagatgatcggcatgcgaatgcggcggccgcggccgtcgaccttgctgtggcggtccttggacggcggtttcttgacggcgagggcggtggtggttggttgctggtggtggtcgacaactgtgttgttgttggagtggttggtggtggtgacggcgttagtggctccgtgagagttggacatgttttattatatggtgttgcggcgtga

SEQ ID NO: 71008 - DNA, 990 bp, Glycine max
  Peptide Sequence Number=SeqID_187786
atggataatactccaagattgattcaaacggtttcaagcttggttctgattctaagcatttcatcattggcctcggcatctctgaaagtgggtttctacagctcaacgtgtccctctgccgaggcaatagttaaaagcacggtagaaaaagcaatatctgccaacccaggcatagctgctggtctcatcagaatgcatttccatgattgctttgtcaggggttgcgatggttctgtgctactggcatctacaccgggtaatccaatatctgaaagagacaatttcgtgaacaacccaagcttgcgcggcttcgaggtgattgaggatgccaagaaccaaatagaggctgcatgccctgaaacggtatcatgtgcagacatattggcattcgcagcacgagacagtgtttccaaagtgggtggcataagctacgacgttccatcgggacgaagagatgggcgtgtctcgatcggcgatgaagtgctagacaatcttcctagaccatccttgagcgctgatgatcttattagtaactttgagcgaaagggtttgtcagcagatgaaatggtgacactctcaggagcgcattcaatcggtgtgtcccattgtggtgccttctcgaatcgcttatactctttcagtgacacagtcacacaagatccctcattggactcttcatatgctgaaacgttgaaaacacagtgtcccccaccaccacccacctcagacccaacagtgtctcttgaaccatccacgccaattcgtttggacagtaaatactatgagggattgatcaaccaccgcggcttgttgacttcggatcagacattgtacacgagccaatccacaaggggaatggttcaaagcaatgctaacaatggtgccagttgggctgacaagtttgccctagcaatgcttcgcatgggttctatagaagtgcttactggctccgatggtgagatcaggaagcagtgcagctttgttaattaa

SEQ ID NO: 71009 - DNA, 348 bp, Glycine max
  Peptide Sequence Number=SeqID_187787
atggaagatagccgccagtgggccaccaccactgaacgggaacggatcgtctgcaatttgagaaagctaaaccgttggataaaatcatctgcggtgtcaacgacaactacgcgatcgcggcggtttgtcaccttcaccttgaggcactttgattattactctcgctttttcgtgggaacagtttatttcggaaatagaggcaaaaaatttattgctctaggaaaaaggtgcagttctattggagaatccgttcatatgtacaaggcgaaatctgaaatcaagtatgccatgaaaagctatggaaattttatttcaagactaaccctaaggctatgtttggattgctag

SEQ ID NO: 71010 - DNA, 1737 bp, Glycine max
  Peptide Sequence Number=SeqID_187788
atgacaatggtgtttgggaaggttggaacctcaaaaacgaagaagaagaagaacaagaagaacaagaagaaaagaagaaatgttagggttaggatgcttaaacctcaatcgattctctcacttcccatccactccctctctaccatcctctcgttccgattcgctttatcagcgactaaaacacagcaatcttcagtcactaagccacaatccacctccaccgctataattgaaatagataacccagccagtgtcaaaaggcaactggcacaactgtttgatttgtctctgagggaaactgtgcctgatgagccacatgttgtgccattagttgatgcttgtgctgttaaaggtggtgcaaaatttggtgattatcaatgtaataacgcaatgggtatatggtctaggatgaaaggaaagcagacaggatttaggggtcccccggcaattggacaggccatcattaacaatcttcctccatctgaaatgatagattcgtgctctgtagctggtcctggatttgtcaatgttgtattgtcaaagaagtggattgctgagaatttttctccagcacctcctcgcaacgccaccatgtctgatcctccagtcaatacagttccttcgagtggtgacactggcagtactccgatcaggcaatgtgctaccgcgtgctccttcttcgcgacgttagaagatcacaatgcaggtcgcatctctgaagcatatctcaattgggagctacaggaccagctccttctctcgtggcttcaagccacgatttccagtcctgtgctcaagaagttgattggttgttctagctcatggcagctatggaataaggttcacaactattttcatgcgcatatgacagcgaaggcgagacagcttcgcactgaattgcgtcaacaaactcttgaagatccaatttctgtgaaggaacacatagatgtttgtagaaagaataataaaggaaacagaataaaacataaaagaaagtatggattcgtaagatttaagggggtggatgatgtgcaccagctagaaaggaagttggacaacattgtcttgggtgggctaaagttgtatgtcaacattccaaaatttggaagagctagacttggaatgccacaaccagcaacatggggtcgagcatatgctaggcaatatgaagaggagaacagaggtacatacccggcaatgaagcaaccagtggtcccgggactgaagcaaaaatggcttagcgaagcatgggtggggagattaaagaacctggctttgttcgatagagttgaggaggacatcctatggaatctcggagctaacacatcgccgaaatatataggggatgacatggtcctgcttctcggcctcacagacgaaaaggcccggcaactgatggaggatgagaacgaacgaggggattcgatgatgcggcctgggtacaaactgacatgggtgcagtgttggggaatacctataatagcatgggactcgcagcaaatgaagaagattgtggccggtataagtgatttggtggatgttgatgacgatgtggaggaacttcggaagatggatagggagaggattctagtcaaaacaccatggaagctgctaatacaacatactgtcaatgtacacattcaagggcagatgttcccggtacacataacggaggaaaatgacagctactcaaatacttgccattgccggcacaacgcggagtacggctcatcgtag

SEQ ID NO: 71011 - DNA, 297 bp, Glycine max
  Peptide Sequence Number=SeqID_187789
atggggcctacatcgtccattgtgcgcttcacaacgtcgaagtcctacatgtccgtcgcaatcgtcaccaccacacaatccccatggcgaggtggatcgtgttctgcgcctcttttaacttctctgacgattgcacgaggattgagtcgtgcacacccttcaccacgtggtgtgccaacaccacatgacttggaacgaggctaccaaatctacaagaagcttctccaagccattgaggactttgtagtacaaattatgagagtggtgagaaataaagtagaacataaaggtggttga

SEQ ID NO: 71012 - DNA, 645 bp, Glycine max
  Peptide Sequence Number=SeqID_187790
atgtacatgttcagtggggagagtggagcagggaagactgagacagcaaaaatagcaatgcagtacttggctgcccttggcggtggaagtggaatagagtatgagattttaaagactaatccaatactagaagcctttggcaatgcaaaaacattgagaaatgacaactcaagtcgttttggaaagctcattgagattcacttcagtgaaactggaaaaatctccggtgctaatattcaaacttttttgcttgaaaagtctagagtagtccaatgcaatgaaggggaaagatcatatcatatattttatcagctatgtgctggtgcacctccatctctcagggagatatatggcaggagtattactcgtggattgggctttcttctgcagcattggtactgtgaaagcggcagaattgatgggcagaggtggatggtgttgtgggctgctgtaacatggtgtatttggcgtcataggaacaagtgcaattttaacaaccgggaattccaaggggaaacagtactgaatgatgcaatgttcttcatttggttgtggatgaaggcactggaaaacggttttaatgtcccattccaagtatggagtagtaatgctagaatgaattttgtaaggggaggagtgcggtag

SEQ ID NO: 71013 - DNA, 867 bp, Glycine max
  Peptide Sequence Number=SeqID_187791
atggaggccattgatgcaagagatgctttggcaaagtcaatatatgcatgcctgtttgattggttggttgaacagataaataaatcacttgctgttggcaaaagacgtaccggcagatcaatcagtattctagatatctacggctttgaatctttcaataggaacagttttgaacagttctgcataaattatgcaaatgagagattacagcaacacttcaatcgtcatttattcaagttagaacaggaggaatatattcaagatggcattgactgggctaaagttgaatttgaagacaaccaagactgccttaatctttttgagaagaggccactgggtttattatccttgttagatgaagagtccactttcccaaatggcacagatctaacacttgctaacaagcttaaacagcatttgaattctaattcgtgcttcaaaggagaaagagaccaagcctttactgtacaccattatgctgggcaggtaacctatgatacaactggatttctggagaaaaacagagacctattgcacgtggattccatccaacttctatcctcatgcacgtgtcctcttcctcaaatatttgcatctcatatgctcactcagtctgataagccggtagttggtcccttacacaagtcaggtggggcagattcccaaaagctaagtgttgcaacaaaattcaagaagagtatggatgagtatccactaagtgagaaactaaaattgccaatgaacaatgagaaaattcactcaaaacaagtgaagttcagaaaattagagactcattctctcaaaatctcatatcatgcagtcagtcatgctcttaattcagatttcaaattttcaatgcccagttga

SEQ ID NO: 71014 - DNA, 1299 bp, Glycine max
  Peptide Sequence Number=SeqID_187792
atggaagaaggtaagaggaagttggcgatgaagagaaagagagagagcacaggtggtggaaaagacagactgagtgagttgcctgactctgtattggtccacataatggaattgatggagacaagaaatgcagttcagacttgtgtactctctcagcgttggaagaacctttggagacgtatgactcgtctctctttcaaccaccctagaacattttccagatatcacaattttgtgtctcatgttctttctggacgagaccattctgtttccctaattgatcttctttttgtggtccttcattcaacttcggccacactcttgcatgacgtcatcagttatgctgtgtcgcacaatgtgcagcagttgacaatctatatagatacattggattgcattaacggtgccacaccctcctttcagctttccaaaactccttttgtccctctcctttttccctctccatctttgacttctcttaagctttccagtgtgttcattggatattctttggaacttccaaaatctctactactaccatctttgaaaaccttgcatctcacaaatgttcactttactgctagtgaccacaacaacaactttgttgagcccttttctacttgtcacatgttgaatactttggtcattcaatattgctttatgcacacttctgcacaagtcctctccatatccaattctaacctttcttctttgacccttgacacctttcaagaacacattgtgctttctactccgaatctcacttctcttacaatcagggatggtttccattttactcttctccaactctcctccacttgtgatctttcacttcttaaagaggcggatattgagacccgtgttgatatacattattcagtcatcattacctggctgcgacttatgactaatgttaagatgctcacaatctcttctgctacccttaaggcaatactaaatgacctatcagatcctgctgcagcgactgttcaacctccatgctttggtagattggagtcattgaaagtgaaaatgcatccacatgtaaacatatctaaggaagaatgtttacttcattttgtgattacctttctccccgacacactcttacagcaaatgatagattgctatattgtcagtatgcttgaaggaaatgaaacattggggaagatgaagagaaagatggaagagttacagaggacaaggacaggatcaatgataagtaactttgttgtgctccacataatgaaatttatgaacaccaaaagtgctgttcatacttttatgtcttggctatag

SEQ ID NO: 71015 - DNA, 1368 bp, Glycine max
  Peptide Sequence Number=SeqID_187793
atgatttcctctgtttgtgtccagggtcaattgtttcaactgatgcaacgactggagagtactactccacattttattcgctgcattaaacccaataatctccaatcacctgaatcatatgagcaagggcttgtattgcaacagctgagatgctgtggggtcctggaagtagttcgaatatcgagatcaggctttccaacaagaatgtctcaccaaaaatttgccagaagatatggttttctccttgataatgttgcatctcaggatccacttagtgtttcggttgcaattcttcatcagtttaatattttgtcggagatgtatcaagttggctacacaaaattatttttccggacagggcagattggtgtgcttgaagatactagaaatcgtaccctccatggcattttacgtgtccaaagttgtttcaggggtttccaagcacgtcgttctctcaaggatcttcggggaggaatcactactttgcagtcatttattaggggagacaaaaccagaaaggcatattcagctttacttaagaggcatagagctgctgttattatacagaagcaaatcaaagcagtatttgcaagaaacagaatgaggactattagtgatgctgcaatagtcatacaagcagttattcgtggttggttggtcagaagatgctcaggaaatattggatttttgaaatctggagacatgaagatgaaagagtctgatgaggttctggttaagtcatctttcctggccgaattacagtgccgagtacttaaggctgaagctgcccttagagagaaagaagaggaaaatgacatccttcatcaacgtctccaacaatatgagagcagatggtctgagtatgaactaaagatgaaatccatggaagaagtgtggcagaaacaaatgagatccctacaatctagcctctccattgcaaagaagagccttgctatcgatgactctgaaagaaattcagacacatctgttaatgcaagtgatgagcgggattacagctgggatgtgggaggcaatcatcggcgccaagaaagcaatggggcaagatcaacgagtgctggtctaagtgttataagtcggctggctgaagaattcgagcacaggagtcaagtatttggtgatgatgccaagttcttggttgaggtaaaatctggtcaggtagaagcaagtttgaacccagatcaagagcttagaaggttaaaacagatgtttgaagcttggaaaaaggattatggggcaagactgcgtgaaacaaaagttattataaataaacttggaagcgaagatggcgcacttgagaaaatgaagaaaaagtggtggggaagaaggaacagtacaaggataaattga

SEQ ID NO: 71016 - DNA, 342 bp, Glycine max
  Peptide Sequence Number=SeqID_187794
atggcgttcgacctcagatctacaaccgttcactccactctcctgaccttaaaccactaccaaaccgaggcggcacaccaccaaatggccagatctagatctcgggaaacagtggcatttagggcattgggatatggggttgagaaggagaataaagaaaatgagctgcaacaaaatattaacacttggtgctcacagaaacttaacagaaggactaaaaataataacagaccaaagcttaaggggcaaaaagtaaaaacctcaaaaagtttagggaccaaaaagatagttaacccaaaaaaacaaaatgatgatggtatgcagttcagcattcagaggtag

SEQ ID NO: 71017 - DNA, 681 bp, Glycine max
  Peptide Sequence Number=SeqID_187795
atgggagtgggaccagttaatatggtcatgattttgaacattgaaatgacgaaattacccttccattcgatgctctttgaattgaggaagcagatctcgtgctctttgcagttgtctaacaagactgacaactatgtggctttcaaggtcaagacaacaaatcctaagaaatattgtgttagacctaacactggagttgtgatgcctaggtctacttgtgatgtcatagtggaattcaatcgcaaaccgcatgtgacaatgcaagcccaaaaggaggcacctcctgacatgcaatgcaaggataagtttctccttcaaagtgtagttgctagccctggggcaaccacaaaagatatcactccagaaatgttcaataaagaatctggtcatgatgttgaagagtgcaagttgagagttgtttatgttgctcctcctcaaccaccatccccagttcgagaaggatctgatgaagattcatcccctcgtgcatctgtatctgagaatgggcattcaagtgctgcggaatttacaggggcttcaaaagctttcaatgagcggggtgaacatcaggatgcttcctttgaggcaagagctcttatttccaaggtaactgaggagaggaattctattgttgagcaaaacagaagacttcagcaagaactggtgtggaattcattctga

SEQ ID NO: 71018 - DNA, 1356 bp, Glycine max
  Peptide Sequence Number=SeqID_187796
tactctagtttcgttaacctcaacccggctctcccagtgaaccgctggcccgaaccgggtttggagattcagtggctttcgcccaaagaaaccgtgtgtgggtcccagcaggattgcgactccgccacgtcgacttgcgggcctgatgcttcttctgcgctcgggatcaggaggtgcttttgtaacgatgggctcgtctgggaccctatccaaggggtgtgcgctaaaaaaattacttgccagaaccctggtggttgtgacgactcaacaagcagaacggccataatagcaggttcagtatgtggggttggagctgcactcattcttgccgtcattgcctttctactctacaaacgccacaggcgcatcaaagaagcacaagcacgcctagccaaagagcgtgaagggattctgaatgccagtaatggtggcagagccgctaaacttttcagtggcaaagagttaaagaaagccacaaacgacttctccagtgaccggcttctaggtgttggaggctatggtgaagtctacaagggcattcttcaagatggcactgttgtggctgtcaagtgtgccaagcttggcaaccccaaaggcactgaccaagtcctcaatgaggttcgcatattatgccaagttaaccaccgcaaccttgttggtttacttggttgctgcgtggaactggagcagcctattatggtttatgagttcatagaaaatgggacacttcttgatcacttgcaaggtcaaatgcctaagagccgtggcttgcttacatggactcatcgccttcaaattgcacgtcacaccgctgagggtctcgcttaccttcacttcatggctgtgcctcctatctaccatagagatgtcaagtccagcaacattctgctagatatcaagatgaatgccaaagtttcagattttggattgtctaggttggctcagacagatatgagtcatatctctacttgtgctcaggggacccttggttaccttgatcctgagtattataggaactaccaattgactgataagagtgatgtttacagttttggggtggtgctacttgagcttttgacagctcagaaggcaatagattttaacagggctgccgatgatgtgaacttggcgatttacgtgcatcggatggtggctgaggaaaagttgatggatgtcattgatccagtgttgaagaatggagctaccactatagagctagagacgatgaaggcagtggcgtttttggcattgggttgcttggaggaaaagagacagaatcgaccttcaatgaaagaggtggcagaagagattgagtatatcattagtattgcctcggcaaaggtagtggagaactag

SEQ ID NO: 71019 - DNA, 375 bp, Glycine max
  Peptide Sequence Number=SeqID_187797
atggccaagaaatttgtagtcggctttgattacgcagcttgggctgccgataaaaccttccaagttggggatgtacttgtatcaagtatgatgttggagaacactgtgttcaaagtgaatggaacagcattccagagctgcacgactcctccagcaagtgaagcattgtctaatggaaatgaccgtattgtattggcaattcctagcagaaaagtgttgttggtcactgcaatgctggccaaaagcttgttattacagttcaaccccaaacactgcctccaactctaccaccatcaccttcacctcgtcagcatcgccctcattttagtcgatgggtgcctattatttttcatcaaacttcatttgttggtttaa

SEQ ID NO: 71020 - DNA, 252 bp, Glycine max
  Peptide Sequence Number=SeqID_187798
atggaagctctgtcaaaggaaaaacaacttggcattatggaattcctcagcctcgtgaagcagatgcaaggggtttacttcaagctcttatttggctctcagatatggccatatgggagtgcatatgacagcttacacttctcttctactgctctctcaaatttccatttgcttttagccaaatgtagaaattatctaagaaattttccaaactcttttgttagaacatcttcaactcatgtacttaaatga

SEQ ID NO: 71021 - DNA, 210 bp, Glycine max
  Peptide Sequence Number=SeqID_187799
atggtgatggagctgctaacaacattagcaacaagccaacaacgacgaaatcatggagtagtagccaagcacactggttgtgatgaaatcaccatcgagttctgtcatgacaaggtggacaagaatagatggtgcatcaagttaagaaaaaactatgtggaacaaagtggggaaaatgatgaatccaacaatgaattaagtataatctag

SEQ ID NO: 71022 - DNA, 219 bp, Glycine max
  Peptide Sequence Number=SeqID_187800
atgggctgtggggcccaggaggagggtgttgttgtggaatttgtggtgtttgaggttgaggttgcgctgccagagaggggtgcgatggcgaaaggtgtgttggctaccgatggagcaaggggattggagggtgtaatgggagatgaggtggaggaccttcgtgacggcgttgtttgtccatggaagggagtgggggttgcaatttacaaatgggtgtaa

SEQ ID NO: 71023 - DNA, 621 bp, Glycine max
  Peptide Sequence Number=SeqID_187801
atggaaggatccaagttagagatcatcagcgaggtgagagtggaggataatattgatcataagtatgttcgtattccaatccataggttaagaaccagaagacttaaccttgcgctaagggttaagccaaagaaaacctcaagcacatcaactaaaaagaaggaccaagagctggttattgcagcattcccatggcatgaagtgttcatgtttctgaatcaacaattccttggagcccttcaagttgagtatcaaaacaagaccaaatcgcccttcgagacacacccaattcacatgtggactttcctaacttccatatgcttttacagtgtgattcttgcattcaaaatcaaccttaaggcttgcagtaatgaccactttgcttttatcctcaaacatgttcttcttgtcttgggttcactttcctcagcctccttattgtgtatcttccaaccaggccagcatttttggtttctctatgtcatagggatatatatgccactaatgctggctcatcacttgctccaaaatcaagtgttgaaggttttgggaactataatgacttcagcttcccaacttcgagactatctaaatatgttttgtggatgcatagggcagtga

SEQ ID NO: 71024 - DNA, 2283 bp, Glycine max
  Peptide Sequence Number=SeqID_187802
atggcgggacaattctcccttaagctctcgaaatgtaccttcgcacaacagcagttagaatatctcgggcacatgtggccaacacctcgcaccccacgagctctgagaggatttctcggcctcgcagggttttatcgaaggtttatccgagggtatgcagccttggtagcaccactcacaaagcttttgtgccattggcagtttagttggaaccaggaggctgatgatgcatttcaaaatctcaagaatgccttcacggcgacactatttctggcgttacttgatttcagtgcaccatttgtggttgaaacggatgcatcaggttcgggtatgggggcggttctgacgcagggaggccatcctctggcttacttcagtaagcaattttgccctaaattactgaactcttctacatacgtttgtgagttagcagcaatcacgacaacggtccggaagtggtgccagtacttactggggcaccacttcataatattaacggatcatcgcagcttacgtgaactcatgaaccaagccattcaaacaccagagcaacatcgatatctagccctcctgctaggattcggctatacaattcagtaccgagtaggaaggtccaacgtggtggctgacgcgttatcacgagtcatggaaggccaagctgcctctctttatctcttatctatgccacaatttgtcttcctcgacgatcttcgtaaggaactagcttctcttgcgacattcctagacctacatgatcgaattcaagaggatcctgtggcatacacggattatacgctgactgaagggctcatcctacacagaggaggcatttggcttccctctaactcttccttcatcaagcttttactagaagagttccaccaatctcctacgggtggccatatgggagtgcagaagactctacatcgcctgcaagataacttcatatggccttcgatcaaagaagatactcgaaattttatcgcgggttgcgtgacatgtcaacacaccaaatatgataaccgcaaaccagcatggcttcttttccttcttccgattccgacgcgactgtgggaagacctatccatggacttcatcactggtcttccagcgtatcgcgacagcacgtgcattttcgtggtggttgatcgattctcgaagggactgcatttaggcatgctacctactcaacacactgcacatatggtggctcttctgtttgtggacatggtggggcgactccatggcatgcccaagagcattgtttcggatcgggatccattgtttatcagcaagttctggagagaacttttcacgttgagtggcacgaagcttcgcttaagttcctcgtatcacccacagtccgacgagcaaacagaggtagcaaatcgcatcgtggaacaatatttacgagctttcatgcatgagaaaccatcgacgtgggggagttacttaccttgggccgagtggtcctataatacatcatgccactccaccacgggtatgacacctttcgaaattacttttggccagaaacctctcacctatcctcaatacattttcggcacctccaacgtagaagcagtggatgagatactgagtcaacgcgaagttgtttttgagatgttgcttcgcaagttactcaagactcagtcccgtatgaaagctaacgctgatcgtcaccgttgtgaccaggaattcaaggtgggggattgggttatggtcaaactcagaccacagagacagatatcagtgactggcaccacttattcgaaactgggtaaacgatactatggccattttcaagtcactgagtgcatgggtaaggtagcctacaaattgcaactcccggagtactcgcgcatccatcccgtctttcatgtttctcttctcaaaccttatattgcgacgaccgccgctcccaccgccgtggatcttccacctctaactttcgacaatcatccggttgtcacacctctggccattgtggcgtctaaggtcattccatctgaggccggacctaaacatatggtgctggttcagtggcgggggttaccaccagaggagacctcatgggaggaatggtctgctttgaagattcttcaccaccttgaggataaggtgttgctcgaagggcacgggagtgttacgagaaagaatactgagggggtcccgttagcaagggaggtgcaggtagaaacaagaacaagaccactcagggtgaggtccactccagcatatttgaaggagtacgaaagaagccatgcagagtggggcgcgtag

SEQ ID NO: 71025 - DNA, 1782 bp, Glycine max
  Peptide Sequence Number=SeqID_187803
atgcagagtggggcgcatagctggtgcgatgaacgtaggttagcctcagtgatattagagggtaagaatgaaaaagggaatctttctgttaaagcttttgttagttgttcagcttctgttagttatgttagaaggtttcttgggccacgaataccaagtataacagtggtgctttcattgatcatcaatggcggactcaacgcgctccaaagcatcagtgatcatcttgaggatgcaattgcaaaactcaccgcttcacaactcaccatgaatttgaagattgatgatcttctccaccgaatgtcgcaactcgaagcgaatcagcaaaaatcgcagatgccattgatcttcaaaatcacgcaatttttcgagtatcattcgacgccggatcaagagaggttaatgatagcttccttctacatggagggaccagcacttgcatggttccagtggatgcatcgtaatgcgcagttgtcatcgtggtcagccttccttcacgctcttcattcgcgctttgctacgacgatagaagtgcaggtgttacaacctatttctttagctcaggcagtgtcgtacacaagattgcaggaggaaaagctccttgatgctcgccggccttcatcgtatcgcacaccaacttccatggcaggatccaccactacacgttcttcatccaccaatgctacaccatctctgctaccaactccgatatggacttcaacatccattccctttaaacgattaacaccagaggaattggcaattttccgagaaaaggggctatgttttcattgtgatgagaaattctctcgaggttacaaagttactaccgaaatcaccaccggcacagctgagcctgcacgcgttatccgtacacacaatttcctccataatcgtgtggtattgaaccttggattaaagccaatagaaacaatgccacttcacgtcacggtgggaaatggtgaggagattcgctatcatcagttgtgcacggccgtacaggtccatattcaacagcactctttcaccattgatttccacgtgttacccttgtgtagggttgacgtagtactaggggtgcaatggctgaaaacccttggaccagtcttaacagactacgatgcattaacgatgaagttcatcgctggtggcaaactaattgagttacagggggatcgcgagaaggaagtagagcaggtgtcaccttctcagttacgccgatttgtacacacaaaccctactagcactttttatcacattcgtgttgaatcagcagccaaacttactcctcaaacgacccaccccttacctgaaatcgatactttaataaccaaatatgcttccctcttccaacccctcatgaacctgccaccatcatgcccaacagaccacaccatcaacctattgccaaactcaactccggtgaatgttaggccttacaagtacccctattttcaaaagaaagaaatagaagaacaggtagctaccatgcttgcgagagggtttatacaacctagttcgagcccattttcttcaccagttttattggtaaagaagaaagatggttcatggcgattttgtgtggactatagagtcctcaatgccataacggtgcgtgatcgttttcccattcctacggtggacgagttgctcgacgaactgggaggggcgcattggttctctaaactggatttgatgcagggatatcatcaaatattgatgaacacaaccgatattagtaagacgacatttcgtactcatcaagggaactgcgagttttga

SEQ ID NO: 71026 - DNA, 471 bp, Glycine max
  Peptide Sequence Number=SeqID_187804
atggcttctcctcttgaaaccttcatttctccatggaatttctgcatcttaatggctatgctaaatttcaaaaatgtttctgaggctgagttaggcctcaaaattacactttctgaagaagctgagccactcgacactacaggccccttggctcttgccaaggatctgctgttagatgcttctcgggaaccttttttggttctaaatgcatatattaccaacgactatccactgaaacaaatcattgactttcacatagaacatgatggagaggctactgagttggtgagtcaggctactgaaccatcaaaatattgtgtggctattatggatcatatcactggattggttcagagttttcaagagataccacaaaaatttgttggtaacagagttaatgctggagtgtacttgatgaacccctcagtattgaatagaattgagttgacacctacttctatggagacaaag

SEQ ID NO: 71027 - DNA, 291 bp, Glycine max
  Peptide Sequence Number=SeqID_187805
atgcaaagtactcgtgttaaaaagcattctgtcatatccgagaatatcactgggtggcattccactgttggggaatgggctagtgtatatcagtgtatcattcaagaaggagcgcttgttggtgatgatattttagtccatggtgcttccatttcaaggttgcatccccagctctcaagaacatcctctgagaaatgcgaaataattgttccgattgcttgctatagtagttatttttacctatacctgcataacaaccaaggttggtcgacgactactagtagtaattaa

SEQ ID NO: 71028 - DNA, 168 bp, Glycine max
  Peptide Sequence Number=SeqID_187806
atgtcgcttgtggagcttggtgcgctccttctccttctccctctcctaattctcattgccaccggcagtgatgtggtggacgaggtgatggcagcgggggcggaagtggtagagatgaagactggggttgccctaacccaaggtttgagatgttaccctgctttttga

SEQ ID NO: 71029 - DNA, 174 bp, Glycine max
  Peptide Sequence Number=SeqID_187807
atgtcgctagcttttaatgagaacgacaaaaatggttcaatcccagcaaaaggtttatccataagcggtgctatgtataaaccagaatcccgaagccttcagaataaagtgcattgcattgattcagcattagagaaacaaatattctacacatacagatatgcgaaacagtga

SEQ ID NO: 71030 - DNA, 207 bp, Glycine max
  Peptide Sequence Number=SeqID_187808
atgatgttagtctccgcgcgtcaacgggctcgttcgcccccggttgatgaaagaaattgtctgtgtacggataacactcggggtatctccatacgtcacctgacttcatgggtcaggatgacagaaagcgcggaagacgatgtaaatctccgcgtgtcaacgggctcgttggccgcgattgacaaagggtgcagaagacgacgttag

SEQ ID NO: 71031 - DNA, 276 bp, Glycine max
  Peptide Sequence Number=SeqID_187809
atgaacagagcagtggaggcggccaataagaatattaagaagattatccagaagatgaccgtgtcatacaaggattggcacgagatgctcccattcgcgctacatgaagtctcccaagccctgaaagacaacaggggaaagtgggccccgaactacgaagggcctttcattgtaaaaagggctttctccggaggggccctggtgctcgccaacatggatgacgaggagctaccttcacccgtgaacttcgacgttgtcaagcgatattatgcttaa

SEQ ID NO: 71032 - DNA, 174 bp, Glycine max
  Peptide Sequence Number=SeqID_187810
atggggggaagaccaaaggactccgtccttggtgcgctaagcgcgcttggctcgcttagcacagagaagaatgcacttagcgagactacgatgcttagcgtgctcattctggaagaggtacacaggctaagcacccctcatgctaagcctcaaccaccctacacctgggcttag

SEQ ID NO: 71033 - DNA, 586 bp, Glycine max
  Peptide Sequence Number=SeqID_187811
gaatttacaagatagtggaactcttaagcggattgcttggggactggacgtaggcacaagggccacttgtccaacactggagaggaatgtcgagctcacacctaccatgttcgacgaattctatggagagctccagcgccaacagtggcatcgcaagctcacacgcctcccagagaagaggattgacgttgctctagtgcgtgaattctatgcaaatgcctacaacctagaggacgactcgctcaaatactgtagggttcgggggcagatcattcggttcggcatgaagacgttgaacaactttttagaggcccctgtcatcattccagagtgggaggagtaccccacatattcccagtacctgcacaactaccttaatcaccaggccattaaggccaagctatgcacggcaggcagacagttcattctgaatgccaatggagccccgtggaagctactcaggaaggacctcaccacactggctcagacttggagcatcctgagctgcttcaacttggctcccacctcccacacctccgatctgaacatggacagggcacgtctcatctataggctggtgtcataa

SEQ ID NO: 71034 - DNA, 453 bp, Glycine max
  Peptide Sequence Number=SeqID_187812
atgacattgagattggcaagaagaaaagggagattggttgcaatggaatatgggtgtgagcggctccccatgcttgagttcctcatccaatctgctcatgttttgaattttgagattggcacaacaaatattgcctttctgttccttgaagatctttggattcaattcaagaaagtggccaaagttggcgaattgattagcattgaaacttgcatggaaattatggatcttctctacgaaaaagatgaaatgtcgtttctttttaggtctcctcactccctttctgcatcaatcttggttgcctcatatgtaatggcggttcctaaacagaaatggggatttccagttcttgcatgggttttaaccttgtatcaaccttctaatacaagcatatccatgtaccgaggaactaacaaatggatttttgttagtaaattttgtgacctcacataa

SEQ ID NO: 71035 - DNA, 204 bp, Glycine max
  Peptide Sequence Number=SeqID_187813
atggccatatcctcaagaggaacacgagcacaacaactcgctagtccctccaaccttcatggagcgatattcgattctagagaggttctccaagacttaagcctctatgatagagtccatcattgtggaagcaatgccttccaagattattttgatgatgccaaagaatcaagagttaagcaagtcccaaagaatcaggagtaa

SEQ ID NO: 71036 - DNA, 306 bp, Glycine max
  Peptide Sequence Number=SeqID_187814
atgacagggacaaaccttcctctacacaggggggttttgattgatctccgacaaggaaagataatttggaggttgggcaatgaggagaaagtgtttgatccagaaattaataacttctcctcctctcctacatgtaattttgttcaagccaccaacaagatgaagactattgtggctaagccttatccatgtgtggggaaggaagaccttccaagaaagaaaatccttccaaaagaccctggatggagtaagaaaaagggagataggatcactattcaagctcttgactatggagtggatcaatga

SEQ ID NO: 71037 - DNA, 405 bp, Glycine max
  Peptide Sequence Number=SeqID_187815
atgaagctaacgatggagctaatgaggggaaacatgttaaaaggatggcatgaaggagcaatcaaatttgctccaacctacaagtattgtccaaattcagacatgtactatggatgttgttaccaaggcaaaaacgcagcgaagaagcgagcaccagcatggtgtgacagaattatatggtttggcaacggcttaaagcaaattcagtatgctagatgtgaatcaaaactatcggatcataggcccgtcaagacattatttatagcacaagtcagggtttcatcagcactaaaatgctttcaaagtttgtttctgtcagagagatttgaacaaattaaaacccactttggacttctctccaatgatgagtttgtatgtaaaaagcaattaagtttccggttgtga

SEQ ID NO: 71038 - DNA, 282 bp, Glycine max
  Peptide Sequence Number=SeqID_187816
atgaaaaataaaaaggaaaacctctttaagaaagagatggaccttggaagcagcggtcttgcaattgtctcaagaagtccatctggatgtaaagctttctatcatcatctgatggtgctactcgaatctggcatcctgaggatccatgcggttgagtaccattgcctgatatgtgtcaaggcttcagttgatcaaggcggtgcacgccaaatgcctaagcaggctgctcttgatgctcgggctcctcctcaatcgatgtcactggtgtacctgaggcagtga

SEQ ID NO: 71039 - DNA, 855 bp, Glycine max
  Peptide Sequence Number=SeqID_187817
atgactggaaagctagttgaattcatgtggcctgcattagtggctaataagatactcaacaagcgactcggaagcagcaattttatagcagattatccaagtaataatacagatatacccttattgggtcacgatcagtcatctctgagctccaaatccattcttaatgatcacaaggatacagacaaatacaagatttttgtcagcacatggaacgtgggtgggattgccccagatgaaggactgaatatggaggatttattggagacatccaacaattcctgtgacatctatgtacttgggtttcaagaaattgtgcctctaaaagcatccaatgtattggggtatgaaaacaataagatctctaccaagtggaattccataatcggaaaagctctaaacaagagcacacatcacagtttcagagatgataaaaaggaggaggatgtgaagaacaatatttgttgcaataataaggaagctggaaataataataataatccaggtcagcagtgtgaagccccacaagatttcgaatgtatcattagcaagcaaatggttggtatattgatatcagtatgggctaagagagaacttcgtccattcattcaacattcaagtgtctcacgtgtcggatgtggcatcatgggctgcttagggaacaagggttctgtatctgtgagatttgtgttacatgaaacaagcttttgctttgtgtgttgtcacctagcttctgggggaagagagggggatgagaagcatagaaactctaatgttgctgaaatattttcaaggtcaagctttcctagaggtcctatgcttgatttgccaagaaagattcttgatcatgagtaa

SEQ ID NO: 71040 - DNA, 162 bp, Glycine max
  Peptide Sequence Number=SeqID_187818
atgatgatcgcgatcggtcctagcggtgttgtccatgctcttcagctttcaaaatccatcaagccttgggcctatggattgactatggccctcttggtttatcacgatcctcatgaattgaccacgatcatgagtttaacatggctgctatcgggtccttga

SEQ ID NO: 71041 - DNA, 3198 bp, Glycine max
  Peptide Sequence Number=SeqID_187819
atgtgggatgaaagtgttgtacccagcataaattactctggagaaggttgcttagcattacccaagctgaacttacagttcttaacacttcatgattatcttcttcgaaattttaatctttttcgacttgagtcaacatatgagatacgtgaggacattcaggaagctgttccacatcttcttgcatatattaataatgatggaggaactgcttttcgtggttggtcaagaatgggtgtgccaatcaaagaattcaaaatcactgaagttaaacaacctaacattggagaagtcaaaccatcatctgtgactgcagaggttacttatagcgtttccagttatagagcacatattagatcagaatgggatgcactcaaagagcatgatgtattgtttttactatctattcgcccatcatttgagcctcttagtacagaagaagaagacaaagctagtgtcccacaaaagcttggcctacaatttgtacgcggttgtgaagttattgagattcgtgatgaggaaggaaaccttatgaatgatttttctggaaagataaaacgtgatgagtggaagccaccaaagggggaactgagaacagtaactgtggctttggatacagctcaataccacatggatgtaagtaacattgccgaaaaaggggcagaagatgtttatggtacatttaatgtgttgatgaggaggaagccaaaagaaaacaattttaaagccatcctagaatcaataagggatttaatgaatgaatactgtattgttcccaagtggttggaaaacatttttcttggttatggggatccttcagctgcacagtggactaatatgcctgatctattggagacagtagatttcaaagacacttttgttgatgctgatcacttaaaagaaagttttttggattatgaggtgtcttttgttaatcctgatggctcaggaaatttgaatccaaggcctccttttaagatcaagcttccccgaacactcaaaccaaacaatggtgctcttactgggcatgcaatatctacttctggtgcaacaaatgaaatcaatgtggttgatgctaattatcagaaagaagcactaattattgagacatatactcctccagatcctggcccctatcctcaagatcagcctaaacaaaattcagttagatttacacccacccaggttgaagcaatcatctctggcattcagcctggtctaactatggttgtggggccacctggtacaggaaagactgatacagctgtacaaattctaaatgttctttatcataattgtccttctcagagaaccttaataattactcattcaaatcaggctttgaatgacctgttcgagaagataatgcagtacattactaagtgcttattttggggaaggggaagctctattattgctcctctttgtaagagggcaagccttgacacaaggagagatgttcctgcacgttatcttcttcgacttggtcaaggagaacaagagctagcaactgatcttgattttagccggcaaggtcgtgttaatgcaatgcttgttagacggttagaattgctgagtgaagtggagaggctagcaagatctcttcaattgcccgaggatgtgggttacacttgtgaaactgcaggatacttttggttgcttcatgtttattcacgctgggagcaatttcttgctgcttgtgctgagaataaagaaaagtcaacatttgttcgagatcgttttcccttcaaagagttcttctgtgatacaccacatcctgtatttacaggtgagtcttttgagaaagacatgcgggctgcaatggggtgctttcgtcatcttaagaccatgtttcaagaacttgaagagtgtcgggcattcgaattacttaagtcaacagctgatagggctaactacttaatgaccaagcaggctaagattgtggcaatgacttgcacccatgcagctctaaagaggaaagatttcctccagttaggtttcaagtatgacaacttgctaatggaagaaagtgcccaaattttagaaattgagactttcattccaatgttactccagcggcaggaggatggtcatgcacggcttaaacgctgcattctgattggtgaccatcaccagttgcctcctgttgtgaagaatatggcttttcagaagtacagccacatggatcagagtctatttaccaggtttgtccgattgggcattccttacattgaactaaatgctcagggaagagccaggccaactatagctaaactttacaattggagatacagagatttgggagaccttccttctgtaaaggaggaagtcatattcaatagggcaaatgctggatttgcttatgattatcagttagtggatgttccagattaccttggtaagggggagacaactccatctccttggttttaccaaaatgagggagaagcagaatatgttgtcagtgtctatatatacatgcgtcttttagggtatcctgcaaataagatatcaattttgactacatacaatggtcagaaacttctcatccgtgatgttataaataggagatgcgttccatatgactttattggtcctcctagtaaggttactacagtggataagtttcaaggtcagcaaaatgattttatattgctatctcttgtgcgtactcgatttgttggtcacctacgtgatgtaagaagattggttgttgcaatgtcacgtgctcggcttggtttatatgtcttttgccgtcgttccctttttgaacaatgctatgagctgcaacctacatttcagctgcttcttaaaagacctgaccaccttgcccttaatgtgaatgagattacatcatatactgaacgaaatgttgaagatcctggaccggggcatcatttacatcttgtcagtggcattgaggagatgggtagtatcatagacagactgtatcaggaaaagttgagacatcagtttgatcaaaatggggcttattttagtcatttagaaccatcagcaaatacagattgggtgcaaagtgggcagcagactatggacactgatatgcctgaacaaacagaggaagctacaactgttgataaccatgtcgctgtagatatgccacctgaaaacagcatggaagatgttaccatggttgataatggtcccagagttgccacagggaacccatcgccatag

SEQ ID NO: 71042 - DNA, 395 bp, Glycine max
  Peptide Sequence Number=SeqID_187820
atggggatctgcaaaacaaaggactttgacgctcaatgtgtggatcgtgttgagggttcaatgaaacctggatcgagtgtctgtgctcctattgcaaggttgacgtggagggttgacacgcgtctcagagtgccattatctgatgttcagggtagttgtcttgacaagtggagggcgaagagtttgtcgagcccccaagtgtggacgagtgtttgttcaatgtcgggtgtgacttgtcaagcccccgagcctagacaagtgtttttcggactgcttctgtcaagttgtccgggaggaacatgtctttggcgtgtcaagtcatctctattggcggttcctcatcagaggatacttgctgaggtgcctttgacagcaagtcctcctcttcggagagg

SEQ ID NO: 71043 - DNA, 486 bp, Glycine max
  Peptide Sequence Number=SeqID_187821
atgccatggagcagagttggtgggactaaaatattgggaaatgataaagtccagggggatcttggttttcaattagctcatcaattgatcaaaaaagcattgaccatccccggggcaactgttcattggtatgataagccagaaatgagaaagcaacgaaagatgggccatataaccattgttgggccttcctttagcaatattgaaagcaatcttgctgtattggtggaagggaaagaattagatgccaagactgcagttggtgttcccttggacagcttcttttatcttggaggaccgaacattgcctcagaaatttacaacaaggaatatgcaaatgctcggatgtgtggggaagaaaaatggaggaaaacattggtaaagtttttgaggcaacctcactattggagcaggaaatacataatatccattctctttacttttgatatggaaatcactaagacgttaaattcttcattcaattga

SEQ ID NO: 71044 - DNA, 654 bp, Glycine max
  Peptide Sequence Number=SeqID_187822
atgcaattcccaagtccagatgcagcttcacaagtgggactactgcataaggaaattgttggaaaagttatgatttatgagttgtataaagctgttgaaataggaaatgtggataactttgttgaagtgttgaagcaacaatgtattgaaatcaccctagcaggtgattcactgcttcatgtggcagcagatttggggaaagaagagattacagagctgattgctcatcactttcctgagcttcttattaggagaaacgtaagaggcgatactccacttcatgttgctgtgaggtctaagaactttactagtactatagtcaagttcattctctcccattatgccacttctaagtcaaaatatgatgagatgaaagataaagaaataacaagagaaagaaatgaacatggtgacactcctttgcacgaggctgtctacagtgggcatgttgatttggttaaagagattttcggtgcagatatggctgcagtccattgtttgaacaaaccaaagcgatcaccacagtgtgcggcagttgagagtgggaaagtggaaattcttaaccttttgttgcaaattccattccctgcagatcagccgctttcagtgtcgtggaagttctccactccatgcagctatacagaaacaaaatga

SEQ ID NO: 71045 - DNA, 414 bp, Glycine max
  Peptide Sequence Number=SeqID_187823
atggctcctacctcagatatcaatcatctttctcatccttgtatatacggggactttgtttcttcatacacagagagaaagtctggttttatgaaatggtttggtaagattttcaacattggatccagtagaggaaggggtggtggtcgtcatctgcagcagcctgttgaggaaaacatggtttggcctgctcctgctagatccttggatgaccgtgctagatctcggaaggaggaagaggatctagatcacgcaattgcactttctttaggcgaaaattttaagagaccaactggatatagatggcgaacaggaactgatgaagattatgcaaaggctcttcaggatcgcaggttctcatctgcacatcctccatatgcccctgtacctttttatccccggggatatgggtaa

SEQ ID NO: 71046 - DNA, 1269 bp, Glycine max
  Peptide Sequence Number=SeqID_187824
atgaatagaaccatcctaaaaagagtgacatgcatgcttcttggagcaggagtccatcgatcatctgcccttgaatacaaaacaccaatggaggtttggagtggaagtccagtagattactctaacctaagggtttttggagccttggcatatgcatatgtcaagaaggacaagttggatgctcgagctgtaagatgtctatttcttgggtatgttgaaggagtcaagggttacaggctgtggaggttggatccaaaaccttccaagctcatcatcaacaaagatgtgacatttaatgagacaagaatgcgaatgtattctgaaaactcagaatgtggaaaggagaaaactcacattaaggtggagccttttactgataaggaaactggacactcagtttcaaatttgaggagatcagatcatgccattaatgattaccaattggttcgtgatagggaaaggagaattcctaaaccaaaccgaaagcttggtcaagctgatctcatctgctatgctttaacagcaactgaggaaattaaaggatcagcaaaaccaaggaatttcaaggaggcacatgaaagtgaggagagacaactttggcttcatgcaatgaaagaagaacttgaggtactcaggaagaacaatacctggaggcttgtggaactacctaagggacagaaggtagttggtggcaagtcgatcttcaaaaggaaaggtgaaattctcggggttcagaagacaagatacaaggcaaggttggtggctaaaggatttactcaagttgagggtgtgaattacaatgagatatttgcacctgtggtaaagcactactctatcagaatcttgatgtcaattggcaaccagttcaagctacacctagaacaattggatgccaagacaaccttcttacatgtagacttggaggaaaccatttacatgaggcaaccaaaaggctttgctgtggatgatagggtatgcctcttgcaaaaatccttatatggcttgaaacaaagcccaaggcaatggtacaagaaatttgatgatttcttgataaagatggagttcaagagatgcagctatgatagttgtgtttatgttctgcaccaggagaattatctatatctcctaatgtatctagatgatattttggtggctagttgcaacaaatgtatgatcaatgacctaaagtcaaggatgaactcagaattcgagatgaaggatcttggggaagctagacgaatccttggtgttgatattaaaagagattag

SEQ ID NO: 71047 - DNA, 315 bp, Glycine max
  Peptide Sequence Number=SeqID_187825
atgaagttctcgaaaagccaaggtccaatatcagatgatgataggaagaagatggatacagttccctgtactagtggggttggaagcatcatgtatggaatggtctgtacaagaccagacttggctcatgctgtgagtgttgtcagcaggttcatggtggaacctggtcaagcacactgggaggctttaaagtggatattgagatatataaatggaagtttggactcaggcttactgtatcataaaaactctcaaggtggaacagtaattgaagggagtgaaacaaggtctatggctgaaagggatgctacatga

SEQ ID NO: 71048 - DNA, 1014 bp, Glycine max
  Peptide Sequence Number=SeqID_187826
atgacgataccaataaatgctgctggtttgattgaatatagatgccacccctattggaaccaaaagtattgcccatctcatgaatatgataatacagctcggtgctgtagttgtgaaagattagagtcgcggggtgaaagatactatagattggaagatggaaggattttgtgttttgagtgcatggaatctgctataacagacactggtgaatgtcaacccctttatcattccatcagagactattatgaaggaatgaacatgaaaattgatcaacaagtaccaatgcttctcgttgggagagaagcacttaatgaagccattgttggggagaagaatggcttccatcacttaccagaaacaaggggcttatgcctttcagaagagcaaactgtcacaagtgtatatagatggccaagaattggaggccatcgattaataagcatgagatctcaagctcaaaggctgcctagaaaatgtgaagttacagctattcttgttctctatggtcttccaaggttactcacaggtgctatacttgcacatgagttgatgcatgcttggttacgcctcaaaggttaccaaaaccttagtcttgaagtagaggaaggtatttgtcaagttctttcttacatgtggcttgatgcagaagtcatgtcatgtgctagaaccacgccctcaacatcatcatcagcttcttcctcctcttactctaactcatcaaagaaaggtgtgaaatctcttgttgaaaataaattgggtgagtttttcatgaaccagattgccaatgattcttccccagcttatggtggtggattcagagcagccaatcaagctgtgaataaatatggtttacgttgcactttggagcatattcgtttgactgtttccaacatacttattcacaatttggtgccgtgtgaaggtggcgttgggtggtggcatttgggtgcggcgatggtgttgggcggaggttttggggagagacaattaaggcttttgcttggaagatga

SEQ ID NO: 71049 - DNA, 1392 bp, Glycine max
  Peptide Sequence Number=SeqID_187827
atgttgaccgtgtctcaattcatcccaaatctaaagccatgccacaatgatatatgcgaccgaccaagcaaggctcataaattggttttctttcttgccctttacagtatcgccttgggtactggaggattcagaccgtgcttagaaagctttggagcagatcaatttgatgatgaccactttgatgaacgaaagaagaagatgtctttcttcaactggtggagctttacactcagtgtttcttcgatgctagcgacaacagttgttgtttatgttcaggacttcgttagctggggagatgcttgtctcatcctcactatgttcatggctctcactagcattgctttctatgcggggatacctttttacaggtacagaatgaagccaaaaggaaaccctttcatgccaattctccaagtcctaattgcagccataaggaaaaggaatctatcttgtccatcaaatcctgctttattatatgaagtcccaatgtcagagaattcccaaggaaggcttctaagccatactagaaggctcaggtttcttgacaaggctgcaatagttgaagagaagtatactgaacagaaagtcagtccatggcgattagcaacagtgacaagagtggaggagacaaagcttattctaaacgtatttcccatatggctaacttcattaatgactggtgtatgcatagcaaatggctccacactctttgtcaaacaagcagctgctatgaacttaaagataaacaacaacttcaaaatcccaccagcttctatggcgtccgtttcttctatttccatcataatatctgtcccaatatatgataggattattgttccaaatctaaggaaagtcacaggtaacgaaagaggcatcagcatccttaggaggattggcattggcttagcattctcagtcatagtcatggttgttgctgccttcgtagaaaatatgagattaagaatgtctggtcatgagaatttgatgagtgtgatgtggttgataccccaatacttgatccttggcattggaaattcattttattcaattggtttgcaagagtttttctatgatcaagttcctgactcaatgagaagcttaggaatggctttgtatcttagtgtgcttggaataggattcttcttaagcagctttctaataatagttgtggaccatgtcacagcagggaagaatggcaaaagttggattgccgaggatgtaaattcaagtcgtctagataagttttattggatgttggctgtcatcaatgctttaaatttctgtctcttcctattcttgacaaagaggcacacttataagaccgtacagaggaaagctacggaaatagatgatggttgtcacagtgatggggtggatacagtggcatga

SEQ ID NO: 71050 - DNA, 222 bp, Glycine max
  Peptide Sequence Number=SeqID_187828
atggccaacagtgaaggaaagaatggccaagagggaaacaaattacaaactgataatatgacacttaaatgcgaaaacaaaatccccggcaacggcgccaaaaacttgttaactcgttggcaagtgtaccaaatcgtcacaagtagtaaagttctcggaagtccgagtgtcgaatccacagggactttgtttgtacttagattaatgcaaaccccaatttag

SEQ ID NO: 71051 - DNA, 1425 bp, Glycine max
  Peptide Sequence Number=SeqID_187829
ttcttgaaccaacaagtggcgttgtctgtggaaaaaaatgcaaaggttaacaagatcattcaagaaatggcaacgaagtttgacattaagaagttctttggctccaatgactttggactatggaagatcaaaatggaagcaatcttgattcaacaaggatgtgatgaagtattgaaaggggagttgaacatgccgccaaccttgacgcatgcaaagaagaaaagtattattgacaaggccaggagtgcaatcatactgtgccttggtgataaggcactaagggaggttgcaaaggagaaaactgcggctgggatatgggcaaagttggaatccctgtacatgaccaggtctttggcccataggttgtgtctcaaacaacaactctattcattcaagatggcagaaacaaggacgatcgaggaacaactcgcagaattcaacaagaacattgatgatcttgagaatatcggagtgaaactagaagatgaagataaagttatcattcttctaaatgctttacctaaaacctttgagcactttagagatgctcttctgtatgggaaggatcagctaaataccttggaggaggtggtcacctcaattcaaaccaaagaattccaaaaactccaagattcaaagattacagaggaggttggccatatcaagaagcactgccctaagaaaggtaccaaggcctctcgggttactgaaactgcagatgttgcaaaagcttatgaaggatatgaatctgctggggtcttggtggcttcatctgatgattcacagaagagttgggtcatggactcaagatgcacataccatatgtgtcctgtaaaggattacttcgaggatcttgaacaaaaagagtatggaacagtactccttgggaacaacaaggcttgcaaggtgcatggcattgggactgtcagactgagaatgtacaatccagaactcaagagaaaccttatctctataagcatgtttgatcttataggatacattacaaaggttgagaatgggataatgaaggtgtctactggagcctcaatcattgctaagggaaggcgaagcaatgggctatacatcctggaaggatccacagtaattggacaagcatctgttgcaagtcaaacaatggaagataagtctaaattgtggcagttgcagctaggccacatcagtgataagtctaaattgtggcaccttctgatgggtgataaactccacaaattggagttttgtgaccagtatgtcttgggaaaatctcacagggtgaaatttgggacagatctatggggaccatttaggatccaaacacatgggggtggatcctatttcttgagcattatccatgactattcaagaagagtatgggtctacatcctaaggaacaaagctgaaacatctcagaagttcaaggaatga

SEQ ID NO: 71052 - DNA, 360 bp, Glycine max
  Peptide Sequence Number=SeqID_187830
atggagcaggaaatggagaagagaaagggaggtagaattgaagaaagtgatgaagagaaatgggtgcatgatgcatctgtggattacaaggaaagagtccctctccgtgcttccacagcaattgcacttagtgaaaggataacctactttgggatatcaagtaatcttatcatgtatctgactcgagtgatgcatgaagacctaaaaacagcaaccaataatgtaaactgctggaaaggagcaacaaccttgttgcctctgattgggggatttcttggtgatgcctacatcggtcgatttcgtatggtcttcttttcttccctcgtatacttcaaggtatattcatttttctttttgtaa

SEQ ID NO: 71053 - DNA, 306 bp, Glycine max
  Peptide Sequence Number=SeqID_187831
atggaattaagagaaccaggaaacatattaagtataagccggagttttggagcaggattcgggttctggcttaggatatggatatgtttaaggttcatttacacatttcttgggcttggagttgcgttctgtgtaatcacttgtttaggtcatgttgctgctgaaactgctaatggctgttgcctgtatttggtatccttttctttaatctaccattatatttcaatctatgatgcacggatacaggcactattatcggatatgtttctgatacaatgcaaggatatgacacttctaaaaacttag

SEQ ID NO: 71054 - DNA, 510 bp, Glycine max
  Peptide Sequence Number=SeqID_187832
atggcgaaggtggcgattgttgagctcaatagaaactgtgccaatacagtggaagagatagtgaaaatggagagaaagatctttcccaagcacgaatcactggcttcattctttcacgatgaacttagaaagaaaaacagtgggttgctttatattcacgtgaatggcgtaattgcaggctatgtcatgtattcttggccttcttccttgtacggctccatcacaaagctcgcaggttccaaccccacttcgttttcttgcttagttctaagtcacggaataatggagcaatggaggggacaaggccacggagaggctctgttgaaagcaggaattgagaaatgcaggacaaggaaagtttcgcgcataatgcttcatgtggatcccttgaggactcctgcagtgaatctttacaagaaacatggtttccaaattgacactttggttgaagggtactactcctcagatagagatgcctatagaatgtacttggacttcgattcaagttga

SEQ ID NO: 71055 - DNA, 1743 bp, Glycine max
  Peptide Sequence Number=SeqID_187833
atggagcaagaaatggagaagaggaaggaaggtacaagtgaagaagagaaatgggtgcatgatgcatctgtggattataaaggaagacttcctttccgtgcttccacgggcgtatggaaagcttctctttttgttcttatatttgaatttagtgaaaggataagctactttgcgatgttctctaatcttatcacgtacctgactaaagtgatccatcaagacctcagtacagctgccaagagtgtaaactactgggcaggaacaacaaccttgatgcctctggttgggggatttgttgctgatgcctacactggtggatttaacatgatcatattttcttccctcgtatacttaatgggattaagcctcttgattttgtcacaattcatcccaagtctaaagccaaacatcaataatcagcctagggtggctcatgaagtggctttcttccttgccatttactgcatctccttgggcactgggggacacaaaccatgcttgcaaagctttggagctgatcaattcgacgaggatcaccgggaagaaaggaagaagaagatgtccttcttcaacttgtggagcttcactgtgtgctttgctatgttgcttggtgcaacagtggttgtttatgttcaagactttgtcagttggggagttgctagtctcatcataactattctcatggctctcactaccatagctttctatgcagggaggcctttttataggtacaagcagccagcaggaaacccttttaggccaattttacaggttttagttgcagcaattaggaaaaggaatttgtcttgtccttcaaatccagctcttttgtatgaaatcccagagttagagaagtcgcaaggaagacttctgagccacactagcggactcaggtttctagacaaggctgcaataattgaagagaaatatgttgagcagagagataatgcatggagattagcaacagtgacaagagtggaggagacaaaacttgttctaaatgtagttcccatatggctaacttcattaacaactggagtatgctgggcacaagcctcaacactttttgtcaagcaagcaactaccatgaacttaaagatgaccgaaagtttcacactgccacctgcttcccttgtttctgttgcagcaattggtgtcttaatatctctcccaatatacgatagggtcattgttccaattctaagtaaagtcacaggcaatgaaagaggcatcagcatccttaggaggatcagcattggcatgacattctcagtcatagtcatggttgctgctgccttagtagaagcaaagagactaagaatcgttggacaaaggacaatgagtgtgatgtggttgataccccaatacttgatacttggcattgcaaattcattttctcttgttgggttgcaagagtatttctatgaccaagttcctgactcaatgagaagcataggaatggctttatatctcagtgtgattggagtgggaaacttcttaagcagctttctaatcatcattgtgaaccatgtcacagggaaaaatggcaagagttggattgggaaggacataaattcaagtcgtttggataggttttattggatgttggctgtcatcaatgctttggatttgtgtgcctttctcttcttggcaagcagttacacttacaagactgtacagaggacaactatggatactgatggttgtaacaagagtgatggtgtggagacagtggcaaaatga

SEQ ID NO: 71056 - DNA, 204 bp, Glycine max
  Peptide Sequence Number=SeqID_187834
atggaggaagcctttttagagcattggttgctggctttcttaagactgacaaggaatttcagagcagaggtttgcacagctaagatgaacttgagtgctgctgaggtttgcatagctataacgttgaattacgcaacaggacttcaaaggtgtggcaagagttgcaagaagaacagaccatcattgaagttcatgccctcttag

SEQ ID NO: 71057 - DNA, 234 bp, Glycine max
  Peptide Sequence Number=SeqID_187835
atggaaatggtgttctcttccgccttgaagttctcatgcaagaagaagaaaatgaaggttcaagttatgctttttggagagaaaatggttctacaggtaacagaaccagtagtaaaaccaacaagtggcgccgtctgtggagacaagatcaagaaagatgggaacaacaaagtttccgtcaacttcaatgttttaaaggctcttgaacgtttcagcttccaaaggcttgcttaa

SEQ ID NO: 71058 - DNA, 291 bp, Glycine max
  Peptide Sequence Number=SeqID_187836
atggatacgatactcggtcttactattttatactacttgtgcgaattggtacacttgccaaccagcgaatcaaaagttgtcaagggaaacatgtttcccataatcgacaacatcatgatcgtagattggatcgccgatgaccttagcaccaactacctcattccatcgcttggttctgcaattcgagtcaacttcttgaaattgaaggaagacgtgaataaggatgaggtcttgagcgcagtgaaaggaattcttgagaacttcaagaaaattagtgtaggtcgaaagtga

SEQ ID NO: 71059 - DNA, 1341 bp, Glycine max
  Peptide Sequence Number=SeqID_187837
atgacgaaagtttacggcacggggttatacgatttccggcgccaccgcgtcgccgagtatccggtggcggcggcaccagcagagtcgaaaacgttagttccaaagaccggcggcggcggcggcggcgttccgagcagcatcactctgtcggagattcagcgcgaccggctgacgaagattgcggaggcgaactggttgaaaagtggcgatgcggggaggcctaagaaggacttcgaccctgagcttgttcgcaagatctacgaaaccgaattgttggtgaaagagggttcgaaacccgttcccttgcaacgtgtcatgattctggaggttagccagtatctggagaattacctgtggccttatttcgaccctctcactgccacttcgagcatgttatgtccatcatcatcatggtcaacgagaaggtctctctcctcttctaataatttccgagaaaatgttgccgcttggacttgcttccatgagaggaaagacgctttcaaaggctttctcgagagtgttcttcgcttgaaggagggacgagaactaagtatagccgaaaagacgaattacctagtttttatgataaatgcctttcagagtttggaagatgaggttgttagcaggacaatcttgagactggcaaatttgaaatcttggtacagtttgtcttatggtcgatttcagatggagctttgtcttaatcctggcttgatcaagaaatggaaaaggatgataaagaaggaacctgtgaaaggagatggatcacatttagatccctcaactacagttgaagtgatgttcgtgagaaacctcatagaagaatttctggagatactggattcacaggtatttcccctgaaacaattatctggtgaggacgatgaacttattgatgctactggtttggggctagttaatgatgcctgtgtcctgtactgtgagaggtttatggaatttctaattgacctcttgagtcaattgccaacgaggaggtatttgaggcctcttgtggctgatgtagctgtagttgccaaatgccatttaagtgcactctataggcatgaaaaggggaaactttttgcgcagttggttgatttactgcaattctatgaagggtttgagattaatgatcatactggaacacagttaacagatcatgaggttcttgaatctcattacagccgaatgcagtcattccagctacttgcatttaaaaagatggaaaagctgcgggaacttgctttgactaacattggttcgattcacaagcgtgctaatctgtccaagaaattgtctgttctttctccggaggagttaagagattttgtttgctgtaag

SEQ ID NO: 71060 - DNA, 288 bp, Glycine max
  Peptide Sequence Number=SeqID_187838
atggtagcagggtacgttaggcccgacgtggcgaaggttttcctggatctaagtgcagatcccggggtacgcaaaggtgacgccggtgcgaatctggaccaccgtgaccaaagcagcgttgcacatggcagtaggatcttggtgcggatcccgaggaaaatggagatgcaggagattctagaacggagagggaagggtgagaatttggagtatcttgtgaggtggaaggacggtggtgccaacaagagggtgaaacaaatattgtcaatttttaacaaatactggtag

SEQ ID NO: 71061 - DNA, 1254 bp, Glycine max
  Peptide Sequence Number=SeqID_187839
atgtttcctcaggagaatcatagtaacggctatcagcatcagcagggttacagtcacagagagcgagtccgtcggggcacttgcaggtcacgtgcctccacttcctcacactctcactccgttagggtttacgaccaacctcgtcctccttgcactgatttcgacgtcgcctatttccattcctacgctcaccttggcatccaccaagagatgatcaaggatcgtgtgcgtactgatacttatagggatgcaatcatgcagcatcagagtttcattgcaggcaaagttgtcgttgatgttggatgcggtacaggaatcctttctatattttgtgctcaggctggtgcaaaacgggcaaatgaagttgtgaaagcaaataacttgtctgatgttgttgttgtattgcatgggcgagttgaggatgttgaaattaatgaagaagtggatgttataatttccgaatggatgggctatatgcttctgtatgagagcatgcttggaagtgttattaatgctagagatcgttggctcaaacctggtggtcttattcttccttcaagttcaacgttgtacatggctcctgtcactcatacggacagatacagtgacagtgttgacttctggcgcaatgtttatggaattgatagtgagttctctacttggactaagagagaacgagaatatccttctccagatcagtatgatccaagaggaaaagtgtctgccatggtatcactggctaaacaatgcgcatttgaagaaccttccgtggagactataactggtgaaaatgtcttgacatggccacatgtgggagtagaagggaggggaggggaatggaggaagaagggggagaaggaggggaatggggagggaagaggagtggcggaagggggagagggaggtcacacggtggcggttgctgtaagccttgcctcaaatcgctgtctcagaaagcagatccatggcaccttgttgagctgggggcacaacgatgaaaggttgctgtggactattgggactattgggtcttcaaagaaattaagggaccgactagaatgtgcatcagcagcagctttggtagcatccaagttaggccaagatattgcagccttcgtttaccatgatcttacacaacaaggtacgcttttcacaggccgctgtctgagaaaggcgcaattttcagacaagcgcacaacactctttcatgcgcagaaaaggaaatgtttcaaaaggccatgcacaacaccttga

SEQ ID NO: 71062 - DNA, 813 bp, Glycine max
  Peptide Sequence Number=SeqID_187840
atggcttctacttcttcttcttcttgttctcttgcttctcagtttctccctcctcctagaaagctttctgtaatcccttttcactcaacgaactgcacacatttgtcattcccggctgttgtgactccaagacaacaaccactgttgttgttttcttcaacctcaacttgtttggcggcggcggcggcggcggcgtcaaactcaaacaacatttggaattccaacaacaacaacaaaccagcttcgtcgaaagagaaggaagtggaagtggaagtggatgaggagctgccatggattcaggaaaaggctttggacctggtcgagttcacgggctccgttacccaagccattcccgggcccagagtgggtcccacctccttgccttggattctcgctattcctctcacatatgctggccttactttcgtcattgcctttgtcaaaaccatcaggaaattctcttctcccaaagcaaaacgccgcagacaggtcagtaaaaatgccacgctatgcaagtcgctggatgatttatttgaaaaaggaagagatcaagttaagcttgatgctctcaagcaaattgagaataagacaggttttgatttggaagaaatattgcgcaagtatatcaggtatactctgaatgagaaaccattcaatcctgacatggtagctgatttaattcatctaaggaaagcttctatattaaatgattcacaagttgctgagattctgaatgatatttcacgacgaattgtgcgagacaaaggtaatccaaggtctaggaaaagtaatccaaattctgatgaactgtga

SEQ ID NO: 71063 - DNA, 675 bp, Glycine max
  Peptide Sequence Number=SeqID_187841
atggagaatctctttaagagcattgaaagtatccgaaggttccgctcctcgcagttcgacttgatcaaggccggcttcaaggccgaaggcgatgttgtttctgttaatatggtctttctcaaggctggaactccatctccaactggttttgtcatgaatttgcagccttctgaagcagaagctggatttgatattcgggtgccacccactgctgatccagaatcgttggagaggcgcattgctgaggaatgggcaccttcatcccgcaatatgtcatttactaacaaagaaaacaaaggacagaaaacggttgaaaattctatttctattctagctggtactgagttcaaacagaaggcgcacacacgagataagtctgggaaaccaatcctcaccaaaactgatagttccaatccctggtgggcccttttagaaaatgctgtccaaaaggctggtgggaaacttggtaagcccgaggtctttcccgccgctacagattcacgctacttccgtgaacgtggattaccagcaattggattctcacctatggcaaacactcctgttcttctacatgaccacaatgagggaatgttatcaggcttgtttgagttgggtagtattctagtgggagaaggtagtgccagaatgttgtctttacaaaatgaggagtgttag

SEQ ID NO: 71064 - DNA, 144 bp, Glycine max
  Peptide Sequence Number=SeqID_187842
atggcatggagacagggggagcagaaagctgatgtcacaattttgctgtcgcccctacagataccgctgtgcttgattactctgataatgaaagttgctgatcccacttgcataactgctcgtacctgctcaggaagtgtctaa

SEQ ID NO: 71065 - DNA, 546 bp, Glycine max
  Peptide Sequence Number=SeqID_187843
atgaatttatttcctagcgctgttcatgtgtcctccacctttgagtgtggagccccacgaattgattgcctagcgaagttcgccaattctccattctccacttttattcggagccccatgaatccattgcctaacgctgttcatgtgtcctccaccttcgagtctggagccccgcgaattgatcgcctagcgctgttcgccaattctccattctccacttttattcggagccccatgaatttattgcctagcgctgttcatgtgtcctccaccttcgagtctggagcccggcgaattgattgcctcgcgctgttcgccaattctccattctccacttttattcggagccccaagaatttattgcctagcgttgttcatgtgtcctccaccttcgagtctggagccccgcgaattgattgtctggcgctattcgccaattctccattctccacttttattcggagccccatgaattcattgcctaacgctgttcatgtgtcctccaccttcgagtctggagccccgcgaattgattgcctagcgcta

SEQ ID NO: 71066 - DNA, 909 bp, Glycine max
  Peptide Sequence Number=SeqID_187844
atgtacgctgatcgcgtggagggtggagcaaggaggccagtgaaggaacgccttaatgatgtgaatggtgtcagtggctctactcgcccgcagcagcagcgtcaaatcactggcaagaggaggagagggaggccaagaaagatattgggggaagtggtaaagagggatctcatggcttttctagaagaaagtttcaaccatggtgaacttgtgcctccaaaattgggcatggacaggtcaaggcaagatgacaagtgggaacatgatctctttgacaatgacgaaccccggatcactagtatggataagattattctcatatgcaactataagttgccactgttgttggatgccaataatcgcaaagttagtgctcaagatcttcgcttcaagcttcaaaggaagggtcttcaacctgcatctcagagtggaaagagttctgccccaaacgtgctggatctccgtgaaaggctatcagggacaatggcaccacaacctacaaattatgatctgcctaagacaaaagttattaaaccaagcagtaaaagtgttggtgttgaggctcctgcagtgcagatcaaaaggccagctgacccagctcctaaaaagtcatggaaggctggtccttcagttgatgaatttttgcggtccttgggtctcgaaaagtatctcataacttttcaggctgaagaagttgatatgacagctctcaatcatatgactgatgaagatctcaaggctatgggcataccaatgcttggttcatttgagtggagggtaactgtcacatttttaaggatatccattcagataagatgctgctttaagctaagactaggcatttggcttccatatgatttaaagcacataggttttagaaaggtgccccatgcatgtcgagggatttga

SEQ ID NO: 71067 - DNA, 237 bp, Glycine max
  Peptide Sequence Number=SeqID_187845
atgacggtagtgggtgttgttgaatcagactggagagaagtatatctgataaaagataaaaaaaaggtagccgaaaaagagggcagcacacgagaacggcacatgagcgggcacatttggcatggtgctagaactttgtttagagatgtttttgctggtatctacccagatttagaagctcaagtagaatttggagcattccaaaacttggagatccaactacaaaaagacaagtag

SEQ ID NO: 71068 - DNA, 144 bp, Glycine max
  Peptide Sequence Number=SeqID_187846
atggcgaatgttgttgaaagggaaaacaatggtgaccgtgttctggtgagggaattggagttcgaaggaaaagaaaaatgttgtttgtgcggaagagagattcaattttgtttggtacggaaggctggaaagggtactctttga

SEQ ID NO: 71069 - DNA, 3840 bp, Glycine max
  Peptide Sequence Number=SeqID_187847
atggcggatgctacacggaatcgcattcttgagcgtgaaattgaagatcgcatggagaatcgtctcagttccaagattgatgaaagattcatggagatggcagcttcgatgcagcaaactcttcacgattccctgacacagtcgttagccttgtcgatatcgcagcaaatgcaggaccttctacgcaataacagtaagggtaaaactcattctccaacggggggaagcccaattcgaggtgcgagatcttcttattcttgcggaacacgtctagctagaattgattttccgcgtttctctggtagtgatgttaaacaatggttaatccaatgtgatacgtttttctctattgataatacacctgaggagtttaaggtaaggttggcggtggtacatttcgaagggaaggcccttcaatggcatagttcttatgtgaaatctgtaggattgcagaacctaccaccttggttagaatatacaaggattttaattgaaaggtttggcgaagtatatgatgatcctatggctgaattgatgcaattgaggcagaagggatcgataggggaataccatgaagcttttgatgctattgtagctcgcttggatttgagtgaggagcataggctaagttgcttttgggggggacttaaacaagaagtccagatgcttgttcgaatgtttcaaccaaattctgtccgacgggccttcacattagcaaaaatgcatgaggcagcaactgtgcatggttctgttacaaaatcttggaataaacagtctaaacctgaggtttcttctaaaccaccattgttacctacacctcctaaaactatttccaagacacaagatatacccaaaataaaacagcaagcctctaaaactttaacccctgcgtatatgagtgatagaagagcaaaagggttatgttatttatgtgatgaaccctttacgcctgagcatggtttgagtcataaaacactgcagatgcatgtgatggaagtggatgagttacaggagggtgcagaggaagaagtgttgcttgaaaactcaacggggtccagctctatagatcctcaaatttttgtccatgccctcacaggaattgccaatttccacaccatgcgtgtgacaggctattaccaaaagaagcctctccatgtgttgattgatagtgggagtacccacaattttttggacattgaggtggccaaaaaattgggttgcaaaattaatgcttttgattccttgagtgtggtggttgctgatggattccagtggacaattcagcaaaccaaattcacttctgatatgttactcattccattgggatgctgtgatttggtcttgggactggagtggttggtttccttgggtgatattgtatggaattttaataagttgcagatggagttctatgttaagggaaggagacatgtgttaagaggggcctctactggattaaaaacagttaagaggcaacaattggggaaggctatgtctactggtgttcatttgtcaattttgcaagtatgtgatggacaaatgggtcttttgaactcacttacaactcaagctgttgataaagaagtccctcctactcttgccaagttattggatgagttctctgatttatttcaagaacctagtgggttacctcctcacagacctggtcatgaccatcaaattccactggttcaaggtgttggtcctatcagtaagagaccatacaggtatgctaaacagcataaagatgtgattgataagctggtgcaggaatctttgtcgactggtataattcaaaatagcagtagtccttttacaagcccagtagtcttggtgggtaaaaaagacggatcatggaggttgtgtgtggattatagggatcttaacaagcatacagttaagaacaagtttccaattcctttagtagatgatctattggatgaattggcaggttctagcattttctccaaaatcgatttgaggtcaggatataatcaagtgagaatggatcctgctgatgtgtataagactgcttttaagactcatgttaggcattttgaatacttagtgatgccctttggtctcactaatgcacctgcaacatttcaagggcttatgaactcagtttttaaggagtttttaaggaagtttctgttggtgttctttgatgacattttggtttatagctgttcattggaagaccatttgctgcatttacacaaagttttggaaactatgagggcgaattccttgtttgctaagaggagtaagtgttattttggggtttctaaagtagagtacctcggccacttcatttctaaggagggggtatcaactaatccagctaaagtgcttgcagtagaacagtggccactacctcaaaccttgaaacaacttagaagcttcgtggggttagctggttattacaaaaggtttgtcaagggatatggtggcattgctaaacccttaactaacatgcttaaaaaagataactttatctggtctgatgcagcaaaactggcttttcagcaattaaagaagaagcttactgagactccagttttggctttacccgactgttcaaaaacctttgtggtagaggtggatgcttcaggtttgggaattggagcagtcttaatgcaagatcaccaccctatagcttacataagtagacatttgaatcatcaacaaaaaacttgtaaaaggaatttacaagatagtggaactctcaagcgggttgcttggggattggacgtaggcacaaggggacatgataatgtagctgctgatgccttgtcgcgagtggaaccaattgcttgtcaagctctcgcagttcatcaggtggtttctgaattggtgataaagattaaagcttcttgggattcagatcctgcagttcagaggttaatttcagaattacaagcaaattctagttctcacaaacattattcttggaagaatggggagttaatgaggaaaggaagactagttgtgggtagagatgatgctttaagacaggatattcttctgcattttcatgcttctgctgctgccggtcactcaggacgaaatgcaactttacaaaggctcaaatatatggtctattggaaggggatgagtaaagatgttagagctttggttcagcaatgcagtcaccttaccatggattttatagaaggcttgcctagttcctttggtaagcaggtgatttttgtagtagttgacaggttgagcaaggtagcccactttatggctctttctcatccttattatgctactaatgttgctcaatccttccttgatcatgaccttatggcttttcagggtgttcaggtccaactctccacagcgtatcaccctcagacggacggccaaacagagattgttaacaggtgtttggaaacatatttgaggtgtatgtgtgcagattcaccctctcaatggtctaagtggttacccctggctgaatggtggtataacaccgcctttcatagctctattcgagctactccttatgaagtggtgtatggacagccgtctcctgtgaatcctccttacttagcaggagcttcgaagattgagttgatggatagaagcctcttgaagagggaggagatgctgaaactcattaaatttcacatgaagagggcccaagatagaatgaaacagttggcaaataaacatagatctgagaggcagttcaatattggcgatatggtctatgttaaattgcacccttaccggaaaatttccgtagctgccagaagcaatatgaagttgtcccccaagttttatggcccatttcaggtattggaacagattggggtagtggcctactaa

SEQ ID NO: 71070 - DNA, 1813 bp, Glycine max
  Peptide Sequence Number=SeqID_187848
aggagtacacgtcctcgccttcagaggagtacacgccctcaccttcagaggactacacgtcctcgccttcagaggactacacgttctcgccttcagaggactagatgtcctcatctttagaggactacacgtcctcgtgtttatagggctacaagccctcgccttcagagggctacacgtccttaccttcagagggctacacgccctcactttccatggacaacacttcctcaccttcagagggctacacgtcctcaccttcgtaggactacacgtcctcgcgtttatagggcttcacgtcctcgcctttggagggctacacaccctcgccatcagagggctacacgtcctcaccttgagaaggctacacgccctcgccttcagagggctgcacacccttaactttcgagggctgcacgccttcgccttcaaaggacaacacgtcctaaccttcagagaactacacgtcctcgccttcagagggctacacgccctatcctttagaggactacacgtcctcgccatcggagggctgagtactacattagttgcctttagagggctacacgccgtagccttcagagggctacacgtcctcaccttcagagggctacacgccctcactttcaaaggactacatgtcctcggcttcagaggactacacgtcctcgcgtttactgggttacatgtccacacctttagagggctacacgccctcactttcagaggactacacgtcctcaccttgagagggctacacgctctcgtattcagttcagagtgctgcacgccgtcaccttcagaggactacacgtcttcgccttcagaggcctgcacaggactacacgtcctcgcctttagaggactacacgtcctcgccttcagaggactacatgtcgtcccttcaaaggagtacaggtcctctcgtttagagggctacacgtccttgcctttagagcgtacacgccctcaccttcagaggactacacgtcctcaccatgagaggactacacatcctcgctttcagagggcaacacgccctcgccttcagaggattacacgtcctcccttcaaaggactacacgtcctcgcgtttagagggctacacgtccttgcctttagagggtacaagcccacaccttcagaggactacacagggcaacacgccctcgccttcagaggactacacgtccttgccattagaggggtgcacgccctcaccttcaaaggactacacgtcctttccttcagagggctaaacgtcctcagcttcagagggcttcacgccctcaccttcagaggactacacatcctcgccttcagagggttgcatgccctcaccttcagaggattacatgtcctcgccttcagaggactacacgtcctcgcctttagatggcatcacgctctcacctttagaagactacacgttctcgccttcagagggttgcacgccctcacctttaacggactacacgtccttgccttcagaggactacacgtcctcgccttcagagggctacacggcctcactttcagaggactacatgtcctcaccttgagagggctacacgccctcgccttcacagggctgcacgccgtcaccttcagaggactacacgtcctcgccttcagagggctgcacgtcctcgccttcaaagggctgctcgccctccccatcagagggctggatgccctcaccttccgaggattacacatcctcgccttcagaggactacacatgctcgccttcagaggactgcacgtcctcgcctttagaggactacacgtcctcgccttcagaggactacac

SEQ ID NO: 71071 - DNA, 831 bp, Glycine max
  Peptide Sequence Number=SeqID_187849
gtcactctagaggacccgaggactacacgtctcgccttcagagggctacacgccctcgcctttagaggactacacgtcctcgccatcggagggctgcatgtcctcaccttcagagtactaaatgtcctcgctttcagaggactacacatcctcgccttcagaggactacacgtcctcgccctcagaggactacacgtccgcaccttgagaggactacatgtcctcgcgtttagagggctacagtacctcgcctatagagggttacacgtcgtcgccttcagagggctacacgtcctcaccttcagagggctacacgccctcactttcaaaggactacatgtcctcggcttcagaggactacacgtcctcgcgtttacagggctacatgtccacgcctttagagggctacacgccctcacttttagaggactacatgtcctcacctctagagggctacacgcgctcgccttcagagggctgcacgccgtcaccttcagagtgctgcacgccgtcaccttcagaggactacacgtcttcgccttcagagggatgcacatcctcgccttcaaaggggtgcacgccctgcccatcagagggatgcatgccctcaccttccgaggattgcacgtgctcgccttcaaaggactacacgtcctcgcctttagaggactacacgtcttcgcctttagaggactacacgtcgtcgccttcagaggactacacgtcctcccttcaaaggactacacgtcctcgcgtttagagggctacacgtccttgcctttagagggtacacgccctcaccttcagaggactacacgtcctcacgtttag

SEQ ID NO: 71072 - DNA, 198 bp, Glycine max
  Peptide Sequence Number=SeqID_187850
atgagggagggatattgtacgcagccttacccttgcatatgcaaagaggctgtttctggattcgaacccatgaccaacaagtcaccaaggcacaactttaccgctgtaccagggctcgccctcagaaagaatgaaaacatattcaccatcccagtggtaaatttctttgagtatcctcaatggaacgcatgggggaag

SEQ ID NO: 71073 - DNA, 315 bp, Glycine max
  Peptide Sequence Number=SeqID_187851
atggctccagctagagctcttatctcaaggctgactgaagaaaagaataatgcaattcaacaaaatagcaagctctgccaggaactgatgtggggaaaaagtgtcaggtcttctcaaggagctactgaagagggaaggcaacaaaagtcgtggtggagtctcatttgtcattgtcgtattaattggcttgcttggcataattatggggtatctcatgaagacaacctaagcatttctgcgattcaatctttcaccatagttttcgatcttagtttctttgttcctgactattcaagcaattatgaggaaagttaa

SEQ ID NO: 71074 - DNA, 275 bp, Glycine max
  Peptide Sequence Number=SeqID_187852
taccgttaggggggatgaggctgaaatgggctcctggacttcacacactagtttcgagaggtgcctttgtcaagaggacaagatgtgggacatgcagaacgagaccgaaatgggctcctggacttcacacactagtttcgagagaaataagcaagtatatgcgtatgagagcaagtatgcgtaagctcgagattgtggccgctaatggatctagtatctgcactcctgttgcaggactgacgtggaggattaacacgtatcgtcttggagtgtga

SEQ ID NO: 71075 - DNA, 303 bp, Glycine max
  Peptide Sequence Number=SeqID_187853
atgtcgaaaatcccaacggtggaagtgtgcgcatttgaatatcgaacaacatatccaaatttcatgaaaatccaacggctacaatgcgaagggttttcctctaagctcagacataatatcgaaattcccaacggtgagaatgctcggaattgggttgcgaacgtggtgttcaaatttcacgacggtccaacggtgaatgagcctgagatcatcgtttttctaagacaggtttggtgggctgcgggaaaaagaaagggttttgagaggagaaggggaaaaacgaaaatgaggcatctgacttaa

SEQ ID NO: 71076 - DNA, 1731 bp, Glycine max
  Peptide Sequence Number=SeqID_187854
atggagaagaggaaggaaggtacaagtgaagaagagaaatgggtgcatgatgcatctgtggattataaaggaagacttgctttccgtgcttccacgggtgtatggaaagcttctctttttgttcttatatttgaatttagtgaaaggataagctactttgcgatgttctctaatcttatcacgtacctgactaaagtgatccatcaagacctcagtacagctgccaagagtgtaaactactgggcaggaacaacaaccttgatgcctctggttgggggatttgttgctgatgcctacactggtggatttaacatgatcatattttcttccctcgtatacttaatgggattaagcctcttgattctgtcacaattcatcccaagtctaaagccaaacaacaataatcagcctagggtggctcatgaagtggctttcttccttgccatttactgcatctccttgggcactgggggacacaaaccatgcttgcaaagctttggagctgatcaattcaacgacgatcaccgggaagaaaggaagaagaagacatccttcttcaactggtggagctttactgtgtgctttgctatgctgcttggtgcaacagtggttgtttatgttcaagactttgtcagttggggagttgctagtctcatcatcactattctcatggctctcactaccatagctttctatgcagggaggcctttttataggtacaagcagccagcaggaaacccttttaggccaattttacaggttttagttgcagcaattaggaaaaggaatttgtcttgtccttcaaatccagctcttttgtatgaaatcccagagttagagaagtcgcaaggaaggcttctgagccacactagcggactcagttttctagacaaggctgcaataattgaagagaaatatgttgagcagaaagataatgcatggagattagcaacagtgacaagagtggaggagacaaaacttgttctaaatgtagttcccatatggctaacttcattaacaactggagtatgctgggcacaagcctcaacactttttgtcaagcaagcaactaccatgaatttaaagatgaccgaaagtttcacactgccacctgcttcccttgtttctgttgcggcaattggtgtcttaatatctctcccaatatacgatagggtcattgttccaattctaaggaaagtcacaggcaatgaaagaggcatcagcatccttaggaggatcagcattggcatgacattctcagtcatagtcatggttgctgctgccttagtagaagcaaagagactaagaatcgttggacaaaggacaatgagtgtgatgtggttgataccccaatacttgatacttggcattgcaaattcattttctcttgttgggttgcaagagtatttctatgaccaagttcctgactcaatgagaagcataggaatggctttatatctcagtgtgactggagtgggaaacttcttaagcagctttctaatcatcattgtgaaccatgtcacagggaaaaatggcaagagttggattgggaaggacataaattcaagtcgtttggataggttttattggatgttggctgtcatcaatgctttggatttgtgtgcctttctcttcttggcaaggagttacacttacaagacagtacagaggagaactatggatactgatggttgtaacaagagtgatggtgtggagacagtggcaaaatga

SEQ ID NO: 71077 - DNA, 1443 bp, Glycine max
  Peptide Sequence Number=SeqID_187855
atggcttccacaactatgttgttgctggtcgtgttcatgattctatgtatatcacacccctcatttcaaatggttcttgtgcctttaacacacacactttccaaagcccaattcaacagcacccaccaccttctcaaatccacttccacccgttccgcaaaacgcttccgccgccaactctccctcccactctccccgggcagcgactacactctctccttcaacctgggcccgcaggcccaggcccagcccattacgctctacatggacactggcagcgacttagtctggttcccctgcgccccttttaaatgcatactctgcgagggaaagcccaacgagcccaacgcctctcccccaaccaacatcactcaaagcgtcgccgtttcgtgcaagtcccccgcgtgctccgcagcgcacaacttagcccctccctccgatctctgcgccgccgctcgttgtcctctcgaatcaatcgaaacctccgattgcgcaaatttcaagtgtccaccgttttattatgcttacggtgatggaagcttaatcgcgcgtctctatcgtgacacgctttctctctcttctttgtttctcagaaatttcacgttcggttgcgctcacactaccctcgccgaacctactggagtcgccggattcggtcgtggtttgctctctctcccggcgcagctggccacgttatctcctcaactcggaaaccggttttcgtattgtttggtttctcactcgttcgattcggagcgagtgagaaaaccgagtccactaattcttggacgctacgaggagaaggagaaggagaagattggtggtggagtggcggagtttgtttacacgtctatgcttgaaaaccctaagcatccttatttttataccgttagcttaatcggaatcgccgtcgggaaaaggactattccggcgccggagatgctacggcgggtgaacaatcgaggtgacggcggcgtggttgtggattccggcacgacgttcacgatgttgccggcggggttttataactcggtggtggacgagtttgaccgccgagtcgggcgagacaacaagcgcgcgcgtaagattgaagagaaaacgggactcgcgccgtgctattatttgaactccgtggcggacgtaccagctctgacgctgcgttttgctgggggaaagaattcgagtgtggtgcttcctaggaagaactatttctacgagttttcggacggtagtgatggagcgaaggggaagaggaaggtggggtgcttgatgctgatgaacggtggggatgaagcggatttgagtggtgggcccggggccacactcgggaattaccaacagcaagggtttgaggttgagtatgacttggaagagaagcgcgtggggttcgcaaggaggcagtgcgcgttgctttgggagagactcaatcgcgacaaaaactag

SEQ ID NO: 71078 - DNA, 642 bp, Glycine max
  Peptide Sequence Number=SeqID_187856
atgattcgcgatcttgggcaagactattttcagcaagcatgtgcaccattgtatgacaaaatagaaagtgattcaaagaagccattgtattcgggttgcacaactttcacaaggttgtcaacgatgttagcttttgtcaacattaaggcaagatttgtgtggagtcacaaaagcttcactgaattgcttgtgctattgaagaagatgcttcctgaagaaaacacattgccgaaaaatcactatgaggtgaagaagattttatgtcctatgggaatggaataccaaaaaatccatgcatgccttaatgatttcatattgtacaaaaataagtttgcagaaatgtgtaagcgccacacatgtggggtaccacggtacaaactgaaggatgatgaatgcagtaatgatgcaaccacaaacaatagtcgtccaacagatgtgtgctgccaagaaacccaaggcttggccttgctttgtatgatgatagtgggtccaaggaagccagggaatgatattgatgtatatctcactccgttgattgaagacttaagaaaattgtgggaagacagggttgatgtatgggatgggaatcgccagcacactttcaagttacgtgtaatggaattaatgaagcattgggcttga

SEQ ID NO: 71079 - DNA, 144 bp, Glycine max
  Peptide Sequence Number=SeqID_187857
atgaggccgaggcacttccgaatcgcttccgtgatcgattcctacatcattcttcaccgttctttttttgaattcactctatgcacccttaagggtcccctcttgcttttcgcatcttcatcttcattcttctaccatcagtga

SEQ ID NO: 71080 - DNA, 405 bp, Glycine max
  Peptide Sequence Number=SeqID_187858
atgccctgggagctcatggttctaatggcgattagtttgggagtgtgtattcgaggtcaggttcgggaaaggaaacgagtggcaatgagggttttggggaacacagaaatcatgggagaccaagaaggtacaagactacttcagcgattcagccttggcccaaagtgcacccttccattatcacctgagtttgcctccttaatcccacaaacagtcggaacttggatcacccaattccacgcctatattaggattaaggaaggaggtacctattcgaaccatataacacccactttagtgttgttgttacatttgttttcacttttcaagttgccttggtacggattctactacacacataggcataccaacatcgctcattatgataggctattactaatataa

SEQ ID NO: 71081 - DNA, 315 bp, Glycine max
  Peptide Sequence Number=SeqID_187859
atggacatgatgcaaaaagccttacatggcatgcagatggcagaacctgtgatggtttgctctgacatccggccgattctccacaatggaagacaattgatcatttgtatccatactttgtggacaaggcaagaaacctatgtggaagcaatgccttccaaggttattttgatgatgccaaagaatcaagagtcaagcaaaatccaaagattcaagaatcaagcttcaagtttcaagattcaagattcaagaataattaagatcaagattcaagactcaagattcaagaatcaagagaagactcaatcaagataa

SEQ ID NO: 71082 - DNA, 207 bp, Glycine max
  Peptide Sequence Number=SeqID_187860
atgacgaccgctgcaagacccacatgggcacctgctaaaggtggcaacgaacaaggtggtactcgaattttcggtccctcacaaaagtactcttctagggacatcgcatcgcacaccactctcaagcccagggtacaaaaaggagggagacagctatttacacagacacaatacagctgtctccataataaagctagctacaaatag

SEQ ID NO: 71083 - DNA, 630 bp, Glycine max
  Peptide Sequence Number=SeqID_187861
atggatctcatggttgatctgttgttagcagaacctttctatgtagggcatgatggcatgcttccatggcagaacctgcggttttggaaggatcgtacaacacttagtgatattctctctgaagatgctctgataattccttgtaaaggaatattgagagcatgtgccgtctctcttccagatctttggaaaagtcgttgttgcttgagtaatgttgaaggttttgaccattcagtggtaaatgctacattgggagcctgtggtcatctacctgatttagaagagggtccttgtctgcctttttttgtctggcaatgtggagaatttgatgtgcttagtgagacatttgatgtgatggagtttgatttttcaaaacaaatatgccaatgtcaaggaaaatcccaggttaagttcaccaagaccggggtatgtcatggatttgtgctgtggattaactgggtgatggatttgcaaaattctgttgtgatatcaactggtccagatgaaagactaaatcaagacccaagacaaaactcatatcttataaaggatctagaacaatactatgagctattgcttattctttccattttaagattgcatataggagatattggaaacagggagtaa

SEQ ID NO: 71084 - DNA, 1755 bp, Glycine max
  Peptide Sequence Number=SeqID_187862
atggagcaagaaatggagaagagaaatgaaggcagaattgaagaaagtgaagagaaatgggtgcatgatgcatctgtggattataaaggcagagttcccctccgtgcttccactggtgtatggaaagcctccctctttgtcctcacaattgaatttagtgaaagggtaagctactttagtatagccagtaatcttatctcgtacctgactaaagtgatgcatgaagacctcagtacagcaagcaagaatgtgaactactggtcaggaacaacaacccttatgcctctggttgggggatttgttgctgatgcttacactggtcgattttatatggtcctgttttcttcctttgtataccttatgggattaagcctgttgatcatgtctcaattcatcccaagtctaaagccttgcaacactaagatatgccaagagcctaggaaggttcatgaagtggttttcttccttgccctttactgcatctcctttggtactggaggatacaaaccatgcttggaaagctttggagcagatcaatttgatgatgaccacttggaagaaaggaagaagaagatgtctttctttaactggtggaactttgcactgtgctttgcattgctgcttggtgcaacggtgattgtttatgttcaagattttgtcagctggggagttgctactcttatcctcgctattcttatggctctcactgtcgtagctttctgtgtgggaaaacctttttacaggtacaggagggcagaaggaaaccctttaacaccgatttttcaggtcttaattgcagcaataaggaaaaggaatctttcttgtccttcaaatccttcattattacatgaggtccctgagttagagaggacccaaggaaggcttctgagccacactaacaggctcaggtttcttgacaaggctgcaataattgaagaaaaacgtgttgagcagaagtacaatccatggagattagcaacagtgagtagagtggaggaaacaaaacttgttctaaatataattcccatatggctaacttcattaacaattggagtatgtgtgggacaaggccagacactctttgttaaacaagcagccgctaccaacttagagataagcgacagtttcaaaatcccaccagcttccatggcctctgttgcagcagttggtaccttaatagctgtcccaatatatgataggattgttgttccaattctgaggaaagtcacgggtaatgaaagaggcatcaacatccttaggaggattggcattggcatgacattatcagtcatactcatggttgttgctgccttagtagaaaaaaagagattaagattaatggttggacatgagactatgagtgtgttgtggttgataccccaatacttgattctaggcgttggagattcgttttctctagttggcttgcaagagtatttctatgacgaagttcctgactcaatgagaagcataggaatggccttgtatcttagtgtacttggagtaggatttttcttaagtagctttttaatcatcattgtggaacatgtcacggggaaaactggcaaaagttggattggaaaggacataaattcaagccgtttggataagttttattggatgctagctgtcataaatgcttttgttctgtgtgtctttctcttggtgtccaaaaggtacacctataagactgtacagagaagagctatggaaactgattcttgtaagagtgatggggttgagatggtggcttga

SEQ ID NO: 71085 - DNA, 138 bp, Glycine max
  Peptide Sequence Number=SeqID_187863
atgtctaaccccattctagatctggtgcgggaaaagttgcgcccggaagaggacctaggtcctcggggccaatggtgcatgcggcgacgtgcggtacagttgttgtctaacgccgatgacagagagaagaaccactag

SEQ ID NO: 71086 - DNA, 390 bp, Glycine max
  Peptide Sequence Number=SeqID_187864
atgcagtactgtggctgtgacaaaggctatgcgcaacgtcaacatgcgcaagacgacgacatgggtagctttcataattcaccaaaaggaatgactgaggaatcaaacttcagagacaatgataagtcatacaaaagggatatggatcatgaaattaaagacttgaaaggaagacatgttggtcaagagaaagaagagatgaaaaacctcgagcaattgaggaaaaatacaaacacaattattggtggcttcgcagaagaaggacctccacgacatgcaaaaaacatctcaaaattgtttgttcaatcaatatggtatccacctacaaagtgccaaagatgttgcccattcaaagatgctacctatcacattcaaagacatggattttaa

SEQ ID NO: 71087 - DNA, 1257 bp, Glycine max
  Peptide Sequence Number=SeqID_187865
atggcttgggttattgatcggtgtatggattccttgagcctcaatctatacacaatgcaaaggacagacgtgggcaatgtgaagaatatatcgaaaaatgggttaaggaatcgcaacgacaacgcccattggcaaatggttgtgttgtgccctaaagacaatgtcgtggtctggttttgttcagtgcgtagaaagcctgatgttcatatcaaaattgcaattaacaatgcatacaagaaattaaacacgactgctgatggcaaagttcctaaaactacaccccagtggcttgaactgaagactcacgttcaacgtggaggctatgagtgtgggtattatgtgatgcattggatgtggaacataattggcacagagttgaagagtgattggactgtgtggttcggtgatggctcggcactagactcggaggtgatcacgacattacgtaaaaaatgggcagcttactttttgaaacttagaaccatccaatgtagaaagctatttatgagacctattgtgtatattaatctttataagaccgagaaaggtatgctttgtacaatgcctcttaggtgggacttctcctcaggatacactggttacgtgatgacatttgaggttggtgcagtgcttgaggatgcaaattggcaggctccagtgaattgttttgatgagaatgacaaggaaaagaatatccccattttgggatctgctgttcgtggtggttctcttgggagttatgacgtaggctctgccacttgggcagaccttaggaaagcacccctccaaagtgcaatggaagtcacttacatttgtgtccactttgttttaaaagaacttgtgcggaagtcaatttcagaaactgaggtcagcaatgtttcagcaatgtcccaacaatcttcagcattggaatctggaagctttcattctcttgttgatgaaaagttgattttgaagccttctgaggtttctattttcactttgaaagtagtagttgcccatcaggagatatgtgcttcaaaaggatttgtcttctcgcagattatatgttacatgtaccgaagtagtttacaaggtatcaagaccttcatttataccattttggggactgtaacaattcagaggcgtgtacctctttctctggtcattgatattatcattgaacaaggaatgatggcctctgggaagacaactgtgggacggatattgtcagaggcactttcttattcttcgttttatgataggttagtgtggtaa

SEQ ID NO: 71088 - DNA, 237 bp, Glycine max
  Peptide Sequence Number=SeqID_187866
atgggtgcactagattacctctccaacttttgcactgtaaccagcactaggaccaagcagaaagcaatagataaaagtgagaatggactgagatggttgcgaaagaagagtgagaaatgcagtgagttcaataaaaggagtgaaatctatggaggtgaacagaaaggagagcagggtggtagtgagaggatatgtggatccaaagaaggtgctgaagagggtaagaagaacagctag

SEQ ID NO: 71089 - DNA, 108 bp, Glycine max
  Peptide Sequence Number=SeqID_187867
atgtctgaaggtgtgcgaagatgtgcggaggggtccggctctgatgccgatgctaactgggagaggaatacgcgctgttttaagctgaatgagggaggaagtttttag

SEQ ID NO: 71090 - DNA, 330 bp, Glycine max
  Peptide Sequence Number=SeqID_187868
atggtgcctgaagccaaggtttccaatgtttcaagcttggagctcatcaactttccaggggcattacaaaacaagagaacaaaaacatggaaaatcttacattcacgaacagttgcaagtggcgacaccactcaaaagggcacgactttgcctatgtggcggtggtgggaacaacacgaggtgcggaggaaaacggcacaatgtcagagtagtgcgagggacattcaggcgaaacagatgatgggagcttatacgagatttttcagacaaaaggtttttggaggtacgcgtgttcaattaccgcgcaacttaacgatggtgtatttctaa

SEQ ID NO: 71091 - DNA, 147 bp, Glycine max
  Peptide Sequence Number=SeqID_187869
atgggtacacaaagcatcaagtttattccactctggggctcatgtgcaaatgctttgatggtaaaggtggcgaatgtagaagcacatgggaggatgatgcttgctccaacctcgtgtgcaatccgtggaaatattattaggggttga

SEQ ID NO: 71092 - DNA, 354 bp, Glycine max
  Peptide Sequence Number=SeqID_187870
atgtcctcaattttaagccttgtaatcgattacccacccttggtaatcgattaccagaggccaccatccacatattacacaaaattcacagctggccagccaccacaagcctccttgctttgtggtcttgttttccttttatctgttgactgccaggagctcgcctgtttaggtacatcacaggttctcactgaccgactatgcccgggttgggtcgggattggtcaagcttggttttgggcaatagcaccccacctgacgtccccaaggtctcctgacccccgcgacatatctccaggtggcggtcgggcgatggtgcacaacaagtttttcacatccacaaagcgcgcataa

SEQ ID NO: 71093 - DNA, 240 bp, Glycine max
  Peptide Sequence Number=SeqID_187871
gttgtaggatgtacaatctgtggtggagctcatgaatctggatgttgtacccctaatgaagatcaaattgcacatgaagttaattatatggggaatcagcccagaggcaatttcaatacaagtgaatttccaggatttcaaaacaaccagcagtatcaacagcagagacagtggcaaaatcaccctagtaaccaattcaacagagaccagggtggttcatctacaagaccccaacagtag

SEQ ID NO: 71094 - DNA, 363 bp, Glycine max
  Peptide Sequence Number=SeqID_187872
atggaatcaagcaatgtgaagaacaagtcaagtggaaaaagaaagatgtctagtgaggacacaagaagttacttcgcatggaacttggaaatggagcgtgtactagctgatgtgcttagagatcaaagcaatttggccaataaaggtgatggaaattggaaagcagtagcatacagtactgtagctcaaattttgtccaagtattttggagttcacctcatggcaaataatgttaagaaccattttaagcttcggagaacatgtcacatgaagaggccaaacgattttgattcaaagtcattcctaattggggtgatattgttgacctatgtgcaaaggatagagctacttgactgggagtaa

SEQ ID NO: 71095 - DNA, 318 bp, Glycine max
  Peptide Sequence Number=SeqID_187873
atgcagatggcagatagaggtagaggtggtggtcgtagaacatttaatcgtggtacaaaacgtggtacccacaatttgagagctccaattaccaccaacccttccccctcatccattcacatatcaacctcagagtcgatgattcatgttgttgcacagactccaaacacacttcctaccgctcaaggccaaccaaatcctacctttgtaagggagtcaattcccactaccactactagaaaatacactttcaacatctgttatttagaacattctacatcggttctaaaaccgatgttgaaagtgacgatgttgaat

SEQ ID NO: 71096 - DNA, 297 bp, Glycine max
  Peptide Sequence Number=SeqID_187874
atggcttccaaggctgcacttctcttgtgtctcaatgttctctttttcactgtggttagttccacatatgtgccatgtaatccaccccccaaaactcccaaacacccacctgtcccaaagccaccatccccaaagctagcaagctgccccaaagacactattaagttcgctgcagtgtgcctttgcactgctctcaaggctaatgtgttgggcatcaacctcaatgttccagtgaacttgagcttgcttctaaactactgtggaaagggtgttcccaagggattcgtctgctattaa

SEQ ID NO: 71097 - DNA, 297 bp, Glycine max
  Peptide Sequence Number=SeqID_187875
atggcttccaagggtgcacttctcttgtgtctcaacattctcttcttcactgtggtaagctccacatatgtcccatgcaacccaccccctaaaactcctaaacacacacctgtcccaaagccaccttccccaaagcaaccaagttgccccaaagacaccattaagtttgctgcggtgtgcctttgcaccgctctcaaagctaatgtgttgggcatcaaccttaatgtcccagtcaagttgagcttgcttctcaactactgtggaaagggtgttcccaagggattcgtctgcgcttaa

SEQ ID NO: 71098 - DNA, 189 bp, Glycine max
  Peptide Sequence Number=SeqID_187876
atgaacaggtcatcaaaatcagaccagtttccactgttgaatgaccctaacaaagcatgcatctatgtgatcaagagaagatgtcaaattgaggcatgtaacggagcatgggcaatgattggtttcacgactggcctagttattgaaggccaaactgggaaaagtattctgactcaggtgaaattttga

SEQ ID NO: 71099 - DNA, 1233 bp, Glycine max
  Peptide Sequence Number=SeqID_187877
atggtgttcttagggactttaggattgcgcgtgaagttcaagagtgaagagtgtttgacgatggtttcaacgtccttgagaaatgggatggaagatggtgcgaaagtagtaagagtggaaaatctggacaatccttacaagcatcaagataattttgacaagagattcaagttatcgttgaacaaactctacgcgtggagcttagtggactatgacagggtggtgatgttggacgctgataacctcttcctccaaaacacggacgagttgtttcaatgtggacaattctgtgcggtctttatcaatccttgtgtctttcacacaggactcttcgtcttgaagccatcaatggccgtgttcaaggacatggttcatgaattacggaatgggagagaaaatcctgatggtgcagaccagggtttcatagctagctatttcccagagttgcttgataagccaatgtttcacccaccacctaatgccaccaagcttgatggaacatataggcttcctttaggttatcagatggatgcatcttactattatcttaaacttcgctggagcataccctgtggaccaaatagtgtgatcacattcccaggggcaccatggttgaagccatggtattggtggtcctggcctgttctgccattaggcctccagtggcacgaaaaacgtcgccaaactttggggtatggtgcggagatggctgtgatactcattcaatcagcaatatacttgggaataatagcaatgaaacgttttgcaaggccaagtctctcaaagctatgctataggcgttccgacaagagcatcaacttggtgcagaacatcctcaaatttgtggcactgtggagcattcttgcggcttacacaacacccttcttcatcattcctcccacggttcaccctttgttgggatggcctctctacttgcttggtgtctttgcattgtgctcaattacggtcaatgcctttctgctgccaatgttgccggttctgatgccatggctcgggatcgccggtgccttgattgtcatggcttttccttggtattcagatggggtggtgagagcattgtgtgtttttggttatgcattctgtgctgcaccgtttgtgtgggcttctatgactaggataatggcagggcttcatcagtctctagaaagggaagcttttttgccaagattaggagaatcctcaccaccttcttggtttaacaagttgtactga

SEQ ID NO: 71100 - DNA, 414 bp, Glycine max
  Peptide Sequence Number=SeqID_187878
atggccgactcatctcaagaccttgaccaactcctcgatagtgctttggatgattttcagtccttcaacctcaatcctccccctccaagtggggaagcaagtgcgaacaagaagaaggagagtccttctttggcgtcgggggtgcaaggattgggcatgggtttacccgatttgagaacgaagaaaaaggggaaacagaaggctgcttccaaagacagccacgtgtcggaggcgctcaacaagctcagggagcagaccaaagaggctgttaaagggctggagtctatttccacacccactgccgatgatttggggaaggatgccttgatggaggattgggtgaaacagtttgagcagcttgctggctctcagttgattgtgttttgcatattctcatggggtcttacagtttga

SEQ ID NO: 71101 - DNA, 1569 bp, Glycine max
  Peptide Sequence Number=SeqID_187879
atggctgctaccattggcgttggcgccgcaaaagccatatcaatcgcaatagcagttaggcacctccgaacaaaaccttacgcagcagcaacaacaacagcacttgctcttctttcactccacaaacctctcttcctccctcattcctctcccttctcctctcgccgcgctttttgcgccgcgacgcttcgcacctccgacaacagagtgcaacagttccgcaggaagcttagggtttccgaaatcaaagaaggcgacggcgccgacgtgctcggccgcaacctagtcgtgcagggctggattaacgatggttcttgcctttctaacatgcaatgtgtgttgaattcggaggctgaaggttacgatcaggtagaatctggcttggttaccactggtgcttcagtgtgggtgcaaggagttgtggtgaagagtcaaggatcgaaacagaaagttgaattgaaggtcaacaaaatagtactgattggcaaaagcgatccctcctttcccatccaaaagaaaagagccagcagagaatttctaagaacaaaagcacatcttcgtgcgaggacaaatacttttggtgcagttgcaagggttaggaatgcattggcatatgctacacataagttcttccaagaaaatgggtttgtatgggtctccagtcctatcatcacggcatcagattgcgagggtgcgggtgaacagttctgcgttactaccttgataccaagttctcatgaaactaatgattctcctgttgatgctattccaaaaacaaatgatggattaattgactggtcacaagacttctttggaaaaccagcattcttgactgtttcaggtcaactcaatggtgaaacttatgccactgctctctctgatgtgtatacatttggtcctacattccgagcagaaaattctaacacttctaggcacttggctgaattttggatgattgaaccggagcttgcatttgctgatctaaatgatgacatggcttgtgcaactgcttatctccagtttgtaataagacatgttctcgataactgcaaggaagacatggagtttttcgatgcatggattaataaaggaatcattgatcgcttgagtgatgtagcagataaagatgttgtgcaaataacctacactgaagcgatagatctgctgtcaggagcaaataagaaatttgaattcccggtgaaatggggtagtgatcttcagagtgaacatgagcgttatataactgaagaggatattaaagcattctatatgcgacagaatgatgatggaaggacagttgcagccatggacatgttggttccagggattggtgaacttattggtggaagccaaagagaagaaaggcttgagtatctagaagctcgtttagatgatttaaagctgaacaaggatgcatattggtggtatcttgatttgcgtcgatatggttcagtacctcatgcaggctttggtttggggtttgaaagacttgtccaatttgcaactggaatggacaatataagggatgttattccttttcctcgaactcctggctcggctgagttttag

SEQ ID NO: 71102 - DNA, 240 bp, Glycine max
  Peptide Sequence Number=SeqID_187880
atggagttggtggttcttcctctgttgttttggtacaacaacaagaaactcattatcacgaaggagagacaaagaaactcttcatcacgaagtagagatgaaggtaattcgcaagctggttcatctttcttccaagaaatccatcacaaagcagggatggagggtgaacttggtattagggttccaagaatatcgaacgatggagctagtggttcttcctatactcttttggtgcgataa

SEQ ID NO: 71103 - DNA, 417 bp, Glycine max
  Peptide Sequence Number=SeqID_187881
atgtcatcacgtgctcagtgcatcatcagctcgtttagtgagaagattgtctcttttgtgcttagcgcgagaatggcgctaagtcaaatttcacttactcgcgctaagcgcgaagatggagtgattcctaggttcctggaggtggaggagacatccccactgctttgtaatctgacttactcctttatgctaagggatgctgatgttgatttgaatgcttattctgagcacttgataaacaccataatagacttactcccacatgctgagtgttttttgtttaggaaacaacttaaaccatattttaagagtttatctggatatgcgcttctcaacaatcccaatattagatatgtacatttgcaagtgaaccaggatgatacaagctatccaggccagagtagcaagaaccattga

SEQ ID NO: 71104 - DNA, 486 bp, Glycine max
  Peptide Sequence Number=SeqID_187882
atggagaacaacaaaaagaaagtagtaggaggaggcccttcctcatcatcattcaccaactttgatcatctttttggtcccaaggacccatccaccacttcatcttcatccaccagcatctttggctccattttcccaccccctccttccactgttggagggagagattcaacaaaacaggacatgggatgcaaaaattatggagcaccaggaaattacagttacaaaggtgaaagcagcgctagcggtgtcgtctccaacagcaagaatactactagtaccaattatcatcatcagaatgagacagtggagcccagctactacagttcatcaatctattatggtggtcaagaaaattattccccaagaaccaggaccactgaatcccaccatagtctgtttaagaaagacaagaaggatgatgatgatccaaatggtaatgattcaacagtgcttcaagagggaactggtggcaaggtaggataa

SEQ ID NO: 71105 - DNA, 873 bp, Glycine max
  Peptide Sequence Number=SeqID_187883
atggtgctttggagagacctggaagcaataaatggaaaaaaggttattcgaattgggcagcaagtgtgtaaagtcttggtgatggatagacacaaatgcaagctttgttcaaggtctttcagcaatggcagagcccttggtgggcacatgaaggctcaccttgcttctctccctctccctctccctccaaagcttcactcttgtttctcttcctctgactcagaacaagaacaatctttaagggagaatcctaagaaaaccttgaggattctggatcctgaagacagagagagcgagacagagtctaataagaacccgactcgtcaacgatccaagcgcaactggaaatctaccatgcccaagctcagcctcggacaccccgaagccgaacctctcagctccgtctccgacacctcccccgaagaagacctcgccatgtgcctcatgatgctctcccgcgacacgtggcaggaacacaaactcgccaatgcaggtccacccaagactcgctgcagcagcggatcagagatcaagctcaagaacaaagtccgctccaagcacctctgccacgcttgtcacaaatcctttcgatcctctcgcgctcttgggagccacagaaccctgtgctctccccgtcaggaagcccaaaataacagcatcattagtaataacaacattaaggtttttgaatgccccttctgttacaagctgtttggttctggccaagcgctcggtggacacaagagatctcacctaattccttcttcctcttcaaccgttaatcattctgtcaagttgaaacagagcttcatagatctcaacttgcctgctccggccgaagacgacgatcttagcgttgtttctgatgcctaa

SEQ ID NO: 71106 - DNA, 525 bp, Glycine max
  Peptide Sequence Number=SeqID_187884
atgagcatactgcaaagcatctctacaaaaactacttccgctaaagagggaaaaattcaattattatctccaccaccaaatgtaatgtttggacagacacaagataatcggttgtctctatctcttggctgcaatcttcatattgtcaagcaacattgtcctacagttcaattagttgaagatcacgaattcaaaccaggttggccaattgtgagtgttggagacatgattgcctattctcttctggcaggtgcagtgagtggaatatgcttgagcgtcaatggttgggcgcttgagaagagaggcccagtgttggtctccatgttcagccctattggcacagtctgctctgtccttttctcagttgttactctagggcaaaccattaatattggaagctttgcgggtatgttcctcatgttcactgggttctactttgtgctttgggccaaagggacagaaggctatgcaaaaggaggtggcttagagagtgagtatgatgcagagaagcctctattaagttga

SEQ ID NO: 71107 - DNA, 171 bp, Glycine max
  Peptide Sequence Number=SeqID_187885
atgactcaaaaacatgtcatgcttgtggaggagaaggttgatgtggagatgttgatggtagagaagatttatgcagctaagccgaggaagctaaatggtgaacagttcaatatagaaagtatgtcctccgcattagtactgtggcaaaccaacaatatagggcatgtttga

SEQ ID NO: 71108 - DNA, 435 bp, Glycine max
  Peptide Sequence Number=SeqID_187886
atgacgggattggattggagttgttgtttggaacttggaaataatggaatagacaaaaaagaggtggtgggggagaaggaaatactaacctgggtagatgtaaatattccattcctttcacctgctttcatcctttgttcctcattctctctctcgccggaaaaccgcctcgggatgaggaaccgcggtggctcggttgctgtcgaccaacctgcctctgttgcaccccaacgccaaacacagttgttggagatccacggcgcctccgccgctgccgccaccaaagtccgtttcttggtcggtgatttgcggtgtaatgctatttgggctgggcctcatctccctcttaacgggccacgtggcatctcatctcgaatggtactctcaccgactccgccaccacgctctctactccacactggttcgtattcctaa

SEQ ID NO: 71109 - DNA, 1800 bp, Glycine max
  Peptide Sequence Number=SeqID_187887
atggatgctttatctaagaaaaacgaaaattcttctcaaaagaaaagtgatggggttgttttgtcttgtctcaccacagattattcttccagtgataccagtttctgtggatccagttcttcagtttctactgatgaagctaaggcaaaagggtcttcttcacctgctcctcttggttggcctattctcaaggccacaatctccaagcgctctagttctgatgaaaaagaaaacagacataaatcccacttggaagacaaaaagtttaccagtattggcttgaagttgtcagaacttgacatgatgaaggagaggtttgcaaaattgttgcttggtgaagatatgtcaggttctggaaaaggggtttgcactgctttggccatttctaatgccattactaatctctgcgcaactgtatttgggcaattatggagactagaacctttaccttctgagaagaaagaaatgtggcagagagagatggaatggcttgttagtgttagtgattacattgtcgagttgatgccttcttggcaaacatatcctgatgggagtaagctcgaggtaatgacttgcaggcctagggcagatatttttatcaatcttccagctctccgcaaacttgacaacatgcttctcgaaattttagacagtttcactgctacagagttctggtatgtagaccaaggaattgtagccccagatgcagatggttcggcctcttttcgcagaacaattcagcggcaagaagagaagtggtggcttcccgtgcctcgtgtcccccctgcaggactcagtgaagactcaagaaaacagttgaatcactctcgagaatgtgcaaaccaaatactaaaagcagccatggctatcaacagcattgctttggctgaaatggaagttcctgagtcatatttggaagttcttcctaagaatggaagaacttgcttgggggattttgtttaccgttacataacatcagatcaattctccccagagtgccttcttgattgcttagacatatcctctgaacatgttgcactagagattgcaaaccgtgtggaagcagcaatttatgtttggcggcgaagagctcactctaggtcctcaccaaaccccaaccgttctaccacaaaatcatcatgggaaatagtcaaggacttcatgattgatggagataagagagaactactagcagatagagctgaaaacattctagtttccttgaagcagcgtttcccaggcttaagtcaaactacccttgataccagcaagatccagtgcaacaaggtggatgttggaaaatctgtgctagagagctactcaagagtattggagagcatggctttcaacattgtggcccgcattgatgatttgctgtatgttgatgacttgacaaaacattcagagaggtttgcattggttcctacaactacagttaacatggtttctcagcagaagaagattacacgtccaccactctcagtgtctgtctcaggcactacaccacacaaagcatcaattggcactcctagcttttcatctgcggctgtgccactaattagtcctgcaagaggggagagaactcctttcctccacaacatcaacaacagcatcaaacctcatcgtcgcggctttggggtgaggagagtgttgtcaaattatcttggtgtagagacaaagactactaagatatgcagcaactcaactgaggtgaattgttcaaacccaagtagcaagaaaaccgaactacaacaacaaccagaacaacaacgtcagaagtttaaaaacaggaccaaatga

SEQ ID NO: 71110 - DNA, 288 bp, Glycine max
  Peptide Sequence Number=SeqID_187888
atgtcttcttcgtttacgagtctccacatcaccgcgttagacgcgatagtgaaccctcaacaccgatccggcgtcgtcaaccgcaccgccctccgcgccggcatgctcgtctccgtcgccggttgtggcttcctcatgctcgccctcgtcaacgtcgcgcagatcaagctcgaaaccctcgtctgcggaagctcacacacttacgccgccgtcatcccgcttctcatcttcgtcccccttgcactcctcatctacttctcgttcgttctctacgctttcactcgctag

SEQ ID NO: 71111 - DNA, 1317 bp, Glycine max
  Peptide Sequence Number=SeqID_187889
atgctatgtcatcaccttcctgctatttcaaacacatctgctgtacgcgagcgcaagtctaaaggctacttgctaattgcaactagtggaggactgaaccaacaaagaactgggataacagatgcagttgttgttgcaagaattcttaatgctacattagttgtacctgagttggatcatcaatctttttggaaagatgacagtgactttgccaatattttcgatgtgaattggttcattacatatctcgcaaaagatattactattgttaaaagagttcctgataagatcatgcggtcaatggagaaacccccttatacaatgcgtgtaccgaggaaatcagaacctgaatattatcttgatcaagttttgccgatactctcgagaagacgggttctgcagttgacaaaatttgactatagacttgcaaataatcttgatgatgagctgcaaaaattacgttgccgtgttaattatcatgccttgagatttactaaacctatacgagaacttggtcaaagacttgtaatgagaatgcaaaagatggcaagccgttatatagcagtccatttgaggttcgagccagatatgctggcattttcaggttgttattttggtggtggtgaaaaagaaagacgcgagctaggtgaaatcaggaaaaggtggacaacactgcctgatttgagccctgatggagagcagaagcgtgggaaatgtcctcttactcctcatgaagtgggtctgatgctgcgagcacttggttttacaaatgacacatatctctatgttgcatcaggagaaatatatggtggggatgggaccatgcagcctctcaaagatcttttccccaacatttatacaaaggagatgcttgctcaagaagaagagctgaaaccttttcatccattctcttcccgccttgctgctattgactacattgtttgtgatgaaagtaatgtatttgttactaacaataatggaggtatatgggtcacaaaagaaccatcagaccaaatgcaagagaagcttagtgcgctgttcatgtcaaggcatgagatggactgggatacatttgcaagtaaggttaaagcatgccaaagaggattcatgggagagccagatgagatgagacctggaagaggagagtttcatgaatatccaagcacatgtgtgtgtgagaaaccattcatggatgatatcagccaagacggactccggccccctaaactcgcagccaacaatgtgacaatgaatggaggaggaaatgaagaaagtgttgtactacaaaagcgaagtgggagaagggctagcacgtga

SEQ ID NO: 71112 - DNA, 315 bp, Glycine max
  Peptide Sequence Number=SeqID_187890
atgcatttccttcttgagaagacgcctttttctttttgcctcgccctcccgtcgaaggtattcctagaagtacagcagtatgatattttagttgaatgttactgcagcaacccaagaaacttaaatctactcactgagcaagacaatcagacccacgaggtcacccctaaagaagtacacttcgagaatacattatatgttcctgagacaattaaatcatgcttcgaggtcacccctaaacttaaatctgaagaagtacgcttcgaggagataaaccaaaacatggatgattggagtattccagaaatcccttag

SEQ ID NO: 71113 - DNA, 198 bp, Glycine max
  Peptide Sequence Number=SeqID_187891
atggaggagctcatgacattgaggaggcgccaatggttctcaatatggaccaagaggatggctggaagactgacccaacctgaaactatgcaactgcaaggaatggttcaggacagaaaagtgatgatcctcatcgatagtgaagccagccacaacttcatctccagccagttgatccaaattttggggctctgttag

SEQ ID NO: 71114 - DNA, 1440 bp, Glycine max
  Peptide Sequence Number=SeqID_187892
atgagcgagttccgcgtgtttgcagaagcgtgtgggcgtgaggatcatggagattctccgcatgccaaacctcaacacagacgatctaagagtgcttctgaaaggaacctggcaaacgcaagaggtggtggagcctcgcatccactcgagaaagaccacaatgaatcccttgtttcaacatcttcggtgagtgcttctaggttacggagtccgttgcatgacaatctcactcgtgtaaacaagaatacctcttcaaatcatagagcattcttagaaaaagatgttgagcaactacagttacggttacagcgggagagatccatgcgcattctgcttgaaagggcgatgggtcgagcctcaagtactttatctcctggacacaggcactttactgcccagacaaaagacttgattgctgaaattgagttgcttgaagaagaggttataaaccgtgagcagcaagtactttctctgtacaggagtatttttgaacagtgtgttagccggtcaacttctcaacaaagttctgctgttgcttcacctgctcatacaaggcaaggatccaggaagcatccgagtataatttcaagtgcattctgttcatcaaaaaaattccctctacgaaccctgcaaggtctagtttctaataatgactcgaggaataaaatctttgggtctaatcatggtcctttatcacgtggtaaaggcaacaattattttaaaaagacttgttctgattccaccaagttcaccagctggtccagtcccattattctcttgacccagaatttagaacaccagaaggaattggtcactgttgaagtaaccagtgttcaagctcacgaaaaaatttctacaatccagaaaactcctattttacgtactttgaaagaccatctataccagtgtccaagcaagctttctgaggatatggtgagatgcatggccactgtatattgctggcttcgtagtgcaacctctgtaaattctgaaaacggtaggtcaccattattgtcaaggtcatctactaatgctatacagcctcgaaatggtattggagacgatcttgactggtcctgcaaatcagcagttgaaatttcttggatatctactcacaaacgtcattcttcccatgcttcttatgccatcaaaaattacagagttttagttgaacaactagaaagggtgaatgtcagtcaaatggatagcgatgcacaaattgcgttctggatcaatgtgcacaatgctcttgtgatgcatgcatatttagcatacggaattccccagggttctctcaggaggctagccttgtttcacaaggggactcgccagtggggttggcgagttggacacgtggcagcgcctggtggactcgccagtggagttggcgagttgctgtccacgtggcggccacttggcgggtcccgccactcgtactga

SEQ ID NO: 71115 - DNA, 264 bp, Glycine max
  Peptide Sequence Number=SeqID_187893
atggatgtagaattcacaaagagatgtctacctaggaacctacttgaatggactctaaaccactcctacttcactcaagaaactcccctcaagatgatatgcacatggcaaaaggatttctatgtcacgtctaattgcaccttctcttctatggtgttattgtccttctccagattattcttcacacatcatgtggaacccatcattgaagaagttgaatctgatattgacgctgcgtctgactccctagttgttcaagtgtag

SEQ ID NO: 71116 - DNA, 453 bp, Glycine max
  Peptide Sequence Number=SeqID_187894
atggaaaacagtgggaaactaacttatcaaaatgagcctttcatcgtggcagaacaagctaaacatgtgttttatgttcaagatccttgtgttgaaaggtggtcagtggttctacacggaaaaaacattggtcttaatcttgaagatgatgattcaacccttgatacttttcttactcctttctccacacaaatgcctaatgtcaatggagaagaagttgaatatgcacatgactacaccaccgcaccttcgttgtctacgccgaagaagactagaaaagcaacacagctcatattattggctaccagacttgttaggatcgagagactagtgaaacaagttcctgcagctcagaggaatttgatttgggaggacgttcaggctgaatttgatattccaaaagcatccgaccaaaggacggagaagaaaatccttaagacaatagaggagtga

SEQ ID NO: 71117 - DNA, 595 bp, Glycine max
  Peptide Sequence Number=SeqID_187895
cggtggcggaggcggcagggccgcggaggaaggagaggaatccggtggcctgagagttgtcctggtcgtcaagaaacagatcctccggcacgcggaacgcgccgtggaggcagacgacggcgacgccaagcatgagagcggagacgagaacagatccaacgctggtgaggaagacgacgaagacgaggtagaggaaggtccaggaggcgaggaggccgacgaggaggatgagagagaaaggattgtaggagaagttcttgcggacgcggagggtggcttcggagaaggactcgggcttcgagaacgcggagcggtccccgagctccgaccacgggcggcgctggtcgaggccgtgtcggagggacgcggagaggttgttgatgaaggcgcggaaggccgggttgttcgccggagcctcgatggcgccgccgcctgcggcggtggtttgggggttggatatgggaaggacgggagccgcggtggaggacatgatagttttagagagagaaagccagaaagggagggattcttgtgggttttcggaagccctttcgctggtcagtcacacgtcaacgcgtttgtgaaaggggcataa

SEQ ID NO: 71118 - DNA, 309 bp, Glycine max
  Peptide Sequence Number=SeqID_187896
atgactcgcacaaaaaattttggagaaatgacatctgaggtggcacgcgaaattgcagataggattccagatacagtcccaaagttagacccaggtgcaatccaggtagttgtactacctcctaagcttaaggctggtccttctattacccgtgacccaaaaatgggtgaatcagaaaaatgtgggttgtatgttgatgacaatcctccctgcctggttgcccttggaagagtttatgaggggtcgacaactgtccacaatgtccctttaggaaatgatcaagtgaaggtcaatgttgaggaagtttga

SEQ ID NO: 71119 - DNA, 1182 bp, Glycine max
  Peptide Sequence Number=SeqID_187897
atggcaaaaattgatgttattgagaagctacctccaccagttaatgtgaagggcatccggagtttccttggccatgctggtttctatcgatggttcattaaagatttctccaaaattgccaagccattgagcaattttttgaacaaggacgttgtgtttaaaactgatgaagagtgcctgccagcttttcagactctgaaggaaaggcttgtgtctgctcccgtgatggtggcccttaattggagccaagagtttgagttactgtgtgacgccagtgactatgcaattggtgcagttctaggacaacaaaagaataatgtattcccttcaatttattatgctagcaaggtcctaaatgatgcacagttgaactatgcaaccactaaaaaagagttattggcatttgtatatacattggagaagctcaggtcatacttggttggctccaaggtcattatttttatcgatcatgcggcaatcaaacaccttctaacaaaggttgattctaagccaaggttgattagatgggtactagtgctccaagaatttgatgtcgtaatcaaagacaagaagagcttggagaatttggtggttgatcacctatctaggttggttaatgaagaagtcactctagatgaaaaaaagattctggatgaatttcctgacgaaaccctattgtctgtgggtgaaaggccttggtttgcggacatcgctaactacaagcagttggaatcattccagatgatctcaattggcatatgcgaaagaattttccccgaagccaagagtatattgtggtattttcacaattctccatatggaggacattatagtagggatcagacttctgcaaaggtgttacagtctggattcttttggccttccactttcaaggacacccatgagcacgtgcttcattgtgatcaatgccatctcccatcttcatacagtaacgagtatatcttggtggttgtggattatgtatcaaagtgggtggaagttgtggctgctcagaagaatgatgtcaagactgtcatcaaattcctaaagagaaacatcttctcccgctttggagtctcagggttcttatcagtggtggtgacaaatggccaggcatgggtatccaacaaagaactaaagaagattttggagaagattgttgcatcctcaaggaaggattag

SEQ ID NO: 71120 - DNA, 603 bp, Glycine max
  Peptide Sequence Number=SeqID_187898
atggagcttagtgcacaacctagcgccacgcccaaaaccttctctatctcatggcctcaaagaagcacagagttggtaccagtcagccacaaagggcggagcccgcatgggactccaccagatttgtctctgaggtcgcctagcatcgctatcaggacaacgttcatctctgaaacactcttctggagaggaacatggagctcgcttatactcagtatgatgaattccttgaggagttggagtgaagatgttgaacgccttcctggagacgccgatcatcatttcggagggggagtggctgaccaatttttcccagtttcttcacacctaccccaaccatcaaaccattacgaggaagctgtgtatgccgggtggccagtttataatattgaatgccgaaggggctctatgaaagattttgtggaaggacttgaccactctcgctcaaacatggagtgtcttatggacatggacttgggtagcatgatattctcccagatcactcaaattgcccagtccaactcttctaggttgggctcccctgctttgatcacaaccctctgggacaccaaaggggtcatttcaaacaccctgactttttag

SEQ ID NO: 71121 - DNA, 499 bp, Glycine max
  misc_feature (437)..(437): n is a, c, g, or t
  Peptide Sequence Number=SeqID_187899
atgggacacaacaacacttgtcatcatcatgtcaaaggtttccacacagacccttttcagcatagcctctcttttgcttcaaatggtggtggtgataggaggaggaaatgccggagcaatgaaaaaagtggtagcggtggtttcatttgcttacccttttttctgtttcttttggcttccacttccaccattcagcatgtttcaggccacttgtgggatggggtggttgtgactcaggctgattttcaagcccttagggttattaagaatgagcttattgacttcaaaggggtgctgaaaagctggaatgacagtggtgtaggtgcttgttcaggaggctgggctggaatcaagtgtgtgaatggtgaggttattgcaattcagcttccttggagagggttaggtgggagaatttcagagaaaattagccaacttcngtctcttaggaagctcagtctccatgaaaatgctcttggtggtccagttcctttgacacttg

SEQ ID NO: 71122 - DNA, 366 bp, Glycine max
  Peptide Sequence Number=SeqID_187900
atgtttttctttcactctgactcaacctttgccgctcaaggttcacgctcacccttgtttcacactctggctcaagcttctcttctcggtttatgggttaataatttgattcatttttacgggtgttgtaagaagattgtgaatgcgaggaaggtgttcaatgaaatgcctgagagaactgttgtttcttggaactcgattatgactgcttgtgttgagagtctttcactgggtgatgagattggattagatgtttacttgagacaacaagacattcaattgctaatacctcatatgcctctaccactaaagcaccattaccacgtcattcaaaagcatcatcagagcataaaactcgatcagtag

SEQ ID NO: 71123 - DNA, 1371 bp, Glycine max
  Peptide Sequence Number=SeqID_187901
atgcttcagtctcttgatattagcaacaattccctcagtggtaaaatcccttctagtttagcaagatccactaggatattcaggatcaatttgagcttcaactcactttctggatccattcctagtagtctcactatgtctccttctctaaccattcttgcacttcagcacaacaatctctccggttctatcccagattcttggggtggaactggaaagaagaaagcctctcagcttcaagttttgacccttgatcacaatcttttttctggaactatcccagtttctctagggaagctagcttttcttgaaaatgtttccttgagtcataacaaaattgtaggggctattccaagtgagctaggtgcactttccaggcttcaaattcttgatctatcaaacaatgtcatcaatggcagccttcctgctagcttctctaacctctcttctcttgtttcattgaatctagagagcaatcaacttgcaagccatattcccgattctttggacaggttgcacaacctttctgtgcttaacctgaagaacaataagcttgatggccaaatcccaacaacaattgggaacatttcaagcattagccaaattgatttatctgagaacaaattagttggagaaatcccagattcccttaccaaacttacaaatctcagttcattcaatgtctcctacaacaacctatctggtgctgttccatctctactttccaaaaggttcaatgctagctcatttgttgggaatcttgagctatgtggattcatcacttcaaaaccatgctcttcaccccctcctcataaccttccaactcaatcaccacatgctccttccaagccgcatcaccacaaactaagcaccaaggacataatcctcatagtggcaggtattctcctgttggttctgagaagagctgcttcaagcagaaagagtagcaagactgctaaggctgcagcatctgccaggggtgttgagaaaggtgcctcagctggcgaagttgaatcaggaggtgaagctggtgggaaactagttcactttgatgggccttttgtgtttactgctgatgatcttttgtgtgcaactgcggagataatgggaaaaagtgcatttgggacagcatacaaagcgacactggaagatggtaaccaagttgctgtgaagaggttgagggaaaagaccactaaagggcagaaggagtttgaaactgaggttgctgcacttggcaaaatcagacacccaaatctcttggcacttagagcctactatttaggaccaaaaggagagaagcttcttgtgtttgattacatgaccaaaggaagcctagcatcattccttcatggtaagtactatggtaattag

SEQ ID NO: 71124 - DNA, 452 bp, Glycine max
  Peptide Sequence Number=SeqID_187902
acacaagaagatctacctccggctactgcgtttatctcggtgacaactcgatctcatggtccgcaaaacgccaacataccttgtctcgttcaagtgctgaagccgaatacagaggtgtcgctaatgttgtgtctgaatcatgttggttacgcaacttactcttggaactatgttgtcctgtcacaaaagctactctagtatattgtgacaacatcagcgcagtttatctttccgacaatcctgttcaacatcaacgcaccaaacatattgaaatggatatacatttcgtgcgtgagaaggttgcttgcggtcaagtacgcgttcttcacattccctcgcgttttcagattgctgacatcttcacaaagggacttccgttgcaactctttgatgactttcgtgatagtctcaacattcgttcacctccagtttcgactacgggggtgtattag

SEQ ID NO: 71125 - DNA, 216 bp, Glycine max
  Peptide Sequence Number=SeqID_187903
atgggaggaaatcgtggtaactcttcaccgtgtaggcatggcagcggaacccgaccccgtgagaaccgaatcgaatctgccccgactttgacggataaaaaccgcgttgagtgggttcggggtcgggtttgggttttccccgataacccaaaacggggggcgggggcggctactgcagctctcaacctctcagtcaaggagaagtggagaacgtga

SEQ ID NO: 71126 - DNA, 794 bp, Glycine max
  Peptide Sequence Number=SeqID_187904
gtattcgccttactgaaaaggaaacaattcatttatgcttaactaagattgagaatatgctacaagcgaatagaagaagcttgcgagattttacatccatgccatacgcaataggatatgcacgaaaccaacatcataataatctgatccataatgaaatgacatatgacaaagagatgttagcagaacaatacaacacggcataccaattgctgacagatgagcaaaaaactattgtcgataccattatgtctgtggttaacactcaatcagctgcagtttactttctctgtggatatggtggaactggcaaaacatttgtttggacaaccttatcatctggtatacgctccaatggtggaattgtttgtacagttgcttcaagtggaattgtttcattactattgcctggtggtcggattgcacattccaaatttgctatgccagtccctgcaacagaaaattcaacatgcaatattcatcaaggcagtgagttagctgaattattaaaggttacaaaactaatggtctgggatgaagctccaatgtgtcacaaatttgcatttgaggaactagataaaagtcttaaagacatcatgcaaaacaatctgccttttggagggaaaattatggtttttgggggagatttccgacagatcttgccaattgttccaaaaggtaatcgctcagacatcgtccatgcaactataaatgcatcatacatttgggaccattgccaaattcttaaacttacaaaaaacatgagattgctatcaactactccccaacaatga

SEQ ID NO: 71127 - DNA, 525 bp, Glycine max
  Peptide Sequence Number=SeqID_187905
atgggctacgtgggagtacgtgagctcagttggaggtgggctacaggggatggtgggtttatgcgcgcattgtggatgtggaaaacttgttgtgcaccatcgcccaaccgccacctagtaccacatgtgatggagtggtacctggagatatgtcgcgggggtcaggagaccttggggacgtcaggtggggtgctattgcccaaaaccaagcttgaccaatcccgacccaacccgggcatagtcggtcagcttgaaaacggagtcaggaagctaagggagcctctgatcgtgatgacggcgcagctaatccgtgatcgagtagagatggagtgcctaaagggagcttgggagaccctcgaaggcaacacgaggtgccgatttcggggcaccattcgattcacggctacttctttggtgcatccagatgaacctgcacggacgcttcagcgcacggtggagtggacaactccttggattagtttggtatactttttgagggtgggcgtatctaggactgactgttag

SEQ ID NO: 71128 - DNA, 2734 bp, Glycine max
  Peptide Sequence Number=SeqID_187906
atgactacctctgctgattcttccgacccacctcctccttccactcctacgccgactcaccctgctctcactgtcccaaatatttctaatttcattaagattactctgagcattgaaaaaggcacgtataacacgtggtccgaacttttcaaaattcatgctcgagtttttcaagtgattgaccatatcattccctctgaaccagccgcagatccctctcttaaaactaccaatccacagttatggcttcgtctcgacgccgtcgttttgcagtggatatatggaacaatctccgatgatcttctcaacactatcatcgaacataattccaccgctgcaaccgcgtggaatcgcttattcgacatcttttatgataacaagaattctagggctctctacctagagcaagaattttcgcgaactcatatggagcaattctctgatgcttcctcctactgtcagcatctcaagtctctctctgatcaactagctaatgttggtgcccctatatcaaatgaacgtttagttcttcaactcatttcgggactaaccgatgcatatgctgctgtgggatcccaaattcgtcatgctgattcacttcctcagttctataaagctcgttccatgatcattttggaagaaacagcactgcagaaaaaggtgtcaaactcagtcgaaaattcatctttcatggcatcccacaatgacgcaccagttgattcatcgacatcccgtcctaaccgcggcaacaacggtaaccacaatcgtggtggccgaagccatggcagaggacagcgtggacgaggccgagggagaaacaatggacgtggcggcggtcgtgctccgcaacagcagtggccttcaccatactacccgcatcagcagtgggcttatccgccgtacccaaatcaatatcagcagtggagctccccgccatggcaaccatgggctacaccaccttgtccgtatcccacagcaagaaatccaaaggaacaacccggcatccttgggcccaagccgtctcaccaagctcatgtcgccaatgcagcgccaacctcctcatatgctccaacggatattcaagctgccatgcatactctctcactttctactcctgatgatcagtggtacatggacaccggagcaacctcgcatatgacggctaacggaggtaatctcacgtcctacttcaatttgagtaataatattactgtcggtagtggtcaaaatattcctgtaattggttgtggacatgcatcattaccaaattcccttcatcctctaaaattacctaatgttttacatgcaccaaaactcataaaaaatcttatctctgttcgtaaatttaccatagataatgatgtgtcagttgaatttgatccttttggtttttctgtgaaggattttcagacaggaataccgttaatgagatgtaacagttctggtgacctctatcccattgccacaagaccacctaatacaaccttgccaccatccacctttgccgcgttatccacggaattatggcacaaccgtttaggacatccaggagctactatcttaagttctctgcaccgagacaactttctccaattgacctctggacttcaccaattctcagttcagagggtcatcgttactatgtgttgtttcttgacgattacacaaatttcttatggacttttccaattcatacaaaatctcagattttcgtgtcctcacacctcctcacaaaatggaaaagccgaaagaaaaattcgtaccataaacaacatcatccgtacccttcttgcccatgcctctttacctccatcaatgtggcatcatgcactacacatggccacttacctacataatatccttccaaataaaaagctttccctccaatcacccactaaaatactctaccaaaaagatccggcctatactcaccttcgtgtctttggatgtctttgctatcctatcatcccttcatcatctaggaataagttacaagctcggtccacaccttgtgtcttcttaggatatccctcaaatcatagaggatacaaatgctatgatttatctagccgtaaaatatttatttcccggcatgtcatttttgatgaaactaagtttccattttctaatctaaatgtccctacaacggttggctataattttctggatgacgacacacccttccttccatcctattcctatagtgctccaccctctaaccatcaaaatcgtactccacccctaactacaccagttcaaacaaacatttatcaaccatcaccatcttcttttaattcgcctctgtcaccctcccacaatcacacctcaccaaccacagcatcagccccatccataacatcacctccaaacccatcattaccaactatcatatcatccccatccccgactcctccaccttcacaacaaaaaccgcccctctcccctcaaatgacaaccagagcccaacacggtattgtcaaacctcgcaaactcttcaatctccatacatcaacctcaacctccatatcccctctacctacaaatcccattgatgcattaaatgatcaaaattggaaaatggccatgaaagacgaatatgatgctcttattgaaaataagacgtgggacttagttcctcgtccgtctaatgctaatgttattcggagtttgtggattttcaggcataaaaagaaatctgacggatcctttgaaagatacaaagctcgccttgtag

SEQ ID NO: 71129 - DNA, 255 bp, Glycine max
  Peptide Sequence Number=SeqID_187907
atgactcactccttaaatgatgttgaagctatacacgcaacaccagaatccatttgcaatcctactaattacaacattggttgtgaccatgttgttaacaaccaaaaaaatgagaatgaaaccccacctgcgacacaaaattcaaagccaaaacgaggaagaccctttaaaacgccacctgaatcgattaaaaattggtatgttatacgcaaagaacgaaagatcgccaacaggttcgatacgagggaaaattaa

SEQ ID NO: 71130 - DNA, 885 bp, Glycine max
  Peptide Sequence Number=SeqID_187908
atgagtgaccttatgaaaaaccatagcagaactcttctccaccaaaccagtcaagttctcaattttcacaagcatcttctgatacaactcctccaaaccctcggtgcagctcctggcctcagaccccatcattctgctgagcctcccaatctcaaacccctcagcgcatttgtcgagctccctctggtccttggcggcctgcttcatttttcccagaacctcgtcgccaccttcgctcatcatcatcggggagccgtggggcccgcagtcgagcggcggaaggttggaattggggctgaaggcgccgtagtggccgcggaaggcgggaccgatgttgacgacgtcgagggagcggggctcgaaggagagggccgcggggcggaactggaaggcgcggtactcgtgggtgtggacgtgggagtggtggttgtcggaggagggggaggcgaggaggaggaagatgcaaggaggaaaaagagagggttcggagtttgggttttggatttgggaggagaattgggtgagggaggagagggaggcggtgacggagaattcgcgcatggaggggcggaggggggagcggcggcgggcggagaaccagccgaggaggggggaattggggagggaggaggggaggacggtgccggaggaatcgtggaaggagggggaggtgaggaagccggtgacggtggcgaggagggtgggggtgggggtggcagcggaggaagtgtcgtcgtcggagagggtgagagggagaggggtgacgtggccgaagaggaggccgtggatggaagagggggaggtggagaagcgctggatgagggaggcgagtgtggggcccgaaatcgcgatcttctgcaacggaggatcctccatggccagtaa

SEQ ID NO: 71131 - DNA, 276 bp, Glycine max
  Peptide Sequence Number=SeqID_187909
atgtctaaagaagttgatatgaatgttgaaaatgaggaaggtgctggcatgaaagtagaacacgtcgattgctctgatgcctttaatacttctcagttgtttgctagccgcgatgaagttttacattgggctcgattggtggcttgtgacattggatttgttgccgtgcttgcaaaaggagtggtgagtataggtgatgtgaacctgagtaggagcggatcgttcgatacaggctacggagatttcgatgacgccacttccagtgaaggaagataa

SEQ ID NO: 71132 - DNA, 333 bp, Glycine max
  Peptide Sequence Number=SeqID_187910
atggcgttgatgatggagaagcagctgaggaagaagaagatgcagcagaggatacagaatcagatgatgatgattctgatgccaccccatgaccatcagacctttagttttttttgctttttactcttactagctattggggcatgtccctttgaacaattgattgttattgctgatagaagatgctgcagtgaactgctgcctagcagaatattcacttcacagcaaattttgctgtcaccactacagatactgctgtgcttgattactctgataatgaaagttgctgatcccacttgcatgactgctcgtacctgctcaggaagtgtctaa

SEQ ID NO: 71133 - DNA, 687 bp, Glycine max
  Peptide Sequence Number=SeqID_187911
atggaggaggacttcctaaagctttcacaaacattcaatgcaataagatctgttgtaagggtgccagctctggatcctaaatataagatagcggttctggcatcaaaacaggaccactgcctggttgatttattacatggatggcaggatggaagacttccagtagatatcacttgtgtaattagtaaccatcatagaggttcaaacacccatgtgatacgttttcttgaaaggcatggcattccttatcattgtttatgcacaactaaagaaaataaaagagaaggggagatattgcagttgattcagaatactgattttttagtacttgcaagcattgatttatatgcaaagatactatcaggaaactttttaaggagctatgggaacgatataattaacattcaccatggtctgttgccatcattcaagggtggtaatccatctaaacaggcctttgaagcaggtgttaaattaatcggtgcaacaagtcactatgtgactgaagaacttgacgcaggacctataattgaacaaatggttgagagagtttctcacagggataacttgcagagctttgtacagaaatcagaaaacctagagaaacaatgcctttccaaggctatcagatcttactgtgaacttcgggtgttaccttatgaagaaaagaggactgttgtattttga

SEQ ID NO: 71134 - DNA, 354 bp, Glycine max
  Peptide Sequence Number=SeqID_187912
atgacttccaagggtgcaattctcttgtgtctcaatgttctcttcttcactgtggttagttccacatatgttccatgcaacccaccccccaaaactcccaaacacccacctgtcccaaagccaccttccccaaagcaagtttcttgccccaaggacactgttaagtttgggaagccaccaaaaaccccatgctgcagcctcattcagggtcttgctgatcttgaagctgcagtgtgcctttgcactgctctcaaggctaatgtgttgggcatcaacctcaatgttccagtgaacttgagcttgcttctcaactactgtggaaagggtgttcccaagggattcgtctgctactaa

SEQ ID NO: 71135 - DNA, 168 bp, Glycine max
  Peptide Sequence Number=SeqID_187913
atgcacttgaggaactccttggatgtcgggaagcacaaggatggagtggtgcagcaggaactagatcatgtcaacgatgtggtggccgtgacaaaggaggagataaagatgatagaagatgagcaaggaggaagggagaagaagaggagaaaaaattatattttatga

SEQ ID NO: 71136 - DNA, 699 bp, Glycine max
  Peptide Sequence Number=SeqID_187914
atggggtcttcagaattacagatacagactgataatggtctaattagcatgccaagcaatatctgctgtgtcgttgtagagtatcttgctggaggtacgctgaaatctttcctaataaagaataggaggaggaagttagcttttaaggttgtcgtccagctggcacttgatcttgcaagagggctgagttatcttcactctcagaaggttgtccacagagatgtaaagacagagaacatgctgttggataagacacgcactgtcaaaattgctgattttggagtagcacgcgttgaagcttcaaatccaaacgacatgactggggagactggtacgcttggttacatggctcctgaggttttgaatggcaacccctataacaggaaatgtgatgtgtacagttttggcatctgtttgtgggaaatatattgctgtgacatgccatatcctgacctaagtttctcagagattacttcagccgtggttcgccagaatctgagaccagaaataccaagatgttgcccaagttctcttgcaaatgtgatgaagcgatgctgggacgccaatcccgataaacggcccgaaatggatgaggtagttgccatgatagaggctattgacacatccaaaggtggaggtatgatccctgttgatcagcagcagggttgtttttgcttccgtaagcacagaggaccttga

SEQ ID NO: 71137 - DNA, 2640 bp, Glycine max
  Peptide Sequence Number=SeqID_187915
atggcggtgtattataaatttaagagtgcaagagattatgattcaattcccatggacggtcctttcatctctgttggtactttgaaagaaaaaatatttgaatccaagcatttagggaggggtactgatttcgaccttgtggtcaccaacgcccagaccaatgaagaatatcttgatgaagaaatgttgattcctaaaaatacctcagtgttaattcgtcgggttccaggacggccacgtttaccaattgttactgaaatagaacaaaaggtggaaaataaggtggtggaatctgaacctgaaaacagaagcttaccagctgaagatccatctgccatgaaatatcctgaagattcagactgggatgaatttggcaatgatttgtattcaattcctgatcaagtgcctgttcaatcaagcaacttaattccagaggctcctcctcccaacaaagctgatgaagacagaatcagaagtgaatggaattgtaagattaggggagtgagggaagaggaacataaagtcaaggttcagattttggcactggtagaggctttggaaggggtacagggggacggatgggtggtggacgtggttttgttaattgctgtttttaatactaatatgttgatcacaactgatgctgaggtctggcagggatggagcgaaaaacacctccacaaggctatgtatgccacagatgcaaggtgcctgcactgtcctacaaatggtgacccgaattatgacatgagaaaagtcaagcaacctactggtattccaagatccatgctgatggtaaatccacaaggttcctatgctttacctaatggttcagtagctgtcttgaagccaaatgagcatggagttgaatttaatcttttccttgcaaacagggctgcttttgagaaagaaatagaagggatgccatcaacacgttctgttggggaactaccacccgagctccgctgtcccttatgtaatgatgttatgaaagatgctgtactgacaagcaagtgttgctttaaaagcttttgtgacagatgtattagggactatattatctccaagtctatctgtgtatgtggtgcaacaaatattcttgcagatgatctcttaccaaataagacattacgagataccatcaatcgtatattggagtcaggcaatagcagtgctgaaaatgctgggagcactttccaagctcaagatatggagtctgctcgctgtccgcagcctaagattccatccccaacctcatctgctgcgtccaagggagatctaaaggtttcatctgttaatgaaaaaacaacaaatatacaggaaacagcagatgatagaaaggctgtttctgctccacagcagacatcagagcaagtaaggaaccccagagctgctgatatatccgaagctactcacgagtctatgagtgtgaaggaaccagcctcacaagggagtgctcagcaggttgaggaagaagtgcagcaaaagttggttcctactgaggctggaaagaaaaagaaaaagaagaaagttcgtttgcccccaaatgatttgcagtggaaaaccccacatgactttggggctgagaactatatgatgaataatatgatgccaatggttccacctcctggctataattcgtactggaatggcatgcaacctatggatggatttatggcaccgtatggtaatccaatgcaaatgatgggttatggtctgggccccttggacatgccatttggtggtatgccacaagacccatttggcatgcaaggttacatgatgcctggtttcccgcctcatagggatcttgctgacttcagtatgggaatgaatgttccacctcctgtaatgagtagagaggagtttgaagcccggaaagctgatatgaggaggaagcgtgaaaatgatagacgtcctgaaagggacttctctaaagatcgagactttggtagggaagtgagcagtgttggggatgtttcttcaatgaaatcaaaaactaggtcaattccaccgtcctcgggtagcgattaccatcagccccgtttccgttcagagcgacactcacctgataggtctccgcgcgatgtggaacctccacctccacgcccaaccaagagaaagttagagcaccactccgatcgcgaacgcgaagacagggatcgcgactatgagcacgagcgccaccaccgccgtcaccgatcggaatcctcatccagaaggtcatcggaaccagtcgccaaaccttcatccaatgccgctgctgctgctgctgcagcagcagcagcagcagcggcagcagccgcggatcgcaagcagaaggccagcgtgttctcccgcataagctttcctgctgaagaggaacctcctaagaagagaaaagtcaccgcttcttccacaacggaaccagccgctaccgccgccgcacccagtgcctcttcggcacacctaaagacagtgtcgaacggttactacgaagggaggaagagtagcggcgtggcggactacgaatccagtgacgacgagcggcactttaaacggaggccgtcgaggtacgagccgtcgcctccgccgcagccggcggagtgggaggaggaagggaggcattcgagaggaacgagggagcgcaagcataggtga

SEQ ID NO: 71138 - DNA, 774 bp, Glycine max
  Peptide Sequence Number=SeqID_187916
atgttggacccggttctaacgcacttaggtcatgcaaatttaacggacggctcagatctattcatctatagggttaagcaagggacggcgtctataaaacttagagcaacacttcatcgaaaccctagttcttcgctactgcgactgcgcttcagcacaatgggtgcctacaagtatgtttcggagctatggcgcaagaagcagtctgatgttatgagattcttgcagcgggtgaggtgctgggagtatcgccagcaaccttctattgtccgtttgacaaggtctactcgcccagataaggctcgtcgcttgggtttcaaggctaagcagggttacgtgatttaccgtgttcgcgtacgaaggggtggccgtaagagaccagttccaaagggtattgtttatggtaagcccaccaaccaaggtgttactcaactgaaatttcaacgcagcaagaggtctgttgccgaggagagagccggaaggaagttgggtggcctcagggttctcaattcatactgggtgaatgaggactccacttacaaatattttgaggtcattctggtggatgttgcccacactgctgtaagaaatgatccaagaatcaactggctctgcaatccagtccataaacacagggaactgcgtggcctcacttctgctgggaaaagcaataggggtttacgtggcagaggacatctctaccacaaaaatcgtccatcacgcagggcaacctggaagagaaacaataccctctcccttcgtcgctaccgttga

SEQ ID NO: 71139 - DNA, 312 bp, Glycine max
  Peptide Sequence Number=SeqID_187917
atgccattaaggcacaaaattcctaaacaattgcatcggataggtcttggaggcgtgtttcatgctgatattggccgttggaagtttggtttctcaacatctaaaccattaggaaactctctcatagccaagttgcaagcttggaaacatggttatcatatgttatgttggatcgggattggcatgtctcacaaagttgcggattctcttacaagatggggaacaacttcttctaattatgatcagacttggagtcttcctcctaatggtgttctcttagcccttgggagagatgctttaagttccacttag

SEQ ID NO: 71140 - DNA, 639 bp, Glycine max
  Peptide Sequence Number=SeqID_187918
atggcaggtgctatagtagtaaagtacggaatcataggagtaggaatgatgggtagagagcatctcgtgaatttgtaccatcttcgcactcaaggcgtggcagttgtcgctattgctgaccctcatcttccctctcaacaactcgctcttgacttagcacactcctttggttggcctctcaaggttttctcaggtcaccaggagctgttggacattggactatgtgatgttttggtggtatccactcctaacatgacccatcataggattcttatggacataatcaatcattccaaaccacatcgtgtactggtagaaaagcccttatgcaccacaatctcacattgcaaagaggttgtcaatgctgctaggaagagaccagatatattggtacaagttagactggaatatagatacatgccacctgttgcaaagctgatagaaattgttaagggaggaaaccttggacaagtcagaaaggtagcaattcgggagcatcagtttccttttctggttaagtgttgccacttctttgatctgatgagactgtttgttggtgcaaatcctgttcgtgtgatggcttctggagctattgatgttaatcacaaggatgaagtatatgatggaaaggtagattag

SEQ ID NO: 71141 - DNA, 360 bp, Glycine max
  Peptide Sequence Number=SeqID_187919
atgatgattcatttattccgttacagaagaagagagcagaagcttcttcttggttataccttgacagacaaatcagcgagtgggaacattttcattttgtgtttggtggagatgcctattaggagcttggtagaggtggagccaccaagcccactgagatacttgatcggtgccgccgttatgatgatcggagtagtgttacccgtcggttacatgatgttccgtaacaagcgcagaattagagatgtgctgaggcctgatgatgatggtggcggctatgatgtgagaagcctatggtttagtggatttggattgattaacttagaggcttcagcagatatgccatttgttcaattgtaa

SEQ ID NO: 71142 - DNA, 147 bp, Glycine max
  Peptide Sequence Number=SeqID_187920
atgactcaccccgtcttcagccatccaaaacaaatgtgctttgatttgttggtggaacttggttgtgtctgttccttggagcaagcgttggaagccgctagaggctacaaagagggagggggagtaaggagtggagaagagaaatga

SEQ ID NO: 71143 - DNA, 423 bp, Glycine max
  Peptide Sequence Number=SeqID_187921
ggattcttgaggcaaaagctatctggccaagggcttgcattcatattagcgggtggatctgttgtacagaaaaatcttgagatcggtgaagttctagctgttgatgtttcgtccattgttgctgtgacaagtacagtcaatgtccaaataaaatataatggtcccgcaagaaggacaatgtttgggggtgacaatgctgtgacagctcttctaacaggaccaggcattgtgttcatacaaagtttaccttttcatcgactctctcaacgaattgctagggcggtgacatcacccaacatgagggaaaatccaaagtttttcatacagattgcagttttcttttttctggcgaatgtgggagagggggttgggggcagatttcttgttggcagatcctttgtgccaattaaaaattcatcctag

SEQ ID NO: 71144 - DNA, 342 bp, Glycine max
  Peptide Sequence Number=SeqID_187922
atggaagcacagcaacaagcaccaaagaaatttcaaccacgagcacacgcaagcacagtaagctctcacacacagaagaagaaacaaagagaaatagaacacaggcttttcagaacatgcaataggcttttcagaacctgcacctacctagcttctcatcactgcaagcctgaaacgtcaaggtgttccgcaggaggcagtggcgggactgccacgttggcatgtcccgccaggaggaacggcggcatggctctctcctcgtcccgccagccctaccagcggtacagcctctctctctcctactcagcctgtcccgccgttcgtactggcggtttaggctga

SEQ ID NO: 71145 - DNA, 252 bp, Glycine max
  Peptide Sequence Number=SeqID_187923
atgggtgaaatcgtgagagagatgaacttcaacccattgcgttgcactttgccttctaaagttctaattcaatttgcgacagggttgtcatcttcaacttcatgtctgctacaaggtgtcgttttggacaaaacaaatggtgtgaaatcacccctaaactcaatagctttagcaagcctgaccgagcctgcacagaaacaattctggaagtgtcaagagggtctagctcaattggttgagcagcgtgtgtga

SEQ ID NO: 71146 - DNA, 291 bp, Glycine max
  Peptide Sequence Number=SeqID_187924
atgcaagagctagattgtctcccgaagctaaaaacctcgagtgaggaagaggctgaaacccctgaggagagtgaggaggtgcaagctttgaaggtagaacttgaaagggcgcaaacagtcaaggaaaagttcaagatgacaactataaagccgaagcattggaacgggaaacaaagagggtccgaaaggaagaacgaggtcgaaacaagtttcgaggggcttcgtggggcagcaacagcaagcttaagcttcggagggccgagagagaccagtcgagagtcaaaggcatga

SEQ ID NO: 71147 - DNA, 709 bp, Glycine max
  Peptide Sequence Number=SeqID_187925
cgtcatcgtcgaaaatcgtaatagcttgtaagcgaagactgttctcttccccgtttgtgacgttcccttcaatctcctccaagatcgatcagcgtcggagtttaccagattccgatccatcttccgaattagtgagaaatgagatgaagagggccttccgacgaactgcttttgttctgatgagggagttgtcatggcgttgctttgggcacaaaatcgattggcgaagattcttcgttctggtggctattttgactgtatctgctttcgtgtttcagacgcttgttcatgcttatttagctctgccaaacagaccgttacattctcctcatcaatctaatagctccctacaaggggggaggcttcaaaaggttcacctcactcttactgactctgttatttcacctaatgcgtctaacaagttgatccaatcattctcagttcagctagagaatgcagaactagaagccccaatccaaaggaagaattccgtatctgcgagaaaaaaggacaaaaatcttgctggtacaacgaaagtcgcaacatctttatctcctccaagacatgttcctaaacagagacacatacagttgttgccacctaacaaggcccttgtgcaagcaaagaaagagattgatcgtgcaccttcagttaatgaggatcctgatatttatgctcctatttttaggaacatttcggttttcaaaag

SEQ ID NO: 71148 - DNA, 1042 bp, Glycine max
  Peptide Sequence Number=SeqID_187926
atggctacctctggctcatctggtgaggatgattctactccaccaccaccaccttccttcattgatcccagtcaaaacccagccagccctttctatatccatcccagtgagaatcccacatctgttattgttactcctccacttactgccaataatttccaatcttggtcccactcgatttattattcgtgggagcgatgcaatacgcttctcatatcatggctgcttaactcgctttctccctccattgctcaaagtgttattttctttgagcatgctattgatatttggaatgacctccgtgaacgcttctctcaaggtgatttgcttcgagtcaccaaattgcaggaggaaatctatgctcttaaacaagcctctctctttgtaactgattactacactacgcttaagtctttgtgggaggaactagataactatcgccctttgcctccttgccttgatgagcgttttgccatggtgcgttctcaaatcctcttgctcgatcctcttccttctgccaatcgagctgaggcaacccacaacaaggggggaccaaatcaacacaaatcgaacaccacgccgccaaaatgtagccactgcgacaaacttggtcacaccagtgatgtttgctactctaagtttgggtaccctcctggacatccgaaatatccaggtcacccacgtctctctaacaacaaatatacctccggtggcggcacaacctcttcaggtggaggtgcggtgaacaacgctgaagtggcaaccccaacccatggaggagaaagcaagaaagaaagctcaactcaggatcatgggtttcacatcacaatggcccaataccaacaattgatgaatcttctcagcaaatcctctggacctggtggtgacatgagcacgttgaggacgattggtttggctgacttgaaggaaggcatttttcacttgatagttggaaaggatagaagcccatctaccaacaatatcaccaccaccaacaccaataactctcagctttggcattttagattaggtcatgtatctg

SEQ ID NO: 71149 - DNA, 1176 bp, Glycine max
  Peptide Sequence Number=SeqID_187927
atgaaatgtgagatcaaggctctgcagttgaatcaaacctgggacattgttcaaaccccttctcatctaccagatggcagtattgagcgttacaaggctcgtcttgttgccaaaggatactctcaaattgagggcatatattactttgaaaccttctcccctgttgttaagatggccactgttagagttgttcttgctctggcatcgattaatcgatggcacctccatcagttagatgttagcaacgctttcttacacggggacctcagggaggatgtttacatggagatccctcctggcttgcttggttacacatcaagtcaaagttgcaaattgaagaaatcactctatggattaaagcaatctagcagaaaatggtatgaaaaattatctactctattgatgacttgtggttattcacatgcccatgttgatcatagtctatttatcaaggctcataattctgaatttactgctttaattgtatatgttgatgacattgtgctgatcggtaattcccttgctgagattgaacgcattaagcgtactcttcacactaattttcacattaaggagttgggaaaactgaaatattttttggggcttgaagttgcacattctgataaaggaatttcattatgccaacgtaagtattgtttggatttactgaaagattctggtatgcttgggtgtaagccgtcctccactcctatggacagttctcttcgactccataatgattcctctggttttcttgatgatcccctatcttatagacgcctagttggaagactggtctatttgacaagcacacgccctgatattgcctttgctactcagcaactaagtcaatttatgtccaaaccaacaaaagcccatcatgctgcagctgtccgcgttcttcgatatctcaaagggtgtccagaccaaggtttattttttccaaggacttgctctcctcatctacttgtgtttagtgatgctgattgggcaacatgtattgactctaggcgctctattactggttattgcttctttataggcaattcacttgtttcatggaaaaccaagaagcaaactacagtatcacgttcctcttccgaggctgaatatcgagcacttgcttctacaacttgtgaattacaatggctttcttaccttctaagagatctttga

SEQ ID NO: 71150 - DNA, 441 bp, Glycine max
  Peptide Sequence Number=SeqID_187928
atggatcgggctcgcctaatatatgggctcatgatgaagatggacatggacatcgacaatatgattttgctacagattacaaagatcacccaatccagtatgtccagattcggcttccccgctttgattatagcactctacgatgccaaggggatcaattcagacactttgagccactcaggatgcaccaccaccagtcatccctcctctagccacctcatctttcgtcgcccaaccttcttctcagtcggagttgctcttccccatgctgtagagcccctagcatggccaatatctcttggcccagggcgttcatcgactatgtctccaacaggcagtgatgacaccagaggcattcctctcttaggttgtttggccaagagtccaacttccttctataggggggtgatacctatgctgttggtgatgatgctgccgtag

SEQ ID NO: 71151 - DNA, 111 bp, Glycine max
  Peptide Sequence Number=SeqID_187929
atgatactactgcgtagggttgtgcaagaagcccttgacaaagcttatatgactaagaaggatcttactgctgttgttgttactgttggtcctggtttgagtctctactag

SEQ ID NO: 71152 - DNA, 249 bp, Glycine max
  Peptide Sequence Number=SeqID_187930
atggaacgaggtgaggtggaggcaaaaagggaaggtggtgggcaaaagacctatggaatatctaaagagtatgataaaatttcaaaggtcttcattccaaagaagacggaaaagaagggagaaagatttggttttgctagaattgaaagggtggcagactctagagtatttgctcttaagctagatgagatcttcattggtacttataaactcatggtgaatgctccaaggttctctagaggctcctag

SEQ ID NO: 71153 - DNA, 3054 bp, Glycine max
  Peptide Sequence Number=SeqID_187931
atggatgtagcatcagagcaaatgccagcagatagcgttcctcagataaagtatgatgtctttgtaaactttaggggcgaggacatccgtcacagttttcttggttatttgactgaggctttttatcaaaagcaaataaatgcctttgtagatgataaacttgagaagggagatgaaatatggccttcacttgttggagcaattcagggatcatcgatttcattgaccatattctccgaaaactatacttcttcacgttggtgtttggatgaacttgtgaaaatacttgagtgtagggagaaatacggacaaattgtaatacctgttttctacggtgtaaatcccacagatgtacggcatcagaaggggagttatggagaagctcttgctcaacttggaaagaaatataatttgaccaccgtgcaaaactggagaaatgctttaaagaaggttgctgatttatcagggataaaatcatttgattacaacaccgatgtagtaacctgcgctttcaacatcgtttctctccttagcaacgatgtagaaatattcgatttctacatcgttgcttacgccagcaccgatctaatcaaggagaaaaagctgtcgctgctgctggatgactcgcgacagctgtttcagcggctatggactgacgaggacgagatcgagctcttgcaagggactgaagttgaactgcttggagaaatcatcaacattgtcaatcttgtgttgacgagtttggataagtttgatcctgaatcaagtagacttataggaattgacaaacaaattcaacatttagaatcactgttacatcaagaatcaaaatacgtccgtgttattggaatttggggtatgggcggtattggaaagacaacaattgcggaagaaatatttagcaaactacgctccgaatatgatgaagatgtggaaatggatcatatgcctagattgtcaaattatattaagagaaagattggtcgtatgaaggttttaattgtgcttgatgatgtgaatgattcaaatttaccagaaaaattatttgaaaaccatgattggtttggacgaggtagtagaattattattacaaccagagataaacaagtgcttatcgctaataaagttgatgatatataccaagttggggccttgaacaacagtgaagcacttgagctttttagtttgtatgcctttaatcaaaatcattttgatatggagtattataagctttcagagatggtggtcaattatgccaaaggcatcccattggttcttaaagttttgggtcgtcttctttgtgggaaagataaggaagtatgggaaagtcagctacacaaacttgaaaacatgccaaatacagatatttaccatgcaatgagattgagttttgatgatctagatcgcaaagaacagaagattcttttagatcttgcatgtttcttcataggattgaatttgaaactggacagcataaaagttttattgaaagacaatgaaagagatgattcagtggttgctgggttagaaaggttgaaagataaagctcttgtaaccatttctgaagataatgttatatctatgcacgatatcatacaagaaatggcttgggagattgtgcgccaagaatcaattgaggatcctggaaaccgtagccgattgatcgatcctaatgacgtttatgaagtattaaaatataacaaggggactgaggccataagaagcataagagcaaacttgccagcaattcagaatctgcagttaagccctcacgtgtttaacaagatgagcaaactacagtttgtctattttagaaaaaattttgatgtatttcctcttcttcctcgtgggcttcaatctttcccagctgagctaagatatctttcttggtcgcattaccctctgatatctttgccagagaatttttctgccgaaaaccttgttatatttgacttgtcaggtagcctagtgttaaaattatgggatggagtgcagaacttgatgaatttgaaagtacttacagtcgcgggttgtttaaacttgaaggagcttccagacctttcgaaagccacaaatcttgaatttctggagatcagctcttgttctcagttgcttagtatgaatccatctattttgtctctcaagaagctcgagagattgtctgctcatcactgttcccttaacacgctcataagcgataatcatttaacctcccttaaatatctcaaccttcgagggtgcaaggcactaagccaattttcagtgacatcagagaatatgattgaactagatttatcattcaccagtgtcagtgcatttccctcaacttttggacgtcaaagcaatctcaaaatcctaagtcttgtcttcaataacattgagagcttgccttcaagcttcaggaatcttacaagattgcgatatctgagtgtagaaagttccaggaagcttcatactctgtctctaacagagcttcccgcatcccttgaagttcttgatgctacagattgcaaatcattgaagactgtatacttcccatcaattgctgaacaattcaaggaaaataggagagagattctcttttggaattgcttggaattggatgaacattctctcaaggctattggcttcaatgcacgtattaacgtcatgaaatctgcgtaccataatttatctgcaacaggaagcagcattccagagtggttggagtataagacaacaaaggattatttaattattgatctttcttctactccacactccactctgttgggctttgttttcagctttgttattgctgagtctaaggatcacaacagagcagtatttcttgactatccattttatatcactgtcagtgaaggcgagggtgaaagtgaaaagggtggtattgacatctttgtgtctcacacagttagggttgaatccggttacaacaaaggaagtggctccaagcgattcaaaacggggtctggagttaaaagggtttggggtcaccccaataacttactcagtatatcagaatttcattcaagaaataaacagctcggctga

SEQ ID NO: 71154 - DNA, 320 bp, Glycine max
  Peptide Sequence Number=SeqID_187932
atggatactaaggtcaacttttcacatgttgctcttcatatgtttaatggagagaactacaacctttgggcagtgagaatggaaaattacttggaggctctagatgtctgggaggctgtagaagggattacgatgatgaaggagtctgagacaatcaatgagttctcagacaaactgcttgacattgctaacaaggtgagcctctttaacaactttggagaacacaaaggatctatcccaaaccactttgtcaaaagttttgcatgctttaaaggcacaagaacaaagaaggcttatgaggtaggaaagatctatggagg

SEQ ID NO: 71155 - DNA, 276 bp, Glycine max
  Peptide Sequence Number=SeqID_187933
atggtgtactacagtcaccgtgccaaaaatgtcgccggccagcgactagatgatggtttcttatgttgtggaagttgtgggagggtgttggaagattacttttttgctgaggagccttcatttgttaagaatgcggtagggcagagtaaattatcaggcaattatgtaagaatagttcaaagtgagtactctgaatcacgtcaaaggactttagatagaggtatgtctttcttaagtctcatgactgatttcacactcgggatgcaattgacatga

SEQ ID NO: 71156 - DNA, 624 bp, Glycine max
  Peptide Sequence Number=SeqID_187934
atgggaattggtggaatgcctaatcataagaaagatattagagttaaaagggtttactggaccaagcttaatctagatggttttgtaaacaagtataaagcaagactggttgttaagggatatgcccaaatctttggggtggatttttctgaaacctttgctccagtggctaggttggatacgataaggttgttgttcgcgcttacaacacaaaatggttgggctacacatcatatggatgtcaagtctgcctttttgaatgggtacttggaggaagaaatctttgttgaagaaccagaaggttttgttgtccaagaacgagaggaaaaggtgtatagattgaataagaccttatatgggctaaaacaagcaccgagatcatggtataacagaattgatgaacacttggtgaacttaggctttgtaaaaagtccaagtgaatttaccttttatgttaaaaaggttgataataacatacttgtggtatctttttatgttgatgatctatttgttacagaaagtcataatgagcttattgataagttcaaagaaagaatgaaagatgcctttgaaatgacagaccttggaaagatggcattcttccttggtatagcaaaagcataa

SEQ ID NO: 71157 - DNA, 516 bp, Glycine max
  Peptide Sequence Number=SeqID_187935
atgtttatatcacaagaacaagccctccttcagtctatgaagcatacttcgagcatttttgaaaaaggatttcaaactttttctaaaatcacgctcagagtaactaaggttgcgtggtattatgaggtaattagtatggtactcaacgacaaggtccaagagaggcaagattggacttctttaatctacgtagatatcgtcatagtgctgaagaaattagacaagtggttgaagcagaaggatctttttacaattgaaacattgaagactatcaaaataggttgggatgcaaaccttcaagaggatgttgatgattttatacttaatagtaaaatgagaggagagttaataactaagaccattagagctgtttttgaacctctcttgtcagctgagtttggtgaaggtatcatagatgaattattcttaagatatgcaaaattggttgcccaactcattgaggtggagacattggagcatactaatgtggtagtgcccatgaccaaacattcttga

SEQ ID NO: 71158 - DNA, 126 bp, Glycine max
  Peptide Sequence Number=SeqID_187936
atggggaggccaattattatgtcacagaaaacaaagacaatggcagtgtatggcttaggcttccgtcaaaaggaaaggaaaatcaaggagtctgacagaacaacttcagtcttcactcttcactag

SEQ ID NO: 71159 - DNA, 918 bp, Glycine max
  Peptide Sequence Number=SeqID_187937
atggaggaaaataagcaatttgtcaccaaggatcctgagaaggctcacttattttaccttccatacagtgcacgccaaatgggattgacactctatgttcctgggtcacatgatttaaaaccactatcaatctttcttagggactatgtgaacaagattgctgcaaagtatccgttctggaatcgcacgcaagggtcagaccatttccttgttgcttgccatgattggggtccttacactgtgactggacatgaggaactaaaaagaaacaccattaaagctctatgtaatgctgatttgtccgaaggagtctttgttgcaggaagagatgtttccctaccagaaactaccataagggcaccaagaagacctcttagatatcttggtgggaatagagtatcactacgtccaatccttgctttctttgctggaagcatgcatggtagagtgcgtcctactcttcttacgtattggggtggtggaaaagatgaagacatgaaaatctacaagcgtttacctctgagagtttcccagaggatgacttatatccagcacatgaagtcaagtaaatattgtgtgtgtccaatgggctttgaagttaatagccccaggatcgttgaagccatatattacgagtgtgttcccgttatcatcgcagataattttgttcttccttttagtgaagttctggattggagtgctttttccgtggtggtggccgagaaggatattcccaggttgaaggaaattttactgtccatccctctaagaaaatatcttacaatgcaaaataatgtgaagatggtacagaagcatttcctttggaacccaagaccaataagatatgatctgtttcacatgattttgcattcaatatggttcaacaagctgaaccagactcaaccttcgcaaatatag

SEQ ID NO: 71160 - DNA, 594 bp, Glycine max
  Peptide Sequence Number=SeqID_187938
atggcaccaagggttaatgatggaacaattacaagcaagagagcaatgaacagaggagcatggaccccagaggaagacagaaagctagcccagtgcattgaaattcatggtgcaaagaggtggaagactgttgcaatcaaatcaggtttaaataggtgtgggaagagttgcaggctgagatggttgaactatctgagaccgaatatcaagaggggaaacatatcagatgaagaagaggatttgattcttaggcttcacagacttttgggaaacaggtggtctttgatagctgggagacttccaggacgaacagacaatgaaattaagaattactggaattctcatttgtgcaaaaaagtgaatcagaaagtggagaagccagaaagttacacgagacacgaaattattggccagaatgatgctggggacaaccgtgcaatgtcagagaacgaggttgaaattaatgaaagtagtaacttagatgttagtagttttgacgtgaacgaatttttcaacttctctgaagaatcctttgggtttgattggctgaacaagtacttggaacttgaccagattcctcagagcactgaatga

SEQ ID NO: 71161 - DNA, 669 bp, Glycine max
  Peptide Sequence Number=SeqID_187939
atgttatttatattgcgtgctgaagctgagttgcaagctatatctggtgataatcttgtacccagccttcgatgtatagattcattgaaggcaaaattagggtgtttatttgatggacacgctattataaagtcattatcaacctgtactgaaccaatgccacatcaacaatcccgtgatgagatattcaagcctagaagaggagctggcaattatgcatttgcagatgttaaatacaaaggcgactggatgagacgtcccatttccaatgatgaaattgcatggcttgcaaaaattctcattcggttgtctgattggttgaatgagagtcttggactgaatcaggcagaaagcaatcaagtaagctctacagtctcttatgtggaggtatcggctgatgttgctgcccacatatggggaccttacaaagccctgaaggtcttcttatgtaccattggttcttggtttctcttcttgggtgctgcttctctgggttgcatgcgaaaacatggtctgagggtgaacttaagtcccctattttgctcactggcagtgcgtgtgttgcaaccgctctgtactagttatatcgctccacatggtcaaacctcggttcagctaatacaaaaatgcaataactctggtagtcaagggattgatgtcattatctga

SEQ ID NO: 71162 - DNA, 216 bp, Glycine max
  Peptide Sequence Number=SeqID_187940
atggcgacgacgaaggagcaagagactcctatgatggctagggtggtggtggaggactggccaacggtgaaggagcggtgggaatctgccgagacgccggtgccggaggaggtgatattggtggaggagttggacggcgataataaaaaggcaagaaaaacagatttgatgaagagagtgttagtgttttacacgtttcagtttatgattggataa

SEQ ID NO: 71163 - DNA, 207 bp, Glycine max
  Peptide Sequence Number=SeqID_187941
atgatcttccctgcgactgcgaggtctgctttgtctccgtctttgcaacattgttctgccaaggttgatggttatggtgaggaaattgattggaaggaggagggttggagtgatgggtctgtggttgaaacgttgagatatgggaaagttaaagaggcagttgaatggatgaacaaaggggtcagagctggtgctagttgcttttag

SEQ ID NO: 71164 - DNA, 153 bp, Glycine max
  Peptide Sequence Number=SeqID_187942
atgagactgtggttaattaggcaaattggaaaaagtgttgttttcaccttctcgctaagccaatctgttggcttaggagcattcgctaagcgcggcactcagtggctaagcgcgaggaagaagccagaagaagataagctgtcagttcgctga

SEQ ID NO: 71165 - DNA, 1668 bp, Glycine max
  Peptide Sequence Number=SeqID_187943
atgccctctcactcctcctccaccttcgattccctctccaaatcccaggacctatcatccgccatccaatccgccaccaccccttcccaaatctcatccgcgtgcgcctccatcgagactttcctgcactcgcactcacccgatcagtcccgccacttcttctccctcgcattcccaaccctaatctccaagctcttcggcttcgacgattcttccaatgcctggatcctccaccgccactcttccgccgacggcgacctctcccaaaccctattctccctcctctccccctccggcaacctcgccgccgccatcgccgccgtcgatcgcctctccctcgtcaaatacgtcttccccgctgaacgcctccctcactggacacgctccttcctctccgacaccgattctcgctccctctccgatctctgcccttccctcttcaaaccctcgccttccccttcccaaatccaattcaacgtcttcgaatacttcttcttctggttcgcatactaccccgtttcgaaaggcaaaaacgacaacaacgaatgcgtttcggttaacaaaagagttaagaaatttaggttagaagattggactaatacttggacttcctccattcccggcttctccgcctcctcctcctccaagcgctgttcctccgagggaaaacctcagtgcgacttgtacacgcgcctcctctgcgcgtatctacgcgcttttgtcccttcctatgattttcacgcgcaccagccttaccggacttcgattctgcactacggctccggctacgacagttctgtttcggcgcgggccgagttcgtggtcaacgcgcttatccacttctggctcgtggacaatgatttctcgccgctgccggcgagtgtttgccggagcctccgagtttcgtttccggcgggggagacgcctcccccgccggggctcggggaggtggtgaggctgtttgtgaggtacttgaatttaagtactgtggcgacgtttcgcgaaaatgggggtggtggtgagtgtggaactccttggtggagagctttggagggtgcaaagagcaaggatttggggtctttgagttctgttcgttcgcttgggtgttggaacttctgcttgcagaggcctctgtataggtatctgttgagaacgttcttgttttgccctatggcggcttcggttaagaatgtgtcccaggtgttgtcggtttgggttggttacttggagccttggacgatgaatgcggatgagttttcgaatatggatggatttaacggcgagaagaaggaagattctgtgcctgcaagtgccggtgatgggttttcaccgcagtggcaggactatgttctctctaattatctatactacagttccttggtcatgcatttcattgggtttgctcacaggtttcttcatagtgatgttgaagttgtagtccagatggtgctcaaggtgttagacaccttgacatcatctaaagagctcattgaccttctgaagactgtggattcccttttccattccaaacaagtagggtcaggcaaagcaatgctgaataacttgtacagatatgttcctattattcatgaacagttgcagtattatagcctctatgatggagtggtctacagttcaatctttgcagcccatcattctgtcaattaa

SEQ ID NO: 71166 - DNA, 267 bp, Glycine max
  Peptide Sequence Number=SeqID_187944
atgtattacatgttattttccttctctccctcttcaaagttggcacttaacccaaaaagactctcttgcaagatcgccacggcgccaacatcgtgttgcgactgcttttgtcgctgcagtggcgtgtgggagagatccaacgctagggaggaggacaagaatgcgggcccttgttggtatgctgttgggaaattctttcaagtgagtgggcggagaagcttgaatcaatctacaaaggtggtggggtggtggtcattgttgcaataa

SEQ ID NO: 71167 - DNA, 843 bp, Glycine max
  Peptide Sequence Number=SeqID_187945
atgaactcgctaagcgagcatgttgcactaagcgagttcatcaatactcatcgtatatgtcttccagaaaaaagaaagagcattggtgcaaggcccacagctcaatatgacacaagaagattccactccttcgaggcctggaccagatacacaaacaatgtgctaggaagacatatactagctgagaggaaggtagaaatataccatacggagttggatgagttcaaggctgaattggagaggcgtaacttccataagcgcctcaccaatttagctgacagcagcatcgacctagccttggtgaaggagttttatgccaacctctacagtcccgaggggccttccccaaaacaagtcaaaatccgaggccacttgataaaaattgatgcaaacagcctcaacaccttcctggagacacttgtggtactggctaagggagaatccttacccgcttactctagatactacaggatgcccactgatattagagagattgaggctgctttgtgtatactcggccgaaggtttgttttaaatgctgaaggccatcctgggaagatcctcaagaaagatctgacaactcatgctcaggtttggagtgttctctcatactctaacctagctcttacttcccatacctcggatttgactttagatagagctaggttaatttttggcctagtctctcagctggacatgaatgaaggagctctcatctctggccagatcacatctatggcccagtctaactcctctagacttaggttccttgctcttatcacagctctatgtaggtccagaggggttgcttctgacagcctagtcttggaacacttgagcacg

SEQ ID NO: 71168 - DNA, 231 bp, Glycine max
  Peptide Sequence Number=SeqID_187946
atgggaaaactagcaaaactacccatcatatctcccaaaacccaatacccacgaaattcaagagagaaagaagttcacccaaacctgaaatttcgaagtcccacacgtagagatgcgcttcacgactctgaaaatgccctcctttcgcgagttggagcagaaatgatggccaaaggttggagctttgttggagcttcaatggagaatggaggagaaggaaaagcaacgtaa

SEQ ID NO: 71169 - DNA, 549 bp, Glycine max
  Peptide Sequence Number=SeqID_187947
atggctgtgggtgggttgcgcaagtgtgaacgcatgaatgcaatatatgactggatttgttcacattgtgtacatccgatacaaatgggagagacaacattacaaaagcatatgcgaacagcacccccgccttacaaggccaaagaagtaaacatctttttcttcttattgccgacatatacaaggcgaaggaaattggtaaacaatagtgggaggtactggctccatgcttatcaacaacagatacgcttcatgttttgggagaaaaagtttttcaaggcctttgtttcagtctttgcgaattgtattcgtgtggatcacataatggctagagttgtgtttcagtcgatgtatgttggagctatgttttggccgatgtcaaccaacaatgtttattggtcaacattggccataactatttttggtagatgtcgactagggtttatttggccaatgttggtcagtgcttttttgtcgaaaatgactagggttttttcagttgatgccaacaaggctttttccaacagacattggctagggtatttctag

SEQ ID NO: 71170 - DNA, 195 bp, Glycine max
  Peptide Sequence Number=SeqID_187948
atggcgccgcggagggagaagacaacgatggagaacggagagttgccaacgatggagaagaaggaggaagaagaaacgaacaatggcaccgcggatcaacttgttgggtcgcacacggttattaaatgggcggctgcaaagcgagttgaaccggtgaaatctgcagcggttggaccggccggccaaggcttataa

SEQ ID NO: 71171 - DNA, 338 bp, Glycine max
  Peptide Sequence Number=SeqID_187949
atggttaagactagaggattaggtcgtgctataggtagggttggtgctagaggtttgggaagaggaagggatggtgatgatactgacggtgctccccagcgccaaaggccgaccgcatcggcacactcgcctgcgataccagaggcagaggctgctgtagttggggatgagcccatggtagatgttgtcgcacaggccaccggtgtagagactgacgcacaagatactgctgcaaagactgacggggacgagcctgtgggatttcctgatggacccagggaccatcagtgcttacagagtatgctgaccatgttgcaggcaacgtatggtctggacag

SEQ ID NO: 71172 - DNA, 573 bp, Glycine max
  Peptide Sequence Number=SeqID_187950
atgaatttcatcctatggttaatctctattgctattgttgccattgttttcaccacctatctcttcaaaataattctctattttgaagcagttcgtcgtgagtaccatgatccagttcatgttaacatcttttttgccacatggatagcccttttgttcctagctcttggagttcccccatcagttgccaaagacctgcatcatgtagtttggtacattctcatgattccattgttctgccttaagctcaagatatatggaaagtggatgtttaagggccaaagaatgctctcaaagatgcttccaacaaataaggccatcccaaaagacctccatccagtgttctttctttttgtggcgccatctagtgttgctgctatggcatgggctaagattcaaggctgttcgggtcaatcttttcagaggattcaaattctcactttcatggtgggcctacacatttccgatgagcatgttgtgtgggaggatatacatgagcaacgtgcactcaacgtctttttggtcgttggtgattgtgttctagttggcttccaggcagcggtggaagcatag

SEQ ID NO: 71173 - DNA, 420 bp, Glycine max
  Peptide Sequence Number=SeqID_187951
atgatttacaatttcaattcctacaagggattccaactgatcagtcccatctatgacttcaccgccatcatcagccccaatgacattgacaagtccaacctcataaacgccatcagcttcgtcctcgggtctgcaccatccagctccgtgacactcaactcaaggacctcatctacacctttaacaaccgtgagatggagcagaaagagccacaacggagacggctttgcgatagcagcatcggtgccggtgggggaggattattttttggtggcgagcaatcccaagaaatggtgtcgagaggtgtgccacctggtgtactgcggtgtgaggaagagggactccaataagtgggtgtgcgaggctcgggagggttttgttgagtgggagagctacaagagggtttcagatgagagttag

SEQ ID NO: 71174 - DNA, 228 bp, Glycine max
  Peptide Sequence Number=SeqID_187952
atggcgatcaattcatcaagagcacaaaagaaagcaaaaacttccaagaggaagcaagagctagtcaaggttttctacacttgtgcgtgtgttgaccttgaaggtaacatcttctttactgtcaatgaagtagatatggtcattgatgctactgtgtggaaagaagtagtcggtctggacatgggaggagtccgcaagtttgatgaaactccttatgggtactgttag

SEQ ID NO: 71175 - DNA, 267 bp, Glycine max
  Peptide Sequence Number=SeqID_187953
atggcatggaagtttgttgggagtcaaacatttcactctaaattgaaggacaaagaatccaaaactgaatccattattgagaatttgcaggaaatagaacatatgaagaatgacactgcagaattgaagatggaagctgaagtcactaaagttgtgttacaagatgcagaaacaaagcttagagtagtggtggaagaagtggaagcagctaatgcagcagaggcaagtgttgttgatcagattaaggtctcctattttcacctctga

SEQ ID NO: 71176 - DNA, 330 bp, Glycine max
  Peptide Sequence Number=SeqID_187954
atggcatcatcatttgtgggtactttattacccaaccacttcacacaaaccaaacactcagctgttcctgcaagtagatcaggtgctccaagaaggaggagagtgcacttagcaacaacaagagtagagaccatgactactgtcatagaaaaactgggcattaagattgagaggaaccctcctgagtccaagctcactcaactgggtgttaggcaatggcccaaaattaacaaccctgaaattgtcgccgccacagataactggtttggtgatgtgaaagaaaggatgttgttaagaaatttaagaggttcttacttcttagccatttaa

SEQ ID NO: 71177 - DNA, 285 bp, Glycine max
  Peptide Sequence Number=SeqID_187955
atggctccgaagaaactctccacgaacaggtctagatgggacgccactggagaaggctccagtgccgccttagagtttgatagtcaccgtttccggagtgccgagcaccagcagcgcttcgaggccatcaagggatggaagaccaacaatgtgaattcagctagaggaggagccaggcagacggtttcgatgaggaagccatcgcccagctgctgtgcataccggggcaggatttcacccgaactgttgcagggaggcgggtgcggatcatgcgcaccatcatga

SEQ ID NO: 71178 - DNA, 333 bp, Glycine max
  Peptide Sequence Number=SeqID_187956
atgttacagaacctcacggattgtgcaacaatgcttccttttgacttccggcatgttacggaacctcatgaattgtgcaacaacgcttctgtcgcaacgtgtcctttagcgggcgagcgaaggcaaggctcatgggtgcgcttttcaaaggaggaaagatgcgcggagtcgccaccaacgtttatttgtggaaaacgtcgggaaaaccgaaggaaaccggtcaaaatgaaaattctaagttcgggaattgtatttacgtttgaggaaggtcgacaaaagcggtgctcttgctcctacgtaccctccatcaaagaggaaatcagaccttcgtag

SEQ ID NO: 71179 - DNA, 195 bp, Glycine max
  Peptide Sequence Number=SeqID_187957
atggctttggaccacatgggttcattcacttgtcataaaaaggatgttgggtcactcaatcaagggggtgatggtagtagtggccctacatcagaagatcttattatgatgaaaaatgtgcatagattagggggtcaggccaggccaggctttaaaaggcctgagcctagcctacgattaatttttgaggcttga

SEQ ID NO: 71180 - DNA, 426 bp, Glycine max
  Peptide Sequence Number=SeqID_187958
atggcagggagattgacgaacgcagcatcgaggatcttaggcggaaacggcgtcgtttaccgatccgttgcttcctctcttcgcctccgctccggcatgggcctccccgtcggcaaacactatgttcccgacaaaccccttcccatgaatgaggaactcctgtgggacaacggcactgcatttcccgaaccgtgtatagatcgtattgctgacactgtcggaaagtatgaagcattggcctggctgtgtgggggattgagttttttcgcgtcgctgggattgttggctgtgtggaatgacaaagcctccaagacaccgtttggacctacaaacatgggagaaatgcagtacttagaagcagaaggaacccagaagttgggggaattgccgcacccggtcctcccaggacttgagttgcagctttaa

SEQ ID NO: 71181 - DNA, 522 bp, Glycine max
  Peptide Sequence Number=SeqID_187959
atgctccacaatgtgaccatagttgaagcagaacacccggcgcgaaatgagaatggaggaagcccttgcggagctggagcgagtccaaacccagctcctgcaacgcatatcgaaactggagcattcgcatcttgcatcacccgcttcccagaacgacaccgtcgaagacactgccaccgacaccgtgactcgcctctcctccattctgcgcagcaacggcgttcccaatttttccttcaagagagtcccttccgattactacgactggcccctcgaagcccggtgcgacgccattctccgccgcctccgtccaccatctctgcaaaagcatcgttctcgttaacacgcaagcccccgccaacgtcgtcgattgcagcgaccgcaagaattccaaatactatgtcgttgtcgttcagtacaccgcccgcttcaacgctgaggctgtcaagaattttatatactcgctcaacaatggaagtatcgcgaaaaagaaattcaacactcctgagtgattgtctttaa

SEQ ID NO: 71182 - DNA, 318 bp, Glycine max
  Peptide Sequence Number=SeqID_187960
atggcgagggttggcagcgtaggcggcggtgaaggcggaggacgcagaagggtcggaatggaaattggttttgaggagatgggcatggagggtttgggtgtgggaaggggaacggaggttggtgcatgctttgaagagaacaatgctctaaatagttgggtccacaatctggatgaacaggtctctgcatttggatgcacagggccaagcttttccctgccagcagttctttcgagtccacttgtatgcggcgttgcatttgccattgttggtcaaaaggggattcaggaatttggaacacgaagactgttcatatag

SEQ ID NO: 71183 - DNA, 981 bp, Glycine max
  Peptide Sequence Number=SeqID_187961
atggcaataatcggttgcagcagtgatggacacatggatgacacaaagttcagcaaaccgatgccatggattggcatatacatagcagcagcatctcttgcctgtctcatagcaatggcagcagatctcatacacggaattcgcggtcgcaaactttggttcccttgcaaattcttctgcctaaacgccacttccttggccataatagctgttgcagtgaagttatcagtggatctcaacacccccatgcctcaccgccacgatcagctatcgaaactcagcagcagcgccttgatctgcacaataatggccaattccatgccaactcttggcatcacagagaacaaggacaccatgatgaacttcatggccatggccatacttgtgatcaccatgattgtgaacatctgcatacagtttgtcactggtgttatttatttgttctgggtggaacatgctgtcatcatgctcatcatgctaattttgttgatgaccatggcctcctcagccataagtcttccaaagatgaaacactactttgagctgaagtataagatgaatgaagaggcacttaaagagggttcaaaactacttggtgaggaagggaatcaaatggtcaacagactcagagatcagctcatgaaaatttggatgatggctcacacaagtagtcctcaatttgttcttggaaggtcagtgactggtactgcttctggtgccttttgtcttctcagtaccttaactttagtagaggctatgcttcgatcttacttgatgccatggtcgtttgatttttgcactggtgacactgactacaagtggtccataatcttaattctcatagttcaggttgctgcagtggtggtgggtactatagctcctgcttttagatggttcattgccataacttataagtgtcccaatgtgaggaaaaagagatgcaagagaaggttccatgtagaagggtggggattgtgctaa

SEQ ID NO: 71184 - DNA, 301 bp, Glycine max
  Peptide Sequence Number=SeqID_187962
gtggaagcaacctagctcgcctaggcgagctaggtggcaaccacctcccccgttttgttaaaaaatgggcttcagggacttccgggacacctactgtttttcggagctgggttgcttccggaagcaacccagctcaccttggcgagctaggcggcaacctcctccccctttttcctataaataggctgaagggtgctgttcttaggatccctgatccccctaatgatgtttccgtaagcaaatccgtgaaggttttcctccgttcttcaccgttcttcatccgttcttctttattcaacgg

SEQ ID NO: 71185 - DNA, 147 bp, Glycine max
  Peptide Sequence Number=SeqID_187963
atggtcaaataccgagccaaatccaagacagagatgaatcgaggtacttggggacgggcacgaatggacgctaggcccatgatcaaaagatcgttgtcccgcgtccagctccggacaatcgagaagtgctactgggaggcagcctag

SEQ ID NO: 71186 - DNA, 231 bp, Glycine max
  Peptide Sequence Number=SeqID_187964
atgaaatggtcgggatctgttgagggtagggtaatgggttgtaacgaggaagaacggtccagtttcccctttcacgaaaactacaaggttgcataccctagcagaggtggcgattttgcgagtgaaccagagccgtgtcttcgttcagcactaatgagtagagcattggcttggtcgcggattggaatagaggatgaaagaaaaccgaggttgagggagctttggggctag

SEQ ID NO: 71187 - DNA, 597 bp, Glycine max
  Peptide Sequence Number=SeqID_187965
atgggtgaccaagaggagatacaggaacagatgaaagttgacatgtcggctttgaaaaagcaaatggcttccatgatggatgccatgttaggaatgagacaacttatggagaataacatggccaccgctaccgctgttagttcggctgccgaagcagacccaactctcccagctaccgcgcaccatcctctcccaaatgtaataagacgagatagaagcacactagggcacatcagcaacccctatttgggatacaaccgagtggcttacccttatggattaccacctaattacatgccaccagtcatgcgtgctgacgcgggtcatgtcccttcccccatccttgaaagggagcctcctcgacagtcggacaaggttcacgaggatcgtatagagtatgcccaaggagacatcgatttctaccccccagtccccgtcgagggggccgacacccaacacactgccttagcccaacctcacgggagaaccttgaaacctcccagcacagccaatattcttgtccacagaaggaccgcccccggcagtggaagaaaaaaggaaactcgatctcatcgaagagagattgagagctattga

SEQ ID NO: 71188 - DNA, 282 bp, Glycine max
  Peptide Sequence Number=SeqID_187966
atgacgatggcacaggagttatcgcggagttcattttgcggtgagtggaatgggtcatcgttatcgaagagcagggaggaacacgaagaggcgagtggggcggcaatgagaatggaagagtcagggtatagaaaaaccggttttaaggtacccgtctttaaaaagttacacttatttacgaaaatgccaccgctttacttattacatcgattttcatacaaccggtgtaaaatcaacgtcaataaaggcactttttctagcagtgattacaaaaagttataa

SEQ ID NO: 71189 - DNA, 543 bp, Glycine max
  Peptide Sequence Number=SeqID_187967
atgaatgtgaattttcacaattcaaaaatcgatgtttgggtgatgagagagtataaccgtggtgacagctggtgcaagttgttcacgctggaggagtcgcgtgagttgagatcattcaagtgcgtgaggcccttgggatactcgagcgatgggaataaggttctattgaaacacaactggaagaggctgtgttggtatgacctgagaaagaaagaggttacccttgttagaattcagggttttcctaatttgaacgaagccatgatttgtttgggaaccctcgtcacaccgtatttcttacctcgtgaaatttgtaggaagttgcggactttaggatgcgaacatcccagtatatgcaccggtaaagattttacattaacatttaattacagactaacgtgtatggtaatggtggagtctaatgatggttcagctacagtagcggcacctggtgaatctgtgacagagtctctgaaaacaaattgtgagatgtgtctgattttaattgtaataattcctctgacacatgagttttactcgtga

SEQ ID NO: 71190 - DNA, 222 bp, Glycine max
  Peptide Sequence Number=SeqID_187968
atgataataataggtggagattggggaactacttcaaactcaggagaaggtggattcgctacaggagattgtggatcagctggtactggttcaacccatgcagggactaaggtttgggagctctggacatccggtcctattgttgttgatggaggagctggagtagatggtgaagggatgtcatctactctggccctttttctcgatgccatctataaatag

SEQ ID NO: 71191 - DNA, 246 bp, Glycine max
  Peptide Sequence Number=SeqID_187969
atgggttcaaaagaaaggagaaggaaaaagtttttgtttatttttattgatttggaaagacagagtcttttgcctacatacccgaatgggatcaaaatcatttcgaaaaagaagagtttaggcaagataagaggccgaaaaggcatagaagaaataaaagaattatgcaaagataagtctaaacgcgccggatctcttaagatgacgttggatcaagtgagggtccctttcctcggatacggttaa

SEQ ID NO: 71192 - DNA, 699 bp, Glycine max
  Peptide Sequence Number=SeqID_187970
atggatggtgagaacgacacccactgtgagaaattagtcaagaaggatggagcggaggacgatactggaagtagtgactcgatcgtggtcaagcagttgcttcagaagcttcagggcaacaccctcgatgagttcaggcaatcggtcaaaaaggtggagctcccaatgttcaatggggacgatccaactggttggattgcgcgtgcagtggtgtatttccgtgtccaagggacgcaagaggagcttaaagtaagtctggcccagttgtgcatggatggccctaccatctatttcttcaagggcttcacggatgacaatgagaacatgccatgggagaagttgaaggacgctctattagaacgatatggcggtctcggggatgtgagtgtgttcgagcagctatcagcgttgcatcaggaggggagtgtcgaggagtacattcaagagttcgagaggctggtggctcaagtaccatggctacctgacaagcagtacttggggggcgctagagaaagtccggataagggtagtactaggccaggcctaaaacaggagaccggggtggatcgtaggagtttaggaccaagggacagtggcgtcaagcacctctcctaccagcaacttatggagagacaaaagaagggcatgtgttactgttcgctctgtcgacaagtgtaccgatttgcacaagtagtataa

SEQ ID NO: 71193 - DNA, 752 bp, Glycine max
  Peptide Sequence Number=SeqID_187971
atggacagggcgaggttggtctatgggctcgttatgaagatggaaatggacgtgggctcgatcatctctggtcagatctcacagatggcccagtccaactcctatcggctcggattccccgccttgatcactactctatgcactgccagaggagtcgtccctaactcgctgactttcgagtccctgagccccgtcattaatttggattatatccggaagaattgttggaacccggatgattcgacaatcacttttacggggacccataaagctcgggctcggggaccttctaacacttctacctctacccttgcatctactccagcaccagcatcagcacctgcacttgccctagctcctctagccacgacagcaccctccgacccctccacttctaccagggacgcgattatgccgatgttcatggaggatttcatggcccaggtggtctggccaggagtccagccttatcctatggggggaggtgaggctcctatagcccaagaccggcaaccagatccgaaggtgacactggacgacacaccagaggagacatctgaggacacttctgccgccacacccatggaggtcaccaaggagggagatggcgttgcggacatagattacgtcacagatatgatagtagcgcagggcacttgggacccttggcctactccaacacaggatacaccgctgccagcccaggatgccccctcatcacctcaggatgacccaacaccagctcaggagga

SEQ ID NO: 71194 - DNA, 188 bp, Glycine max
  misc_feature (59)..(59): n is a, c, g, or t
  Peptide Sequence Number=SeqID_187972
atgtcccacttagcagaaattgcaaaccaatccaagctgcataacttactaagcgcaancacctatgcgctgagcccaaaaacctcttgggtttcttatttttcaaattgggctaagcgagttggtctcgctaagcgtatgagtctaaatcctgaaaattcaaacgtcactgagtactcgcttagcga

SEQ ID NO: 71195 - DNA, 187 bp, Glycine max
  Peptide Sequence Number=SeqID_187973
atgttcatgacccctaggctatgcatttcggctattttgggtgaaaaaacacgttttcgtgaagaaaaatcgagtcaaagtgcttccgtaacgcttccgagatgtttttgtgagcaaatctgtgaagattttccgtcgttcttcactgttcttcgtccattcttcttcgttcttcgttcttcaactg

SEQ ID NO: 71196 - DNA, 1393 bp, Glycine max
  Peptide Sequence Number=SeqID_187974
cgactgcgaatacgccatcggcgcggtgaactttaccggtgacttcccggtgatcctgacgcacgacggcccaagccttggtggcttcgtctgcccggtcaccatcgccaaagccgagctgtggaaagtcggccaggtcaaaccgggcgatcgcatccgctttcacccgatcagcgccgacgaagcggtcgcgctggagaaagcccaggcgcacagcgtaaccacgctgcgcagccagcacgcaccggccttcgcggtgccttcgctggcggcgagcgacatcggttctgccactctgttagcggcgctgccggcgaccgccaccacgcctgcggcggtctaccgtcaggcgggcgacaaatatgtgctgattgagtacggcgataacgtgctggatctggcgctgcgcctgcgcgtacacctgctgatgcaggcgctgcgccagcgtgcagagcccggtatcgaagagctgtcgcccggcgtgcgctcgctgcaggtgcgctatgacagcctcgtgatcggtcagcagcagctgatgacgctgctgctggagctggaagccgggctgggcgacgtcagcgcgctgaaagtgccgtcgcgcatcgtctggctgccgatggcgtttgaagacagcgccacgctcggtgcggtggagcgttacaaagagacggttcgcgccagcgcgccgtggctgccgaataacgttgacttcattcagcgcatcaatggactggcgagccgcgaagcggtacgcgacaccctgtttgccgccagctatctgattctcggtctcggcgatgtctatctcggcgcgccgtgcgcggtgccgatcgatccgcgccatcgcctgctgagttctaaatacagcccggcgcgcacctttaccgccgaaggtacggtgggcattggcggcatgtacatgtgcatctacggcatggattcaccgggcggctatcagctggtggggcgcacgctgcccatctggaacaagttcctgcaaaacgatcagtttaccgccggcgaaccctggctgctgcgcttctttgaccaggtgcgtttctatccggtgagcgaagcggaactgacgcagctgcgcgacgatttccgcgccggccgcgctcgcattcgcatcgagcagagcgagtttaatttcgcggcgcatcagcaattcctcgccgacaacgcgccggaaatcagtgctttccgtgaacgtcaggccgcggcgtttgagcaggaggtcacgctgtgggcgcaggaagagcaggaagcgccgctcaccagtgaagagacgctggtggtcgccgatgcagaggacgatgcgctggcagtgtgcgctgatatgaacggcaacctctggaaagtgctgttgcgccgggcgattcaatgcaggccg

SEQ ID NO: 71197 - DNA, 180 bp, Glycine max
  Peptide Sequence Number=SeqID_187975
atgtacccttcatgtgttcatgatacagggccggggtacatattccacaaaaagaaggctgctaagccagttagctattcatttcggtgtcaaacaaaagaaataggcatggcatcctctagctcagccaataaaggaagcaattcagtggaagaaaggaactaccccaccatatggtaa

SEQ ID NO: 71198 - DNA, 198 bp, Glycine max
  Peptide Sequence Number=SeqID_187976
atgggcaaaagcggaagctgcgaaaaccctaacaggctagaagttaggaaaaatagaagcctcggtgacagtatagggttgaggttgaacctgaggcggcggcggtggtggtggcggtggagagtgagagcgagaggaagaaatgacaaagtcgaagagtcggagaatcagagagtcagagtgtcaaagagaggatga

SEQ ID NO: 71199 - DNA, 828 bp, Glycine max
  Peptide Sequence Number=SeqID_187977
atgatgcaaggccgcattaccaaagtattggtggacgaaggcgaccacgtgaaagccgggcagcaactggccgtggtggacacttcactggccaaagtacagcgcgtgcaatctctggccggcaaacaacgggccatcgtcggctttagcgaggcggaagctgcgctggaagatgcaaagaaacaacttgagcaggcccgtgcagaaaaagcacgcggcgaaaaagtggctgaggacgggttgatttcaaaagaaaccctggagcagcgcgtgcttgcagaacaagcggcagaaagcaaagtcaataccgcacgcaatcagttacgtattgctttatcggacctactggcagccaatgcgcaagtggacgaagctgatctcaaaataaaacaggcagaattgattgcgccggccgccgggcggattatccagaaaaacgccgtggtcggccaagtgctgggccaggccagccaaccgcagtttttactggccaaagacgacacactggaagtcgatattcaaaccacacccgaagaagcgacttccctgaaaaatggcatgccagtcgtgattaaagttgacggcatgtccggcacttaccgtggcactatccgcaaaaaaggcgtgatggtccgcgacgaaaaccagatggtgcacatcaaggtcgcttttagcaaagcgccagaactgatgcccgggcaatccgccaccgtgtcggccaagctgccacatcaagacggtatccgcctgcccgacagtgccatcaccgccgaaggcaatcaatactttgtctatacggtggagcagcaacacgccaaacgcattgca

SEQ ID NO: 71200 - DNA, 150 bp, Glycine max
  Peptide Sequence Number=SeqID_187978
atgactttgccgaacagttccaggctactgttgagtgggctgctttgtatggtttgtaccgtgacggataagacagaggaggccgagcgggtggtttttgagttggcgctaaagtgccagatgatgaatatcaccactgcaatcgcgatg

SEQ ID NO: 71201 - DNA, 171 bp, Glycine max
  Peptide Sequence Number=SeqID_187979
atggccgattcgttcacagcagctacactggttcagggagacaagggttacagctacaatggtgaactgcacgagctcactttgagggacacaatggtaacaacggccagggcatatgggacgcaattaaacgggtgtacgaagacggacttacacaataactgtcattga

SEQ ID NO: 71202 - DNA, 213 bp, Glycine max
  Peptide Sequence Number=SeqID_187980
ggacaggcagttaacctcatagctaagttccctgaccttaactatggtgttaaaacgcgcaaaacatacaatggcgatttccaaactcagaatgatgcaaaggcaagttcgaagattccgcttcagttgaaggattcctctcggtgtggggtttcaacagagaacaacagcagtttgtggtggctaatggtggctatgggtgatggagagtaa

SEQ ID NO: 71203 - DNA, 204 bp, Glycine max
  Peptide Sequence Number=SeqID_187981
atgaaatttggatatgttgttcgaaattcaattgcgcacaattccaccgttgggatttttgtgataatatttgtggagggagaaaaaggaatcgcagaagatagtacaagtggaggtttcaatctcttctccgtctctctgacgtttgggaattctattggagcagttggaggaataactgaaggaatctcagggaaccgctag

SEQ ID NO: 71204 - DNA, 402 bp, Glycine max
  Peptide Sequence Number=SeqID_187982
gttgtgaaaacaagacaacgattggtacctcaaagccttacactggggcaatgaggggcatcgtgcatgagcctcaagtgaacataggggcagatcaaaagttctcacctgtcgatggtggacccttgggtactagtaccctcacccttagagggctacacgcccttgccatcagaggactacacgtcctcaccttcagagggctacatgtcctcgccttcagagggctacacgccctcaccttcagaggactacatgtcctcgccttcaaaggggctacacgcccttaccttcagaggactacacgtcccccctttcagagggctacacgccctcaccttcagatgactacacgtcctcgccttaagagggctacacgccctcgccttcaaaggattggac

SEQ ID NO: 71205 - DNA, 303 bp, Glycine max
  Peptide Sequence Number=SeqID_187983
atggagtcagctgtcaggcggagataccttagggtcatccacacttttcgtctaccaggggcaaacgagcctgttggcgcgcagagactaacatcgccgtctgcaccttttgctatccagggacagctagtcaggtggcaggcggagataccttgtggtcatccgcacctttcgtcaaccgaggtgaacgaatttgatggtatcaagatgatgtttttgctctcgtcgtccgaagacattcaagcccgacgacacacgagattcttctctgatgggcggggacgatcaagttcgatggcatag

SEQ ID NO: 71206 - DNA, 420 bp, Glycine max
  Peptide Sequence Number=SeqID_187984
atggttaaggagaagtgtaaggaggtaagtgtctcctccaagaggttagcaaagaaggagagtcattttgcaataaacacaaacattaaagaaacttcccttcttagacaacctcaacatcttctcctttgtaaaaggacacttgtaagcattgccacacctcttgggcttgagtttattcctcaggtgctcatatgggacaccttaggtttgtcgtactttttagtaggagtaatcaacatgaaaatacaaaaaagggatcaaggggttcccatagaccctaagagaataaaggttattcctgagtggcctactccaccaagtattagggaaatttggggcttccatgacttaacaaacttttacaaaagggggttgagggaagaagcccagagttttaaagaaccttttcgggtttga

SEQ ID NO: 71207 - DNA, 129 bp, Glycine max
  Peptide Sequence Number=SeqID_187985
atggaagacgtgcagctattcgaactgcaagaacaaggagaaacccaggaagaatttgtagtaggaagtagcttttgtagtgtaatagcagcttttgttgctactgtcaattgttgttttgctgaataa

SEQ ID NO: 71208 - DNA, 423 bp, Glycine max
  Peptide Sequence Number=SeqID_187986
atgtcctcacctttagaggactacacgtcctcaccttcaaaggactacacatcctcgccttcagagggctgcacgccctcccctctcagggctgcatgccctctccttcatagaaccacacgtcctccccttcagaggactacatgtcctcacctttacaggactacacatcctcaccttccgaggactacatgtcctcgccttcagagagctccatgccctccccttctgagggctgcatgctctctccttcataggactacacgtcctcgccttcagaggactacacgtcctcgccttcagagggctgcacgcccacgccttcagagtactacacgtccttgccttcagaggactacacgtcctcaccttcagaggacttcacgtcgtcgccttcagagggatacacgccctcgtctttag

SEQ ID NO: 71209 - DNA, 780 bp, Glycine max
  Peptide Sequence Number=SeqID_187987
atgatcttaaaggaagagttagctgtttgcgcaagatccaagaggagtttggctcaacacttggaagccacggagcaaagcatgctagctatcatagggcagtacaagcaagagttaaaccagtctgtgacccatgaacaaaagctagtagaggatttcgcacaagcgtacgccgaaaaggaagcaagagggagggtgattgatgcattgcatcaagaagcgactatggggatggataggttcgccttgaccttgaatggaagtaaagacctcccgcgactgctagccaaagcaaaagccatcactgaagaattcaccataactaagaaagcgcaacggcacccctataacactcgatccagaaaaatggacaatgaagagggcatgcaagaacaaatgaaggccaacctatcggccttaaaagatcaaatggcttctatcacggaggtcatgctaaaactccagaaaactatagaggataatgccacggcgaccgcctccaatgcatttagggaagcggaaccggtgctacagcccgcaataaacttgggccgagatagaagcacaactgtgacatcctggaaatttctacccggaatttttgtaaagagaaacgcgagggactggaaccagagaaacggcatgcaaaccgaggtaggattttggcatttcaaaaggtcagatttttctcttcatgtggctgagcatgagtcacatcaagagaaaaagtgggcccttttgctccactcaaatggagacatgtggcatagcttaaaataa

SEQ ID NO: 71210 - DNA, 195 bp, Glycine max
  Peptide Sequence Number=SeqID_187988
atgatgcatgcacctgactcaactctcagatgcaatgtgagttcgtcgagaccacccgattgtgcatgtaactgccccccccccataggtgatcagcctggggccaaaaagagttccctaccaagtgataagccccctcagtacaaagtacactctgccacagttattctatttcctgtgtcgtatgagctatga

SEQ ID NO: 71211 - DNA, 336 bp, Glycine max
  Peptide Sequence Number=SeqID_187989
atgcctaaaaggaaggtatggttgggactctgttggttcactgagcatgcaagacatgaccttgctggattcacattgagagttagcacaaactgtttgcataatctatttggttctgatgcagatatgcttctcgatttggtgtgtaaaacagtgaagaacaccacagaattcaattataagccatttgtggatgatgatcactttgcgcacaagtacttcttaccccaagagtatgccattatgataccagtttcagctggtgtggcacttctttgcctcttgtgcatatttattggattcgtgatgctcaaatccaaaaagaagaaggcctaa

SEQ ID NO: 71212 - DNA, 687 bp, Glycine max
  Peptide Sequence Number=SeqID_187990
atggatgagaaagccaagaaaaaggggagaaaagatgaagtaatgaatattaatgttgctgatgataaagaagtgcagttcttggatgacaaccaagaaagcaagatgaagaaaagaaaaaaagatgattcttcattaaatggaatccaagaattggttttttcaaaaccaagcaagaaaatgatgaaggataataggttaaaaagcaacaaaggtaaagatgatgaccaaggcaagctgatgatgaagaagaaattgagtgcagaaaaccaacatgtggatcacaatgaatttaaaagtaatgaagataaagatgatggccaatacaagaaggaggaggaggaggagaagaagaagaagaagaaaaagaagaagaagaagaaactgagtgaagaaagtaaaagtaaagagtataatgagtttgaaagcaatgatggtggagatgatggcaaaggtaagaagatgaagaagaagaaactgtgtgacaaaagcaaaagtaaggagaattgtgagttcaatagcaagcagatgatgaagcagaagaaatcagatgcagaaaaccgacatgagggttacaatgaatttaaaagcaatgaagataaagatgacaatcaatacaagaaggaggaaaagaagaggaagaagaaaaaactgagtgaagaaagcaaaagtaaggattataattga

SEQ ID NO: 71213 - DNA, 735 bp, Glycine max
  Peptide Sequence Number=SeqID_187991
tgcagcgctgtgccattctgagacgttctctttacatcctgcgcttcagcccctgcattcacgctttctccattctggcatcctttttgctcctgcttcgctgagacatttatttccgcgtccacgccgtaacggacgtcttcgcacagcgttctttttcaggagtgaaaatatgcaccgtcgtactttattaaaagcctttgcattgtctgcgtctgtcgttgctatgggaatgagttttggcgtgcaggcggccgataccatcaaagtggggatcatgcattccctctccggcacgatggccatctccgaaaccccgctgaaagatgtcgccctgatgaccatcgatgagatcaacgcgaaaggcggcgtgttgggtaagaaactggagccggtggtggtggatccggcctcaaactggccgctgtttgccgagaaagcgcgccagctgttaagtcaggataaggtggcggtggtgttcggctgctggacgtcggtctcgcgaaaatccgtcctgcctgtctttgaagagctgaacggtctgctgttctacccggtgcaatatgaaggcgaggagatgtcaccgaacgtcttctataccggcgcagcgccgaaccagcaggctatcccggcggtggaatacctgatgagtgaagacggcggcgcggcgaagcgcttcttcctgctgggcacggactacgtctacccgcgcaccaccaacaagatcctgcgcgc

SEQ ID NO: 71214 - DNA, 340 bp, Glycine max
  Peptide Sequence Number=SeqID_187992
atgatagttaaccaacaagtgaaggtacctttctccattgggacatatatggatgaagttaattgtgatatagttcccatggaggccaaggggaaagaaaaggaggaaaaggattcctccaacaagattgttaaaaaggaaaatcattttgcaacaaaaggtgatattaaaagggcactccttcttaagcaatctttctaccttctcctatcatgggaaacatcccttagcaccgccatacctcttgagcttgaggttattcctcaagtaaaagagttgttggatgagggtttggttcacaagagcttaaatccttgtgctttgttggtgcctaaaatag

SEQ ID NO: 71215 - DNA, 281 bp, Glycine max
  Peptide Sequence Number=SeqID_187993
gggaaaagagggaggtggttgtcgcccagcttgcccaggcaggcgagctgggttgctaccaccagaaggcagcaccttctgttggaacaccctggaaggcccaagacatttgttttctttccgtaatgtcgcgaaactttacggattacacagcaatcccttctttgacttctggaatgttgtggaactttacggattgtgcaacaatgcttcctttcgacttcaggatgtcgcggaacttcacggattgcctaacgatgggtgttaagtacctcgaagcg

SEQ ID NO: 71216 - DNA, 330 bp, Glycine max
  Peptide Sequence Number=SeqID_187994
cgaaattcaaaagaagaagatttcaagtgctttagagaaaaaattgatgcaaaaacgggaagaaaaagccttaagaaaaattggaagaactggaaagcccgcttagcgcgaaaaaggcccatagagaagtccaaaggtgcgcttagcgcaaaggcccacgctaaacccgaagtcagtgtgaaaattaagctacctagtgcctatataaggaggaggaagcagaagaaaaatggacggagtctcagaacccacgcactggatctataccttaggggaaatcctctatctttattcatcttcttccatccacctcaagcccctaaagtgtaa

SEQ ID NO: 71217 - DNA, 171 bp, Glycine max
  Peptide Sequence Number=SeqID_187995
atgcacgagatcagtgtactaagcgcaacggttgtcttcagccaggctcagcaattagggtacatgcacaaagagaagacaacttttgcagagaattccaaagcacaccacagtgcctatttcgggaaaagagctctggaggcagcaagaggagcagcttttgcagagtga

SEQ ID NO: 71218 - DNA, 264 bp, Glycine max
  Peptide Sequence Number=SeqID_187996
atggatgtacatcaacaagctctgttggatgacactaatgagtatcaactagtcgcacttgagagtattctactcaacaaaataaaactaatagaacaagaaggaaaagagctagatataagcattcatgctaaatacttgaaaaattattccatccttccatgtgggaaggaagtaaggcttggaggaagtgaggctggttttctaatgcactttggatactactggcttaggcttgctatctacattgtagtcactgtttag

SEQ ID NO: 71219 - DNA, 201 bp, Glycine max
  Peptide Sequence Number=SeqID_187997
atgtcacgcatagcgccaccctcacgctttgcgcaaacaaccatcgcgcttagtgcgcggcctcgatatttatgctctgctagattcttctatcacgctaagcatgctgaagttgcgcttagcgttgaatgcgggttgagcccaaatggtgagctgagtgcaactgccacttttagcacttcaagacttagactcttttaa

SEQ ID NO: 71220 - DNA, 360 bp, Glycine max
  Peptide Sequence Number=SeqID_187998
atgggtgaaagaaagggtgtgcaacatcagagagaaagtttcaacttaacacatataagttgtgaacctgtgacttatgagtacacgacaaataagaagagggtcaagggttttttctcacccttaggagatggcactacaactaaattctggcaccacaattggataccagattgtggagttttttgggatttagctgcaaatagttcactagaggcagagttggagaaatctatttttgagtatgtgggtgtaaataggtgttggttgataaatagtttcaaggattacattcctaatcatattacaattaaaattgtatccatgttacctccgatggtggaagtcaaaaggatttaa

SEQ ID NO: 71221 - DNA, 129 bp, Glycine max
  Peptide Sequence Number=SeqID_187999
atgaatgaagatgagaatattactcaagaggaagaactcaagaatactacaaaaggcgatccacctcaacgggagagaagtcgaaaaatcggcataaagaaaaaattcaagaatatagcacaaggttag

SEQ ID NO: 71222 - DNA, 1458 bp, Glycine max
  Peptide Sequence Number=SeqID_188000
atgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgtgtgagtaggaaacagaaaatatctattctagttttatcatcagctatgggttcgaatttaagcgaaattctagagaatgtttgttatcctgaaattttcgtttctttcctaaatgataaggataaaaaaaaaatagggtcaaaagaaaatgccattttggagttttatcgacaatttgcttgtgttggtggagatccagtattttctgaatctttatgtaaagaattacaaaaaaaattttttcaacaaagatgtgaattaggaaggattggtcgacgaaatatgaaccaaaagcttaatcttgatatacctcagaacaatacatttttgttaccacgagatatattgacagctgcggatcatttgattggaatgaaatttggaatgggtatacttgacgatataaatcatttgaaaaataaacgtattcgttcggtagcagatctattacaagatcaatttggattggccctggttcgtttagaaaatatggttagaggaactatatgtggagcaattagacataaattgataccgactcctcagaatttggtgacttcaactccattaacaactacttatgaatctttttttggattacatccattatctcaagttttggatcaaactaatccattgacccaaatagttcatgggagaaaattgagttatttgggccctggaggattgacggggcgaactgctagttttcggatacgagatatccaccctagtcactatggacgcatttgtccaattgacacgtcggaaggaatcaatgttggacttattggatctctagcaattcatgcgaggattggtagttgggggtccatagaaagtccattttatgaaatatctgagagatcaaaaagaatacgcatgctttatttatcaccaagtagagatgaatactatatggtagcaacaggaaattctttggcacttaatcgagatattcaggaggaacagactgttccagcccgataccgtcaagaatttcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgacacgagggaaacatcatttataccatactga

SEQ ID NO: 71223 - DNA, 540 bp, Glycine max
  Peptide Sequence Number=SeqID_188001
atgaccaccctcacacagatatggatgacgttgctacttagcaacattctacccagcgaccacaactctgacctccctctgccgaagtgtcagttggtttatgccatcctgacacagatgagtgtgcacgtggctcagctcatatttggcgctatttatcagtttgcagggattgcatctacgagacaccctgtggacccagagaagtccaacaaggacttggggtttcccgctctgattacgggcctctatcagttctatagagtgcccgtcgcccccagcaaggggcaggcacaggcacagggccaggcaccacagcagcctggggacggccaccagcaagcagttgacgacacaccaccactacctccagagtccacctctactcacctgcggaggttggaacgatgtatacgacatgtggctgaccagcaggcggccaaccataggggtcaggtgcggctaaacgagagtttttatcagtacactatacgtcagcaaggccaggactccagcccttacacatggcctactccatag

SEQ ID NO: 71224 - DNA, 420 bp, Glycine max
  Peptide Sequence Number=SeqID_188002
atgagcgttcacatgccccaagtgattgctgatgccatttatttgtttgcaggaatagcgcctactaggcaccctctggacccagagaagtccaacagggccttggggtttccggctttgatcacgggcctctgccagtcctacggagttcctatcacccccaacaaggcacagggcaacgcacatcaggacgcgggcgcaccgccgccacctcggcaggccgattcggttgggccactgcgcgtggagtggtatatatatcatttggttcgccagcaggcggccaaacaccatggacaggtgcagatacatgagtgtctctaccggttcagcctcagtcagcagggccagggttccgccccttttgtatgtcgtaccccaaagcagtttggggctgaggtcacatggcctggtgactag

SEQ ID NO: 71225 - DNA, 888 bp, Glycine max
  Peptide Sequence Number=SeqID_188003
atgcagaagcagatagattacctagggcacattgtttccggcaatggcatacaacccataccagaaaaggttcaagccatccaaaggtggctgcaaccgcacaaaacccgagctctgcgtgggttccttggcctcctgggattttatcgtaggttcataaggggttacgctgctatggctgcacccctttcacaacttctaaccaaggcagactttgtgtggtcactagaagctgagcatgcatttcaaactcttaaggatgcagttactaagtccctagtgcttgcacttaccgattttgctaagccctttacggtagaaaccgatgcttcgggtttggctactacctcgttcttgattctttcgatgccacattttaccttccttgaggacttgcgcaaggagctgcaaacacataatgagtttgtaactttgagggaaaagatatgcaccaattcgacatcatatcctgatcattcgttgactcctcatttcatcttacatcagggtcgcatttggcttccctcagattgttcattcatcaagaccttgctcactgagtttcatcaatcaccaacttggggtcacatgggttttcgtaagaccttgaatcacgtcgctgagaacttcacttggagcaccatggctaggcttactgtgtccattatcggtgtcatcgcagtagtgggaggacctttcaatggacttcatagttgggctgccagcctactgcggcaacacatgcatcttcgtggttgtggatcgcttctccaagggggttcatctcggcatgcttccccctcaccacacatcacaaggtgtggctcagctgttcatggagatagtgggcaaacttcacggcatgcccataagcattacattcgatag

SEQ ID NO: 71226 - DNA, 957 bp, Glycine max
  Peptide Sequence Number=SeqID_188004
atgggtagaccgaagttgcaaacaaagtcattgagcagtgcttatgagcgttcgtccaccgacggccaagttgatgcagtagatgatttactcagccaaccagaatccatattttccttacttcgacaaaagctacagaagacccagaatggtatgaaagctatcaccgacagacaccgtcgtgaccacgagttccaggttggagaatgggtcttggtcaaactatggccatatcgccagtccacaatctcgggtacagcccagtctaagctttcaaagcatttttataggccatttcaaatcagtgtgaggatgggtacaatcgcttacaagctcgcactaccagagcactctcgcattcatccagtgtttcattgttccattttaaagcccttcatcggacctctggatgcggtgcaggttgaggaccttcctctagtggcggttgataaccaaccaggtcttcaccctaacgagacgtcttgggaggagtggacgagccttcagaaccttcatcaccttgaggaaaaggtgttgtttgaagcgcgcgggaatgttacaagtagcaataatgagttacaagtagccaagcccaacgcgaataatagcaaggagttaccaacaataaggcccaagaggcaaagccacactcccaatcatctgaaggatttcgttgattctgcaaaatggatgttaaggctctggcagagaatctcatggattgctagcattgtcagaggccatacaagaggagctggttttcttgatggagcttgcaaaggagctgtcacaggggccattgcagcactagaattgctaaacattgttgcttgtgatgagccactttctaagttccatggtgtaatacttctaagattgtttttctttgcaaccatgtcgaccaagcaagctaagcctttgaagaaacccaagtctgataagaaggattacgacgag

SEQ ID NO: 71227 - DNA, 979 bp, Glycine max
  Peptide Sequence Number=SeqID_188005
agggcaacacatcctcgccttcagagggctatacatccttgccttcagagggctacacgtccttgccttcagaggactacacgtcctcgcctttagaggactacacgtcctcgccttcagaggactacacgtcctcgccttcagagggctccacgccctcgcctttagaaggctagacatcctcacctttagaggacaagacgtcctcgccttcagaggaccacacgccctcgccttcagagggcaacacggcatcgcctttagaggactacatgcccttgctacatgtcctcgccttcagagggctacacgccctcgccataagagggctacacgtcctcaccttcagaggagggctgcatgccctcatcttcatagggccgcacgtcctcgccttcaaaggactacacgtcctcgccttcagagggctacacgccctcgccttcagagggctgcacgccctcgccttcataaggctgcatccctcgccttcatagggctacacaccgtcaccttcaaaggactacatgccctcacctttaaaggactggacgtcctcgcctttagagggctacacgccctcgccttcagaggactacacgtcctcgccttcaaagggctacacgccctcacctttagaggactacatgtcctcacctttagaggactacacgtcctcgccttcagaggactgcccgtcctcgccttcagagggctacacgccctcaccttcagaggactacacgtcctcaccttcagaggactacacgtcctcgcctttagaggactacacgtcttcaccttcagagggttgtacgtcctcgctttcaaagggctccacatctacgccttcaaagtactcaaggtctccggctttgatgaggagactatcgcacaactactatgcataccggggcaagatttcacccagtcgctgcaaggagacgagtgtggatcgtgcgcaccaacatatggatga

SEQ ID NO: 71228 - DNA, 279 bp, Glycine max
  Peptide Sequence Number=SeqID_188006
atgtcgatccttctcggcgttcaacgacggtgcacggccgtctttgaatgcgacgtcgtcgtagaccttcggccaatctacgatggttcgccttcgaagacgttgtcggcgtcaggaacgacgttgaaaccatcgatgtcgaaaggtgccctttactacgtcgttgcatcgacaatgaccgctgttgaatgcttagccaactacgtcgttgctgccgtaagcaacgacgtcgaaagctaccccttgctatgtcgtttcgcaggaaaagaccgccgttga

SEQ ID NO: 71229 - DNA, 1212 bp, Glycine max
  Peptide Sequence Number=SeqID_188007
atggaaaacaacactgacaagttatcctccttgcctgaacttttgtgtctgttcatcatttccttgcttccattcaaggatgccgtgaggacgagcattctgtccaaacattggttgcacatatggaaatattcacctaaaatagagtttagtgaaaattttgatggaaattgtatcgatcgttttgaacccttcagttccataaaagctcggagaagtgctttcatgaaattcataaaactttggcttgatttccgaaaagtaggtgaggtggaaaagttttctttgaagttctcaaagcctaacaatgatcatcgtgagatcatagaagagtgtgtcacctttgtcacccaacatggggtgaaggagttggagctagatttctctgaccccttttgggaggaggaagtgattccaaacaaacgtaaggctttgtttgaattgccaaaacttgcgtatgggaacaaacccaacattgaatcactgaaactctcttcatgtagttttcgtgaaaattatttgagtaattggcaggcacttaaagaagttactttcggttggatggaagtgacactcgatgccatgacaattgtgttatccaattgtaaaatgatcgagagtttagttttgcacaagtgttggaacttgagtcattttgaaattggcagtgaagccttgagtctaaagaggcttgttgttgacaagtgttcttttcgaaatgctctgttcaaagtcagtgccccaaatttatgctttttcaagtattttgggaaactgtgtttttttgaaatgaaaaataccttagccatcgaagaggcacatcttcatttctaccttggttatgacaatgttggaaccggtgctagggttatgtatgacctggtgaaagatctctataatgctagggttctgactgtgagcccttatctaattcaggttattcttacgggagaaaagagacgtatggaacatgacatgaatgcaagacatttgatactgagaatgaacatgctccgctgtgaacttcgtgcagtctcattctttctccttagctgcccaatgttagaatgcctcacatttgaattaggctcagagattattttaccagattatcaagcaatgtggatagacagtgatgaagaacaagatgatctaccactgtggattgacagtgacgaagaccaggatgatcaagcaaagtggatggacaat

SEQ ID NO: 71230 - DNA, 372 bp, Glycine max
  Peptide Sequence Number=SeqID_188008
gattttgaggattatgatgacgacgatgaagataacatagacgatgaagataacatatatgatgattactgcagagattttatcaacatggttgataatcaaatcaaggggatgaaaaatctaatcaactataattgtttggaatcatctttaaagctagtggaggtgaaggattttgtagggtccaagaacgggcttgtttttctatgctatcttatccgttatgggaaggtcttgaaaaatgttagcatcaacgtgttaaagacagagcttgaaggtaatagcaatgtggcattttaccgtacaatagaagaatacttgatgaccactcctagggcttcaagtaatttgcagatatcaatatgttattga

SEQ ID NO: 71231 - DNA, 352 bp, Glycine max
  Peptide Sequence Number=SeqID_188009
atggatgtagcggaatgggtttatcacctcctggtcctccttgcttcaagtgttggagtcaagcctctatcccttactcatgttgtcgcttttgcgaagttgcaagaagacaaattgcgggatcaccatcttaactaccgcccatattttccccttccatcttcgccgccatcaacttcatctaacctcaaatttcagtccaagaaactgtcaacggaagaaatagccattaggcgtgacaaagtcctatgttatttctatgacgagaaatgggtatccaatcatagatgccaacctcagatacacctcatcctggaagacgagccacaagaaactccactgccacctgcaa

SEQ ID NO: 71232 - DNA, 274 bp, Glycine max
  Peptide Sequence Number=SeqID_188010
atggtggtaggtcttcaatcccttcccattccggcgggtgttagggaggacctctccttagacttcatcacaggtttgtctccatctcatgggtacacttgcatactggtcgtagtggatcgttattctaaaggagcacactacggggcattacctcagcaccattctacttttaaagtggtcaccctgtttctggatattgtttgcaaacaccatgatttcccttgctccttggtatcagatagagaccccatctttattagctctttctggc

SEQ ID NO: 71233 - DNA, 234 bp, Glycine max
  Peptide Sequence Number=SeqID_188011
atgggatttttccaagaaccccccttctcgccaagtcttggttcaatggtgaggccttgccccataagacacttcctaggaagactaggacactttgcgttctacttatcacctcgaggacgagggggacacatagaactgcatctgttagtcagggaagtagccgccactgcccatcacgcggcagaggtactcgccggcacagagggcctaggtcatgccttgcatcgttga

SEQ ID NO: 71234 - DNA, 249 bp, Glycine max
  Peptide Sequence Number=SeqID_188012
atgcaggtgttactgttaaggcgtgtggcgactgttaaggatagcaatatagttgatacacttccatttaacatattgtcatctcattcagtgttgcatccccgacaacaaagatttccttactatcatcgttcaagggtcacacctttttatgaagaagagaggttgacatgcatatcggttaatgtgcgggctatgacagtacaccaaaatggatcgaagttggatgacaagaccacgcataagtga

SEQ ID NO: 71235 - DNA, 477 bp, Glycine max
  Peptide Sequence Number=SeqID_188013
atggggacgaggggctgtatcaattataagcccgtccttgccataagacaacttggctaccccatgagaggagcgccatcggaagaaagtatcatgcctttcatcgcacgggatttcagtgaccccaatgcaaggatgtttcaaagagtccagaaagcatggagcgcggtgcaaagaaaggataaggatcttaggggaagcaacaatgtgatcattggtggctatcacaagtggctgaaggctagaacgcaagagttagattggctcccaaagctaaaattttcaagtgaggaagaggttgaaacccctgaggagagtgaggaggtgcaagccttgaaggtggaacttgaaaggatgcaagtgatcaaggaaaagctcaagacgacgaccatcaaggtccgaaaagaatgcgacaaactgagagacgtcaatgtggccaccgctgaagcattggaacaggaaacaaagagggcctga

SEQ ID NO: 71236 - DNA, 336 bp, Glycine max
  Peptide Sequence Number=SeqID_188014
atggccaaaatacatcatcaagcatggccaacaaaaacatatcatccaatgaaacataccccccacacttattcccaaaacaattccaaagctccaaaatttcttaagggtagaaaggggaacataggctcaaaggggctatcaaaggaattaattcaaggtaggctcatttggctagaggcttataagaacaaaatgcctaaatcatctcccaacatgcatgtgaagcaagaagtatcaacaagagtcaagccaaggctattgtgcaagcaatcaatggggcaaaacacaccgaataaaatcaatgatgatgactcaaattctcaccaagggtaa

SEQ ID NO: 71237 - DNA, 393 bp, Glycine max
  Peptide Sequence Number=SeqID_188015
atgtgcgaggcaagctctgtttgaccatgatcatgtagcgtgtgaagtgtgttccgtgaatgtgaaaggatgccagaaggtacaagaggatgtacaagggctgatagacagcaaaaaattaatcatcaccaggaaagacaaggaagtgtgtgttattacccctgagttccagcagctggaaataagttataacagtgggagactagctactactccactagtgattagcttgccaagacccgtgccttatgcttctctaaaagcggtcccttacaagtataatgtcacaatgttggaaagtggacaggaggtgcctctcccctctctaactcctgcgacttatgtagacaacattgtcagtaacagcaaggttctgaggaatgggcgtgttat

SEQ ID NO: 71238 - DNA, 207 bp, Glycine max
  Peptide Sequence Number=SeqID_188016
atgacagataaacttgttgtgtccacctcctgctcacttcttcacactgctgttgatcttgttaatgaaaccaagttggataatgagataaaatcatggctggcttttgctgcccaaaaaattgttgaagtaaatgcattggccaaggcattgtctggtcaaaaggatgaggtaaactctgttccttttattttatcttacatctga

SEQ ID NO: 71239 - DNA, 534 bp, Glycine max
  Peptide Sequence Number=SeqID_188017
atgggtgtgggcagttttagagactatattttcaagtttgtttcttccgtcaaactttcccccttttccaacttgatgcaatcctacctcgcaagggcattggatagaagactccaagaagattgggccagagatgcaagagaagaccctagggttctcatgagccttaggactcatcttctacttgaagtggcgtctcgattcatctttctccttctccattccactacaattagacctcaagaagcaaaggaatccattgatgaagaagatccaaggcctacaagctccacatggagctacatcagaactgtctcgtcattgacctgtgttgacaatgtagatttcgcgttggagatggcttccccgggatgtggcattgtgattcctcttgtcagagttgattggcattctttggttcctgatttggctttcttcggttgtctgacacaagatatgtgtcctaggagaagaactatacaagaacatatggctcccaataattatgctgaagctgcttcaatgttcaactga

SEQ ID NO: 71240 - DNA, 372 bp, Glycine max
  Peptide Sequence Number=SeqID_188018
atggcctttacccccctttctgtggtgaaggtgggtttgctttatgctcaacgggatccaccattccttcgtcccatatctaaggggatacagaggtgtctagtgagatggcttgcacagcagtggatgcagctgaattttcacaactggattcattttgtgtggcacagaatgatacgcggacgctattatcgccatttgatgactccatccgctctatggaccacattgatattaaaaagaaaaggaaggattcaaagggacaagagaaataaaaaaaatgacactgatttagagccaccatcaacccagaaagagagagtctaccttctcggcaacgacaagcctggaggtcttgtagaagttgtttga

SEQ ID NO: 71241 - DNA, 1317 bp, Glycine max
  Peptide Sequence Number=SeqID_188019
atgttggtttatcaagtagaagttgatggttaccacggaaaagttgcccttgaatcaatattgtctcagaaaggcaatgttgacttatcaatgagggaagggacgccacttaaggaacatcttgatgagcaaaactttgttctgatggagctacgtgacattaataagaagaaaaacaaagctgacaagaagaacaaagctgatcctaaggacatctacaattactgcaaagaatcgggtcattggaagcaagactatccaaagaaagcaaagaaagattttgttgctgcacttgttcagaatgattcctcaacggaaagtgatttggttatgactgtgagtgaacaactacaacaatactcaaaacaatgggtactggactcagttctcattggtgacaatgcttcttgtaagtttgtcggtatagattctatacaaatcgtaatgcatgatggtgttgttagaaccttaactgaagttcgtcacattccagagcttaagaaaattcttgtatatggggtgccatggattcaaaaggtttttcttgttgggttaaagcactatgtctatgggaagcagcatcagacgaaattcccaaagcactatgtctatgggaagcagcatcagacaaaattcccaaaggttgtacacactataaaggccattttagacaacgtcagttttgattgttgggggcctttgagagttccatcactaggaggggcaagatatttcctctccattattgatgattactctaggatgacattggctaagacagttagcacaacatgcgatctcatgaatcgcttactgtccattgccatagactttaagacccctattaaggtatggtctaacaaaccatccaaatactcaatgctgaaggctatggagatggagttaaaggattttgagtctggtctccatctgaaaggccattacagtagagatgttgtctttgatgaactttctatgatgcattctaaatctgatgaagatttagccgtggagttggcaatggttatgaatgaagagatggaatcccttcagaagaaccagacttgtgatttagttaagccatatgaaggcagacaagtagtggggtgcaagtggatcttcaagaagaaatctggatcgttcactgaagaagaaggattggactacaatgagatattctctctagtagttcgacacatctatatacgtgttttgctagccctagtggcaactctggacatggaactagagcaactcgatgccaagactgcctttctccatggaagactcgatgaagacatgatgcaacaaccttaa

SEQ ID NO: 71242 - DNA, 489 bp, Glycine max
  Peptide Sequence Number=SeqID_188020
atgggtacatcaaaagtccctatgactcgtgtttatcatagcaaagtggaagatggttcccacatctatctactgctctatgtggacaatatgctcatagcatctcaaaatttgtgggcaattcagaagcttaagacatatgcaaaatcaatatgtactcctctgacaacgtctattcgtctatctgaacttaatactactcagtcaaaatcagagaaggaatacatgtctcatgttccttatgcaggtattgttggtagtctcatgtatgctacaatatgcatcataccatacctaacacaagtagttaatctcggtacaattgatattggactcgtctaccatggacacatgttctatgctctcattggttactttgatttcgattatgctgcagatatgaatatgcaaggaaacacttcagctgacaatgactttatccactacacaggaagagtacatgctgcaatctgtttagccaaggattaa

SEQ ID NO: 71243 - DNA, 183 bp, Glycine max
  Peptide Sequence Number=SeqID_188021
atgctaggttacagggtctacaaagttggcttagctggcaaggatcctgctaagcctaaggttagccgcatggatttgcgcttagccaagaataagcttagcgaatatggccgctcagctcagcagatgccgcaaggaatttcgcttggcgcaggagatcctggcttaacgcagtgggcttag

SEQ ID NO: 71244 - DNA, 135 bp, Glycine max
  Peptide Sequence Number=SeqID_188022
atggggcatgccacattgtccccatcctcttgcatttatgtccaacatgggctcaccaagtgctcggtgaaatgccccaatgatgtacatcataggagattcaaaataggtgcccaaatgcaattccaagcttag

SEQ ID NO: 71245 - DNA, 240 bp, Glycine max
  Peptide Sequence Number=SeqID_188023
atgaagaactggatgcagaattcaaaatgcgatgtctacctaggagcctacctgaattggccaaacaactaccttaaaggaataattaacagtgttttgaaaggactagatgatactccacaacctaaatccaaggttggtgctaggtggattgttgttaaattaacgtttaatactatatttcattatgtatttagtgtaatagacaaaaaggaagcactgagtgtggctattacatga

SEQ ID NO: 71246 - DNA, 231 bp, Glycine max
  Peptide Sequence Number=SeqID_188024
atgtcttgtgcggatgaaactcaaagcctatgcgaatcaaaagcagcaatggaaacagaaacgcagcacggggagggagaacaaagcttacctcgacaatgtcgacacaggagcatgaaggagactgaagaagaagaagaagacaccaccacgcgctcaggatatagttgcaaaacaaactcccaaactgaaatattgctgctgcaattgcatttggaaactgctatttaa

SEQ ID NO: 71247 - DNA, 249 bp, Glycine max
  Peptide Sequence Number=SeqID_188025
atggttgctaggacaagattaagtcatttgattgcgtgttcagtagacaccagcgatcggggacttatatccttgtttgtcgagaggtggcaccgggagatttctagtttccatcttcctgtgggagaggttttgatcacgctagacgacatcgcgtctcttcttcatttgctgatcattggcgacctccatgtcttccagcctctgcacatcgacgtggcagtgctgatgttggtcgagttattaatg

SEQ ID NO: 71248 - DNA, 849 bp, Glycine max
  Peptide Sequence Number=SeqID_188026
atggctatgacaaggatgtttaacataatccatccaacaggcatccaaatgtggtttatccctagacctttggtgacaaatatgagttacatgcttgccgatgttagtaattcatttgcttctacccttggggggcaagcagttgcaaatgattataccaaccaaaatttgctacataggggaagggctaatcaagtcatgaatggaggtgttaccaatggagaaatcctttttgtcaacaatgatgttggcctcaggccaaatgttatagatggcaaatcaactatcgaacacatagggcgattcacaatccagagtagtgagaattgggcaaacatggagatgtgtttccatgatagattttacaggcctttacctgaagtgactatagtcgatttgatgaacatgagacaaatggttgatgattcgacaatagacatcatagaaaggttcaagaaagaaaagttggtagctcaagagtatggtgatcttaaaagctttgaagaagaagttgagattatggctgctgacattttatgtgggaagctgtattcatgtcctgatttaaaactaggaaaaggaaaaagtaccggtggggatggaaagtttgaatacaattttgacatctttaagatggataaggttttagatcatatgataaaagaccaacaaatctggttgaaggatggacataagataccatctccaaatgaattgaaagggaagaaatattctgatagaaatgtagccaaaatggtagtagatacaaactgctttacaaagttagacattgatatggtctcttatgagcaggctgctagcaaatggaggaagatgaagcgagtttga

SEQ ID NO: 71249 - DNA, 150 bp, Glycine max
  Peptide Sequence Number=SeqID_188027
atgtcattagagaacttcacgaaggcatttgtagcatgcacttggggagaaggacccttccctaaggccctaggacccttccctacatttgggggcgattactttaccaagtgggtacaggtcaaaccccttgcaacaattacaacctag

SEQ ID NO: 71250 - DNA, 507 bp, Glycine max
  Peptide Sequence Number=SeqID_188028
atgaaggcattttcagtattgttgaaagtgaaagacaaaatcaaattcatttgcaaaaaagaacaacaacaagcctttgaccaaattaagcacatgaatgtgaaatataagtgtaatactgttacactatgggatttctatcaatcgactaagaaattgttgcaatattttgcaaatgtgatcatagaacatgtctatagggacgagaatgatgaggtaaatgagttagctcaacatgcttctggatataagaaaatcaaaggagaaacgatggatcattttgtagaagatttagctattagaacaactagggaatgctatatggcaagtcttaagcttagccccctaacgaaagatgaaccgtgtcaagttgtacactatgtggagatcattgtaggagtagaagggtccgaggagttagagttggacctgagaaccaatgacgacaatcgggttaaaccaattgaagaaacatgtaactttcagctcgacattaaagaggaatag

SEQ ID NO: 71251 - DNA, 691 bp, Glycine max
  Peptide Sequence Number=SeqID_188029
gaaggccaggctagacatggaccagtttaaatctttcggatatgaagacttagcaattactgcaaaaagtctattggactacggatgtttggaatcaatcctgattcctccatctgatagattcgaaggatttaatccctcaatcaatgaggccataaacttaatccaggcagaaatgatggactacattgccatcaagataactacctgcccgagcaacttcactgctcagaattatccttgccatgttatgaaactcttaccagaggatcatagagattatccctgcctattcaatgatgagtatgagagctgggatgtacaaggcaatacacaataccagtacagccttatgagggcacaaattcagggctatcaatggttcttctctgaagaagacaaacgtgagtttgatctgataaaagaaactcatgacacaaaactcttcctgcccttatacaatggaaaatttttcattccctttctggtggatctcaacaacaaattagttcagtttttccagaaagagaaaaaagacaaggagatttatgaagccagcgggtgccatggacaacaaactcctcctttcccttctactgatctttcaatggaagattcatctgatattttctgttttggaaatatccaagatgaagaagatgttacgattacaaaagcaagtaagagttaa

SEQ ID NO: 71252 - DNA, 132 bp, Glycine max
  Peptide Sequence Number=SeqID_188030
ttattggcaacaaaggcttattggagcacatgtttcctgtgcagatgatggtggtggaatgaaccctaatgcaattcgaaaatgcatgagcttgggttattcatcaaagaagtcaaagacaacaattggaca

SEQ ID NO: 71253 - DNA, 228 bp, Glycine max
  Peptide Sequence Number=SeqID_188031
atgttgaagaaagatagtttttcttggtctgaggaatgttcgcaaccgacaagtgtaccagatcgcacaagtagtataaaacggcctaagtggagaagggcgaaggcccaagtggagaaggataaagcccccgagtggagaaggatgaaggcccaagtggagaaggatgaaggcccagaggcagagacactatcaagactattaattgttgttgaaggcccaaattaa

SEQ ID NO: 71254 - DNA, 216 bp, Glycine max
  Peptide Sequence Number=SeqID_188032
atgcatgcttgtttgtacaagaccaatgaagtaaaaggaccttacatctgttctacccttcacaaccgtctgatttcaatggttgttggtcaggctcagccaaaatacttcctaggtggaaaccagccttattgggttgagttaatgaatcctcaagtgtttcagatgatatcaagaaaggatgggatggaatccatactttatccaaagaaataa

SEQ ID NO: 71255 - DNA, 540 bp, Glycine max
  Peptide Sequence Number=SeqID_188033
atggagaaccctaaagaaaataacaaggtagagaaccatcatacggtgaatgcaattttgagtcctacttttgtcttttctgctacaaaactagcagaccaattcggatatgcagaaggtaatcctactccagaacaacaaatattggatcctaaattaagaagaatattttctaaccgatttgctgcccaaagatcaagggagaagaagaaaaatcatttagccgatttggagattcaaaagaaaacttttgagaatgaaatagcccaaaaacaacaactacaagatttgtacgaaaataagaggcagactcagatagtagaagaagaaataatgtaccaggaaattgatattcttaagaattattcaatgttcaaagatggtgaaattgagaaggacaaaggtgaagtgattagggagagggaactccaagtgatagagcaacaagaggaattgcaagcacagttggttaacttgaatattggtccacaggagtgtccaattatccaacctcaatttattatgcaaactcatatctag

SEQ ID NO: 71256 - DNA, 321 bp, Glycine max
  Peptide Sequence Number=SeqID_188034
atggtggtgaaggtgctgcagagaatcgcacagagtggaagcatcataatcatgtccatccgccaactgagttatagaatcctagggcttctcaaccgcaagatcttcttatcacacggccaaactgtttgcagcggcttgaagacctgcttcttctcacatggaacattttcttggatagaaaatgtggttagtagaggaaaaacatgtttaaatattgaagtggacaaaacattggacattgcttttataattagagatggaaatttaaccaaaatagttaaggataaggagcttgaggtttcagtgaaatctttataa

SEQ ID NO: 71257 - DNA, 147 bp, Glycine max
  Peptide Sequence Number=SeqID_188035
atgagacagctagacgatgatgttgacttattgtgtacggctagccaggatggggatgatgacttcattttgtggggatgtattggggacgacggtggcctacaccttgttgccaatggaccttctaattctccaacaaaaacatag

SEQ ID NO: 71258 - DNA, 228 bp, Glycine max
  Peptide Sequence Number=SeqID_188036
atggaggatttcatggctcaagtggcttggctaggagtccagccttctcctttggggggaggtgaggcttccgcagcccagaagcctcagccagaacctcagccgaaggtcgcatgtgaggctatgccagagatgactccacaggtttcacctgttacttcacctgttgtggaggtctctaaggatgaagaaggcgccgaggacatagactatgtagcagatttatag

SEQ ID NO: 71259 - DNA, 282 bp, Glycine max
  Peptide Sequence Number=SeqID_188037
atggacgggcacattgatgtggccctggttaaggagttctactcgaacctatatgatccagaagataaatctccaaaacaggttcgagtcagaggaaagctgattaagtttgatgcggcatcactgaatgccttcttggagatgccaccagtcattcagctaggggagcagtacccttcatattcttttttttctccctctacttctcttccaccaccatcagttccagcacctgttggcaccgccgctcagagctctgatgtcacggtgccgatgctgtag

SEQ ID NO: 71260 - DNA, 354 bp, Glycine max
  Peptide Sequence Number=SeqID_188038
atgggatcgagtcaggcgccttggcttaaaaagaggttctatcaggtcaagatcaagagcctaggagtcgccagtctgaaagagttaggacagttgatgggtcaactccagcgacaagccttttgcaaagcctatggtaagatctgggacctaaccatggtggaggtctccacagaggccattgcctccctcgcccaatattatgaccagtctttgaggtgcttcacctttggggacttccagttaacacccacgatggaagagtttgaagagatcctgggatgccctctgggaggaaggaaaccgtatcttttcttaggcttctatccctccttggctagaatttccaaacta

SEQ ID NO: 71261 - DNA, 1943 bp, Glycine max
  Peptide Sequence Number=SeqID_188039
atggctgccgcagcctgtacggccctgctcggcgtgggcctggttccgcagctgatgcccaccgcgcaactttacagtgccggacagggtgagcttcgcgacctggtgctgcccgaccagacccaggtgcggctcaacgcggacagccgcctgcgggtacgcatgggctggctcagccgcaaggtggagctgttgcagggtgaggccacgttcgacatcgcccgcgaccgccgtccgttcgaggtggaggtgaacggcctcgagattcgagacattggcacggtgttcgatgtcgcgcgacggttgaagagcacgcgcatcggcgtggtttccggcgaggtggagatctggagccagggtgcggacgcccggcgtcttgcgcaactgggcgaaggccgggtggtgcaggtcgacgcgcgcagccatgcggtggagtcgctggatgtaccgttgtcgatgctgctggactggcagcaacgcaaggtgtccttcctggatgagcggctggacgaggtagccgctgccttcaaccggcacaaccaggtacaggtccgcgtgctggacgaaggcgctgcatcggcacggttgtcgggcagtctcgatgcgcatcgcatcgccactgccgagccacgcagcgggcgcctgctgccttctctcttccaaggacccgtgatgcgcaacacgctctacctgtcgatcatcctcgccctgtctccctgcagcgtgccgctggcggtcgcggccactgccgatggccttgaggcccgcgtttcggcgccgatcgcggcgcagccgttggcacgtgcactggagcagttgtcgcgcagttccggagtgcagttcctgtactcggccggcggtgatgcgcgcatggccggtgcggtgccgcgcggtgctaccgtcaagcaggcgctggacgcactgctggccgggaccggcctgggctacaccgtggtggatggcaacgtcatcgccatcgatccggcgcccgtaagcaacgcgccgaagccggccgcgccgaagccgcgcgaggcagaggcggtggtggcgccaaccctggacaccgtcaaggtgattgccgcgcacgaggtgatcgaccagaagaagtcgtcgccagtgatcaaggattcggtggtctacgacgagatggacagctacggcgacgagaccctggccgagagcctgatggccgctccaggcctgagtgcggtggaggatgccggcgagccacgttacgtgaccgtgcgcggggtacaggccaacctcaactacaccaccatcgatggcatcgcaattgccagcgtgggaggcagtggctccggcgagcgaatgaacaacctgcagctgattcccagcgacatcggcacccgtaccgacatctacaagagcttcagtgcggagcaggcaccggatgcgatcggcggcgtgatcgacatcatcagccgcagtgctttcgaccggtccggcaagtacgtgtttgccgatgtggcgggcatctattccaccgccgagaccaacgtcgagcgcagcgcaggcggcaaccacgagactctgggccacttcggcaagagcgccaaggtggtgttctccaaccagttcggcgccgaccaggagttcggcatcgttgcggtggcacgctacgagcagcgttcacgcaacagcgtcaagcgctgggtggagtcgaactactactacaacgacgctggcaaatacctcaccgacggtaccaccggtccggacgaggcaaagggctggaacgggctgcgcgcgcctggcaacttcagcaccggcacctataccaacttcatcaccaacttcggtggctccgccaagcttgagtggaagccctcggatgatccgttctacgcatcgctgctgctgtactcgtaccggttctacgagaactcgacgatgaacaagaccgatctgtacggcaatgccaa

SEQ ID NO: 71262 - DNA, 2071 bp, Glycine max
  Peptide Sequence Number=SeqID_188040
ggatcttttagtcaagctattagaaacttgctgcagtaagatatcaatcccacagttgcactcacagtgtttgaaagtgggccttgcccatgatagtttcgttgttaccaagcttaatgttctttatgctagatatgcatcactttgccatgcacataagctttttgaagaaacaccttgcaaaactgtctatctatggaatgctttacttaggagctattttttggaaggaaaatgggtagagaccttatctctattccatcaaatgaatgccgatgcaataactgaggaaagacctgacaattacacagtgtctattgctttgaaatcatgttctggtttgcagaagcttgagctggggaaaatgattcatggatttctcaagaagaagaagatagataatgacatgtttgtagggtctgcattgattgagttgtattcgaagtgtggacaaatgaatgatgctgtgaaagtgtttacagagtatccaaaacaagacgtggttttatggacttcaataattactgggtatgagcagaatggaagtcctgaacttgcacttgcatttttctcccgaatggttgtgttggagcaagtaagtcctgatccagtaacacttgttagtgctgcttctgcttgtgcccagttatctgattttaaccttggaagaagtgtacatggatttgtaaaacgaaggggttttgatactaagttatgtttggccaattctattctaaatttatatggaaaaactggttccatcaggagtgcagctaatttgttcagggaaatgccatataaagatattatatcttggagctcaatggttgcctgttatgcggataatggagctgaaactaatgcgttaaatcttttcaatgaaatgatagataagagaattgaactcaacagggttactgtcattagtgcattgcgagcttgtgcttccagttcaaatttggaagaaggtaagcatattcataaattagcagtcaattatggttttgagttggatattactgtctctacagctcttatggacatgtacatgaagtgcttctcacctaaaaatgcaattgaccttttcaacagaatgcccaagaaggatgtagtttcttgggctgttttgtttagtggctatgctgaaattggaatggcacacaagtccctgggggttttctgcaacatgttatcttatggaactcgacctgatgctattgctctagtgaagattcttgctgctagttcagaattggggattgttcaacaagctttatgtcttcatgcttttgtatctaaaagtggatttgacaataatgaatttattggagcgtcactcatagagttgtatgcaaaatgtagtagcatagataatgctaacaaggttttcaaaggaatgagacgtaaagatgttgttacctggagctcaataattgcagcttacggattccatgggcaaggagaagaggctttgaaattattttatcagatgtctaatcattcagatgttaagcctaacgatgtaacctttgtctcaattctatctgcctgtagtcatgcaggtttgattgaagaagggataaagatgtttcatgtcatggtgaatgaataccaattgatgcccaatacagagcattacgggataatggttgatcttcttggtcgaatgggagagttggataaggccttggacatgattaatgagatgcccatgcaagctgggcctcatgtatggggagccttacttggtgcttgtcgtatacatcaaaatattaagataggggagcttgcagctctgaatcttttcctgttagaccctaatcacgcagggtattatacacttttatcaaatatatattgtgtggacaagaattggcatgatgctgctaaactcaggacattgataaaggagaataggtttaagaagattgttggtcaaagcatggttgagataaagaacgaggttcacagtttcatagctagtgatagatttcatggtgaatctgatcagatttatggaatgctgagaaaattagatgcaagaatgaaagaagaaggttatgatcctcct

SEQ ID NO: 71263 - DNA, 388 bp, Glycine max
  Peptide Sequence Number=SeqID_188041
atggcttcgtctggcccagtactttcattttctggaactcccactatcacaacagcaaagctcaattggaaaaattacttatcctggtctgcttcagtagaactgtggttccttgggcaagggcatcatgaccatcttgaaaacgatgctgaggcagttccagatgatagaagacctgagtgggaaaatttagattatcatctctgtgttgtcttatggcagtcagttgaggtagatgttttggagattctcagatcgttcaaaacatgctgctccttttggaaaaaggcccgggaaatatttactaatgatattcagagtttgtttgatgcaaccatgaaggtcacagctctcaaacaaaccagccacgatatgattgcacacatag

SEQ ID NO: 71264 - DNA, 169 bp, Glycine max
  Peptide Sequence Number=SeqID_188042
gttacaaggcattttgaagaagtcaaaagtggagctgattatcccaattcgacacagcgaatggagtattcgccacagtgaatcatcaagtctgggacatggagccccagccaaattcgccacagtgaatgtatatatcatcaaggccaaaaagcgttcaaagacatga

SEQ ID NO: 71265 - DNA, 186 bp, Glycine max
  Peptide Sequence Number=SeqID_188043
atggcacgcagcgacgaatgtggtcatttgctccctttgtcgaagactcaatgtctatcagctgaggctactaaagtctcccctattatcccgaaacaagcgagtccgatagcatgcggagaccgtcaagctcgaacaaaattagtctcttatctttacttcccttttatctccaataaaggataa

SEQ ID NO: 71266 - DNA, 276 bp, Glycine max
  Peptide Sequence Number=SeqID_188044
actagctttttggattttctaacatttccaagaataaatgttggtggcgactccgcgcattttccttccttcgaagacacacccatgagtctcgcgtcgccctcccgccaaagggtaggttgcgacatctactatgcgagcaaggtcttaaatgatgctcaagtgaactatgccaccacagaaaaggagatgcttgcaattgtctacaccctagaaaaattcatatcatacttggtgggatccaaggtgttggacaagtggcctcagatatcttaa

SEQ ID NO: 71267 - DNA, 306 bp, Glycine max
  Peptide Sequence Number=SeqID_188045
atggagaaccctaaagaaaataacaaggtagagaaccatcatacggtgaatgcagttttgagtcttgcttttgtcttttctgctacaaaactagtaaacgaattcgaagatgcagaagttgaaattgacaagaacaaaggtgaagtgattagggagagggaactccaagtgatagagcaacaagaggaattgcaagcacggttggttaatttgaatattggtccacaggagcctgtgtccaattatccaacctcaaattattatgcaaactcatatccagtagtaccctcatgtgttgttaattag

SEQ ID NO: 71268 - DNA, 1143 bp, Glycine max
  Peptide Sequence Number=SeqID_188046
ggtgttctcctttacgggcctcctggtactggtaaaacattgttagccagggctattgccagtaatatagatgctaacttcctaaaggttgtttccagtgccataattgacaagtacattggagaaagtactaggttaattagagagatgtttggttatgcacgtgatcaccagtcgtgcatcatttttatggatgagatcgatgccattgtaggttgccgtttcagtgagggaacaagtgcagatcgtgagattcagagaatgctaatggagctacttaatcaacttgatggatttgatcaacttggaaagttgtgccgtagagaaattcactctattgattatcctttggcaagtatttataccttatggagtttaggtttgagagtagggtggagttgggagaaaggggttgagaggtggagggaggatgctaaagccattgtgatgatatgtggaggagaagaacaacaactatttttcaatgattacaataatgtctacaaggcaaccatttttcctcacaatgttgggctaggaattactaggcaatgctttgaaactattctcatcatatgggttcacacctgctccttgtatcttccagatggcaatgtctattattccatctttttcggagaacaatgtagcaagtacagtcatgcctctagaagcatcgctatattcatgaggctagaagcaccaaaagaccttaactcttcctttgtttcacctgtgatactgcaacccttcactagtgtgcccatgaatgaaaatgcgacacatgcacctgacaacattactattcctagatttatgaatagtgattactctgaagctcactctgtgacatctgaaatgtcccaccttgcctacacagacccactactaggtgaaatgtccatcatagaaaacatgaatgaagatgctttcatagatccattaccaatagaaatggagagaattgaaaaggagaaagaagaagccttcaagatacatgagcaaaagatattgcagctccaatctgactatgaaaaggaggttgaaaagaataaggtattagctcaagtttggacccataatcttgatagttgtgaaggaaatggtgtacagtgcacagaacaaggtacagatcatgcataa

SEQ ID NO: 71269 - DNA, 396 bp, Glycine max
  Peptide Sequence Number=SeqID_188047
atgtcaggcagtggcaggtttctaatgtggctggctaaaagaactcctaaagagagaaactttttgggattggaaatacgggaaaggatagtcaagcgtgctgagtcatgggcaaaggatctggctcttgataacatgtactatcctaaatctacatatatagatggtggaacttttcttgtttgcaaacgcgacaatttctttcaagcagttggtagaatcatatcccgggcccttggtcttagtttcagtattggatgtcatctacatttttatagtactaagctggtaggccccattgagcaacctaaggctgttcaacaggagggggagtgctttcaggggcaattgagacccctatggagcactgcaaggcaagaagggcttgttgactaa

SEQ ID NO: 71270 - DNA, 1014 bp, Glycine max
  Peptide Sequence Number=SeqID_188048
gactacacgtcctccccttcagaggactacacgtcctcgccttcagagggctgcacgccctcgcccgtcctctccttcagaggactacatgtcctcaccttgagaggactacacgtcctcgccttcagagggttgcacgccctcgccttcagaggactacacgtcctcacctttaaagaactacacgtcctcaccttcagaggactacacgtcctcgccttaagaggactacacgtcctcgtcttcagagggctacatgccctcgccttcagaggattacacgtccttgccttcaaagggctacacgttctcgccttcagaggggcaacacgtcctcgccttcagaggactacatgtgctcgccttcaaagggctacacgtcctctccttcaaagggctacacgccctcgccttcaaagggcaacacgtcctcgccttctaaggactacacgttctcaccttcagaggactacaaatcctcaccttgaaaggactgcacatcctcgccttcagattgctacatgtcctcgccttcagagaggactacatgtcctccccttcagaggactacacatcctcgccttcagagggctgcacgccctcgcccgtcctcaccttcagagggctacatgccctcactttcaaaggactacatgtcctcaccttgagaaggttgcatgccctcgccttcaaaggactaagttcctcaccttcatagggctgcacgccctcgccttcagaggattacaggtcctcgcctttagaggactacacgtcctcgccttcaaaggactgcacatcctcaccttcagaggactacacgtcctcaccttcagagggctacacgctctcaccttcagaggactatacgtcctcgcctttagagggttgcacgctgtcaccttaagaggactacatgtcctcaccttcagagggctacacgctctcaccttcagaggactatatgtccttgccttcagagggttgcacgctgtcaccttcagaggactacac

SEQ ID NO: 71271 - DNA, 183 bp, Glycine max
  Peptide Sequence Number=SeqID_188049
atgaagagatgcatgatgcaatcaaggaacatgccagagtggggattatcagcgacaatgcatcacaaaaagaggaaaactctagatgaggcttcattgtcatcaagcaagtcggagacccagcatgaccacaaatcgacctccactccttatggctcacatagacccgggtatagggcataa

SEQ ID NO: 71272 - DNA, 189 bp, Glycine max
  Peptide Sequence Number=SeqID_188050
atggctcttcttccttgggagattccactattccttcttctgagggcaaggatggaaattctcatcctgggtcaaggtttatggtggtttgaggttttggctcaaaaggcttgtagaacggctggacatgatatatgtcagggtgttggtttggccagcgcttgtaacatggacacggttgatgcctga

SEQ ID NO: 71273 - DNA, 213 bp, Glycine max
  Peptide Sequence Number=SeqID_188051
atgactcatcaggattttcaagtgcaagccattggtcagtttgctcaagcgacctgtgctcctgagtttggacttccaagaccgttcaatcagagattactcgtcttgcacattggtggggttgccgtaaaacaacgagtaaaaaagtttgtcttcttagagaagcgagttgtcaagaataggatgttggacaaatggcctcagttatcttaa

SEQ ID NO: 71274 - DNA, 816 bp, Glycine max
  Peptide Sequence Number=SeqID_188052
atggcttccagaaagagaaagagtatttgttcaagacccacagtgcaatatgaaacaaggagattctcttccttagatgcttggaccagatgcacatatattgttctggggagaaacattttaccagagaggaaagtagagatatatcattttgagctagatgagtttaaggctgaattggagaggcgtaatttcaataaacgcctcaccaatttagtcgatgggagcatagacctagctttggatcatccaccaaagcagtccagagtcagaggtcatttggtgaagattgatgctgatagtctcaacacattcttggagacacctgtggtattagctaagggggagaccttactcgcttactctagatattgtaggttgcctacagactacagagagatagaggctgccttatgcatacctaaccaagggttcatcttgaactcacagggccatcctgggaagattctcaagaaggatctgactacactagttcagccagatgacctttatagccagtctaacacttctagacataggttccctactctaatcactatattatgtagagctagaggagttgtctctgatagcctcacttttgagtgcctgagcctggtcattaacttggcctacatcaggaagaactgttggaaccccgaggatctaacagtttctattcgaggggctaggagggcgagggcaaggccagctgagcttccttctacttctgcagctcctactccagcatccacttcagcagcaccttctgtcccagctcaaacagattctcagtgctttgaagctatgctttag

SEQ ID NO: 71275 - DNA, 870 bp, Glycine max
  Peptide Sequence Number=SeqID_188053
atggcgcacgccgcgaatcgccacgctgtaagcgaagatgttttccggcagcgccagccccagatagccggtatcgccgatatggtgcagatccgcgccggccattttgctcatcagcgcaatctgccgcacggtctgcacgtcggcaccctcttgcgaggtgccgatcgccgtcattgccagcgcgccctgccgctgggcataagcaatcagcgccgccactttctcctgcgacatgccgggaatggtgccgggcgccggcaacagcacgatgtccgcgccgttctccacgaacagcgcgatgtcctgctcgccgatcagctggctgccgctttcgcgcacgataccggccccgtgcatcttgccggtcaccagcaccatctcgtcgcccacctcatcacggatcgctttcagcgcggcggcgatcgcctgattgctgacgccgttgttcgggttgccggtcagcaccagcatgcgcgcgccgagttgatacagcttgcgcgcattctcggcagtggcggcacgccccgccgtcatctgccagaaatcgttatgttcggtggtgaaggccggatcgacggcctccaggttcaccccgatcacccgcccggtcaggcgctgcagcgtgcgcagcgcctcctgcggcggcacgtcggcgggcaggcccgcgatgtgcggatggtcgacgtcgaacaggttcagcagcagcaggtcggcgccctggctggccgccagctcggcgttggtgacgttattgagcagcggctgagtgaccgcgatggtttcgctgaccaagatgcgcccttcgctggcgcggatggcgtagagcagatcggctttgccgatatcggccagatcgctggcgctgca

SEQ ID NO: 71276 - DNA, 501 bp, Glycine max
  Peptide Sequence Number=SeqID_188054
atgactcattccttaaatgttggtgaacctatacatgcaacaccaatatccttttgcattcctactaactatgacattgatcgtgacgatggtgttgagaaccccaaaaatgagaatgaaaccccacctacgacgacacaaaattcaaagtcaaaaagaggaagacctttcaaatcaccacctgaatcgattaaaaattggtatgttatacgcaaagaacgaaagatcggtaaaaggttcgatacgacttatattcataaggagacacgctttcggtgtcggtctttgaaggaggttaagaattacgagaaatatggaagtcttcctcgacgtcacaaagttaaaacacaagacaaagaagaaagcgataacaaaaccaaaaatgaaacagaagaaatgattgttgctcagagaaaagcaaaagcagaagttatgagaacctttgttgaagagtttctttcagaagctcatcacaatcaacttcacatgttcaacccataa

SEQ ID NO: 71277 - DNA, 315 bp, Glycine max
  Peptide Sequence Number=SeqID_188055
atggactccaagattgttgggcaggactctaaagtcaacgcaatttcctccaaaatgtggaaagatattatacttaaaagacaaacaaatgaattatgtgagaaggataagaaaatcaccatgagccatgcatgtgcgattgtggaagcaaagccttccaagtttattttgatgataccaaagactcaagtcaagaatcaagagtcaaacaagtttcaagaatcaaagagtcattcaatcaagaatcaagattcaagtgaaaattcaagagaagactcaagatatgcaagaacttcaagaaaagcatcaagataa

SEQ ID NO: 71278 - DNA, 330 bp, Glycine max
  Peptide Sequence Number=SeqID_188056
atgcacccatgcgcaatcaaggcacctttgttacctagatttatttatgtgtacttccaaggtgtatttactacttacatcacatgcacttccttggctaaacttacatacatgcatactcaaagcatcttggctaccaaaaattgcacacgtgcacattctgaaaatatgtgcaaacgaaaaatgccccatgggttgtttccctacgaaaaccacgcgctaatgccattgaggcatttcaccgaacacttggtgggcgcgcgtttaggcatcaatagcaagagaacggggacaatgtggcatgtcccattgcttcaaaatgcattatag

SEQ ID NO: 71279 - DNA, 240 bp, Glycine max
  Peptide Sequence Number=SeqID_188057
atgacgaaagacatgaatagatacctcaaagccctacactgggcaatgagaggcaccgtgcatgagcctcaagcaaacctaggagcagatcagaagttctcatgcggttccctaagcgcaccgcttcatctctctaagtgcaccgctttagttcatccgctaagcaagaaaggtgcgctaagccaaaaatcactaacgtgcactaagcggtccatacgtgtgctaagtgcacgagcatga

SEQ ID NO: 71280 - DNA, 498 bp, Glycine max
  Peptide Sequence Number=SeqID_188058
atggtccggacccgcaccagcaaccttcaggatctggatcgtgcgaccggagaaataggccgcgcggcgcagcatgtcgaggaactggtcctcggctaccaggccggtgcacgagaaggtggcgaacaggccgcccggcttgaccacgcccagcgccagcttgttcatgtccaggtacttcttcagcgcggtgatgacctggtcgcggtcgcgggtcatcttcgccgggtccaggatcaccacgtcgtactgctcgccgcggttggcggcatcgtgcagccaggggaagatgtcggactggacgaacttcgggcgcacgttgttcaggcgcgaattgcccttggcgatctggatgacgtcttcatcgatgtcgatgccgaccacttccgaagcaccacgcgccgccgcgtacacggcaaaaccgccggtgttgcagcacaggtcgagcacgctattgccttccaccaaccggctcagccactcacggttctcgcgctg

SEQ ID NO: 71281 - DNA, 561 bp, Glycine max
  Peptide Sequence Number=SeqID_188059
atggaagcgatgctggcttccggcatcgattacaccatcttcttctacaacccgaacatccatccgctgaaagagtacgagctgcgcaaagaggagaacatccgctttgccgagcagtttggcgtgcctttcgttgatgccgattacgacaaagacaactggttcgagcgcgcgcgtggcatggagtgggagccggagcgcggcgtgcgctgcactatgtgtttcgacatgcgcttcgagcgcaccgcgctgtacgcgcatgaacacggcttcccggtgatcaccagttcacttggcatttcgcgctggaagaatatgcagcaaatcaacgactgcggcgtgcgcgcggcggcgcgctatccggatatgctgtactgggagtttaactggcgtaaaggtggcggttcgtcgcgcatgattgagatcagcaagcgcgagcgcttctatcagcaggagtattgcggctgcatctattcgctgcgcgatactaaccgtcaccgcgtagcaagcggtcgcgaacgcattgaaatcggcgtgcagtactattcgccggatgagtaa

SEQ ID NO: 71282 - DNA, 189 bp, Glycine max
  Peptide Sequence Number=SeqID_188060
atggcagctcgcccaagcgagctgagacttactcctgaagtaactggctcgcccaggctagctggttccttcaccttgaagcaactggcaaaaaccaaggaagtgaaaccgaaaaaacatgaggacattgaagttttattaaacataaaacagaggacattgaagtcctgtagagcggaagacatttga

SEQ ID NO: 71283 - DNA, 909 bp, Glycine max
  Peptide Sequence Number=SeqID_188061
atgaggggaggaggttgcatagtagcttgcccaggtaagctacttgcttcctccaaaagtaacctagctcgcccaggagaactgctcaattcggctggcgagagtccaaatgttggcaaacgatcatccctaaacgaaattagggtgcttttggttcgaaagaaaggcaacacatggcctttttgtgtcaattatcatgccttgaacgctattatggtgaaggacatgttttcgatacccactgttgttgagttgagggacgagttacatggtgccattgttttctccaaattggatttaaggattctagagggttttgaattgttgatggtggtggtttcatcccgagatgagcacaaaggatttacctttatagatggtgtctcgtatttccaacagtgcttatttgttccactagagtctgcgctttgctttcaattgcttcaagattgccatgccacccttgcaggaggacactcaagtgttaaaggcatgcttatatgtttggcagcttccttttcatggccacacatgtgtcgggatgtcaaggagtatgtgcaaacctattgtttgacaaagtatactcacttcaaaacattaccagccaagttctccgttgcttccgttgcacctatgttcttaagtgacatctacaagcttcatgacatgcctaagttgattgtcaatgattgtgatcactggggtgaccaatcatatcctacaaagttaaaagctttctacgaaactccttcaactactccacctccattaacgacccacgtcactgaaactattatgcctttggtgccttctgccatcctagagagccacatgcttcgtcttggccgtggctacattgatcaagtgttgattcaatgggaagggctttcacctacgacagctacttga

SEQ ID NO: 71284 - DNA, 684 bp, Glycine max
  Peptide Sequence Number=SeqID_188062
atggctaggaatcaattagcgtttgtcgaaggtgcgtctattaacaaaaatccaatgttctatggtgtgaattatcctttctggaaggttcgcatgaagattttcatggagtctgttaataggggtatatggcaagctgttgttaatggctatacaattccaactcaagtagtcaataacgagacaatagagaaattgcatgaatcttggtccattgaagaaattagaagaagtgaatatgactctaaagcaatgaacattatatactcttcacttaattctgatgagttttttagggtgtccgcatgcactatcgctaaggaaatgcgagatttgatcaaagtcacacatgaaggtacactagaaataagaagagcttggaagaattcgctcatccaaaaatatgaaactttcaagatgaagcaagtgaaccatctcaagggtcttggcaagatttttgaagagataaatgtcaagatactcaagtctctaaacagaacatggcaacccaaagtcacatcaaattttgaatcaaaaagtcttgcttctatgacacatgctgagctatttggcaaattgagggaatacgaaatggacttgacaagaatgactaaagaagaagtgatagataaaaagaagaaaaggcttggccttgaagacaagcattccatcaagcgacgatag

SEQ ID NO: 71285 - DNA, 518 bp, Glycine max
  Peptide Sequence Number=SeqID_188063
atggagacacataagatgatgcaaggaacaaaagtttatgcaagtgctatcaaccgacatgttagattgatgggcttgtccactgggccactcatgttgggggttgatgccataaagatttcgtacaactctttcatcacatatggacccctccaaatactatttttttttcacagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 71286 - DNA, 176 bp, Glycine max
  Peptide Sequence Number=SeqID_188064
atggccctggggtttccaactctggttacgggcctctgtcagtcctatagggtgcccgtccccccagcaaggtcacgccatcgtgagataggtaaggatcgcacccgcaagacacccagtggacccaaagaagtccaacagggtcctagggtttccagctctgattacgggcctat

SEQ ID NO: 71287 - DNA, 436 bp, Glycine max
  Peptide Sequence Number=SeqID_188065
agggcaacacgccctcaccttaaaaggcctacacgccctcgccttccaagggctacacaccctcaccttcagaggactactcatccttgccttcaaaggactacacgtcctcaacttcagaggactacacgtccttaccttaagagtgctacacacccttacctttagaggactacacgtccctgccttcagagggatacacgtcctctccttcagaggattacacgtcctcacctttagaaggctacacgtcctcgccttcatagggctagatgccctcaccttcagagtactactcgtcctcgccatccgaggacaccacgccctcgctttcgtggggctacacgccctccccttcagaggactacacgccctcacctttagaggactacacgtccccgctttcagagggctacacgtcgtcaccttcagatga

SEQ ID NO: 71288 - DNA, 303 bp, Glycine max
  Peptide Sequence Number=SeqID_188066
atggaggccatgaaagagcaaatggctacaatgatggaggccataatgagcatgaagaagataatggaagccaatgcagctacagttgccgctacaagggctcctcaaccaaataaatcatccaaccttagctatggtaggcaaggatttgggaagtacgaatggccccatgatgtgcaaattcaaaacgagcacgccttcacgccatatggcttgccttccaactatacaccacccaatgtggtgtacactcccaatgagaatgtcaataactccgctccgatactcattgagagccaataa

SEQ ID NO: 71289 - DNA, 309 bp, Glycine max
  Peptide Sequence Number=SeqID_188067
atgatccacgattcgattcagagggcctcgactttgcttttttcttcttctctttctccctgcatttttccttctgttccttcaattgccaaccccttaacccttccccctgaatggggaagctcgcccaggcgggctggttgcctaaggatgaaggcattccatggcccaggcaagctagatgctggattgggcaagctcaggcctagaaacatccaaaaatggccattttgccctttttccttgtggtttttgttcccaaatttgacaatcaaacatcaacttgagcaatccctcgaccttgagtag

SEQ ID NO: 71290 - DNA, 249 bp, Glycine max
  Peptide Sequence Number=SeqID_188068
atgtttgcttttgtggaacgcaagcataaggaaactagtagtttccatttgcctgttagagaggtgactatcaccttgggtgatgtcgcgtcgttgttacatctgcctatcgtaggggcgttccacagcttcgagcaacttcatgtcgacgatgcggtcgatatgttggtggaattacttgaggtcagcgctgcaaaggcgagagctgagacaattcagtgtcatggctcttatgttcgactatcgtga

SEQ ID NO: 71291 - DNA, 301 bp, Glycine max
  Peptide Sequence Number=SeqID_188069
acacttgctagcattgcgacacctcttgggcttgaggttattcctcaagtaaagaagttgctggatgagggtttggttcataagagcttaaatccttatgctttgctggtgcccaaaataggggttcccatggaccctaagagaataaaggtcattcctgattggcccactccaccaagtgtagagggaaggagcccagagtatgaagaaccttgggatttgaggtcaaatcctttccatggtggaggggatgatgccatcctaccccccaaggggtggatttctgatcccatgggtcaag

SEQ ID NO: 71292 - DNA, 1644 bp, Glycine max
  Peptide Sequence Number=SeqID_188070
atggaacctgactcctttattctacaggacctcaagactttgaggaggattggcactgctaagcaaaagcaaggattactggaattttggaactttatgttatgcatatctactcttttgtccacacgacacaagttcaatccaagagctactacaacagttttcataggttatcctcatggatataaaggctacaagttgttggacttgaccactctcaaaactttcatctcacgggacgtgaagttctatgaacacatttttcctttccaagacaaagactctacaacaagatccacttatcctctcagccctcacatcactccaaatttgattactctaggcatttgtgatgatcctgaccctatacacacacaataccttccaggcaaccaaccaggcatacaaaacaaccctcagcctaacccattttcagaatatcagctcagaagatcaactagacagtgtggcaaacccagataccttactgattaccattgttacaacagatacaagcaagccatcaagtttcctcagtggaaacaagttattcaagatgaacttacagccatggacctcaacaacacttggacaatcactcacctaccacccaacaagaaacctatcacttgcaaatggttattcaaactgaaattgaactctaatggaactgtggcaaaacacaaggcaagacttctagcgcgtggtttcacacaacaatatggcctagatttccaagagaccttttcccatgtggctaagattactactctcagactcattttgtctcttgctgcttctcagcattggcacctagctcagctagatatgaacaatgcattccttaatgacagcttggatgaagaaatctacatgcatatacctcaaggctacaaccatgaacctccttctagatcatctgcacctcttgtttacaagctgaataagtccatttatggcctaaagcaagcttcaagaagctggttcaataagtttcgcaccacattgacctctcaagactacatacagtcaaagtatgattacaccttgttcaccaaaggaacaggttcatcatccatagccattttggtctatgttgatgatattgtcattgccagccttgataaaacagctattcattctacaaaaatcatgcttcagcaatacttcaaattaaaagatttgggtgatctaaaattcttccttggcctaaaactctcaagatctcaagtagggatattcattatacctatggaggctgatctcaaattgaatgcagaatcaggatcacaacttccagatccagaaacttatagaagactcataggaagacttctatacctaaccatctcaaggccagatatttgttacactgttcacaaactaagccagtttgtatctgatcctcgctcaggacacatgaatgcaacaaacattatgctaagatacttcaagcacatagctggacaagaggtcctttttaaagccaagtcagacacatccctccatgcctatgtagatgcaaattggggttcatgtattgacagccggaaatcaacaactggatattgtattttcttaggaaattcattgatttcttgtaaggcaaagaaacaaaagacaataagtaaatcttctacataa

SEQ ID NO: 71293 - DNA, 513 bp, Glycine max
  Peptide Sequence Number=SeqID_188071
atggagacacaactatcaatagcttactacattatatttcttctccacaatatatttgtcacactaacacgatctacgtaccaatatcagttttaccagcaagagtcatccaaattgagaagacaaattcgagatattcagaatctaaacaggcacatccttggtgaagcacttggttctctgagtctcaaggaactaaagaacctcgagggtagattggagaaaggattaagcagagttagatctagaaagcatgaaacattgtttgctgatgtggagttcatgcaaaagcgggaaattgagctgcaaaaccacaacaattatctgcgagctaagatagctgaacatgagagagctcaacaacagcaatcaaatatgaatatgtcaggaacactgtgcgagtcccttccttcacaatcatacgacaggaattttttccctgtaaatctcatagcttctgatgatcaacaacaatactctcgtcaagaccacactgctctccaacttgtgtaa

SEQ ID NO: 71294 - DNA, 425 bp, Glycine max
  Peptide Sequence Number=SeqID_188072
atggctacatcaaccaccgatccaagtcaagatccaaccaatcctcttcaccttcatcattcaaatgggcctgaccttgttctcacatctcaaccccttgatcacaagaattgcaccacctggagcagagcaatgaaggtagcgctctctatcaagaacaaaacgacgttcatcgacggcaccttcctgaagcctaaagaagaagctcctacctacgctgcttggacgcatgcaaacaacgttgtcatctcttggctctacaattctatctctaaggatatcatcaccagcatcttgtttgcaaacaccgcgaaagaaatttgggatgacttgaaaactaggttttcaagggaaaatggccctcgaatcttccaattgaagtgccaactaatgtcgttgcaacaaggcactgacgatatcagcac

SEQ ID NO: 71295 - DNA, 291 bp, Glycine max
  Peptide Sequence Number=SeqID_188073
atggaggatccaaatcaagctccagaagcgtcttctcagaagaaaatgggaagagggaagattgaaatcaaacggatcgagaacaccaccaataggcaagtcaccttctgcaagcgccgcaacggtttgctgaaaaaagcttatgaattatcagttctgtgtgatgctgaagttgcccttgttgtcttctcaacccgtggccgtttgtatgagtatgccaacaacaggttgcaaatctgtgtggtgagagatagaaataggtgtcaaggtgatactaggagtagcacttga

SEQ ID NO: 71296 - DNA, 594 bp, Glycine max
  Peptide Sequence Number=SeqID_188074
atgacacaggaaaacattgatatagaatactcattgaatgacccaacaatagatgattttgatgattatgatgaacagacctttctatctgcctcatctacataccaaaatacaggtggtacttacattgatatcggagatcctgtatgggaatgcccacattgtaaggctatgatgtggtatgatgagaggataaataaagacaaacaaacaaacaaaccaaggttttcattatgttgttctgatggaaaaatacaattacctctgttgcatgaaccaccccatccattaaatcacttacttttcaataaccaagatcctaaagctaagaatttccagcaatacatacgaatatataatctaatgtttgcctttacatctcccgatatcaaatttgacaaatcctataccactggaaaaggacctccaactttccgtatacatggacaaacacatcatcttattggaagcctcctccctatgcctaataacccacctaagtttgcacaactatatatttatgatacagataatgaggtcatcaacagactttcgcaaaacccgttagtattcatacttatgtcacacatgtaa

SEQ ID NO: 71297 - DNA, 166 bp, Glycine max
  Peptide Sequence Number=SeqID_188075
gcaactgagacatgagatcgtctatcccgatgttgatatgctatttttcaaaggaggtcgtcatggcaacattttgtctattagtggttcatttgccatgacaaaagatataaggatttggttaggcatgttctgtattggttgggcaatagaaattgccaagtaa

SEQ ID NO: 71298 - DNA, 989 bp, Glycine max
  Peptide Sequence Number=SeqID_188076
cacttcgccctgcccggcggctgccatttccgtacctggtgggatgaaaacggcggttcgctgtttatccctgagaacccgcagcagcattgctcaaccgagggctggctggaagtgtccggcggcgatgacgctgctgagtgacggcaaaacgcgcagccagacggtaaccttcctgcagggttatcccatcgccgatcttacgctgacccgcacgccgctggaggtggtagcggtgaacaaacagcgcatgattgtcacgcggcccgatgccagtgatagctggctggtgctgccgtttgatgctcagcagcacgtctggcgtttcagcggcacgctgctgattaaaatggataaaaacaccggcacggatagcgaagcggtgaaatcgcgggttgatagcttacgcggcatctggtcgccgcagtttatgccacagcaaaaagtgactgtgttactgattgacaccctgcacgccgatctggccgatccggcaattggtgcctggcagctcactatgtcggcaaacgaaaatcatacccccaatgccctgcctgcgggctaccggtttaacgagtttgaaatcaaggaagtgatcgggggcggcggctttggcattgtctatcgcgcctgggatcatcagctggaacgcaccatcgccatcaaagagtacatgccggtgtcgctggcggtacgcggtgcggatctggcgctggaactgcgcggcgagcgcttccagaaactgtttaatgccggacgcaacagctttattcaggaggcacggctgctggcgcgtttcaatcatcccggtctgctgcacgtcctgcgcttctgggaagagaacggcacggcttacatgggcacgctctattacagcggcatgacgctgaaagagtggcagctcaccagcccggacagcattgacgaagcgtggattcgccgtctgttaccgccgctgtttggtgccatcaacaccattcacaccgccg

SEQ ID NO: 71299 - DNA, 612 bp, Glycine max
  Peptide Sequence Number=SeqID_188077
atgattggaaggaataaaaagacatatttcagcttcatcaaagacagaatgtggaaaaggatcaaccactggagtagtaaacatctctcaagggtgggggcggtgataagggaaggtcatgaatggagaattgagaacggtgagaaaatcaatgtttggggtcagccatggcttcaatcaaaaggtaacacttttgtctcctctacagttccacacggtctagaattaatgaaagttagctctcttattgaccatgcatctctctcctggagattggatattatgagccaaattctgaacacaaatgatatcaaccacattcagaatattccacttttaaatgttgatatggaagatgagaaaatttggaagttcattgctcatggcctttacactgtcaagtcatctcatggagaccctattctacgacaacaatttcaaagtagaagggctatggaatcaggttggagcttacgagtatcaccaaagattaaacatctaagttggcgtatccttcgtgactatctcccttcgcggcaaaatctgatccgaaaaggagttatctaccaacccaactgcactttctgcgagaatgggctagagaatgaatag

SEQ ID NO: 71300 - DNA, 516 bp, Glycine max
  Peptide Sequence Number=SeqID_188078
atggacggagtcattcgtggcgtcgccgcgattcttggaggtcgtcatcatcgtcttgaactcctcgaagttgacacaacgattcgtgacacggcattcatcgacgaaacagttgaggtcgaggctattgagcgcgaggtggagctccgcggtagagatgaggccatttttgtcgcggttgtagagatcgaaggcatcacggaactcgctggatccaccgtcgatggaggcatcggagcggcagaaggcgacgaactccatgaggttgatgaagtcgtcgcggtcagtgtcgaggtcttccatgacatggcggaggtcctctggagagacgtcggatccgagcgaccggagcacgctgtcgagctcgtcagcggagatcttgccgttaccgttggtgtcgaagcggttgaagattgtctcgagttcgttcatgtcttcgaaatacggaaagaacttgttttcaagaatttgaaattcactttcttgaagatagaatttaaaattctattcttttaa

SEQ ID NO: 71301 - DNA, 147 bp, Glycine max
  Peptide Sequence Number=SeqID_188079
atgagtaagactcctgggcagaaagaggaggtgtctattgggtggcaaactccattggaagggtgggttgctcttaacagtgatggatcctggagaaggcatgcagtatggtttagctacgtgtggtggcttcttacggaattctag

SEQ ID NO: 71302 - DNA, 294 bp, Glycine max
  Peptide Sequence Number=SeqID_188080
atggttcctgatgtcatcggacccgccttctctggattacaaaaggcgcagaagatgatgttagtctctgtgtgctatcatgctttgagtcttggagatagcaagagaaagtttgaaagtgcgggaccaaatggttcccgcatgtcatcgggcccgccgcctctggatgacaaaaggcgcagaagacgacatagcaaaagaaagtttgaaagtgcgagaccaaatggttccgcgcctaaaatgtcatcgggcccgccgcctctggatgacaaaaggcgcagaggacgacgttag

SEQ ID NO: 71303 - DNA, 755 bp, Glycine max
  Peptide Sequence Number=SeqID_188081
gttagattggctctccaagttgaaaattatcaacgaggagaacttcgaagctccggaagaggatgaagaagtccaagctctaaaatcagagttaggaaaggcaagactcgccaaagaaaaattcaagttagtcgctacagacatccggaaagagtgtgccggattacgagaggaaaatgcggctaccgaaggagcctttgaacgagaaaccaagagggatcgcaagatccaagaggagttagctgcttgctcaagatccaagaggagtttggcccaaaatttagaagcgacggagcgaagcatgctagcaataatagggcagtacaaagaagagttaaaccagtctttgtcccatgaacataaactagtagaggacttcacacaagcgtacgccgagaaggaagcaagagggagggtgattgatgcattgcatcaagaagcgaccattcctcaagcctacccttatggttcgcctccagacttcactccccgtaccactccagacgagttgagcgaagcccctaccttcgaggggcagctccctcctcatgccgactatcctctgcaagaagatgatgaaggagatgcccatttaggccctctacttcccctcaaggaaccagccccccatgagttgaccaaaccaaacatagtccaccacgacccgtctccatccgcacccgttaaggaactcgctgagagcgatagaaggcctcgacaactatccgttctcggatttagcggatctgtgtctg

SEQ ID NO: 71304 - DNA, 162 bp, Glycine max
  Peptide Sequence Number=SeqID_188082
atggcacatcaccagatttatcaaggtaatccttgtggcgtctaccctgacttatcttccctcaccggaagtggtgtcatccaaaactttgtaacctatatcaagcgatttgttcctagtaaggatcacatcaaaagtgctcaaggttcttactctatataa

SEQ ID NO: 71305 - DNA, 123 bp, Glycine max
  Peptide Sequence Number=SeqID_188083
atgacgacggtaattgaaagacgaccgaagacgttcgacgaaggggtggggcagcgcagaagataccaacgatggagatggttagtattgactgagggcatgcggttgggttcacatgactaa

SEQ ID NO: 71306 - DNA, 198 bp, Glycine max
  Peptide Sequence Number=SeqID_188084
gtggttataacaaacttctacaaggagagtggtggaggcccaactgcactaaggatattgggtcctcccaagcttcctaagtggattcctcaagagataatcccaaccattggaccagtaccaacttggaaggctcatcctgagtttgatgccactcaggcgaaacagctcctaccaaaaagagctaatgaaaacaag

SEQ ID NO: 71307 - DNA, 867 bp, Glycine max
  Peptide Sequence Number=SeqID_188085
atgcacgcctgcggtcacgatgtgcacagtgcggtgatactgggtgccacgctgcagctgaaagcacaggaagctcagctaccggggcgggtgcgcatcctgttccagccggcggaagagattgcccagggcgcgcgccagttcatcgacgcgggggtgctggatcaggtacaggcgatttttggcatgcacaacgaaccgggtttgcccacgggcacctttgccacgcgcagcggtgcgttttatgccaacgccgataaatttgtggtgcgcgtgcacagcacccgcacggacgtaaacagcatcctggtcgccagccagattattcaggcgctgcaatccctcaccagccgcagctttaatacgctggacagtctggtgctgagcgtcacgcggattgatgcacacaggcacgacggtcagcagacggctgaagcggaatttggcggcacggtgcgcacgcacgataaacaggtgcgcgcgcagctggagcagcgtgcacgcgaggtggtggtcaatatcgccgccgccagcggtgccacggccacctttagctggcatccggggccgccggtgctggagaacgacgcccactgggcacagtttgccagtcaggtggcgcagcaggtgggttatcaggtgcaacaggctgagctacaccttggcggcgaagatttcgcttattacctgcagcagctcccgggcgcgtttgtcagcattggcagcgccagtgaatttggcctgcatcacggtggcttcaaccccgatgaagcgctgatcgccccggcggcacactactttagtcagctggcgcaacaggcattgcagcagctaaacgcgcgatgtcgcgacgccatccttaactga

SEQ ID NO: 71308 - DNA, 1200 bp, Glycine max
  Peptide Sequence Number=SeqID_188086
atgactgcaagacaactgcgcctcggcaccattctgcacggcgcatccggcaacatgtccgcctggcgtcatccggcggcgcaggcggatgccagcatcagttttgattacgcccgccgtatcgcccgtaaagccgaggctggcaaactggatttcctgtttgtcgccgatggcctgttcatcaatgagaaatcgatcccgcactttcttaaccgcttcgaaccgctgacgctgctgtcggcgctggccggcgtcaccgagcatctcggtctggtcggtacggtgtccacctcctacagtgagccgttcaccgtcgcccgccagttcgccagtctcgatcatctcagcggcgggcgcgcgggctggaatgtggtgacatcgccgctggagggctcggcaaaaaacttttcgcgtcagcagcatcccgagcatgcgctgcgctaccgcatcgccgacgagtacctgcaggtggtgaaagggttgtgggattcctgggaagagggcgcgtttgtgcgcaataaagccagcggtcagttctatgcgcctgacaaactgcacacgctgaatcatcacggtgattttttccaggtacaggggccgctgaacattgagcgcacgccgcagggccggccgattatctttcaggcgggcgcctcggaagatggccgcaagctggcggcgcgtcatgccgatgccatcttcacccatcagccaacgcgcgaagaggcgcaggcgttctaccgggatgtgaagcagcagctggtggcgaacgggcgtgaaccgggcgatctgcacattttccagggcgtcagtgtgatcgtgggggagaatgacgcagacgtcgagcgccagtaccagaccaccgcggcgctggtctcgattgaggatgcactcaactaccttggtcgcttctttgaccatcacgacttctcgcagtatccgctcgaccagccgttcccggacattggcgatattggccagaatagctttcgtagcaccaccgacgaaatcaaacgcaaagcgcgcgaacacggccatacgctgcgccaggcggcgctggaagccgcgacaccgcgtccgctgtttcacggcacgccacagcaggtggcggatggtctgcagctgtggttcgaaaccgaagccactgacggtttcattattcagggcggcacgccaggacaccttcgagcgttttgttga

SEQ ID NO: 71309 - DNA, 222 bp, Glycine max
  Peptide Sequence Number=SeqID_188087
atgctctcaggaacggaagcttcgcgcgtactccagacatcttcccatagatctcaacggtcagatattggtaaattgtcttgtgaagctgcaaaccaaattttgcgaagatccaacggtaaacgaaggctgggctgtgtttttaccaagacagctcatgtagcttcctcaagaagcttcattaagaggcttcctcaagaagcttcctcgtggcttctttga

SEQ ID NO: 71310 - DNA, 558 bp, Glycine max
  Peptide Sequence Number=SeqID_188088
atggctgttggtgtttgccatattggaaaaactcgttttgtaatcaagtatgtaggggatgagcaagaaaagaggagcttgcagatgaagggacttaatttgatggacaaaactttatttgttcaaggagctaggatttcgtttagtatatgggatgttgcaggtgacccaggttctatttgtcaaattccaatggcttgtaaagattcagttgcaattttgattatgtttgatctcaccagtcggtgtacactgaatagtgttgttggatggtacagtaaagcaagaaagtggaatcagactgcaattcccattctaataggaaccaaatttgatgattttgttaaactccccccagatgtgcaatggacaattgtaacacagtgcatccaggcaagggcttatgcaagggcaatgaaagctactcttttcttctcaagtgcaagccacaacataaatgtcaacaaaatcttcaagtttatcatggccaagctcttcaacttgccatggaaagtggaacgaaatctgacactaggagaacccacaattgacttttga

SEQ ID NO: 71311 - DNA, 387 bp, Glycine max
  Peptide Sequence Number=SeqID_188089
atggtggaaatggattcagcaattggaattggcaggcaagcaagggacaaggttgccaagtcagcatcaaggccattagaggtagtccttgagcaccttgtccctcaaggtgataagttgacttcaattgttcccaatctttccaagaagtttcttctagcaaaagaccttcccattggaccaacacctgaatggaatgatgaaacagttttagcaatgaacactagaacacagggtggatgcaggcaccttcaggagttgtgccttaaaaaacttctttcgtatcacagtaaagacctcctccctgtttttcagaaaatcatcaactgcttcaagattgaaggtcccagtgatgtattgcgggatagtaaagggtttcttgcctaa

SEQ ID NO: 71312 - DNA, 615 bp, Glycine max
  Peptide Sequence Number=SeqID_188090
atggcataccatgcaagttctaaagctaatcataatgcaatacaaaagcaagagattcaatgtgccaaagttttttttgaagattatcaagggaaaccagagtcacaattctactatcaaaataaagcagaaaggagtttcaatctggacattttgttaatacaattcaaggatacaattggatcttttcaacgggcatttaaaagtgcagaaattaaggttgaagaaaggcatgaagaccatgagggttcaatcattctaggacaaccctgtctgccatttgctagttgtgttttcgacatgggtaaagaaatatcagagcaggagatggaattaacaaccttagccatggtattacaaacgcctggggagaaagagtttgaatatgtgatagaatgtctagtcaatgaagatggaggaagaatggtagcttgtattgaaaagctgggggatccagatgatgaatctattggtcatgtgatgtttgaagaattggaaaacaatagaccaaaagaaaagcccaaagtagaattaaagacccttccagcgcatctaaagtatgtattcttggaggacaatgagaccaaacctgttataattagcagctccttgtag

SEQ ID NO: 71313 - DNA, 264 bp, Glycine max
  Peptide Sequence Number=SeqID_188091
atggtggaaaatagacttaggtggtttgagcatgtagagagaagaccgtacttcaactatatggggatgctcgcagtagaaggtacatatgataaaatggaggctcttctaagccaaaacatccaccccgtggacatccttctgctgttagctgcctcagaaggtgacaagccaaaaattgaagaactcttgagagctggagcaaaatatgatgtaaaagatgcagacggaaggacggcactggatagggctggacgaaattaa

SEQ ID NO: 71314 - DNA, 246 bp, Glycine max
  Peptide Sequence Number=SeqID_188092
atgtggctgccttttatgagaaagcttgtgacattttcaattctgcatatatccttcttgctctctccaaatgggtcgatgccaagcctgaaaaacctaattgagaatgaatatggggcacagagtaagttgcaaggagctgctggtcaaaactatgtgaattgggctgcaaaaatggctgtggaaatgggaactggggtctcttgggtgatgtgcaaggaagacgatgccccagatctagtgtga

SEQ ID NO: 71315 - DNA, 273 bp, Glycine max
  Peptide Sequence Number=SeqID_188093
atgtatataatctggaaagagtttgagagatctcagatcttacacctcattttgcacttcacatatctggaaacggattcaaaaccctcagatctcagatcccatttttcacttctcagagaacagagttgtgcgagaaaacggggaccagagcgaaaggtagtgggaggtggaacaatggtggttagaggagaggctttgaggggtagggcttgtggcagtcacggtgaggctttgggtgtggcgacaggggtatcggagggaggagcttga

SEQ ID NO: 71316 - DNA, 599 bp, Glycine max
  Peptide Sequence Number=SeqID_188094
gggtagagggtgtcacagactccatgttacaaaaggggcttattcaacccagcactagtcctttttcctcatcagttttgttggtcaaaaagaatgatggtgcatggcgattttgtgttgactatagggcgttgaatgccttgacgatgcgtgaaagattcccaatccctacgattgacgagctcctcgatgagctaggcggtgcgcgattcttctccaagcttgacttgctgcaagagtatcaccagattcgtatgcattttgaggatattcctaaaacggctttcagaacccaccatggccactatgaattcaaagtgatgccattcgggttatgcaatgtgccttccttttttcaggcaactatgaacatgatatttcacccctaccttcgtcgtttcatcatcgtcttcttcgacgacatcctgatttacagcgcctccatggatgaacatttggatcatttggagcttacctttcaggtattactcgacaatcagtttgttctcaaactctctaaatgttcttttgggcagtcacaggtggaatatttgggtcatttggttttgcatcgtatatgttatgcaaccttggtataa

SEQ ID NO: 71317 - DNA, 282 bp, Glycine max
  Peptide Sequence Number=SeqID_188095
atgggtgaacttaagaaattggtggaagaggataaagggaagtatattgggttatctgttcaaatggcgtggtccctatggactcgtgacattgaagatgatacagttcctctttgtagggagcttggaattggaatcgtaccatacagccctcttggccgaggcttttttggtggcaaaggaattgtggaaaattttattgcaaatagtttcctgatatttcttatagttgtaatattctctagaatactctttggatctctagagttgagaactctctag

SEQ ID NO: 71318 - DNA, 702 bp, Glycine max
  Peptide Sequence Number=SeqID_188096
atgggggagacacatgagataccccaccacaatctagccgacttcgagccttgcattggatgcgccacagaggggcaagcaattggtggtgtacctttgtcaaacactttggagggccctcgattttgcccacaaccacaacccttttattttgcggtaggaagagtccctcctgctatggctgaaaatggaaagttggatcagatagaggaaaggctaagggccgttgaaggaggtgaagattatgcctttgctgacatggaagatttgtgcctagtacccgacaaggctaaagggctacacgtcctcaccttcagaggactacacatcctcaccttcaaagggctgcacgccctcgccttcatagggctacacaccctcgcctttagagggctacacgtcctcatcatcaggggactacacatcctcgccatcagaggactacacatcctcgccttcagagggttgcacgacctcaccttcaaagggctacacgtcctcgccttcagaagactacgcgtccttaccttcaaagggctgcacgccctcgccttcataggtctacacctccttgccttaagagcgctacacgccctcgccttcataaggctacacaccttcgccttcagaggactacacatcctcgccttcagagggttgaacgcccttgccttcatcgagctacacgccctcaccttctga

SEQ ID NO: 71319 - DNA, 336 bp, Glycine max
  Peptide Sequence Number=SeqID_188097
atgaggagttcttcgagcctgtcagaagttgaagaactggcattatcaggcatgcttcttcttccttatcagatatggaaccttgccggtgagagagttcacgggaatcgtggtgggagccactgtcatgctcaacatacacatagcgagatgataacaaaagatgatgacaaaggtgatgacaaaaagctcaaaggtcaatcaaagaatgagttcaagatattcaagaaagaatcaagaacacttcaagattcaagaggaaagttgatttcaagaatcaagaatcaagattcaagagatcaagcagttatttctggcaatgatgctctctggtaa

SEQ ID NO: 71320 - DNA, 1188 bp, Glycine max
  Peptide Sequence Number=SeqID_188098
atgccgacacccactcctttttcatcctcagcccctcgatctttccccaaccctgcgctgcaaacaaggttcgcaccatcccagtacgaggacccaaccagagccctcttcaatttaactcagaagggatcagtggctacataccttgcggagtttgaggatttagccaactacatcgtgggccttcccctgccgttcctcctcagttgcttcatctctggcctcaccctggagattcaccatgaggtgcaagctcaccagccactcacacttacccaagctgccggccttgccaaactccaggaagagaagatcttcgactctcgtccaccgacaaccctagcccgccctcgtccacccctgccttccctcactttccttccaccacggcccaactctatttcccctctccttcctccctcccctcgaccaaccctcatgccttccacctctcctcagccagcaccaccaccaccctttaaacgcctggcctcggaggaaatcgcctctcgccgtgagcgagggctttgtttcagctatgatgagaaataccatagaggttaccgctgtgcctctagggtatttctattgctcgcggaggaagaggaccctcctgacctgcttattatagacaccttgaaccctaacccagacccggttcctgacccgcccgctactcacgacccatacccggcccatctaagtttgaactccctagctgatcatctggcccccgagacgctccgttttgtcgccactgttgtcggtcgcgatgtcgtgctcctgggcactgaatttcgcgttgacctttatgtcttgcccatttccggcgccaacatcatactaggtgttcaatggcttaagtcattagggcccatgttgactgattataatactttagccatgaaattcttctacgaaggaagattgatcaccttgcagggcaacttggatgtttctctgagctccctttccgagttccggcgactcggtcgaacacaccgtgatgccctttactatcacatcactctactcccagatactgactcctccactcaggagcttcctctggccatacgtacattgttgaccaaatttgcagccctgtttcacccacctgactcgttaccacctgctcgcgagactgatcatcatatacatctcctccctaatgcagcaccagtcaat

SEQ ID NO: 71321 - DNA, 294 bp, Glycine max
  Peptide Sequence Number=SeqID_188099
atgtcacagagagcatcatccataaaaaagcttggttcaagacaaatttgtcccaaatttgggggagacactagtgctaaaaggatcagtcgcactaagtggaccctatgggctcagcgcacatccaccgctaagtgcaacttcagcgcgcttagcatgacaagggaatctggaagagcacaagaatcaaggtcatgcgctaagcgcgagatcagctcgctaagaaagacgtttgtctcttgtcaggctcagcgcacggctggcgccaagcccaaatccacttactcgcgctaa

SEQ ID NO: 71322 - DNA, 1041 bp, Glycine max
  Peptide Sequence Number=SeqID_188100
atggtagggcagggaggcgaagcattaggaagtatgagtggctcccattttgtgcaggttcagaacaagcattccttccggccatatggcttgcctcccaactatacaccactcaatgttgcacacactactgatgagaatgttgacaactctgcacccatacccattgagagccaacaaccccaatctgatcatgcacatgtctctcaaaccatgggggagacacatgaagaaccccgagaccataatctagccaacttcaagcctcacctcatatatgccactgaagggcaggcgtgttgctgtgtacccctaccaaacactttagggggccctcagcatcacccacaaccacaacccttgcattttgcggtaggaagagtccctcctactatggtggaaagggagaaatttgatcatataaaggaaaggctaagggtcattgaaggaagcagaaattatgcctttgttgacatggcagagttgtgcttagtgcccggcgtggtcattcctccgaagttcaaggtgtcggatttcaataagtacaaggggactactttccccaagaatcacctgaagatgtactgcatgaaaatgggggcatacacaaaagatgaaaaattattgatgcatttagtccaagaaagtcttactggggcagctgtcacctggcaatatcaatataattctgatatggctctggatagaatacaactacaaaatatgtgtaagaaggagcatgaatcttccaaagagtacgcccaatggtggagggatttggcagctcaagtagtgcccccaatgatggagagggagatgataacaatgatagtagacacgttaccggtgttctactatgagaagatggtgggttacatgcctttaagctttgcaaatttagtgtttgcttgcaaaaggatcaaagtgggtctgagaagaggcaaatttgattatcctgctttgatgaataggaagcccggggaaaatggagagaataagaaggagggagaaacccatgttgtgactgcagttcctacatga

SEQ ID NO: 71323 - DNA, 351 bp, Glycine max
  Peptide Sequence Number=SeqID_188101
gttactaactatctagagatcaatagagaaaggaatggacattattcttacaagaaaggtcacatctccggggctcatctcaaccccgctgtcaccatctcttttgctgcattaaagtacatcccgtggaagaatgtgcctgtgtatattggtgcacaagttttggcatcagtgagtgctgcatttgctctgaaggcgctttttcatccgtacatgagcggtggagtgacggtcccttcagtgggatatgggcaagctttcgctatagagttcattgtcagctttatgcttatgttcgttgtcactgcagtggccacccgcacaagagttgtgagtattttattctactaa

SEQ ID NO: 71324 - DNA, 467 bp, Glycine max
  Peptide Sequence Number=SeqID_188102
cctccaacaaaacagagtctataagattcattcatcacataaccgcaaaaccttcgctcgcgttcacaacacaaaccctagaagccaacgtttttcaggagcgagtgcgagcagaggtagtggagtgcggatgtgtaattgaattgccagaattaaaaattttaagtgggaaagaaatactttattgtctaaacagcagaacattgatgtgttttattccaactctaggtgttcattcagttatttctttgattcttgctttcattttggaccgtgctgctcatcatcacaagaataatttggagacgtattttaatgaagttagatcattggtagcagttagattcaaggcgcttcgcatccagtggacacagtattatctaaaaaaaaccgatgttaacgataatactattaacgtcggtactttcaacatcggtttaaaaaccgatgttgaaagtcataaataa

SEQ ID NO: 71325 - DNA, 310 bp, Glycine max
  Peptide Sequence Number=SeqID_188103
atcgcgtcttttccggtttttccgacgttttcctcaaataaacgttggtggcgactccgcgcgtattcctttcgtggaacacgcatcccgcgagtcacgcgtcgccctcccgccgaaggttgaaaggaaagatattgagctggtagacgaggaagaagcacagattggtgctgatcgttctaggtctgtgtgtatcatgaggatgtgtgtagttgtcatgctagaccctgttagtgtgatggagaggagggaacgttttctgcagggtttgggcttagctgattctacaaaccaactatcttgtgcctaa

SEQ ID NO: 71326 - DNA, 291 bp, Glycine max
  Peptide Sequence Number=SeqID_188104
atggtagtggaagatgtgcaaggcatagagatcatgggagaagggaggggtttgcaacttcaaacgtcttctgcttctgttacttacgccaacaagggtttagggtatttcaacatttttctcctttttaaggagattgacattgtttgtggttggagaggtagcgatcgaggacaacaccgagcaatgcttcatggggttgttggtgatggagcaaggtggctgacaagggcaatagctgttggagaaatgcatcatgcatggagaacaaatccatacactaatggatga

SEQ ID NO: 71327 - DNA, 405 bp, Glycine max
  Peptide Sequence Number=SeqID_188105
atgtatttgaaagggtgggtggtggcgagggcgaagatgatggggttgaagatgaagtcggtgggtgatctgttaactttctgtcgagtctctgtccacctacaacgcgtgccacgacatgagctccctaaatattcgtgcgaccaaccaggcaacttgttcgatgagacagtgaacgagacttccattagaggtgagattagaggtgtctttgtagatgtttttgaagagctagagcaaaaaagacatctcagagtgaaaaatggcgtcgtcgagcttcgtgacattgagcgttgtgtggtctttgagggacgtttgagcatgggcgagaaagtggtcgagggaggctacaaacgaggtttcagcattaggaaggtggaaatgggtgggagaaggagaagaagg

SEQ ID NO: 71328 - DNA, 579 bp, Glycine max
  Peptide Sequence Number=SeqID_188106
atgaagaaaaagaataccgaaagtagacgagatgaagatgaaaacatacaaagcaagaatggacccctaagagtgtatagaatgaattcaaagcttcaaaatcaaaaactgactagttcaagatcgacgaacgatgaagaacgaacaaagaacggcaaagaatgccttatcctggatggagttttcaaagatacaattgcatctgagggtgagggctttttccatggtctccacgtagccttccaggtggaacctagaggtttgaacttggagaggttgatgggagatggaggtggacgcttgttgtttacaagaatggtggagttatttggtgttgaggagcaaggggggttgacatcacttttagaggcgagtagcccttgtcttcctccgtcttggaacttcaactatgaagaggagtttcatcctctatctcactcagatacctcatgtagaagcaagcttcatgatgatgaaccaagcaattttgatgatgccaaagactcaagtcaagaatcaagagtcaagcaagtttcaagaatcaaagagtcgttaagtcaagaatcaagattcaagtaa

SEQ ID NO: 71329 - DNA, 694 bp, Glycine max
  Peptide Sequence Number=SeqID_188107
taaatatgacacagctgcatctctaggcctgcttcagcccttacctattcttgagcatgtatggcagcacatcaccatggacttcattgaaggtcttcctttttcttttggtaaacaagtcatttttatagtagtagataggcttagtaaggcagttcatttcatggccttatcacatccttatactgctgcggatgtggcccaatgcttccttgataatgtctttaaattgcatgggtttcctgacaccattaccagtgatagggatcctgtttttgttagccacttttggaaggaatttatgtccttgcaagggattcaggtacagctttctacagcttatcacccactaactgatggtcaatcagaaatggtgaatagatgccttgaaacatatctcaggtgcatgtgtagtgactctccagcacagtggtccaagtgtttgcctcttgctgaatggtggtacaattccacttaccacagcactattaaagcaagcccttatgagattgtgtatggccaagctcctcttgttcatttaccttatctttcgggggaatctcaaattgctttggttgatagaagtttgcagaaacgcgaggaaatgttaaagttactcaaattccacatgaaaagagcccaggacaaaatgaagcaacttgcagatagaggcagatctgataggagtttttag

SEQ ID NO: 71330 - DNA, 384 bp, Glycine max
  Peptide Sequence Number=SeqID_188108
atgagatatgatggaatagcttcaggtggaaagacactcaacttcacacaaacacacaccatgatgcaatttacaacgctaatgataaatggatgctatttcctagacatcaattcctatgaaacgtttgatactgtgtacctcgatgacgaccttcgcgttgtaaaggatatcagaggagactatttagttgttaaccgagcttcctataactggaaagaatgtatggaatcttcatcgtcattctgtttgctgaatgtatgtatgccaaagaaggtgctgaattgtttgtactttacatcttactgttcgtggcacaggtggctgaaaacgcaaccagtctgtattttattctctagagtcaaaccaggaggagctcattaa

SEQ ID NO: 71331 - DNA, 747 bp, Glycine max
  Peptide Sequence Number=SeqID_188109
atggtggttaactctggattgtggctttctttcccactgacaaaacatagtagtggtgacttcttcccatcagcaatctatcaagatggcacccttcaaggttttgtacaggttgttcaagctgatgttctatgccaacagtttcctgttttctgtattgaggagctggaattacagggacaaggtggtgatataggcttaggaagaacttcgaatcccatagctgagttcctagttcttctacatcaattggtatcagagcctgttccttccttggtgatcaagcaatggcagagaacacacacaatcaagcttcccttcgtgaaatggaagaacgtctcaacagcagaatgtaatcaagatttgtcgagctcgctgcttccatgcaacaaacaatacacggaatgtttcaacagaggcaacaagattctccagccgcaagcaatccacctagaggtgagagatccagtccctattcttgtggcactcgattggctaggttggactttccaagattcaatggttgataatactcctgatgaattcaaggtacgtttagcagtagttcatttcaaaggaaaagcactgcagtggcatagtgcttacataaaatctgtaggattggagaatttgccttcttggaatgaatatcagatcttgttacttgatcgttttggagatgtttgtgaagatcccatggcggatttaatgaagctcaggcagacaggatccatcagagtatcatga

SEQ ID NO: 71332 - DNA, 1346 bp, Glycine max
  Peptide Sequence Number=SeqID_188110
atgaaaaaagagggccctggacctcaacaacttgatgctaatgtggttactgaacctgatttagaacctttaatttctgggaatgcattaactggagtagctaattttcgaaccatgagagtcactgaagccatggacattgtttctgtcactgtagcagatggaaataaagtccagatttcttcaaaggaaccatctagtcttcccccttgtcgagttggccatgatcacaagattccattaatgcaaggagctaaccctgtcaacaagaggccctgtaggaatctcaataaggcaactctcaagaacaaattccctataccattaatagaagaccttttggatgagttgcatgggtcaaccattttttccaaaattgacttaagagctgattacaatcaagttcgaatggatgcagctgatattcacaaaactgctttcagaactcatgcgggccacttagaatacttggtgatgccctttgggcttaccaatgctcctgccacatttcaagggctgatgaattcagtttttcagtattacttgagaagaactcactgcttgtatgctaagaaatccaaatgctactttgctattgacaaggtagaatatttgggccattttataactaaagaaggagtttccacggatccttcaaaaattgcagcagtacaagattgggccctaccacaaaacttgaagcagttaaggagtttcttgggtcttgcagcaaaagaagcatttcaggaattgaagcaaaggctagtagcatcaccagttttggccctaccagatttttctaaggaatttgtggtggaggtggatgcttctagcctaggcttaggtgctgtgttaatgcagaatcaccacccaattgccttcaccagtagaagtttgaacacacagcaacagtccttgtcaacatatgagaaggaattattgacagttgtgtttgcagtccaaaaatggaggcactacttactccccaagaagttcatcattagaactgatcatagaagtttgaagtacatcctagagcagagattgtccacagcattccagcaaaagtggttggtaaagttgatgaaatttgatttcaacatagagtataaagagggtcgagaaaatgtggcggcagatgctttatctagacttgattcccctgagatcatggccttacagctgaggaggaaaggcagattaggcattggctcagactcccaactaagacaggacattctctcttggattcatgcttcagcttgtggtggtcattcgggtagagatgctaccttgcaaaagatgaaaaatgtggtttattggagaggcatgtccaaggctgtcaa

SEQ ID NO: 71333 - DNA, 231 bp, Glycine max
  Peptide Sequence Number=SeqID_188111
atgaagattcatgctgacaagttggtagccagaggcatcattggacacgcccttacacacacaaaagagcatggctggtcagattccaacaagaggcatgtggtggcacatcagagatctagtggccgcaccatttcacaaacaagcaaatctggacatgctagagttgatagcaatggcgatgaggtgatagcttgtgcagacaatggtaaatcagacttccctagttga

SEQ ID NO: 71334 - DNA, 520 bp, Glycine max
  Peptide Sequence Number=SeqID_188112
atgtgtgctccaaatcaagcagttgcatatccacctagtcttcatatcagcaaagccactaatattttgatggtgcctaatcgatgttttcctagactacctctaaagtatgaaggaagaaagaaaggtttcgaaatgggtcatgaatcaagaaaaaagaaaagcatttgtgggagtacattgagcttaagaaaaccagttgttatgattattgaagcaccaaaagtcactgagtccacttcagctcctactattgagaaacccaaagaaaagaatgatgaggctcttgaaccaacctcaaatgaagccacatggaagaacataattgatgtcattgtccacactaccacctttgaacctactccaatcaactttgctcctccaaaagtagtgactaaaactgaggtcaaggagatgattggattggctatggataaatttcctaagaagaaaatggctgagaatgaagagttcagatgcaccatgcaacaagctatcgctactcagtttagtagccttg

SEQ ID NO: 71335 - DNA, 222 bp, Glycine max
  Peptide Sequence Number=SeqID_188113
atgtgggacacgttagccataacatatgaaggatcaaatcaggtccatgagtatgaactacaacaggacatagggatcaaaaaggagaaatatttggccttgaaagtacaaaagaccaaaaaatcctcagtgctcaacgaagccacttctagaataggactcaagaaagccctaaatgtagacaaatcctctgatgatgagtctggtgaagatgatcactag

SEQ ID NO: 71336 - DNA, 393 bp, Glycine max
  Peptide Sequence Number=SeqID_188114
atgattttactcaaatcagtcctcatattcaacccggggatggacttcttgtacagtagtgtttattctcaagaacagccatttgtgactaattttattctcaagattgaagatagcatagcatggtttaatgttccaatgctttctgataattatgtgtggctatatgtgaattttccaaaagaaaaacctggccctgaaggtgttcgaggtcgtaagtcagacaatacactaataaaagaaaaacttggttgggctccaactatgaggttgaaggatgggttgagaatcacatacttctggattaaggagcagatcgagaaggagaaggctcaaggtattgatatatttgttttgttaaggtggttttttaaggcacttcgtggtgcttaa

SEQ ID NO: 71337 - DNA, 198 bp, Glycine max
  Peptide Sequence Number=SeqID_188115
atggctgaaataggtacggctgtggcgtcaacaattatcgagtgtgtggtcgattcaaatgtagagttggagaagacgttgcagcatataaaagaacgtgaacgagctaaagaaacctctacaaatgcagagaagattgtgcaaccagttgaagagtggctgaatgatgtggagagggttcaaaaaaatgtcatataa

SEQ ID NO: 71338 - DNA, 438 bp, Glycine max
  Peptide Sequence Number=SeqID_188116
atggcacctacacctcgcacacatgttgagatattaggccctatacccgggtctattccctatcgctacaatgtattatctaagaacatgatatctctggagacctgtcgcaacctaccctacgatgggagtgcgggcgaaaagccaaaggagcgtcttccaaaaaggaaaatgtgcgggagttgccaccaacatttattcaaggaaaacgttagaaaaaccaaaaagaggtctgcaaatattgaaaagaagggtttcagagttgtttatgcatggggaagcctctggcttgtctgggcccccaaagagcttaggggtgaagtaaccagctcacctgggcgaccaaggttacttcaggttgaagcaacagctcgcctaggcgagctacagattaatcaagtcccctcatttcctataaataggtgtcaggagggctga

SEQ ID NO: 71339 - DNA, 321 bp, Glycine max
  Peptide Sequence Number=SeqID_188117
atggtatttgacaccagttgcaacacgaagccaagaatcactcagtgttttgatcaagaatacaaaaggataccaaggaagggggcaaaaggctcgcccaggctagcatctagctcgcctgggccaccaaatagcttcatggtgaagaaactagctcgcctggacgagctcactgcttcagggttccaaggttcagaagttgagggaattgagagaagagagaaggaagaggaaatgaggccggggcactaccgaatcgcgaccgcgatcattccctacgtcgctttcttattttgtgttcttcgtgcgaccgtcggttag

SEQ ID NO: 71340 - DNA, 138 bp, Glycine max
  Peptide Sequence Number=SeqID_188118
atgaagctgacctcgagtggcagccacaggcaactcagactggttgcagtcgtagctcaggcagaaggagaaaggagaaagtacgataaggttttagccagtgggaggatgaagagaattataagcaattgggcttga

SEQ ID NO: 71341 - DNA, 669 bp, Glycine max
  Peptide Sequence Number=SeqID_188119
atgtggcaaagacaacgattaacctgtactaaggtgattgattcactgcttaattggtatagagttgaagtgatggttaatcacaagggcgaacaaaccaaatttttgctctgggaccgtgaatgtgcagagttaattggtcaatcagcggatgaagtcaataggctcaaaatagaagatggcgatgttgatttaaatgcctttcctcaagcactagataggctattgggttgtttccttgcattcaaagtgaaggtgcaaccaaggttcatgaatgctgttgttcttaaatattcagatgaatcaaacttgatcaatgttgtgctggatatgcttcccggtagtgagccatgttgcaagatcgagagttcaatacttgagtcgaccgaccctatagagcttgaatctcaatctgtctctgttaccgctgatgatgaccattcaatgcttgactcgactgagcctatagagcttgaatctataagctgtcgttgtccttgtgtgtttttgctgcaatttgtgtctgttaccactgatcatgaccctcttctcaggattccattaacaccaactaagcatgtatcttctgatgagttggatgatgagcccaaaaactttgagatttcacctgcccaagtttcctcaaataaattagccaagcatttttag

SEQ ID NO: 71342 - DNA, 207 bp, Glycine max
  Peptide Sequence Number=SeqID_188120
atggaggagcttatttcaaaatatgagtgtagattaggtgttatgagggatgtagaagctccaagggagggttcagaagttgggaacaagaaagagaaagaagaggaagaagtaagaaaagcgaagccgatgcactaccgaatcgcgatcgtgatcattccctacatcgttctcttgttctgtgtccctcgtacaacagtcaattag

SEQ ID NO: 71343 - DNA, 549 bp, Glycine max
  Peptide Sequence Number=SeqID_188121
atggtggttgttgattctgatggagatgaaatccatgttgtttgcaaacaagatcagctaaagtctcggaaggctgatttgaaggaaaatttgacttatgtgatgcataattttaaagttatgaagaatgatgggaaattcaaaatttgtgatcatgaatataaattatgttttactggagttactgttgttaggcaatctgatatggaacacttaccttttaggaaattcagatttgttgatttttccagtgtcattgctggtcattttcaaactggactcttggttgatgctgatatactgatatatttattgttgtttccttctgatagtgggcagtttttgtcttatttgaatgaggttgaagatgaaaggcccatcgttattcttttgacacatgccaggatcaaggaagcccagggatcatatccgccatcagttagtaattctttcaaggcgtctaaactcatgatcaacgagcttgtgctggaaattcaagaattcagagagaggcttttagatttagggatcaaggttagatcagtttga

SEQ ID NO: 71344 - DNA, 630 bp, Glycine max
  Peptide Sequence Number=SeqID_188122
atgttacggtctctcaccataatcaaatcaaactcacaaaagattagtttgatgtatcctatcaaggatattcccatggttgaaaagggaatggaaggtaagaaaaagaagaacccttctaaaaacctgcggcaaaaagaagcaacaatgtcgccgagcttcgtctttgaccctcctagcgttgaagaaatcgaacacgaagaacacaaagaagaagaagaatcagtaggagaaccacagtcagaatcagagtcagaggaacacgctcgcaagagcacaacctcggtcgacgagaaaatctcaaaagcactcaaacaacgttccacgcctctcgttgctgagcttgaccacagcttcgagtccgaacctgatgaacaagaagaagatgaagaagagggtaatgatggtgacagcaaatccttttttgcttcttctaatggaacctctttccatgttgattccttcttgcagttcaatttgtctcgccctttgctccgggcttgtgaggccttcgggtattctaaaccaacaccaattcaggcagcttgtattccattggcattgagtggtcgtgatatatgtggtagtgccattaccgggtcagggaagaagtcagcagacatagactag

SEQ ID NO: 71345 - DNA, 326 bp, Glycine max
  Peptide Sequence Number=SeqID_188123
ctcgggcagcagtagaagacctgagaaggtttcttgtggctgattcgttggaagaggtgaataggaaactggacaagttctacatggtccttatcttgaggagtctacacttagattttgatcatgtacgtgatcaggtcctagttggagatcaagtcccatcgatggattctctcattactaggcttctccgtgtacctcatgcgttgaaggatgaaaatctcactgatgttgtggaaacatcagccatggtggcacctcgtgggagagggggaggccgtaacagtagaggatgccgcaatggaagaagtggacgtccgcaatga

SEQ ID NO: 71346 - DNA, 744 bp, Glycine max
  Peptide Sequence Number=SeqID_188124
atggtacagagtgaattggattcagagaatattgatttcacagtgattgatgatgttggtagtgaaagcctaggtcctggcattcgtagagaactttcattttcacgttggtgtgatgatgatggaaggattcatttagatcagcaattaggtaatgaagatgttagtgtagaagacgactctgattttgagttaccgtttcctgaaaagaatgagccgcagggcagatctttagatagagagagattctttcaccaaaagtttcagcataggagtatgcaaatgaatggtattggtaccatggatgatgattctgttcatcggagaggtaatggatctgaaaagtatgtgtcttttgacattgaggacaagtctgaaagaggaacgaacagtcttgattcctacatttctgtgggtggtgatgggtcattgggaaaaatctcccagaatcctattcatgcagcaaatatattgaagacattgattttgatacttatgtggtacacttccagtctatttttgaccctgtataataaaagtctattgggagatcatatgggaaagttcccagctccctttttaatgaatactatccactttacaatgcaagctgttttatcaaaatttatcacctggttttggtctcacaagtttgaggctaatgttgtcatttcatggagggattactttttgagagaatggcatcagttgtatttgcactctgctagttctgatttaaaataa

SEQ ID NO: 71347 - DNA, 972 bp, Glycine max
  Peptide Sequence Number=SeqID_188125
atgaagatcagcgcgcacagcaggatcagttgcacgatgtcgttaaggttcagcatgcggttcctcctgcgggccgagcgtcagcgtgaaggcgaccggctgccgccgttctgcggacgcctcggccgccgtctcgcgggggcgcggcgcggcgccggcggtgccggtggccgaaatctgccagcgcccctgggccatacgtttgatttccgaaatgatatcgacgtcctgatgccacaccacccggttgctgaaggcttcatccaccggcaggcggaagatgaacctcagcgcggtatccagatcgttgatgcggcaggtggagagaaacagcaccagccgcccctgcaccacggtcatcacgtcgccgaagcgccgcaggtggcacagggtcatcgcctgttcggcgcgcagaccggtggccggccgcagcgccaccatcacgcctttgccgtcctcgggcagcagcgtgttgcccatcagcgaaagcaccgcctggctgaacggttccggccgcatatagcctttaagctgcagcgggcgcaaaccggccagcagcgcatcgatgtcggcgggcacatggcgcgagaagcgctgcccctggatgccctcgagcatggtcagaaaacgcgacagcggcgcgacgtgcggcacgatcaggttggcgccgcaggccagcagcagccgctcgtcgctgtagcgcaggctggcgctcatctcgcgcaccgcgattttcaggccgttgccgcggctgcggcgcagggtgtggatctggtgcgccaggtgatcgatttggtcgctttggtacagcgcgaaaatcaacgtcgccgagagtctcagcatgccgtgctgcgccagttcgtcgttgctgtccagcaactgccagttggcggacagcggcggcgcgccttccaggatgctgcgctcggccagatacaggccttcatcgctgcgcaaggcggtggggggagg

SEQ ID NO: 71348 - DNA, 213 bp, Glycine max
  Peptide Sequence Number=SeqID_188126
atgaactcgctaagcgagcatgatgcgctaagcgagttcatcaatattcattggatatatgcatttccagacgaactcgctaagggcacctaccgcgctatgcgagttcatcttgtgaggatgaactttcatcctcctgttgagatacctgtggctaagcgagtgatcggaatggagaaggagaaagatgaatggagacgccacatcaagtag

SEQ ID NO: 71349 - DNA, 150 bp, Glycine max
  Peptide Sequence Number=SeqID_188127
atgaagatgaacccaccacttacgaccccagaggccttcatccagcaagttgtgtggccaggagtcagagagtctatggccggagctgaagattacatcattgtggacctgacaactgctgattggggcccatggccagacttgggttga

SEQ ID NO: 71350 - DNA, 392 bp, Glycine max
  Peptide Sequence Number=SeqID_188128
atgagccatgggcgcctgtatcaacaaaggataaagaacgcgttcgacaagaaggtgcgcccgcataagttgaacgagggggaccttgtgctgaaaaagatatcccacgctgttaaagataatcgagggaagtgggccccgaactatgaagggcctttcgttgtgaaaagggctttttctggaggggctctggtgctcaccaacatagatggcgaggagctaccctcgcccgggcagaatcgtcttaggcaacggtcagatgtcgagacaaagctaaagggacggatgcaagtagaggctagggtcacgaccgatggatcgtcgtcccttgcccaactctggacaaacggaaagcactgccgcaaggcagcccagtatcctttaaattccca

SEQ ID NO: 71351 - DNA, 204 bp, Glycine max
  Peptide Sequence Number=SeqID_188129
atgccaaaagatagggggacttgtcttgatttcaggtattgtcatcatcaaaaagggggagattgtagacaaaggatcaagctgaatgttttgatgatgcgaaaggattacatgaatcacatgcttctcaaagatttattcaagactaagatattcaagatgaatgatcaagacagtcttagagtcttaggaagggtatattaa

SEQ ID NO: 71352 - DNA, 222 bp, Glycine max
  Peptide Sequence Number=SeqID_188130
atgaaattcaaattccagaaaagattgttgaatagccactaccaatttgttttgaatataagtgatgttgatcgcaggagtgcattatatctcaaaaatttgttcactctaagaaacttcaaaagaactttgacaccacaattccaacagggcttcagtgaattaactgagaattgtaatccaattaaggacaacaatgcagcatctggaatgtactcataa

SEQ ID NO: 71353 - DNA, 395 bp, Glycine max
  Peptide Sequence Number=SeqID_188131
tagtcaccgacgatccgagacttatatatgcgcttgtggagaggtggcacggggagaccaacaacttccaccttcccgtgggagagctgacgatcacactagatgatgtggaggaggtggaggaggtgatcatcttgttgatggagttgctcgaggtcttgggtcaggaggctagagctgagactgcacaggcgcgtgggacatatgtacgcctgtcatgggtatgggatatatatttgagtagatgtgaggcccgacggtggattgtagtagctcgtgcttatctcctccacttggttggttgcactcttttcgctaacaagagtgcaacacatgtccatgtagtgcatctggaggcttttcgagacctgggtgagagtgggaggtatgcctag

SEQ ID NO: 71354 - DNA, 793 bp, Glycine max
  Peptide Sequence Number=SeqID_188132
aagaagacgaacaggcacagtggcgctgaagatgaacacgaggcaccttgcggaagagaagaggaatgccaagcaccttgaggaagaagatgaatgcgaagaacttgcggaagaagaagatgaacaaaagaagttgcggaagaagaagatgaatagaagaacacctccaccgttactactatgggccgtcactcttccagcaaccactctccctcctcctcacgccgccaccggagccaccgcagcagcgtctctccgcctctacgagacaagcacgagcattccggctgcacggctgaagaaaggtcaatccgaacgcgagcgggagcctcgagagaacgagaggaaccatggcgatggtagcagagggagaggctccgagagggaagccggtgagcggagggagaagaagagaacggagaacgatgagagtaacggaaggagtaacaaatcggagaagagaacagagtacgaagacggtggcggaaggagtagcaaatcggataagaaaatggagtacgaagacggtgggggaaggagtagcaaatcggagaagagaatggagaacgatgacggtggcggaaggagtaacaagtcgttgcggtcgaggcacgagaggtcgccggagcgtgaccgcaatgggaggagccggcataggtctcagtctccgccacgtcaccatgcttccgccgcggatgcaaaaccacgtgatgaggatgaggatgtggtttgggagatggttggaaggttgaatgttgatacttggttgctagaaaggggtgttattgcatga

SEQ ID NO: 71355 - DNA, 480 bp, Glycine max
  Peptide Sequence Number=SeqID_188133
caaaaaccttcatttgagctatctggaaagcttgcgggtgaaacaaatcgagttagaggtgttactttgttattcaatgaaccaccagaggctcgcaaaccagatattaaatggaggctttatgttttcaaggctggtgaagtgctaaatgagcccctttatatacatcgccaaagttgttatctttttggaagggaaagaagggttgctgatatccctacagatcatccctcttgcagcaagcaacatgctgttattcaattccggcaagttgaaaaggagcaacctgatggtacattattaaagcaactaaaagttcctcaatgcgcaaaccctaatatgcatatgatctgtgccaggccttacgttatggaccttggaagcacaaacaaaactttcataaatgatagtcccattgaacctcaacgatattacgaacttaaggaaaaggacaccattaaatttggtaacagtaggtaa

SEQ ID NO: 71356 - DNA, 309 bp, Glycine max
  Peptide Sequence Number=SeqID_188134
atgagtcatcactcatccagtgttaatggtgagggtactagtcataaggaccctcaatctagaatcttagatgagttgagttccctcaagttatatatggaaataaaaaaactaaaaagaaaagaaaaaggaaaagagagggtagaaagtgtcaagggaaggagcccagagtatcaagaacctcaggatttgaggtcaaatcctttccaagggggaggagatgatgcaatcctttcaatgatgattttccaccatggagatgcagcggaagataaaggagaagaggtgagaggaggcgccatccactaa

SEQ ID NO: 71357 - DNA, 183 bp, Glycine max
  Peptide Sequence Number=SeqID_188135
atggatgccgccagaagaactggcgacaaaggtgttccgtcattgcagatggcgagaagcatgatgagctggagggtgccgccagtgacacaagcgagacatgctgacgtgaagcatgccaccaataagaatagcgggacaaaggtgactgggaaggaaaataatgttaaaagatcatactga

SEQ ID NO: 71358 - DNA, 526 bp, Glycine max
  Peptide Sequence Number=SeqID_188136
atgcacttggttcacaggcaaatgaagaaagataaggagtttttcctggagaagctttcttgtggtatatctatattaaggcataacaatcggattgttcgactacgacctatagatctcccagacgaaataccatgtaacggccatgaaacatatgatgaaagcttaccaagtgttccatataaagatcttttcaacgttgatgttttccccaagagcacacttgaagttgatgagttgaaccagatacaaagcaggccctatgaggaagaggggtgctcaaatattactaccaatactaatgaaaaaacatgtcagacaatggatggaacagaaataaatagtaaccaaatgattgacaaaatagaaagagatgagcaaggccaagatcaagaacagttgcaaagcatgccccatgagacagaggaggacacaacaattgtgattaaaaatgatcaaacaactgctcgagaaataggtgatcaaccgaaccaagatgaagaaaagacaaacaacttcctcaatg

SEQ ID NO: 71359 - DNA, 261 bp, Glycine max
  Peptide Sequence Number=SeqID_188137
atgggcctctggccatggaaatcgggcatcgccagaaacttacctgtgcaagggaaactcaatcacaccagggctcacaaaattaacaatgctgttgctcaagctttgcttgctaagaggttgggcaaaaaatgcattattgctgaaactggagcgggtcagcatggagttgccactgctactgatatggaaaggcaggctctcaatgttttcagaatgcgtcttcttggtgctgaggagataggatccttccatgaataa

SEQ ID NO: 71360 - DNA, 291 bp, Glycine max
  Peptide Sequence Number=SeqID_188138
atggccacaacagcaaagaatgtggtggtgatccaggatgcatctaaaacacttaatttaagagttttttattggattataaatggcttatctcttaagccagaagatgtggtgaccctagttgcaatcctgcatgaggtttatcatcctatggggtacagaatcacggtggataacaagttgcttggggtaaaccagaggatcatcgagcaagagcttgcaaataagaaacaagactacctgatggatgaggggcttgctcagattgttaaacactacgcatcaaataag

SEQ ID NO: 71361 - DNA, 399 bp, Glycine max
  Peptide Sequence Number=SeqID_188139
atgttagcaacaccaggaataccacgaaggctgttgctaggtgcatccagtgcacccagcagaattgctggtgcacccagcaattcaactgcatcttccgccctttcttcttcccccgtgtacccagcaaactttgcttgcttcctccccctttcttcttcgtcttcttccgttcttcctgtgcagacgtttcaaatttcttttcttgctcatttggttgaagacgaagttctttcgcgagaagaaccttcttccgcgcgtgtgaaagtggacgaaaacgttgcctacggaagaaggttcttctcgcgggaggacttcgtcttcaacctccagcaccaaaacataacaatgtcgtcaatcctaaggccatttacgcgattcaaacacattggtggttag

SEQ ID NO: 71362 - DNA, 849 bp, Glycine max
  Peptide Sequence Number=SeqID_188140
atgtcaagggatcatgatgagggagtgagttgggggaatgaatcaagttcatcaacggggatgatgcctgagattttgagggtaattctagacacgagtcatcaatttgattacaacaaggattatgaagttgaggatgattgtgagtggaactcaatgttaggaggcattgaaacttccaatgttgatttagaagatgacatatgccagttgagtttgaagaatttgactgatgaagaggtgaaacttatgcagtttgttagtctaacatggcatgagttttattgttggtttgcaaaattcaacgggtttactgtaagaaagggcaaggtgttgatcaatacaaaagaggaggatgagaatgtcccaatcatattggggtgtcaatttctaaatacatgtgacatggtgataaagacaaaagatcccactaatgctttagtggaagcctcattcacaagtgtagggatagagaatcccttagaaatagttcttattgccgaggacttggactcagattcaagcaatgatgaggaagaaatactaatgttcctccaagctcaaagtgatgtcaaaccaatgagaaatgaaaggtttgaagagtcgaaaatgagcaatgagccaaagcctaaaccctccattgagaaacctcctatgtcggagttgaagcccatgtcttccaatttaaagtatgtttttcttgacgaattgttattgctacaggaggcctttgggtggaccatacatgacatcaaggatattgaccctactgtagcacctataggattcacatggaggaagggtaaacacccaagtggttgcctcataggagactatagaaacaaataa

SEQ ID NO: 71363 - DNA, 885 bp, Glycine max
  Peptide Sequence Number=SeqID_188141
atgactggaagggatgaatatggatatcccgtttatcaggcgaaaaagtcttcagttgcatggccgcgaaccatctggaacaaacgatctcataacgcaagtgtatatggctcaacattgcttcgctcccttatcccaggcagaaaatttccatttccaaaatcgctatatgctgttgaagacacattgcggttctttgtaatgaataagcccgacgccatcattctagatttcttctcagggtcagggacgacagttcacgctgtcatgcgcctcaacaaacaggatggcggatgccgacagtgtatttcagttactaacaatgaagttgcagccgacgaacagaaaactttgcgtatgaaagggttgcgcccgggagatgccaagtgggaattgcatgggatatgcgactatattactaagccgcgggttgccgctgctatcacgggaaagacgccaaatggtgatttgattaaaggggcttacaagttcaccgatgaatttccaatagctgaaggacttgaggaaaacgcagaattctttactttgagttatgaatcgccggtatcagtcagctacaacctagcatttgaacgtatttcgccattgctatggctgagggcaggagcccggggcagtcgtatagataagcttccaagcgacggttgggcaatagctgatacatatggattgctaaacaatgtggacgtaacctcaacatttattaaggcgctagctggtgttgctggcattcgaattgcttatatcgtaaccgacgatgaccgtcgcttccaagccattgctaagcgattgcccgatagtatcgaaccagtgcgtttatacgaatcatatcttaccaactttagctttaccaacggggaataa

SEQ ID NO: 71364 - DNA, 123 bp, Glycine max
  Peptide Sequence Number=SeqID_188142
gggagcctcctcgacatcctgacatgatccacgagaatcctcgagagcgcgctcagggagacgtcgactcctactccccgtttcctactaaggggccggtgcccaacgcactacctcaaccct

SEQ ID NO: 71365 - DNA, 465 bp, Glycine max
  Peptide Sequence Number=SeqID_188143
atggcaagtgacaaagatcatgtgggatttgctcgagagattctctcaggtgtacatgtggagactgtccttttgacagaagctgctattgctggaggtgtaactcgaacaacaccagcatctttgttgagagattcttggattaaagcttctgatgagcttggcattggtattgttcatgatggaatggcagaatacagtgaattattaaaggaacaaccagtaggctctgaaagcaatttgggtgatggtaagaccgtgttggctactgtgccatgtttaaagggttgtttgagaagcgcaaatcagattctaagcagacgaggggatgaaaagcgtgttattgtcttcaccgggtctctgcatattgcagcttcagtcttagcttctcttgctgtcccaatgcggcagctctcgactggaattttggatgtcaataatcagcattcaacagtaatctattaa

SEQ ID NO: 71366 - DNA, 285 bp, Glycine max
  Peptide Sequence Number=SeqID_188144
ttgatgcgatacagcatcctacaacttctagagaacttgagatttcaatatcatgggaaggaaataactgatgctggtattctgcgatgggcaaacagcaaagtgagtagttcaggaagtcatagccgaatggatagttttaagaatgagtttttggagggacagtactctcagggttctgaccatgaaattttggtcaggactggcaaactgttatgtgatgccaatatgacgactagcacagtacaccggtctattaaatgcgatgatttagtggcatggtga

SEQ ID NO: 71367 - DNA, 267 bp, Glycine max
  Peptide Sequence Number=SeqID_188145
atgatgaatgcaacctacattatcagtattgcaagaaagcttggatgttcaatattcttgcttcccgaagacatcactgaggtgaatcaaaacatgatccttacactaacagctagtataatgtattggttcttaaagcaccctctcgaggaaagaacagtaggaaattcagacagtgagagtgggagtcaattggaaactacatcaaattcaacactggatgactctgcttctgattcatcggcagaggagaaggggagcatgtaa

SEQ ID NO: 71368 - DNA, 318 bp, Glycine max
  Peptide Sequence Number=SeqID_188146
atgtttggtaaggctcttgagaagcttagagcattcacaatggatgacttaggaagcaatgtgttagaggaagcaacatgcttgggtggtggtagcaatgacagtgaccgtggtggtagttgcagtgacgacaatggttgtgacaatgacaatggtggtagtggttgtgatgacggtaatagcagtgatgatggcggcattgatgataatagtggtagttgcggtggtgacaatgacagtgatggtggtggttgtggtggcgataatggtagtggcggtggtggttgttgtggcgacaatggtagtgagtggtggtag

SEQ ID NO: 71369 - DNA, 273 bp, Glycine max
  Peptide Sequence Number=SeqID_188147
atgaggacccacttcctgaggtggattctcccgaggaagtcatgtcggcatctgaggcagactctacggaggatagtggcccgggggagatggcgatcagcagaggctcttcatcctagtggacagctctttggattagttttgtatacttttgagggcctgatgtataggaatttgatgattgtatacatgtggctgaagccaccactatggacacctttgctctggatgacactgtattttgtaaaactcccatattttgaacagctttaa

SEQ ID NO: 71370 - DNA, 243 bp, Glycine max
  Peptide Sequence Number=SeqID_188148
atgaacagagagagacagaaaagaaaggccaaaggaagtgaaattttatttctctcctctttcgaggaaatcaaagtgcatcggagagaagttcctataaagaaaggtacaagtcttcctatggagaaagatataagtctttttatggagaaaggtttcaagatcctgttatttcctataattgatagtctaggataccccttaagaatttttacagataaggtgtggctgccttatgtctga

SEQ ID NO: 71371 - DNA, 303 bp, Glycine max
  Peptide Sequence Number=SeqID_188149
atgggggtgcaaatagcaaccagacccacttgggcacttcagaagattcctccagaaggcggttgcttctggaggaagccaccttgctcacctgggcgagctggggggagaagtgaagaggaatttcgttcagccctcctggtaattcaagaatcacttgaaattagtgaaaaaaaattggttccgcgaagaaaatccgagccgaggcgcttccgtagcgtttccgtggggattttcgcgaagattttcatccgttcttcgacgttcttcgttcgttcttcatcgttcttcggtcttcaaccg

SEQ ID NO: 71372 - DNA, 192 bp, Glycine max
  Peptide Sequence Number=SeqID_188150
atggcagaatccttgaagaagagaaagggatcctcctccaccaccaccgctgcaggccaacgccgccacaacacatccagtgacccaccagtgcatcaaatacctattgttgttgatcaatctctattttattctctgactaaactgagcagtcagggtgttccttttgagggcattctagttgatgactag

SEQ ID NO: 71373 - DNA, 366 bp, Glycine max
  Peptide Sequence Number=SeqID_188151
atgaggccatggatcaacaaggatcaagggggtccatccaatcaacctcctaatcaagggcctaacttgaatgagcaaaccactaagctagaagatacattgactcaatttatgcaggtatctatgtctaaccataaaagtaggcaatcagcaattaaaaatcttgaagttcaagtggggcaattggccaagcaactagctaaaaagtccataggaatttttatggcaaatactgagaaaaccccaaaagaggagagtaaagcagttgtcaatagaagtcatggtacaaaaagagtggagaagagggaagagaatactgggggagaagtagaaaacgaaaaagaaaaggagggagaaaatgagtag

SEQ ID NO: 71374 - DNA, 210 bp, Glycine max
  Peptide Sequence Number=SeqID_188152
atggcgagtgtatggaggtcattaaaaggagtatcaatttcagaaattggatcaagcactttcctcttccaattcttccataatgtagatattcatagcgtccttaaagggcaaaacattgccaaattcttaggccaatttctagactatgatgataagaacaaccccaacttgtggagacctttcatgagtgtaaaaatgaagagttga

SEQ ID NO: 71375 - DNA, 606 bp, Glycine max
  Peptide Sequence Number=SeqID_188153
atggatgtcgacgccatgatctcttctcagatctctcaaatagcccaatccaactcctcaaggttgggctttctaactctgatcactactctttgtgaagcctggggggttgtctctgactctctcaccttcgagttcctcagctcgaccattaatctagcctacattcgcaagaactgttggaaccccgttgatccatctatcacttttccggggtccctcaaggccacgactagggctccagtagaggcacccccagttgctcctccacctcccaagtcgttggcgtcttccttttcctccactccaccagaccagcttgtccccatgttgcagagtatccatcatggacagtgcgtagtgatccagagcattcaccacttttccgagcaacaaccggtcatttccttgcaagacttcctggagcaagttgcttggcccacaatccagacttcccttgttggggtgggggatgttgtcagtgctgagattgctcagaacccagccggtgaggtggattatgttgatgtaggtgatgctgatcctgagatggatgcagattatgtagctaatgtcacagccacacagggagcctgggatccatag

SEQ ID NO: 71376 - DNA, 237 bp, Glycine max
  Peptide Sequence Number=SeqID_188154
atggaaaacagagtgagagagtgcggtgtggaaagagatggattgggtggtgtcgaagggttaccgaaagaactgtggcagtggtggccgatagtggtggtggaggatgatgagacctctttgacgattttgccatttggtgaagtttctaaaaatttcaattgggtgtggggcgccattagagaaacaggggagatgagtgtttggaacttagagagagagaaaagtcatatttaa

SEQ ID NO: 71377 - DNA, 180 bp, Glycine max
  Peptide Sequence Number=SeqID_188155
atgggttgtttagcccttcatggtcatgaagggctcaaatgtacaaaaggatcgcaagtaagtggttgggagctaagcatgccatgtgcgctaagcaccccttcgcctgactacagattctccatgctgcttctttgcgctaagcagaaaccctctcgcttagcgacaacaacttgctaa

SEQ ID NO: 71378 - DNA, 174 bp, Glycine max
  Peptide Sequence Number=SeqID_188156
atgaggtattttgaggatatggtgagaaatagggagtgggataaggtggataagtacttgtctggttttatgaagttggatgacaataaatactccatgaagatcttctttgagatacgaaaggctgggaggatatcattgtcaagcaagattagtctgatgagaacccattag

SEQ ID NO: 71379 - DNA, 438 bp, Glycine max
  Peptide Sequence Number=SeqID_188157
atgccttcaccattaagccacaattcgcttgggcgagctgcagctcgcttgggcaaatttccctgcaacaattggttgtcttctataaatagccatgcattgttgaggagaaatggatccagcagccttcaaatgccagagaaaacgcaaaagaagaaggagaagaggaaaagtgaagctgaggcgctgcagagttgtgaccatggatcacttccttcgtcacttccttttgatattatatatatgataacaaaagatgatgacaaaggtgatgacaaaaagcttaaaggtcaatcaaagaatgagttcaagatgttcaagattgaatcaagaacacttcaagattcaagaggaaagttgaattcaagaatcaagaatccagattcaagagatcaaggttcaagactcaagattcaagaatcaagaaaaggctattga

SEQ ID NO: 71380 - DNA, 207 bp, Glycine max
  Peptide Sequence Number=SeqID_188158
atgttcctccagaaggtggttgtttctggagaaagcaacctagctcgcttgggcgagctgggtggcaagctcctccctcattttcctataaatagggggaggagtgatggagaaaaacgttcagccctcccggtatcttgggatcacttgaaattagtgaaaaaaatcgtttccgtgaagaaaatcgacgccgagacgcttccgtaa

SEQ ID NO: 71381 - DNA, 460 bp, Glycine max
  Peptide Sequence Number=SeqID_188159
atgggggtagcaacgttgagcgcagcggtaaaggtgaagttttcggcgtcaagctttgcggtggtcggtggcggcaaacgaggtacgcagatggtgtttgttcgtcacggacgtacagatgacttccggatcaagttgatccatgagtggatgtatgaaataatgtcagaacgagcggatatggattatgaaaatgcagaatcatgtggtgcgaatgaaccacaagttgattgttcggatgcgttcaagacttctcaggtgtttgagtgccgagaggatgttttgcggtgggctcgatccgtggcacatgaaaacggatttgtggcggtgattttaaggtcagacacaaacacaggtagtagaggaaggagtacgtttgtgttaattggctgtgaaaggagtggcgagtataagtgtaggaaaaaagaatttatcagaagagacactgggactaggaaat

SEQ ID NO: 71382 - DNA, 939 bp, Glycine max
  Peptide Sequence Number=SeqID_188160
aatgatcagaaccatgattcttcttggtacgaggaaatcatcgatgatgatctcaaatggtcttttaaactcaacagtgtgctccataaagccattagcgagtaccaggacatagctctcttagatacaaaacgttttggaaaggccttggtgcttgatgggaagatgcagagtgctgaaacggacgaatttgtttatcatgaatgcttgattcatccacctcttttatgccaccctaaccccaagactgtgtttataatggggggaggtgaaggttctgctgctagggaagcccttaagcacaggtcaatggacagagtgatcatgtgcgatatagacaaggaggtggtaaatttttgccgaaaatacttgattgtaaataaggaggcgttttctcataagaagctggaccttgtcatcaatgatgccaaggctgaattggagaagagaaaggaaaagtttgatatcattgttggagatttggcagacccacttgaagatgggccatgctatcaactctacaccaaatccttctatgagaagatcctgaagcccaagctcaatgataatggcatttttgtgacccaggctggaccagcaggtatcttcacacacaaggaggtcttcacttctatatataacacgatcaaacaggttttcaaatatgtgattgcatacacgactcatgtaccatcatttgccgacacatggggttgggttatggcttcggaccaaccactatcgatttgcgctaatgaaatggacagaagaatcgaagcaagaatagatggggaacttctatatctaaatggtgcttggttccattcatctacaaccatgaataaaactgtttaccaatcgctgcaaaatgaaactcacgtgtacacggaagaaagtgctagatttattcctggacatggcatggcttttcatctctaa

SEQ ID NO: 71383 - DNA, 438 bp, Glycine max
  Peptide Sequence Number=SeqID_188161
atgcggcaacaacctcgacctcatcggagacacaaccaccatggccacatgctgacaacacagggcaccacaaccgctgcggtacgggtcactgtaaacgcgacaacgacctcgacctcatcgaaggttaaagggaaacgaaagtttcaatcttgcagtgtgatgagagagatctgtgacgcagatttcttcatggcaatttgtgattcgcgttgggttgttggatgcgagggttctttcacttgcatggcgacgaagaagattggtagtggtggtggtggtgttaagaaagacagtggaggtgttgaggaggacggcgaaggtgtctacggcgacaatgaggggtttgctggtgtcgaaagtatcgtcggtaaaagagaaaggggacagagacgggatatggtggtgagagtatactataatagatgctgtctttga

SEQ ID NO: 71384 - DNA, 496 bp, Glycine max
  Peptide Sequence Number=SeqID_188162
atgcctctggtactaggcgacatcaatcttgttgcacaaaaagagaatggagcattggaaacaaagcctaatgataataagctggatagggaagctttatgccacaagaaagaaaacaccaagtttatatccgagggattgattaaccgacttatctgcaagggtgaaatctcaatcgcgattcttcaagcgttcgagacgctggttcaagtggtcgatcctgacgacgaggttggtgacggagtagaggagccagtagaagaggagtgcggcggcgatgaggagggcgttgcgttggctcttcatgatagatttctggtggcgaaggtgctcggaaggggtgcaggaatctccctcacagctaggcctggtttcgtacttccaatatatgtccatgaaaaggaacaggcagaaaggcaccaccgagaggaacggcttcagaaggttccgggtcaccgcgatcagaccctttcggagagcttccaggcccgggatg

SEQ ID NO: 71385 - DNA, 792 bp, Glycine max
  Peptide Sequence Number=SeqID_188163
atgaataatccaagattaaagagctgttgtgatgttgccgggggagttgagttgctgagtttcgtagggtttgaactcagggaggagaatggagagacatgggcagtgatggagtttccctctgaggaacaaataaaattcattcagagagcaatagtgttgctggaatcacaacttgtacaacaaggacctcctaagagagacgatttgccgtctgcaacttctaccgagatgggtccaaaggcagaaacaaagccggttgacagacaaggggcatatcaaattataggttcttttggacagtggtctagggttgtgtggacaattagacattgtgaaaattgtgataggtttggtcaaaacacttctgcaagggttgataaccagggctggcatatgctggtgaaggtcttctttgctgtccctgaaagtgttgcagctaaaattgagctgccagattccttctataaactttcagctgaagaggtcagaagagaagctgaattaaggagaaaaaagattgctgattctcagcttttaatccccaagtcacttaaagaaaagcaagcaaaagtttccaggaagagatacacaaaaactattatcaggattcaatttccagatggagttgtacttcaaggtgtatttgctccatgggaaacaactattgctctctatgagatagatgtcactcaacatgaaacttctcataagaacaatgaagcggattttgcaatttccatgtgtaacttgattgcatttaacaaaggattctgggaattctgtcaatga

SEQ ID NO: 71386 - DNA, 357 bp, Glycine max
  Peptide Sequence Number=SeqID_188164
atggtgtcgacgaagatgcgtatgtcctcagtggtgttgtcgacggagaaccatgctgaaactgatgatgtgacgctggatgttgatggcgacgaggaggtcggagatcacatggacctcacagaaggtctcaacgttgtcgtcgtcgaggatgacatgacagctcttgacaaagtgcttgtaggcctacaagttgtcgaagcgccgcacgacaaaccacactatagagaccagggcgtccatctcttgcaccacgacagggcaccactgtgcaaggacacgacgtgggtgtggtggcaagccactgtgttgagagtaatcttggaagagaaacagaaagagagattagttaagtga

SEQ ID NO: 71387 - DNA, 762 bp, Glycine max
  Peptide Sequence Number=SeqID_188165
atgccccgccctgtaattgcgaaggcgatggttgatgctgccgaagaagttggagctgatgctgtctcccatgggtgtacagggaaaggaaatgatcaggcatgtcttgctattagggagtgggatattacaggtagagaacttgctatcgagtatgctaaaaagcataatatatccgttcctgtgacaaagaaatccatatatagcagggataggaatctttggcacctaagccatgagagtgatattttggaagacccagctaatgagcctaaaaaggacatgtacatgatgcctgtagatcctgaggatgctcctgatcaagcagaatatgtggaaattgagatagagtggggccttcctgtttcagtcaatgggaagaggctttggccagcatatttacttactgagctcaatgagattggtggaaggcatggaattggccggatcgacatggttgagaatcggcttgtgggtatgaagagccgtggagtttatgatactccaggtggaaccatcctgtttgctgcagcacgcgagctggagtttttgacacttgatcgagaaacaatacaagtcaaagattcattagcccttaaatatgcagagttagtatatgctggcagatggtttgatccgcttcgggagtccatggatgccttaatgcagaagatcacagagacaacaacagatgctgctgggttcatccggctttatgttcttccaatgagggtccgagcaatgcttgagcagggcatctaa

SEQ ID NO: 71388 - DNA, 441 bp, Glycine max
  Peptide Sequence Number=SeqID_188166
atggagggtgcacaggaggagctagaaagaagaagcaagtttctcaaaagcttgatacaaaagaagaaaaccatagagcaacaagagcagcatgatcacctacaacacaataacgttcgtgtcagagcttgtgacatgcctctccctcttcagaaccgtgcctttcgttgtgcacgtgatctcctggattctatgccatcaaagaagcttgatacaactgatttggtgaaaaatggtttgatcctgcgtgctattatacagtatacaaacgaagcttggattgaatttgatacttcgtatggtccagcttggcactgcattgtgggtactagttttggttcctatgttactcattcctttggtggtttcgtgtatttttccattgacaaggtttatgtccttctcttcaagacagctgttgaaccattagaccattcatag

SEQ ID NO: 71389 - DNA, 663 bp, Glycine max
  Peptide Sequence Number=SeqID_188167
atggaagagtcttccaagtccaaggcggttgaggttgagcaggaagcaagtgaagcaaaggctcctcacgaggctatgtttctggtcttggcatatcttcctgtgtacgaggttgtggtcatgtctcaagtctgcacatctcttagggatgcagtgaacaatgacatattaccatggttgaatgtttttgttcaaaggcctctcagttggcgactcaatgatgatattttaatcaaaatcacttctaaggccaatggtagcctcaaaactctcgccctaatcaactgcatgcacgttaccgacgaggggctccaaagggtcgttcaacaaaatcctctcattaacaagaaggagcatcttgacatgcttatcgtaaaccttggaaagaatcaaccattagaggagcagcaagagcctgtctactatcataaacgatgtaacttttcagtatttaagcaggaagaaagccgacggcttattgatttggagatatgtcccagtgtgaaaactgtggtggatgcattgaatccggagaagtggaagagggagactgtgaagatatcttttgccttgaatgttggttacagattcccaagtgcagtttctgtaacaaaccatattgtaagcaacacattaattgcacttcttcagactcttcattga

SEQ ID NO: 71390 - DNA, 1443 bp, Glycine max
  Peptide Sequence Number=SeqID_188168
atggttactcagaagaataacaaagaatcttcacttatgtcacctgaaaaagcctcagggacagtgggcggtgggctgagcactgctgctaattactatagcaggctatgtcttttcacaagacagagaaatctaggacctagaaaagggtatgcacatggtgatgcttttattggtgtcaacattggttcagatatatctgacatgccaggttcaacagagatagtttctcttctgaaggctcaaagtatccaacatgtcagactctatgatgctgaccgagcgttacttcttgcacttgccaacacaggaatccgtgtaactgtttctgttcccaatgaccagctacttggcattggtcagtccaatgccactgcagcaaactgggttactcggaatgtcatagctcatgtccctgctaccaacatcactgccatatgtgttggatctgaggtcctaactaccctcccaaatgcagcccctattatagtctctgccataaatttcattcactctgctcttgttgctgctaatctagaccagcaaattaaaatctctagtccgcactcttcttctatcatccttgactctttcccaccttcccaagcatttttcaaccgtacatggaatccagtcatggttcccatgcttaaatttttgcaatcaacaggttcatatcttatgctcaatgtgtatccatattatgattaccagcagtccaatggtgtcatcccactggattatgctttattccgccccctacctccaaataaggaagctgttgattccaacactctgctgcattatactaatgtttttgatgcagttgttgatgctgcttattttgcaatgtcagacttgaactttacaaatattcctattatggtgactgagtcaggatggccctccaaaggtgactcatctgaatctgatgcaactgttgataatgctaacacttacaacagtaacttgatcagacacgtcctgaacaatacggggactcctaaacatcctggaattgcagttagtacatatatttatgagctttataatgaagacttaagatcaggtccagtctcagaaaagaactgggggctattttatgctaatggagaaccagtgtataccttacacttgactggtgctggtattatatttgcaaatgatacaacaaaccaaaccttttgtgtcacaaagagtaatgctgaccctaagatgttacaggcagcacttgattgggcttgtggaccagggaaggtggattgttcccctttgctgcagggccaaccatgttatgaacctgataatgtagttgcacattctacatatgctttcaatgcatattatcagaagatggataaatctcctgggagttgtgattttaaaggggttgccactgtcactaccacagacccaagtatggcaatacatactcctacataa

SEQ ID NO: 71391 - DNA, 877 bp, Glycine max
  Peptide Sequence Number=SeqID_188169
ggtgcaggtgttccagtttgctgacaaacatcgtggtgcatacagtaacagcctgcaccgtgcagtctgcccattttactgcgacgtcaatggttaccaggacgagctactgtgggcagcagcgtggttgcacaaggcctcacgtaggcgtcagtacagagaatacattgtgagaaacgaggtggtgttgagagctggggacaccattaatgagtttggttgggataacaagcatgccgggattaatgttctcatttctaaggaggtgttaatgggaagagcagactattttgcgtcgttcaaacaaaacgctgatggatttatctgttctacattgcctggaatttctcaccctcaagttcaatattccccagacccgtccaaagccgttaattatgctttgcttactaaaggaaaagcctttgattgtgttttcgcatgcattggtgggcttatcttcaaggctggtggaagtaacatgcaacatgtaacgtccctgtcttttctgctcctagcttattctaactacctaagccatgccaataaggtcgtgccatgtggcgagactagtgccaccccagctttactcaaacaccttgctaaacgccaggtggattacattcttggggacaatccattgggaatgtcgtacatggttggatatggtgcacgctacccgcagagaatacaccaccgggccagctcgcttccctcagtggcagcccacccggcccacattggttgtaaagctggatctcgccctcacataaatgggagagccatggaggaaatatctgagcactgcaaccttccatggatcctttacttggaagagaggatccctgttggagaaagacttcatagagccatgaaatga

SEQ ID NO: 71392 - DNA, 618 bp, Glycine max
  Peptide Sequence Number=SeqID_188170
atggcgccaaatgctctctttctcttctctttcctcgccatgctcctccttctgctccgctcaaccgccgccggccacaactaccgcgacgccctccgcaaaagcattctcttcttcgaaggccagcgctccggcaaactccccgccgaccagcgcctccgctggcgccacgactctgcattgcacgacggcgccaccgccggagtggacttgagtggagggtactacgacgccggggataacataaagttcgggtttccgatggcgttcacgacgacgatgctgtcgtggagcgtgatcgatttcgagaagagcatgggggcggagctaggtaacgcgttgaaggcggtgaggtgggggaccgattatttgctcaaggccacggccaagattggctccggcgttgtcttcgtgcaggttggtgacccttactccgaccataactgctgggagagacccgaagacatggacacgctgcgcaccgttttcaagatcgatgggtcccaccctggctctgacgtggctggtgaaactgccgctgcacttgccgctgcttccatcgtcttcagatcacgtgacccctcctactctaccatgctcctcaatcgagccgttgcg

SEQ ID NO: 71393 - DNA, 732 bp, Glycine max
  Peptide Sequence Number=SeqID_188171
atggatagatcaaatatctttggaatccatgatattctgggaaactggctccctgccagatacattagtaatgaatcagttgagctgaagactgacaataatgtcgtacggttctctctagacaagtctgatgatattaattatggaaagaagagccagctgaacaaaagagttaaaatgtctagaaaagctaaactgaatgagcttaggttctatcgtttgaaggccaagaaaaagatgatttccccaaatccagaagttagaattacatataagcttgaaaaggccaagcgaaaggaaacttggttggttgagaagctaagaaaatttgatgtaccaaaatctcctccagaaacatttgatcctgaaattttaactgaggaggagaggcattacctgaagcgcactggtgagaaaaagaaacattatgttccagttgggagacgaggagtgtttggtggggtagttcttaatatgcatcttcactggaaaaatcatgaaacagttaaggttatctgcaagccttgcaaaccagggcaagttcatgaatatgctgaagagcttgcccgactgagcaaaggcattgtgattgacatcaagcccaataatactatcattttttaccgtggaaagaactatgtacaaccggaagtaatgtcacctccaaatacattatcaaaagtgaaggggagtcgaggagacgctcagaataatatgatatttgtattatga

SEQ ID NO: 71394 - DNA, 555 bp, Glycine max
  Peptide Sequence Number=SeqID_188172
atgtataaaatcggacggcattcccttgttagcgtaggagttgacgagcgccaaggcattgctggtgaacttcttgacgttggtgacgcgatcgcatacatccgttttcaacgggacagtccgctacgtcctggaagccgtccgtacaggtttcttcgtcgcgagggcggcgcgcgtggtgccgtcgtagtcggcgtcgcgcgtgaggttggagacgtaggaggcggcgcggtggaccttggagaggctcacggagatggcaacgcgcgccagctggccggggttctgttgcaccgcactggcgtagcgagagagggaggtgaagcacacgtccgggtagagcgtggtgttgcagctagtgcgtatgaaatcggcgtcgccgtcgccgtcgcctggggagggtgcgccttcgtctccggcggtggccgtcgggtgaaggctggagaatgcggctgcgaagaggaagagggagagaaggagatggttaagacgttgggttctcattgtttgtttctttctgttatggtttgtgctgtgagtagtgtgtgtccgtga

SEQ ID NO: 71395 - DNA, 269 bp, Glycine max
  Peptide Sequence Number=SeqID_188173
atacgaaaaataaggttgcatttagcaaaagtggcacagaaaggaagaaaaaagaagaaattctgaagcaggcccagtccaataggggcgctcagcgcgcatcaggcgctaagcgagcaactaactggaggcgctgggcgtggcagaaaccgttacgcgcgctaagccagccaggcgcccagcgtccgatccaacagaagcacaggcccagcgtgcatggcgcgcccagcgcgcgatctgaacgcgctaagcgcgaggtgtggcgctga

SEQ ID NO: 71396 - DNA, 246 bp, Glycine max
  Peptide Sequence Number=SeqID_188174
atgtcctggaagtttcacaaattgcctaatgatggaagccaagctcctcacgaggagaccaaagaatggtcgaacagcgtcatcgagcaaaggtcccggggctccagactcgaagtgctagggaataaagtcatagggctccgaaaaaaaagtggagaatggagaattggcgaacagcgctacgcaataacttcgcggggctccagactcgaaggtggaggacacatgaacagcgctaggcaataa

SEQ ID NO: 71397 - DNA, 150 bp, Glycine max
  Peptide Sequence Number=SeqID_188175
ccactggatcccgaggacaatgtcagcgccactaatagggagaatgtggaggggggtggtagaggaggtgggaagctggagatatttagcaaccctggactgaataaaattgtgggtgctcccttcgttgatgagcactgtgacacggga

SEQ ID NO: 71398 - DNA, 116 bp, Glycine max
  Peptide Sequence Number=SeqID_188176
atggcaactgcaattgtgaccaaaatgacagctatactggtagctagagtgacgtttttcaaaaacccattttttcctttaaacaatggtgccctcaaaaggtgcaccttgacagg

SEQ ID NO: 71399 - DNA, 379 bp, Glycine max
  Peptide Sequence Number=SeqID_188177
atggaggttgatgaaccttggctagggttatggctaccattgaattatcaagtagatatgggagcaagtcagcctaggatactggaattgggcattggtcgtgtggtaggtgggttttgtggtgtgattttagggatggcctttgtggataactggatggtgggtaaggagaagacccacatcgatcctttcactggcaaagaccaaatccgcaaagctttgaaggtgccacttgagctgccaggttctccacctttgggcgtattctttgaaagatcggaatggactcgggaaggttccaagttagtgtaccagatggttcttggggcaagtaatccccttgtacttgtcaaagtccagcaccttgaacttgggaggg

SEQ ID NO: 71400 - DNA, 1143 bp, Glycine max
  Peptide Sequence Number=SeqID_188178
atgaagtttgatagcataaaaaaagataaatcatcgattcgcaataagttgcgtcgtatcagcaccgtcaatgccgccgtgatattactgctgtgctggctgctgctgacatcgacgtctttactgtttattaaacgctatgagaaaagaaacctcgaactcattgccgccacactcagcaccagcctgaccgccgcgacggtatttgaagacagctatgatgcccgcaacaaaatagccctgctcggcaatgaagggatgtttgcctccgcgaagctggtcacggcgggcaataccgtactggtggactggcacgatcgccagcaagagagcggctggtatgaaacgctactgcgtcgctggatctatcagcagccgctggcggtggaaattaatcacgctgaaactcaggtcggccatttaatgctggccggcaccgtcagcggtgcagccgattttattcgctattcggtgatgattttatccatcggtatgctgtgcgtgctggtgatttcctgcctgctgagtgaatttctgcatcgtggtattctgcgctcgctgcgcaatatcaccagcgccatccattacgtgattcgctctggcgatttctcgacgcgcgtgccgcaaaatccgaccaaagagtttcagctgttttccgaagatctcaactcgctgctgagtgaaatgcagacgctaaaagcctcgctgctgcgcgataaccgttcactggcggccaaagcgctggaggatccattaaccggactggccaaccgctcggcgtttgttggccgcctgtcgcagctgctggatcagcagctggcgcatgagaattttgtgctgctatttctcgacggcgatcgcttcaagagcattaacgacaactggggccatgccgccggtgatgaagtattgaaggccatcgcggcgcgcctcagcgcgctggcgtatcaggacgatctggtggcgcggctgggcggtgacgagtttgccatgctgatcaccagccgcacctcagaagccgatctgcagcagctgacggaagatattcgtaccgcaatcgcgcaatcgattgtgatttcggaaggcacgcagatcaccacatcggtgaccatcggctacgcctggtcgcagcatggcgattcg

SEQ ID NO: 71401 - DNA, 422 bp, Glycine max
  Peptide Sequence Number=SeqID_188179
aggactacacatcctcgcctttagagggttgcacaccctctccttcagagtggctgcacgccctcaccttaatagggctacacgcccttacctttagagggctacacgccctcgcctttagagggctacatgcccttgccttcagagggctgcacgcccttgcctttagagggttgcacgccctcaccttcagaggactacacgtcctcaccttcagagggctacatgcccttgccttcagagggctacacgcccttgtcttcagaggactacacgccctcgcctttagagggctgcatgccctcgccttcagatggttgcacgccttcgccttcagaggactacacgtccttgcctttagagggatacatgccctcaccgtcagagggctacacgcccttgtcttcagagggctatgttag

SEQ ID NO: 71402 - DNA, 2472 bp, Glycine max
  Peptide Sequence Number=SeqID_188180
atggccgaaacctgcgactccaacaataaagtgatccgtgaataccatagtgatgactcctttatgtcaaggtgtgacatctttactgatgttaccgagtaccaactgtgtctggcatctgccagagaatctggtcaaggaaagttcgaacctaagtgggacacaaagatagtcactccccaccttatcgagcagttcaagctaaattgtgctgcctcgaatctgccagtcaaagtgtttgtcagcattggaggaaaagaccccttcaaagtggttgctggtggtgccgatgattgggttctcaatgccacaaccacactccaccacatgatcaacgagtaccacatcgatggaatcgatgttaagtacgccagaatcctgtgcaacaaagatatgtttgttaactgcattaaggatctcataaggggcctaagggaagctctatgcaccactgggtttgtggcttccttagctccaaatgctgccaccaatgaggctttctacttgcccttgtaccgatctattgataattcttggattggaactgttgtgtttcagtgcttcgttgatttcgaacctaaagatcctaacagatcagttgaaatcttggtgcgccaggttgagaagatagtggaagagtatgattattatgactctaagatcttgcttggctacagcgccattaaggaggattggaataaagtttcaccacccctcttctttcttgctctcaatcgcctagtgcattcttggcctagggttaagggcgcatctgtcaaggttcttagtgacaactttgccttcattcccccaacgtggatccctaaactcctgtctttggccgtctccgatgagataggctcccgtcttctagagcttcggcctacgatcacgatcttaattgagacaagggtaaaacaagttaaggctcgcaatattcgaaataaagtcaggttgcaagcgatctatgcccttaataagctggatcagcgtagaactttgtggactgatatcgaatgtattcatggcaatcaacatggtccttgggtcttgcttggtgactttaataacgttttgaaagctaaagatagaatgggtggtaatttggtcaccgagtcagaatatgaagacttgacaaaaatgatgcgaaatacgggaacttttgaaaaggatagcacgggtgactactatacttggtcgaataagcaaactgatggtatgatctattctagaatcgatagggtggtggggaatgtggaatggttccaagacaacatggacacaatgctccaaatcctgcctccgagcgtatcggagcacgctttactttgtttggctgatccagggaatactgcaggtcggcaatttcattttaaattctcaaactgtttgacagatttggaggaatatcatagcactgttagtaatagttggaacgaaccactgaatggtagaccgatgtatgtgctttgggagaagctcaaacggctcaaacctgctttgaataaaatcaacaggcctctgcatcatatccagtctagaataatggaggctagacaaaatctgcaacatgcccaaaaaagccttgtagaagatagatggaatagcagtaaaattgatactgttaagcggtatacagaggaggttatcaattggaattccctggaagagaaaacattacaacaaaaatccaaaattgattggcttcgattgggtgatggaaataactcatatttccatgctaccataaaagctaaaaagagttccaaaaggctgaatttgctgcataaggatgatggtacggttattacatctcatgacgaaattcaggacgaagtcttaaatttctatgagggtttaatggggacaaaagatggtaatgtgcgtcatattaatattatggccatgagaggggggcctcaacttagtatggaacagagggaacagcttgtagcccccattaccgaccaagaaatccgtaaagcgttgaatggcattggtgacacaaaaagcccgggaatagacggttttggagcaaaatttttcaaaaccagctggaatattatagggaaagatgtggtggctgctgttagagatttctttgagaatgatcggatctacaaggctttcaattgtactttggtaactctcattccaaaaaatgaggaagccaaaactattaaggaatatcgacctattgccggggtgatggatagtatcgttggtaagaaccaagctgcttttgtccccggccaaaaaattcataatcacattctacttgcttacgagctgattaagggttactctcggaaaggtgggactccccgctgtatgatgcaaatagacctccagaaagcttatgatatggttaactgggatgcactggaatgtattcttaaagagattggtgtgcctcaacaatttatcagatggatcatgatagctgtgaccactgtttcttaccgtttcaat

SEQ ID NO: 71403 - DNA, 861 bp, Glycine max
  Peptide Sequence Number=SeqID_188181
atgtctttgttccttaaagctttgcctttgatggccttccgcacgaggccatgtttggtgtttctgtgcagagtttccaacaccattccactgtcactttccagaaccagtaccagaaccagaaccgtgttttctaattctgcttctgcttctgaaacactcacttccaatgctaaaccacctttggccctcagtgaaccccttgagtgggtcaacaggactgcattttgtggtaaattgtcttcaaatgatgtgggaaaaagtgtccagctttgtggttgggttgcccttcacagggtccatggtggcctcacatttcttaatctcagagaccacactggcattattcaggttacaacccttccagatgaatttccagatgcccattctgctatcaatgacctgagacttgagtacgtggttgccattgaaggtgttgtcaggtctaggccaaatgagtcaatcaacaagaagatgcaaactggcttcatcgaggttgctgcaaatagagttcaagtgctaaattcggtaaattcaaagttgccattcttggtcactacagcagatgatgcaaaagactctcttaaagaggaaatccgtttgaggtatcgatgtcttgatctgaggcggcaacaaatgaatttcaacatattgctgcggcataaggtggttaaactcattcgaagatatctagaagacattcatggttttgtggagattgaaactcccatactgtcaagatccacaccagaaggtgcccgggattatttagttccatcaagaatccagaagcaatgctggtggcaaacacttgacagtgactccatgagtgcaaatttccttcctgtttccaagagatga

SEQ ID NO: 71404 - DNA, 1188 bp, Glycine max
  Peptide Sequence Number=SeqID_188182
atgaagccaggaacattctatgccttgccacaaagtcctcagctatttaagcaaatgctaatggtagctggttttgacaaatattatcagattgcaagatgtttccgtgatgaagatttaagagctgatagacaacctgagttcacccaactagatatggaaatggcctttactccttacgaggatatgttaacgcttaatgaagaattgattagaaaggttttccttgaaattaaaggtgtggagttaccaaacccttttcccaggcttacatatgctgaagcaatgagtagatatggttcagaccggccagataccagatttgatcttgatttaaaagatgtatctgatattttctcagggtcttccttcaaggtattctctgattccttggagaatgggggagttatcaaagtgttatgtgtaccttctggtacaaaaaaatactcaaattcagcccttaagaaaggtgatatttacaatgaagcactcaaatctggtgcaaagggtttgccttttctcaaggtcttggatgatgggaatattgaaggaatctctgttttagtatcaagtatggatcctacaactagagggaatttgttaaggcgatgctctgcaggaccaagcgatctgattttatttgcagtgggtcatcacgcgtctgtaaataaaactttagaccgtcttagagtttatgtagcccatgacctaggtttggttgaccatggcaggcattcagttttgtggatcactgattttccgatgtttgagtggaatgatccagagcaaaggctagaggctcttcatcatcctttcactgcaccaaatcctaaagacatgaatgaccttgcatctgctcgtgcgttggcttatgacatggtttacaatggagtggagattggtgggggaagtctaagaatttataaacgtgatatacaacaaaaggttttggaggtcgttggcatctcaatggagcaggatttggacaaaaagggggttcagttgttggctaatagagaaagttgcatagcttatgggttggacagattggttatgctgttggcgggggctaattccataagagatgccattgcttttccaaaaacaacgactgcacattgtgccctcacgagatcaccatctgaggtggatcctcagcagctgaaagatctgtcaattacaacttag

SEQ ID NO: 71405 - DNA, 1176 bp, Glycine max
  Peptide Sequence Number=SeqID_188183
atggacaagctctttttcaaccactgtttcattggatactgccttctttattctctcttgcttgtgcatggcaaacaattgtcatgcaatgaaaccccttacccctctgtgtgcaagcattacattgaaactaccaaaacattatcagccctagatgcttcaccttcttcattccatgatatggcccttaaggtcaccatggtgcaagccatggaggcttataaacttgtctcaaacatggacttgaataatttcaaggacaagcgagccaagtctgcatgggaagattgtttggagctctatgaaaacacactttatcagctcaaacgctcaatgaactcgaacaatctaaatgataggatgacttggcaaagtgcatccattgccaaccatcaaacatgccaaaatggtttcactgatttcaaccttccctctcacctaaactacttcccttccatgttaagcaacttgtctggattgcttagcaattccttgtccattagcaaggctatgacattgagatcattgtcatcatcaccaacgaccaaacaaagtggtgggcgaaagttgctttcagatggcttcccctattggctgtcacgttcagatagaaagcttcttcaggaaacagcatcaaaagctgatgttgtggtggcacaggatgggagtgggaactataagactatctcagaaggtgtggctgcagcttctagactcagcgggaaagggcgtgttgttgtgcatgtcaaagctggcgtatacaaagagaatattgatatcaagaggacagtgaaaaacttaatgatcgtcggagatgggatgggtgctactattgttactggtaaccacaacgcaatagatggttccactacttttcgttctgctacttttgcggttgatggtgacggcttcatagctcgggacataacattcgagaacaccgcgggacctcaaaagcaccaagcggtggctctccgttccggcgcggaccactcggtgttctaccggtgcagctttagggggtaccaagacaccttatacgtctacgccaaccgtcaattctaccgtgactgtgacatatacggaacagtagacttcatattcggtgacgccgtggcggtgcttcaaaactgcaacatctatgtgaggaaaccgatgagcaaccagcagaacacg

SEQ ID NO: 71406 - DNA, 1394 bp, Glycine max
  Peptide Sequence Number=SeqID_188184
cggcgcgtagtgcctgttgcgtcgcggcgcttgcggtgagatctccggcgcgcagttgctggctcgcctgccataaggtggtcatacgcgcctcctcaggcaatcaccggcagcgcgccggtgacatagtggtgttccagcgtgcgattcagcagcggatcgtgcagcgccatgcggaactcgctggccggacggatgccgccgatcgcgctcaaccgcgccagcagatccctcggcgtgagcagagagtcgagcgtgccctgctgataagtcacccagtcgccgttgactttgatccacgcgcgcagctccagccgatcccagtgcggctcaacctctgccatacgccacgcatgaccggcgaccggcttaacgcaggcctgcttcgacagtgccacgctgaaggtttccaggtgacggtcggtgtgatcggaaatcagcgacacccagtattcgccgcgatggaaaaacacaaacggctcggcttcgccggaggtttgctcgcccaccacttccagcgggctgtgctgcgccagctgctgggtggctacgcgataaaacagcgggactgcaccaggtgcgggcacgcccagcgcctccagctccctgatatggtgcagcaccgccgcctggtcgcggccaacccatccggcaatgaccagctgcttaatgtcgacatccagcaccggggcggctttaccccaataaggatctgcgtgatgagtgattcaattgctgaaaatgtgaagtcacaggccggacaaaaaagcgtttcattgaatgaacaggcctatctggcgttcaggcatcgcctgattacgctgcgctataagccaggtgaatatctcaataccgcgcaggtgatggaggatctggcaatgggccgcacgccggttaaccaggcggtacaccggctggcgaccgaagggttactgcagattatcccgcgtaaaggggtgatggtggcaccgctgtcgattgacgatgcgctggagctgattgaagtgcggctggtaaatgaagcgctgtgcctgcggctggcgacgcagcgcgtgaatccggcgcagattgcccagctaaaggcgctgaatcagcgcatcgccgccgccagcgtggcgcgcgatcgtgagcagatgatgctgctggaccgcgagtttcatcaggtgctggctgacatcgccggcaacggtcgtctgtcagatattctcagcatcatccatgcccaggcgcagcgcttctgggcaaccacgctgtcgagcgcgcagcacatgcaggaggtgatcgccgagcatgacgcaatcattgcggcgctggcgcagggtgacgtaacacgggcagaagacgccgcgcgcgtgcacatctattcgttcaagcaggcgctgctgaacgcctga

SEQ ID NO: 71407 - DNA, 786 bp, Glycine max
  Peptide Sequence Number=SeqID_188185
atgatgcagcattcggcgcgcattcttgagcagcagggccgtcagctactgctggtggacggcaaacacagcgccgaagaggagcgtgcggcgattcagtttctgctcgatctgcgctgcgatggcgtgatcatctatccgcgttttctcaccattgatgaaatggacagcatcattgcccagcaccgccatccgattctggtaatcaaccggcggctgcgtcagcacgacagttactgcatctactccgatcagcagcgcaccagcgccgaggcggtggcgcagctgattgcactcggccatcgcgatatcgcttttatcaccggatcgctcgactcgccgaccgggcgcgagcggctggcgggttatcacgcggcactggcgcagcatcagctggtggcggatgacgcactggtggtggagggaaaatggcaggcgcagcacggggcggcggcagtggaaacgctgctggcgcgtggtaaaccgttcagcgcgctggtcgccagtaacgatgagatggcggtgggcgcgctgaaagcgctggcggcgcataacatccgcgtgccgcagcaggtggcggtgctgggtttcgacgatattccgctggcgccctataccattccggcgctggccagcgtgcgcatgccggtgaccggcatgatcgaggagaccattgaacgcctggtgtcgatgctcgacggcggcgaaatgcgtaaccgcaaaacctttgccggcgagctgattatgcgtgaatccgttggtcccggcccgttttaccctggctga

SEQ ID NO: 71408 - DNA, 1269 bp, Glycine max
  Peptide Sequence Number=SeqID_188186
atgacaaagccggagatcataaaaaacaactgcacgccaacccagccaaatgccagcagcggaatatgctgggtagtggcggcatacggcaacatctatgatggcgaaacgttcactgatggatttcccgaccgatggtcggatgcgcggactgatgcgccagccgatgctgctgatggtgctgctgatttttctctcctttatggtggcgctggtgacgctgtgctttatcgccagcgatctcaatcagcaggaggcgcggcaaaaccgcctgctgctggagaaggcgttgcagacgcgtcaggaagtgatgcaaatctgggtgagtcgctgttccagacctttgcctacgagggcgtgtttgtcatcgcgccgcgcggcgatacggtttacagcgtgatcgacggtcagctacagcaacgcgatttcaccgactggctcggtcgccagcaactgcccgcgctgcgtcagcagttacagcacaatgacggtaaggcgctgtcgcgctttgtggtggtaaaccagcaactggtgctgctgtgcgcggcatggatcaccaccggtggcgataatagcgtgccgcaggagcccggtgcgccatcgctgatgatctttgccgatcgcctgacgccgcaaaaattacagcagctggggcacgagtacggcatcaacgcgctgcgggtggaattcgctgcaccccgcgcgccagtggcggaaagcctgcgcctcgccgcccacggccatgacgccacgctgcgctggaccagcagcaaccccggcggtaaattgctgactgccctgctgccgctgctgatgattgccatgctgatcacgctgtatggcgccatcatgctgatgcgcaacgcgctgcgtaaagcgcagctcaatgatgaaaatacgctgctgctggcgcaaagccagcgggcgctcagcgccagcgaacgccgcttccgtgatatcgccgaaattaccaccgactggatttgggagatggacgaacagctgcgcttcagctgggtttccggccgtttcccggtagttaccgggtttaccagcgaggagtggctgcagcgcacgctactggatttcctgctgtgcgatgaacaccagcgcgcccggcttttgcagttggctgactcgggcggtcagctcacgctgaacggctgccgctatctctccgctcagcatcagccgcgctactgcaatctgaccctcaagcgcgtcagcctggcgcacggcgtcagcggctttcgcggcagcgccagcgac

SEQ ID NO: 71409 - DNA, 1490 bp, Glycine max
  Peptide Sequence Number=SeqID_188187
atgcttgtggcgcagcagctgccacagcgtgatatgaccaatcgctttacgctgtgcattctcttcagccagtttgccgctcagccagttgcgctgttcgctggtcagccagtgggcattttccggacggttgctgagcaggaagaaagccagcacacccagcacaatcgccgggaacccttcgatgataaacagccagtgccagccgcgcaggccgaaccagccgtccatcgtcaggattgcgcccgagatcggcgagccaataaagttggctgccgggatcgccaccataaaagtcgcaatcacgcgcgcgcgatatttcgccggaatccagtaagtcagataaaggatcacgccgggaaagaagccggcttcggcggcgcccaacagaaagcgcagcacgtacagcatttccgcactgctgacgaacgcggtgcacaccgagacaatgccccaggtcaccatgatgcgcgaaatccagattttggcgccaatcttctgcatcgcgaggttgcttggcacctcaaacagaaaatagccaacaaaaaacaggctgcttgccaggccaaacaccgctttgctcagcccgagatcttcattcatttgcagggacgccatgccgatgttgccgcgatcgataatggcgatcagatagcagacgatcaggaacggcagaatgcgccagatgacgcgttttacggtctgctgctcaatatcgggcacagcggccgcgcgggttatcttcacgggaaaataccagcattcattccgccaggcgacagtggaattactttgcaacatcttgccattttcccgctacgtcattctgcgggtgtggtcgacgggctgtactacccgttttacatggagtggacgcgccacgcttacatgcgcgaggcgctgtgtatcgacattgaagaagagttcagtcagggcaagatttacatggtgctggagtacacgctgcgcttccgcaagagcctggtgaaaggcgataaggtggaagtcacctgcgcgctggagcagaatgagaagcgcaatcgcgtgaacttcgtgcagcaaatcaaggtcgacggcgtggtgtatgccgaggccaccggtaacgcgcgcgctcggtctgtaacgttagaatacgtggcagcagcctgctttatgcctgctgccactctgcaaccagcgtctccaccagctgtgccgccggcagcgcgcgcacccgcgccacgccctgaccggcccactgcgcaccgaagccgtcctcgccgtgcgcagcagcagcagccgccagggctttacccagcgcataggccagcggatagtcgggaatctcctccggcgttacgtcatggcacaattcacaaaatgcgttgcgcacgcagcgcgcctgacgcccggagatcgccgccgtcattaccgtgccacgctcgccagctgccagcagcgcgcgacgataggccgcactggccgccgattcgggacacagcacaaacgcc

SEQ ID NO: 71410 - DNA, 579 bp, Glycine max
  Peptide Sequence Number=SeqID_188188
atggcgctgatttacgccggcgcgtcggcagcgggttcgacgctgagcgtctggtcaccgcagctgctgaaatcatttggcctggataacttcaccaccggtttgatgaatgcgatcccgtatggtctggcatcgattctgatgattgtctggggccgcagctctgaccgtagcggtgagcgtcgctggcacactgcgctgacgctgttcctgattgccggtggactgctggcggcgttcctgaccgatacgctggcgggcagcgtggtgattctgtcactggtgctgattggtgcttactcgatgaaagggccgttctgggcgctggcctcgggctggatgtcctcaaccaccgcagcggccggtctggctgctatcggcgcgatggccaacctgattggtggcgggctgatggtgaatgtttacggcatcattaatgagaaaaccggcagtcatgcgatggcgatgattcctctggcactgctgtgcgcggcgggcgggattgcggtattgctgatgggacgcagcaaaaagctgcacgttgaagcggaacagccggtggccagcaccgggaaataa

SEQ ID NO: 71411 - DNA, 1259 bp, Glycine max
  Peptide Sequence Number=SeqID_188189
atgggttcaaacgcgtattttgcttacaccgtcgtgggcttccacggctctggcaacgtctcctaccaaagcgccctcgccgcagtcttcatcgaaggagcaatcttcctcctcgtctccgcaatcgggcttcgcgccaagctcgccaaactcgtccccaagcccgtcagaataagctcctcggccggaatcgggcttttcttagcattcatcgggcttcaaagcaaccaaggaatcgggctcatcgggtacagcgcatccaccttagtcaccctcggcgcctgtccaacctcctcacgtgcctcactcgcacccgtcttaacggcagctaacggcaccgttagtttactacccggcggaaccgtctcgggtgatattctctgtctgaaagacagaatggaaagcccgaccctctggctgggcctcgtgggctttattataatcgcgtactgcctcgcgaagaatattaaaggcgcgatgatatacggcatcgttttcgtcaccgttgtgtcgtggttccgtggcactaaagtgacggcgtttccgaacacggacgccggtaactccgcgcacgagtacttcaagaaggtggtggatgttcacactataaaaaccaccgcgggagcgttgagcttcaagaacattggaaaagggtatttttgggaagccgtggttacgttcttgtacgttgacattctcgacacgacaggaacgttgtactccatggcgcgtttcgcgggcttcaccgacgacaaggggggcttcgagggacagtacttcgcgttcatgtcggacgccacgtcgatcgtggtggggaatcacggcgttgacggcgcgggcttcaccgacgacaaggggggcttcgagggacagtacttcgcgttcatgtcggacgccacgtcgatcgtggtggggtccttgctcggcacctcgccggtgacggcgtttattgaatcctcgacggggatccgggaaggtgggagaacaggaatcacggcgttgacggtggcggcgtatttctttttagcgttttttttcacgccgttgctggcttcgattccggcgtgggcggtggggccgccgttgattctggtgggggttttgatgatgagatcggtggtggagattgattgggaggacatgagggaagcgataccggcgttcgtgacgctcattctgatgccgttgacgtattcgattgcgtatgggcttattggtgggattgggacatacattgtgttgaacctttgggattgggg

SEQ ID NO: 71412 - DNA, 264 bp, Glycine max
  Peptide Sequence Number=SeqID_188190
atggatcgtgttacatcgctgcttcgtctactaccaaacacatttagagctgtcgatgtccctgttacttccagtttcaccttgacaaaagaatccgctttacggagcccttaccgaacctgtgctagagctagagtaatgggtaaagcagaggaggtgcaagagaaggtgaaggccgacatggaggccatgaaagagaaaatggccacaatgatggaggccattgataagcatgaagaagatactggaagccaatgcggttaa

SEQ ID NO: 71413 - DNA, 210 bp, Glycine max
  Peptide Sequence Number=SeqID_188191
atggttacttccatacttcaacttgactcgatgaaccttttcgtaaaagcgcgagcttggttcaaccccataacccagggaatggcaattttgatcgccaatacttcatcaaaaattcatagggatgcaaaactcgggaatatgcatgctatgcatggaaaatgtaattatgagattgagatgcccgaagaaacatcctttcttagttaa

SEQ ID NO: 71414 - DNA, 327 bp, Glycine max
  Peptide Sequence Number=SeqID_188192
atggaacacaaaggttacactttagatgacacagtggatcttagtggacggcctgtgctttcttctacaactgggaaacggaaagcttgcattttcattcttgcttatcaagcatttgaaagatttgcctactttggggtaagtgcgaatttggtgatttatatgacatcggagctccacaaagacttggtatcagcagtaaccagtgtgaataactggtcaggcacagcatggataactccaatagttggtgcttatatagcagattctcacttgggccgcttttggacaatcacttttgcgttgctcatatatgccatggcttaa

SEQ ID NO: 71415 - DNA, 254 bp, Glycine max
  Peptide Sequence Number=SeqID_188193
gagaccagccctcttcttctggagggggtggagcctctgcagccgatgagcttgatactgaggagccactagcaccagcacatgtagaggaagagactactccagatcagactccacagccatgtccagcccctgcacatatacctgaggatgctgcaccagttgcggagtctgagcagcttatacaggattcatcagcagctccaacactggatttgaatgaagaccagccacaggaggagaaagacgtttaa

SEQ ID NO: 71416 - DNA, 240 bp, Glycine max
  Peptide Sequence Number=SeqID_188194
atggcatcaagaaagagggttagaaccgacgacatcccttcatcatccatcccacctcctcacttgcgagagttggctcagaacaggacaatcgtgcctctggagtattttcttgagaaagtagtctggtctgaagctcaacttccattggtgagacccaatgaggttgctcctccagagcccgcaccggcacaggttgaactaatgtcagctgagccacaaactccagtggtgaattaa

SEQ ID NO: 71417 - DNA, 567 bp, Glycine max
  Peptide Sequence Number=SeqID_188195
atgagtctttattcttcatctagtgttactggtaagggttctactcctaaggacccctttagtcgtaactcttgcaagagcctaagtgaagaacttcgtgactattatgaaggaaggcatagggcacatcttagacctcactcccattggagagaaaaggaaagaaagcctcaagaggctaacattaacctccaatacttccatgggaatgacaatgtagaggctaacttagattgggaaataagggtagagcaacaacttaaaaggaagtctacttcaaaatcttatggctctcactcttatccaaagaaagaccaaggtcaaggcatcttaggggtgacaccttctaagcccaaagatgataagggaaagacaatagaaaagcaaccccttaataacatcaatccaattcaccaaaccaatgcaaatcgcattatcatagttattacgaatgatgttcagagtgtgaaagttcagtcaaatgcattagagatagttcaatcgaatcaattcttaaattttttgggatcgcaaattaggttggaaaatcctgcaaacaatctgtga

SEQ ID NO: 71418 - DNA, 351 bp, Glycine max
  Peptide Sequence Number=SeqID_188196
atggctagggaccttttatggcagatattggtgcacaaacccccttcttcttatattttcagagaaagagaattaatatatgatctatttgaagctgcgacgggacccatgcttcgggcttccggaatacaatgggatctccgtaaagtggataattatgaatgttacgaagaatttgattgggaagttcaatggcaaaaagaaggagattccttagctcgttatttagttcgaattggtgaaatgatggaatccataaaaattattcaacaggctttggaaggattcccggcggaccatatgaaatttagaattcgctgcttgatagagaaaagagccagaatggaatga

SEQ ID NO: 71419 - DNA, 216 bp, Glycine max
  Peptide Sequence Number=SeqID_188197
atggctggtacattcttccttttgaaacagcaaaatagtttagagattatgagcgcggaaccgccaagaaatataagcaatttacatggtgatgaagatgatgatgattatcttgtgtctaactcatacgttgaagagtctttagacgaagatgatagtgttgacggtatatctgatacagacgatgaagtcaccgacatgattcaaccagtgtag

SEQ ID NO: 71420 - DNA, 360 bp, Glycine max
  Peptide Sequence Number=SeqID_188198
tccgacgactcagcagcagtgcggaatggagtttctcgtctggtggatctgatctttagggggcaatacataccaaaaggtgctttagtgatctttgatggtctgaacaaggaactctgtgtggggatccatcttgttgttattcgcattgttcaccttggtcggaaatcagggtggttgttctgcgctttctattttaagcaagcagcttcatccttgatgatggcctatggtggtgatgaattcgttcatcctgacaatgcggtaccagtttctctcactcggtccggttaccctcggatcattccgtctcatcataggcgtatgattctgaagaaggatgagaaagcggacatgctg

SEQ ID NO: 71421 - DNA, 126 bp, Glycine max
  Peptide Sequence Number=SeqID_188199
atgaccaagacgatgaccagtcccacaaggtggtggacgccgattacgtcgcggatttcttcttttcagtatgactgggttcttccacgtcatgatcatgttgttgttctatctgaagaactttga

SEQ ID NO: 71422 - DNA, 231 bp, Glycine max
  Peptide Sequence Number=SeqID_188200
atgactccttcacccttagatcgcaagactaaggcaaacgaggcggaacctcggtggcgtgataggctggttctcaccaaggagccctatgttagtcacataggcaccccccggtttcttagtgaaactcatcaaggtgagggtgggctagcttatagctattctatcactcagggatccagaatggagcaactgggggtgacgcggaagccacccgggtggggctggtaa

SEQ ID NO: 71423 - DNA, 258 bp, Glycine max
  Peptide Sequence Number=SeqID_188201
atggcaccctcatttcaagtcttggagaggatcaataacaatgcctataggttggacctcccagaagagtatggagtcaacatcacttttaacatttctgatttaattctttttgcaggtggagctgatagtgaagaggaggaaccaacaaatttgaggtcaaatcctcttcaagggggagagaatgatgcaatcctccctaggaagggaccaagtcaccagagccatgagcaggaggctctgagaggattgggttag

SEQ ID NO: 71424 - DNA, 894 bp, Glycine max
  Peptide Sequence Number=SeqID_188202
atgccgcgcgtgacgcagggcatcatgcgtaacgtgtggattgagcacacgcgtaatccgggcgatctgtcggacggtgcctggagcattgatacgctgaacattgaggattgcggcacgccgttcaatctcaataatgcgcgcgtcatcatgcgccagattggcctgcagtccggagcgaagatctcgaacgatatggccggcacgcgctggctgtcgacttttgactatggctatcgtcgcgaagagcatcacggcacgctgatcaccggctcattccgcgcgggctactacagcggccacaaagtcaccaacaataccgacaccgataactggtatcgcctcggccagctgttctttccgacggcgaatcagcagtgggtgatggagctgattggtaaagccgacgccacccagccaaccggaacggccgcctcgccggtcaatctggcgggcaccgggaaaacgtggattaacctgcagcggctggaaacggtatgggctgacgcctgccatatggggcagccggcggtgctggatattcgctacagccgcgtcggcaccacgtatgccgtggtgtgggtgaagctgcgcgccaacagcggcgacacgctgattaacctgaagaccaccggtccgacgcgttttgaagccggctcctgctcgctgttccagcctgacttctcggtggtgacggataccaccaaaatgggcaccctcaaaccggcggcgcgctttggcctgcacaatggcgtcgcgggtattggggctaacgagaaaggcgtgcttaccgtcgcgacggcagcaggtacgccgaccaataaaaccacgccgacgggctttgtgctggtcaatatcaacggtgtcgatcgtaagcttccttattacgattga

SEQ ID NO: 71425 - DNA, 171 bp, Glycine max
  Peptide Sequence Number=SeqID_188203
atggcacccgaaaatccatgtccagacgttgagatgaatacacattatctacattatttagtatcagtttccatcattaagggcacaatgcttggagggctatgtggtgatcctgacattaggtacctcggagtcatgatcagattcagaagatctgtggcagatgtgtag

SEQ ID NO: 71426 - DNA, 324 bp, Glycine max
  Peptide Sequence Number=SeqID_188204
atgcatggccctcaagcacatggtccagagcttgatcaaggcgggatggttgacgttccaagaagattagccaaatgtgaagatgaaactactcgccaaccatggaggatcaaatccctacaagaggcaggtgtggttcctctcggtgggcacaagggggatccttgtttgatgcatccgggtgcaccgcatgatatggaaacatgctcagcggtggaggagttgttgcagcgaatgatagaccaaggccaactcgagatcggtgacgaggacgagaaagagcaacatgtctacatgcagtcagtagacaaggaaagtccttag

SEQ ID NO: 71427 - DNA, 543 bp, Glycine max
  Peptide Sequence Number=SeqID_188205
atgagaactagacaaacctctaagcttattaatgtcattgacaaggacagtgacaaaacttcagaacaagcatctgaagaaggtttgatgtttgaaaagaaaatcaatccgattaacaccaaacattggaaaacaccttccaagctttattaccaaaaaccaaccgcccctaacctcctactagaagaaagaggattttctggtcagctaaaaggatggtggaataattatctcactaatgatgaaaaatcaaggatttacagcgctattaagatggatcttaacaggaaagtcattacaaatgacgataatgaagggatccctgacactgtcaatacccttatttttacaatcgcccaacatttcattccatcattatggaaggataggtcagcagaattactatccaatcttaagtgtaggactttagtagactttagatggtatagagatatcttcctcactagagtttacactagggaagataaccaacaacctttctggaaggagaaattcctagcttctaagatcagtaggagataa

SEQ ID NO: 71428 - DNA, 480 bp, Glycine max
  Peptide Sequence Number=SeqID_188206
atggctgaagaagtagctattgataagaagaacagaggtttagcattgaagactagcattccatcaagtgacaaaagtgaggatgacaacgtagaagggtcgaaagctcaaaatctgaacttgcttgtgagaaggttcaacaaattcctcaagaaaaagaagaactatggaaacataacctttcagcctaagaagaattatcttcctcgaatggattcacttgcttcgagtgcaaaaagacagaagcaacaaggagataagacgaataagagttcattcaaaaggaagaagaaggcatatatctcttgggatgacaatgaatcaacaacttctagcgacaatagtgaagaagaagaagcaaatttgtgcttgacgacaaacaatgaagctgaaaataaggtaaccatttctgatttggaagataatggtaactatgatcagctactagatgcttttaatgaaatgcatcaagaagcataa

SEQ ID NO: 71429 - DNA, 495 bp, Glycine max
  Peptide Sequence Number=SeqID_188207
atgaagggcacctactacactgatttggtaaaagtattctataccacaactcatattgatgcaaagggaaagcaacattttggtactggaccgttgatgcttgagcacaggtttttggcctatgatgttggttggagtattactccaagggagagcaatcatactcaattgactgagaaggatcttctccttatcagacttatgcaaaggaatctgaagattaactgggtcaacattattgttggtattatgttgaatacgaaaaggattggctttttcaaatgtccttatgcaattctgatctatgggattcttgactattttggtgttgatacccaagaagaagtctttggttttgttgaggcagagtttaaagtgaagaccaaagtcttgaagcagatggggtacatcaagtctgaagaagctaggattggatggaaggagaagagcagagaagatcaaacaaaacaagaagaagtagaagagaaaccatga

SEQ ID NO: 71430 - DNA, 309 bp, Glycine max
  Peptide Sequence Number=SeqID_188208
atgaaggacaagtatattgttctaagcttgttaaagaacttagaaaaaatcaagatcaagcttgttcgcacatcgttcgtgtgtatgatatccactcgacaagatgttgtttacacaaatgagcacatcttaaaagcttactccgcacaatggtggcctcttgggaatgaagcggctattcctccttctaatgacgcatggacacttatccctgacccaactacaattcgtgcgaaaggttggccaaaatcaacaaggataaggaatgagatggattgggtcgaaccatctgagcaccgacaaaaatga

SEQ ID NO: 71431 - DNA, 510 bp, Glycine max
  Peptide Sequence Number=SeqID_188209
aaaactgacttgactccttcatgcatgctccactcggctcggggggatatagctcagttggtagagctccgctcttgcaattgggtcgttgcgattacgggttggatgtctaattgtccaggcggtaatgatagtatcttacgggctgtcaagaacgtagaggagggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccagggtcgcggaccgaccatagaaccctgttcaaaaagcggaacgcattagctatccgctctcagtacgatgaaagttgtgagctgtgttcgggggggagttatgtcatcgttgcttatggtagatcagtcgggctgaggcgtggtttaccctgtgcggatacg

SEQ ID NO: 71432 - DNA, 654 bp, Glycine max
  Peptide Sequence Number=SeqID_188210
atggcaccagaagacatgaagaagactatgttcgtcaccttttggggaacgttatgttataaggtgatgtccttctggctcaagaacgctggggcaacctatcagcaggcgatggtggctttgttccatgatatgatgcatcgagagattgaagtctacgtggatgacatgattgccaattcaaaaaccaaaggagaacatctcgtcaatttgtggaagttgtttgagaggttgcgaaaatacaagttaagattgaaccccaccaagtgcaccttcggggtcaagacagggaagttgctaggtttcgacatgaaaggggatagaagtggaccccgagaaggttcatatcacaactcacggccacctgtgagccactcttcaagctcttacgcaaggaccaatccgttcgttggaatgatgactgtcaagaggcatttggaagtgtcataccctaatttcgtccagggacctttgcttgatgacatgcgacctttgtttggtccttgggtgcaaatagcaaccaggcccacttgggccctccagaagattcctccagaaggctgttgcttctggaggaagcaacctggctcgcctgggcgagctgagctcgcctgggcgagctgggcggcaaccatctcccctattttgctataa

SEQ ID NO: 71433 - DNA, 432 bp, Glycine max
  Peptide Sequence Number=SeqID_188211
atgagaggagcgccattagaggaaagtctcatgccatttactgcacggggtttcagaaaccccaacatgagaatactccaaggagtccacaaggcgtgggaggcgctgcaaaggatggataaagagcttaggggaagcagtaacgggatcatcgacggctaccgtaagtggttgaaagcatacacacaaggcttggatatgctaccgaagttgagagccgctagggaggcagaatctgagacctcgaaagagagagaagaggtgcaagccctaaaagcagagcttgaaaggacccgggcagccaaggaaagattcaaattaacggctgtcaagacaaagaaggaatatgatgaattgagagatgtcaacacagctaccgccaaagccttagagcaagaaaccaaaagggaccgaatggaagaagatagctga

SEQ ID NO: 71434 - DNA, 225 bp, Glycine max
  Peptide Sequence Number=SeqID_188212
atggtcctctgtttaccattaccggcgccttttggcgttgttggggtgcagtgccccgggtccgggtgcatcaaacaggtatcccccttactcccactgcggggaaccacacctgcctcttacagggcttcaaagataaaccctcttcaggctaccacgtcttccaaatgcttaggccgcagcgacccacatacatccacggcattcacggttggccctccatga

SEQ ID NO: 71435 - DNA, 351 bp, Glycine max
  Peptide Sequence Number=SeqID_188213
atggcattcatggtggcccatgtcatgctagagcacggttatgagcccaacatgggcttggggaagaacaatgacagtaggcccgacttggtcaatatcaaagagaactacggaaagtgcgggttgggatacaagcctgcacgggccaaccagaagaaaagcggtggtggaagaaggaattggggcactagcccgccgttgaggccgcaagtaaaggaggcccctccttgccacctcaaggaaagctttgtcagtgtgggcttaaggtgcaaggaggaagtggccatgatacatgatggacccctgcaagagcgtccaggctgggtacaaccgtgtcttccagggttttag

SEQ ID NO: 71436 - DNA, 471 bp, Glycine max
  Peptide Sequence Number=SeqID_188214
atggccaaggtcctcatcgacaacggttcaagtttgaatgtgatgccaaaaagcatgttggagaagctgcctttcaatgcctttcacttaaggccaagctccatggtagttcgggcctttgacggaagccgccgtgaggtgaggggagagatcgatctcctagtccaagtaggaccccatactttggtagtggtgccctcgacgcttcaccagaaattgaagtttgtagtgagaaggcttctggtcattgtttcgagggaggaggatcttctggtgagctgtccctcctctataccttatgttgaagttgccgaggaatctctagaaacgaccttccaatctttcaaggtagtaagcaatgtgatgcaatcctaccccctaagggtattggatagaagactccaagaggcttgggatagagctactaaagaaggccctagggttctcatgaaccttagggtagatttttga

SEQ ID NO: 71437 - DNA, 270 bp, Glycine max
  Peptide Sequence Number=SeqID_188215
atggttttgaaggatgagttgaaggcttgtctacagtccaaaaggggtttgtctcagcagctgagcaaaaccaaagagtgttggccatcatcggaagcaaaaggaagggtgattgactcattgcaccaagaggcgacgatgtggatggatcatttcgcctttgctttgaacggtagccaagacctccctcgaccactagctaaggccaaggcaatggtggacgtatgctcgcccctcgaagaaatctcgtcttcgcgggcgaaagaatag

SEQ ID NO: 71438 - DNA, 285 bp, Glycine max
  Peptide Sequence Number=SeqID_188216
atgcatgaagggatgctaatgtggtgcatgatgcaaaggcgtttagcgaacacgagagcccggaacatcgtctcttcttacttgaaacatttgagggcagagttacccccccccatgtgtgtgcagttaagaaggctaaataggcaagtttgtgagaatgctgattttgagctgctcgctaagccaatctgccggcttagcaagccatccactaagcgcaacactcctgtggctgagcgtaaggaagaatttggaagaaggatgagctgtacatgcatgctatga

SEQ ID NO: 71439 - DNA, 308 bp, Glycine max
  Peptide Sequence Number=SeqID_188217
ttacaagcggctcaaccctctcattcagctgttatgcaagttggaggctatagtatttgtcgaggagctcatgaatctggctgttggataccccaagatgattctgctaaagagcaaggaggaaatttctatcaaaatcaagggcaaggatggaggtcacattcaaggaatcaattcaacaaagatcaaggacctaacttgtataaaaggaccaccaaccaagcaaatagctgagaattcttctggaggttttggagctaagacagagaaaaatccttatgaagaatgcaaggttgtggagaatgaga

SEQ ID NO: 71440 - DNA, 384 bp, Glycine max
  Peptide Sequence Number=SeqID_188218
atggctgacactttcccacatgaggtgggacacattcgcatccatcctcatagtagggatgattgggtctggaaactagactcaagtggtcaatactcagcaaaaagcgcctatcatgcattgaggggacacataacagaaggggaagaggttgcagattttgaagaattatggaagttgaggatcccgtctaaagctggagtgtttgtttggagattacttcgggatagattgccaactaaggagaatggaagaggatgcaacacatttattcttccactgcagcaagattacacccctttggtgggaagctttgtcttgggtcagaatcctcagtgtattccagcagctcccaaggcaacacttctcccaacatatggctga

SEQ ID NO: 71441 - DNA, 945 bp, Glycine max
  Peptide Sequence Number=SeqID_188219
atggagagaaagagtagagagagaaacagtgggtgggagagagttaggattaggaaagagaggagagttagtgccaggttacgaacgagagagggttcccgtctgactactgaaaggataacaacaggacagcgtcaatcatacaggcgagcgaattggagagaccataaggacgtcatttctttctactttacgaggatccctgaagatgcaacagcagaagagttgtggagccatttcaaacagaaaggagatgtgcgagaggtcttcataccccggaaaagaaacaaccaaggaaggagatatgatttcgtgaggtataagggggtgagagacatgcaccagcttcaacagcaattggacaatatggtgtttggaggattgaagatgaatgttaacgtccccaaatatgggagaacaaagaagggagaacaacaaacagtagagaggggaagagcagagaccagacaaactcaaaaagggagcagagaaatgtacctgggcaggatatcaggaaggaagatgggagtccagcgacggtcgtatgcggaggtactcaattggaatatccgaacaccagcacagacgagaataccagacacactcgaatacacaagctccaagtccacttctgaagtgagtcttgacataccgatcatgggcaaacagtggctcaacaaggcctgggtgggtaggttgaaaaacctagcagttttcgatagtatagaagaagacatatggtgggataatggacagaacatatcaccaaaatacgttggtgatgatatggtcttattactggggctcacagaagagaaagcagagagaatgctcaacgaagaagatgaaggatggggaaacttgttctactcaatagagaagtggaatccaaatcgtcgccctggctttagactaacttggctccaatgttggggaatacctttg

SEQ ID NO: 71442 - DNA, 165 bp, Glycine max
  Peptide Sequence Number=SeqID_188220
atgggtatcttcaaattctgccatttctctccaatggtattgccgggtactttgtcgtatccaaatcaattttcctcattggttgaaccaaatctcatgcgtgtctttgtccacagtccaaccctccaacactctccattagagaaagcacttatactagtttga

SEQ ID NO: 71443 - DNA, 525 bp, Glycine max
  Peptide Sequence Number=SeqID_188221
atgggagctcacacgaatacaaggtgggagagggattttatatggaggagatcattgtttgataatgagatcgacatggctgatagtttcttaagagatgttgaaggcaatccaatccagtcacttagaagagatgattggatttggaaagcagacccaagtggccaatactcgacacaaagtgcttacaatctattgatgggggaaacaataggggagactcatgatggagcttctaaggaattatggaagctaaagatcccaagcaaaacttcaatattcgcatggaggaacaaggaggaggatgcaactcatttatttttccactgcagcaaaatccttccaatatggtgggaatctttgtcttgggtgaacatcttaggtgctttcccacaaaaaccaaggcaacacttccttcaacatgtggaagtgttggtggatggctctgacatgcaccatatgacagcagaggaacaacatagtgttctccaacgacaccttcaatggcagcaaactgttggatga

SEQ ID NO: 71444 - DNA, 159 bp, Glycine max
  Peptide Sequence Number=SeqID_188222
attttccgtgtcagcgaaaagattgagaacattaatgatcaatattgtgctctacgagcagaggagctatccacatatatgctagaaagaagaagcatgggtttaagtctgaatgagtgggaatggggattattgttacaacagaataatgagaaataa

SEQ ID NO: 71445 - DNA, 747 bp, Glycine max
  Peptide Sequence Number=SeqID_188223
atgcacggttctcgtgaaaggtacctgcaggctgttgatagaatcttccaatatttgaagacaagcctaggaaaaggattgttgttcaagagtgagggtacattacccttgaaggtatatgtagatgcaaattatgctgggtcagttgtagataaagatccaactctgaatactgaatggctgctcaatctagtagtagcagaatttcgagctatgacacatggtatgcgtgagaggttatggataaagattattcttgataaccttgaagttcttgaagaagagaaaaaccttggcccgcatgatcggttgatccatgtttatcatttcttgaaagacacaactcaaaatcagcagcaagttcagaactttggacatccttttttattggttatccatgagggtgagacattaactgaagtcaaattgcgaatacagaaaaagttgcaagttccagatgaggagttttcaaagtggaagtttgcatttttgtcatttggtcgtcctgagtaccttcaagattcagatattgtttcagctcggtttcagaggagggatatctacggtgcatgggagcaatatctcggactggaacacactgacaatgcttcaaaaaggtcgaatgctgccaatcagctgcacttgaagcgttctgaaggagagaatggagaagctaccaatcttctaaagggtagtctgttgaaaaccataattttcttagctgagatggtggggggtggtgtatag

SEQ ID NO: 71446 - DNA, 1743 bp, Glycine max
  Peptide Sequence Number=SeqID_188224
atgccgggaacagggatggacaacaacaatgctctaatagggcaaactgaagggatcagaatgacatctcatccttctacttcacgcgattcccagaagatgcaactgagaaggacctgtggtacaagttcaaaaagtggggggatagagatggcgagaaaagtagcaccagaagacaaagcaaaggggtttgacgagagacacgataatgaagcaaatcgacgaagacaacctcagcaaacaatgaatccagtctcgtatgcagcggtggtggagaggaacaacaggaacttagggcaaatgtggacaccacacaaccagcattacagtcgcgaaggttcacactcatcggtacacctcgacatcccaatggatgagaagaagtggttcagcaatgcttgggtggggcgattgaaaaacctcacgctgtttgacagagttgaagatgacctactatgggatatcggtgcagaaataacaccgaagtacataggggatgatttggttctgctacttgacctcactaatgccagagcagaacaaatgatccaggaagaaatcacgagtggagcttccttgtttcattcgctagagaaatggagcccgaggttgcgtacaagatacaggctcacttgggtccagtgttggggtattccgctgctagcttgggatacgacgcaaattcagaagattgtgactgctattggggatatggtggaggtggacgacgacgttgaagaagttcggagaatggacaggacaagggtactcatcaaaacgccgtggaggcccgcaatccaacacacggtaaatgtacaaataggtggggaggtttacggagtacatgtagtggaggaaaatgggtatagcaccggaacatgtaacttccgacgaaggagtgtttggggatcatcggaggaaatcgagtccgacgaaagtgataacgaaactccggtaccggagatgctatgcgcgttggagaaagaagatgagctgcaagacaaagaggtgccggtaaatcacgcgctgcaaaggaccacctccaatctcaacgccggtggctcgtgggtacaacgtttcagtcagaaagggagcagagcagataccacaatgggtagcaatgaagaacaggtggagcgtaggtggatggtgacagctgacagcttccgagatgagggaacacgcaacaatgaatgggagaaggttatacacgaaaacggaaaccatgacttgagaaggtgctatgacgtgtcgggggcacatattttgaatgggaaacagccacgtgacccacgggtggctgaggggggttttaaaaattgtttgggcttttctatccacacccccgaagaagcaacacaacagtccggtctcagcccacaaaataataaaaaggaacccattcgtgcctggcaggtatacttgcgaaataggagatgccaaaagcaaatgaagatgggttctgcaaatgatgaatatcccgccatacttacaaaaccacctattaagggctcacagcagcagcacaacgtggacaaagaccaagacagaagtggtaacagtgataccaatgttcacatggaaggaccatcaacacataatgaagctgagaatgcaaattcacaaagaccagtgggaagaggcaacatctctatggaatatggcaaaagaattgggggcaacatgtgggtcagagcagggaaaaattattggcaagataagggcaatgggggaaagagatag

SEQ ID NO: 71447 - DNA, 378 bp, Glycine max
  Peptide Sequence Number=SeqID_188225
atggcactgtgcgtaattacccaatacagggaatcacatactagcaacattcgagtgctgctaggtgcacctagcatttttgctggtgcggtgaaggtgaaggtgcgttgcggtggtcgacgacggcaaacgaggtatgcagaaggtggtggctatgtcgcggatatggacgatgatgagtggatgtatgaaataatgtttgaacaaacggatatggattatgaaaatgaagaagcatgtggtgcgaatgaaccacatgttgattgttcggatgcgttcaatacttctcagatgaatggtagcggaatggagaaggaagagagagaggagacgccacttcaaggagaagatgagtctagaagaagctcaccaccatag

SEQ ID NO: 71448 - DNA, 276 bp, Glycine max
  Peptide Sequence Number=SeqID_188226
atgggccaggctctgaagctagcaatgttgtttctgagtacaaatggcagcctagtggaaagactagccgatcttcatgaagcaagtattcatcaattgcctacaactctaatatacacaattgaccaaaagactcaagcaattgaccagaggaacaaaagcagcaaagtaggtagccttaccggagttattgctatcctagcaattacatcaaaacattcaaacattgtagcaacaccaacaatcaatgcattgcaattcacacacgtaaactag

SEQ ID NO: 71449 - DNA, 939 bp, Glycine max
  Peptide Sequence Number=SeqID_188227
atgcaaagtgggtcccaatctaaaccatttgatgtagaaataggagatggcttggaggacatgatttgtgaccttggacaagagtctttccagcaagcacacgcccctgtgtatgaaggattacagagtgattcaaagaagcctttgtatacggggtatttattagaggttgcagcagcacagaagcataaagcaaaaagggtggagagtgtcaatgctgatgcagaagcctttggtgatcaccgggaaagttcagattgctctatgcattctgaagctgaagcactagaacatatgaagaaaagagatagaggccatcaaagtgtgtcattggagaataagacaggagattcaactatggtcaagatgagtcagaaaaataataatgctgatgtcgacaactgcatgattcttgaagaccatgaaggagaagagcattgttgtggcaaaggaacaaatgcgaggagtgtttcttttttgccacgaagccaagagaagataggagattcggctaaagttatgataaaacaagacatgaagggaggagagcataaatatgggtttaacaacaataaacgtgagaagccaaagaaggtaagggtggtggatgatgaaactggagacaaacatgagttgtatgaagtcctaaggatgccatctagatgtagttggtctctagctttgttgggtgaagacatgaaacatataagctacatcttcattgtcttgaagttccagactttgggtgcctacctctctcaggctggaaattcattcactcaagacatcggttatggatgggagaggttgcacgattgttactggcatctgtggcttgtcaaaaaaattccagttgtggggctgttgctttggtgtgactatcgtggtaatgaacagggaaggaagagtgtacggactacattttgggttgggcattaa

SEQ ID NO: 71450 - DNA, 495 bp, Glycine max
  Peptide Sequence Number=SeqID_188228
atgtgggacaatgtgggtgtcgagggagcgatttttggtaaatttcaggcaggaggagaaagagaagagcgatttcaggaaggaggacaaagagaagaaggagggcaagataccttattctggtataacaacaaaaatgacgatgtttcctctgaccatcgaggtggtgggtttgagttatggaaccagcaacaactcataggccagggccctcctcctcaaccgcaacctctctttcaccaagatctctactccgcactgggcgttgggcccagcaagaccatctcggacgatcagtcgtggtcgagatccaggttcatgcttggtagcgtagtaggaggagggattagctgtcaggactgcgggaaccaagccaagaaagattgccctcatatgcggtgcaggacgtgctgcaagagccgcgacttcgattgccaaacccacatcaagagcacttgggtccccgcttcacgccgccacgaacgactacaataa

SEQ ID NO: 71451 - DNA, 231 bp, Glycine max
  Peptide Sequence Number=SeqID_188229
atgaagaagaagaaaacggaaacggtcggtgacgtgagagagtctcgcgttaatgcaggaagaagaagcaaaaagcctgtgaggaagaacagaagaaaaccgcaggaagaagaaaaggaaacacaggcagggcgggagagagagagagtctcggtattgtcaacgtatagggccgaaaatgatggttttgatgcgcaagttgaggggaaagaaaatattgaagtggtttga

SEQ ID NO: 71452 - DNA, 107 bp, Glycine max
  Peptide Sequence Number=SeqID_188230
atggaaaatggtcctgttgcgagggtagcctccaacgccttggtgtcagctactgtgatctctattatcatcaccgtgttgacaccactgtacccattgaagacact

SEQ ID NO: 71453 - DNA, 228 bp, Glycine max
  Peptide Sequence Number=SeqID_188231
atgaatgctctcctagaacttaagcttttgcatcctagaaaaaccatgatttgtttgcagcccaacctcattacaagccaagaaaagtccttcggattcaatttgtgtgtttgtgactgtgcaaagatgaagaataagaaggttgttatggctggtgtctcgctaagtgaggcttgtgcgtttagcgagaatcatccgctaagcgaggcactcagcctgcttagctag

SEQ ID NO: 71454 - DNA, 405 bp, Glycine max
  Peptide Sequence Number=SeqID_188232
atgaagaagatccaaggcctacaagctccacatggagctacatcagccttaaggaaatataccaaggatgaaggattcagaagagaaaagtctctggctcttagtagtcagaagaacaagaaggcatcatcacccaaagaacaagtcttgagaagttcatccaaagcgcttaaagtcgaagatgaatttgatgatgaatctgaagaagactcagatgaagatgagctttcctttatctctcataaaatcttcaagatgtggagaaacaaaggtgggtccaagtggagaaaaccttcaagaaaaacgcccagagaaaagaaggaaaaagacaatagctccatagtttgctatgagtgcaaaaagtctggacattggatgtccagatatggagaaaagtcaagataa

SEQ ID NO: 71455 - DNA, 213 bp, Glycine max
  Peptide Sequence Number=SeqID_188233
atgagccataggcgactatatcagagcagaatgaaaaatacttttgacagaagagtgcacctgcgtaagttcagcaaaggggatcttgttctaatgaaagtgtcacaggttcaaaaggatcaccgaggaggagctttgttgcttatgaacatgggcgatgaagagctgccttcacctgtgaattccgatatcgtcaagcaatattacgcgtaa

SEQ ID NO: 71456 - DNA, 207 bp, Glycine max
  Peptide Sequence Number=SeqID_188234
atggcgcaggaagccaattgcccctcatatatattgtataatatcttttttatcttagctttatttgaccaatgcttagggttgaacaaggagtctgaggcttttgcagaaaagctttttgatactcttgctaggcagagagggttgataaagatgcagatggcagaatcaccgaggaagaaattaaagaggtacaatacaaaataa

SEQ ID NO: 71457 - DNA, 428 bp, Glycine max
  Peptide Sequence Number=SeqID_188235
cacagcttatcttggatgccatctaccattttgtaggtatcgcacctccaagacacccagtggacccagaaaagtccaacagggcactgggattcccagcattgatcctaggtctctgccagtcctatggggtactgggacaggaccagcagcaacaatcggttgcagacttaccatcgccacctccacatcagccaccatctctagagtccatctctgctcacatacagatgatggagctctacatgcagcatttggctaaccacccttacctgtggcctactctcgagcagttcagggccaccgttgcatggccttgggataggccaaatttttcggcaaggggaggtcccaccgaggtcctaggagataaagatggagctgaggaagacgaagacatggtagatgtgatggatttcttcctttga

SEQ ID NO: 71458 - DNA, 150 bp, Glycine max
  Peptide Sequence Number=SeqID_188236
atggagattgtcgataataattattctcaggacttgaagaaaaacgagggttttcaagaaagattggtgaggagtatggatttggggtttctaggatcatggcatcctgaaccagttatccagagtgagaagctcaagtggcatgtatga

SEQ ID NO: 71459 - DNA, 1600 bp, Glycine max
  Peptide Sequence Number=SeqID_188237
atgactgattattggagaaatattggtttctttatatgtgttttatcaatcttcccccttgtgtgcttctgtgccacctttgttccagtagataattatcttatagactgtggagcaactgcaagtacttcagtaggtacacgcaatttcatagcagataacaacaaggatctcctttccacacaagaagatattcttgccactacctccttaaaatcagttacttcttcctccgatgatttgcctctctatcaaactgcaagagtcttcactggatcctcaaagtacacttttaaaattaagcagaaggggaggcactggatccgtctctatttctttccatccacttatgaaaagtacaatttgagtgctgcagatttcactgtttccacccaaaaccatgtccttttcagaagcctcaacatgcagaaagatcctgtgatgaaggagtactcagtgaatgtgacctcagacacccttgttctcacttttaccccttcaggaaattccactgcttttgtgaatgccattgaagttgtttctgtccctgatgacctaattgttgatgatggttttgccttagatccatcagtaacctcttctgggttggtgacacaagcacttgagacagtttggagggttaacatgggtggtcctactctgacccctataaatgacacccttcaaagaacttgggttccagatcaaagtttccttttggaacccaaccttgcctcaaatttttccaatattaagggtgttaaatacgagaaccgcgggcaagcaacagaaaacactgctccgcctaccgtttacgggactctcacacagatgaactcaagcaatgatccccgtagtattttcaatgtgacatggcagtttgatgtgagtcccggatttcagtaccttgttcgacttcacttctgcgatgtagtcagtaaagctctcaatgtactcatcttcaatgcttatgtagactccaagctcgctgcctccagtgctgatcccagtactactagcaataatgctttgggtgttccatattatagggatctggttacagccgtggcagtaagcaaaacacttcgtgtaggtattggtccttcagatctaaataaggattaccctaatgccattttgaatgggctggagatcatgaaaatgaacaattctatgggtaatcttataccaggagcaggatctgtggctattacttctggctcaagttctaagaaaactggcatgattgtgggtgtgagtgttggggtggttggtgctgttgtcttggctggacttttctttgtactatgcaggaaaagaagaaggttggtgcaaaggcagtcaaagacatgggttcctctatccataaatgatggaactacttctcataccatgggaagtaaatattctaatggcacaacactgagtgctgcttcaaactttgagtaccgtgtcccttttgtggcggttcaggaggctacaaataatttcgatgagagttgggttattgggataggtggtttcggaaaagtgtacaagggagagttgagtgatggcacaaaagtggcagttaagagggggaatccacggtcccagcagg

SEQ ID NO: 71460 - DNA, 420 bp, Glycine max
  Peptide Sequence Number=SeqID_188238
atgtcgagcttacttaattcttctctgaacgggtctgcttctaatcttccagatggtgctgggcgatcctttgctacgtctttctctggttctattcagggattgcacaacattcatgggagctttaatgtacccaatatgcccagtacacttacgtcaagaaactcaacaataaatagcgttcgaactgggggaggagttcaacaaccttcggcaagcctttcaagtggaagatttgcatctaataatctaccggttgctctgtcacagctatctcatggaggctcccatggacattcaggagtcaacaatagaggaggtataagtgttgtaggaaatcctggatttaatagtaacacaaatggagttgctggtcctattcctgggattcttccaacttctgctgcaattgttaactga

SEQ ID NO: 71461 - DNA, 156 bp, Glycine max
  Peptide Sequence Number=SeqID_188239
atggatgagccaaataatagaagggaaagtcgtgctcgtgccttccggtgtgaaagagaagaagaacagaaaattacaatctcaagaaagacaagctcattgcatcagctaagagcaactgatgcatctccgaaggaggagaatctaactcagtaa

SEQ ID NO: 71462 - DNA, 512 bp, Glycine max
  Peptide Sequence Number=SeqID_188240
tgtggaagcaatgacttccaagattattttgatgattccaaagaatcaagagttaagcaagttccaaagaatcgggcttcaagaatcaagtctcaaagaatcaagattcaagaacaattaagtttcaagattcaagaacaatcaagatcaagattcaagactcaagattcaagattcaagattcaagagaagttgatttcaagattcaagagaaggaatcgagaagcaacagtcaagacttcacaagggaagactaaccgcttgagaattcttagtcttaacacattggaggatacatcctttgtggcacaagtaaagggtatatctacttgggttgttatactgagaacaagagagggtacatctcttgtggatcagttcaagtggaggatacatccacttggttgttcaaagagaacaagggaggatacatcccttggatctttggtttgtaaaggattttacaaggttgaaagaaatctaaagaaccgttggttgcttggggattggat

SEQ ID NO: 71463 - DNA, 449 bp, Glycine max
  Peptide Sequence Number=SeqID_188241
atgtctttgaaagagaagggcgctaatgttcaggtcctcctctgttgtagtccatttagtggtcgtgttatagagcatcgccgacaagtaggggtggaaatgagtgtagaagcaagcttcatgattcaagaacaattcaagaatcaagagaagtttgatttcaagattcaagaaaagatgaagtcaagtttcaagagaagaaatcatgaagacttcacaagggaaggtacatcctttgtggtacaattagagggtacatctacttgggttgttgtaactgagaacaagagagggtacatatcttgtggatcagttctactgaagggtatatccactaggttgttcaaagagaacaagggagggtacatcccttgtggatctttgcttgtaaaggattttacaaggttgaaaagaaatctcaaggactgcaggtcgcttggggactggat

SEQ ID NO: 71464 - DNA, 720 bp, Glycine max
  Peptide Sequence Number=SeqID_188242
atggtggttgcgcgagggagcactctcaatggtggctcaagggccgacggtggttgcatgaggaaagggtcacgatgttggggacacaagggaggggtcgtgatagtggttgcacgagggaagggccgcaatggtggctcgaggggtgatagtggttgtgcgagggatgggctgcaatggtggctcgaggggcaacggtggttgtgcgagggaagggccgtgatggtggtgcatggagtcgaccaaacatcaaagcaatattgggcaaggataaaaattgcgtacaacaatgatgatgtgtgtcaaagtgagaaattttttgaaagaagctggactcaaatgaaatattggcggaacaggatctaccctccaattcaaaagtttaacaagatacttggtaaaaaatttgaggttgagcatgcttggttgttgttgaaagatcaaccaaaattcaatgcagaatttatgtcaaagtgttcaaaaagaacaaatgtttctgctagtggaaattactcattgtcttctaacccagagacacccattgaagtcaaagaatatgatacgtcatcaccaatgtctcgcccaattggacaaaaagcagcaaaaaggaagagcaaagaaaaagaagcttctaacactctcgatttatctgacatggaaagtgtaatgaaggacaaaaatgtgaacacatcaaaacttattcaggtaaaggaggcatag

SEQ ID NO: 71465 - DNA, 612 bp, Glycine max
  Peptide Sequence Number=SeqID_188243
atgattggagatgctctaaggaagcttagtgggaagttgctgattactcgggactggcatgaagttaccgaggattggcagcagctggcgaactgggtgtttcttgatttggtcgaggagttgaagaggaaattagtggacatgtattgtggagtacctgtggagaaatctggtaatggagctggcatggaatctattaaagttatggctagtgttgacttaagcttgaccttgcctgataagaaaattgttgtgcaaaaagaacctgttcctcctggtaaaaagatctcacctgagttgcaagaagaaatttgcccctatggtacttgtaaagtagtttcagttgaattatgccctgatgttgttgttagggaatatctacttgctcccaagcaagcaaatagggcattatggatggaagaattacaaaaacatcttgtatgtcttggatggaaaattgagtggtcaaataaaaataatgtcaaacgttacggttatgatgttcctgataaaaagggccgaaagctttacctttcactcattgaagtttgtagagttatggaaaaagacctcaacatgaatgtgaacgtactcctcgcagctccaaaatga

SEQ ID NO: 71466 - DNA, 393 bp, Glycine max
  Peptide Sequence Number=SeqID_188244
atggatccaaacattgatttagatgaagttttgaatcaaatgatagatgaggaattggaagacaaccctgacaaagaaatcattatattgatacttgagagccaacaacaactacatggcaacaccactaggtgtaggcaaagaagaagagtggtacatcggaatcgtgaaaaagacacgctaaacaatcatgatgagtactttcaaatgagggtcgatgcactgtgtcgaaaaggcctatctccattacagaagtgcacagctgctcttcatatattggcttatggctcatctgctgacaatgtgaatgaatatgttcaaattggtgaaacaactgcagtggaatgcttgtcgcgatttgtatcaagcatctacaccatatttggaaattag

SEQ ID NO: 71467 - DNA, 210 bp, Glycine max
  Peptide Sequence Number=SeqID_188245
atggcttggacaggtaaaagccggtcattggaagcaccaatgaggagagtacattgtatggtttttagtcctgtggaaaagggaagagggagaccaaagacattggagaaagttgttaaaggagatctcatggtgaataatatctctgaagatttggtctttaaccaagctgaatggcatcatgtgatccatatagttgatctcacctag

SEQ ID NO: 71468 - DNA, 300 bp, Glycine max
  Peptide Sequence Number=SeqID_188246
atgaatacaaggagagcaaaaagtgacaaaaaaaggcaaaaagatcaagaccacacaagggagtctatcctccaagacggagtcaatgggataaagaaccttcttctgtgccatctcgtggaaaaacttcttccacgggaagccacggaagaaggttcttccgcagttgcaaataacaatagcgaaagaaccttcttatgtggattcatgcggaagaccttcttccgtgagatggcacagaagaaggttcttcccctgttgttattttcaactgcggaagaaccttcttccgtgagttaa

SEQ ID NO: 71469 - DNA, 144 bp, Glycine max
  Peptide Sequence Number=SeqID_188247
atggagcaacacaaccagaaggagaacacgcaaagcccaggtgaagagcacttccaccatgccgccaacaatggtgaagaagcaagaaccacgccgccgggaacaatcgaggttgcggaagcaagaaccacgcgcaaaaaataa

SEQ ID NO: 71470 - DNA, 1638 bp, Glycine max
  Peptide Sequence Number=SeqID_188248
atggcaacaccagcgatgcaggcagtaaacaccccaaggaaaaaaatgacaaaacaattgacaggaaaaagggatgatacacctttgcattctgctgcaagagcagggaagttggctgtgttgaaagatatcattttgggaactgatgagactgaattgcatgagttattagccaagcagaatcaagatggggaaacgcccctttatattgctgctgaatatggttacgttgatgtagttagggagatgattcagtattatgatcttgttgatgctggaattaaggctagaaatggttttgatgcattgcacattgctgctaaacaaggggatttagatgtactaaagattcttatggagggtcatcctgagttgtcaatgactgtggatccatccaacaccactgctttgcacacagctgcaatacaaggtcacactgagatagtgaaattcctattggaagcgggaagtagtctggcaaccattgcaagaagtaatgggaaaacagctcttcattctgctgcaagaaatggacatttggaggttgtgaaagcacttcttgagaaggagcctggtgttgcaacgcggaccgataagaagggccagacagcacttcacatggcagtgaagggacaaaaaattgaggtggtggaggagttgataaaagcagatccctcattaataaacatgcttgatagtaagggaaacacagcattgcatatagcaaccaggaagggcagagctcagattgtaaagttgcttctagaacagaaggaaaatgttacaagtgcagtgaacagatgtggtgaaacagcagtagacactgctgagaaaacaggaaaccatgaggtgcaagccattcttcttgaacatggtgttcagagtgcaagaaccataaagccccctcagggcacaacggctaccacagctcgtgagttgaaacaaacagtaagcgacataaagcacgaggtccatcaccagttagaacacacacgccaaaccagaaaacgcgttcaaggcattgccaaacgtataaacaaaatgcatgcagaaggactcaacaatgcaataaactccacaactgtggtggcagtgctaattgccactgtggcctttgctgctattttcacagtcccaggccaatttgttgatgacccaaataacattcctccgggaatgtcccttggtgaagcaaacatagccccacaagccccgttcatcattttctttgtgtttgattccattgcactgtttatctctttggctgttgtggtggtgcaaacctcggttgtggttatagaaagcaaagcaaagaagcaaatgatggctgtgattaacaagctcatgtggctggcttgtgttcttatttcggtggcgttcttggcactgtcttttgttgtggtggggaaggaagagaagtggctggccataggagtgaccattatagggacaaccataatggctacaacgttggggactatgtgttactgggtcattaggcatcgcattgaggcttcgaatttgaggaacattcggaaatcttccttgcaaagcaagtcaaagtctttctcagtttcggccttttcagattctgagctactaaacagtgagtattataagaaaatgtatgcgatttag

SEQ ID NO: 71471 - DNA, 501 bp, Glycine max
  Peptide Sequence Number=SeqID_188249
atgggtgacccaagttatatgagtattttagttcacatggtgttgagatcctactttcagaacaattgcccccaaatcgattgtttctttgtaaaggttgtcgaacttacatgctataacaagacattggacgattcacctgacttagtccttatcctaatatcaatgttccagaacaataaccattttggcatagtggtggcattgggtggttgtggtggtggtgttgggtgtgttggtcatgaagttttgggggagaagcaactaggctcgtggttgacggctaaaatgtgccaagaattgctaggggcacccaacaagattgctgttaatgttactgtgaaagaaccttcttttgtgccatctcacggaagaacttcttccgtaggaagccacaaaagaaggttcttccgtagttgtaaattacaacagcggaagaaattcttgtggaagaactttttctgcgagatggcacggaagaaggttcttccacagttgtaa

SEQ ID NO: 71472 - DNA, 174 bp, Glycine max
  Peptide Sequence Number=SeqID_188250
atgagatggaggaaattggggatggagaatgggggaggagaggataaggacaattgttgtgtcgatgagaacattggtgatgatggtgtcagtgggtctgtgtttggacaagaaatgacgtttttgctgaatctgatagaatggagggggactgaagaagaaactgtaggatag

SEQ ID NO: 71473 - DNA, 822 bp, Glycine max
  Peptide Sequence Number=SeqID_188251
atgggaggtggtcgagtgtatgtggcaggggtgtgggctaacgaaagcaccattgccaaagggacttcaaaccatggtttcaaggaggcttcaaaagtaggatctggatccatagcaagaaaaaagggtatcgaaagtgcaagagagatgaaaaggcacttgcaagtgcatgtgcaacgtgctaacaaagtgggatccaaaggcatgagaaagtgggtattgaatgatgtagatggagctttggaaatttggtgggcattggaggcttatccccatgattacgacggcgatggcaaatgtgaccccaatcatggcgggtgctcttacgcgcatagtaaggattcagagtcatgcaaggctgtttgtgattccagcggatgcaaaagaaatctggttgatgctattggaatgcttttgaaggacgaaagaggggttgtagagcacatcgtagaagtggcgataatttaccatgacgactctgacaatggttgtgacttcattggagtgagttttgccgccaacttcttctctaaagatattggcggcatgatgatggatgaagagtttccacgataccgaacaagcttagcaatcggttccaggtgctctaaaaatcaaccccatagtatagagctagatgtacataagaagaacatgggtgctgaagcgaaaggaatgggtcacactgttttgagaggctgcaacggcgattgtggtggccaccagggagagaggtgggaagcagccacgagaggcaagcaggggagtgggctaacaaaagcaccattatcaagagaagagctattctaccgttactcctaa

SEQ ID NO: 71474 - DNA, 510 bp, Glycine max
  Peptide Sequence Number=SeqID_188252
atgacgtcatcggcgatctccatcaacggccgaagacactcaggcgcgaacttcctcgcgaagagatacagcggtgtacagatgcgggtgcccgtcccagcacccggtccagttgacccgggtcagtgtaaacccgctacacccattcggatcctgcatggacaaaagggtgggaaaataatgctcttcggggtaacaaggttcttctgtgacacacggaagccgaaacttgttccaaagctttatatcacgcaccaccgtgcgcgcgtggcggcgagtgaggatgaagaactgcgaccccacgcggaaggaggagaagggtacttctgggagcatcgcgtgttcgccacgcgcggtgtagcggtcgaagaggttgggttcgttggagagaatctcaatgaagcttttatgtgggtgagtggggtttttgaagagaaagttgtgagtgaattggagggagtgaagagggatgcagtgctgggagagaagggcgaagtagtggttgagggg

SEQ ID NO: 71475 - DNA, 585 bp, Glycine max
  Peptide Sequence Number=SeqID_188253
atgagagctagagctagttctggggatcttgtgaggattgggaacagtaatgaaatgctaaattctgtgagtggagttctccgcaccaactgcattgactgcttggaccgtacaaatgttgcccagtatgcatatggtcttcaagctttaggacgccagctccatgcaatgggtttgactgatgttccaaaagtggatcctgatagtagtattgctgtagctctactggatatgtatcaaagtatgggagatgctcttgctcagcaatacggtggctctgatgctcacaatactgtgtttccagagaggcagggaaagtggaaagcaacaacacaatcaagagagtttttaaaatctataaaacgatactatagcaatgcttacacagatggttacttccaaccacatgaagggaaacctgctctctgggagctggattcagattattatatccatgaatctgggattggggatgatctaattcctgagaagtgttctgaaccaaatatcagtccttctggaagaggtggaatggtattcatgcctataccagcttgtagagatgacttctctcgcataaagtag

SEQ ID NO: 71476 - DNA, 666 bp, Glycine max
  Peptide Sequence Number=SeqID_188254
atgatgtacgagcgagtggtggtggtgatgttgttgtcgttgttgcattttgcgtcgggagcagaactcgtgaaggagttgcatagtgctctgacgacgggcttccacaacgacgtcgtttgcctgtggaagaagagcttggtagccatttgggttttgctttggtggagatgggaacactaccattgggatatcaacactaccattgctttggtggagatggaaacagaggatatcaacgagggtggagaaaggaaggactttggttttgagtgtgtggaaggcagccaggaattggacgagggtttgtgcagcagccagaattatacgcttcccttcagtgatgtactgcgatgggagtcgttttcagtgcaggtggatgtttcagatattccaaggctgaaagaggtgcttagtgcatttccagagagcgagtacttgaaaaggggtgtgaatgatcgggggagggttggtaatgatgttgagacagagcagattgtccttgatgaagaatcaggctcttgcaaggggaagatgagttcagttgtgcaaatacgtggatcaatagcgcttttctggtcacaagaagcatcaacatttagccccaagcctgacataatttgtatgaaaacagttgagattaatatttatcctgttcattattaa

SEQ ID NO: 71477 - DNA, 369 bp, Glycine max
  Peptide Sequence Number=SeqID_188255
atggagcttgatagtatagatgaggtggatgattttgatgcctttaaacaaagaatgttaggaactggggacaagaaaccacccccacatagaagagctttactttttgtggacaatgctgaaaaaaaaatctacgtcggtgcttacgacagcaacgacgtagttggccatgcattcaacggcgatcgttgtcggtgcaacaatgtagtaaagggcgaagctgcaacttcggccgtgaagtcatcttcgtcgcaggaattgcgtccttctaaaaaggtgtttagagaccgtcgtagattggccggggtctacgacgacgtcgcctttaaagacggttgtgcaccatcgttgaacaccgacaaggactga

SEQ ID NO: 71478 - DNA, 600 bp, Glycine max
  Peptide Sequence Number=SeqID_188256
atgcactacgcccttcggccgaggtcacgggggtgcgacggagatgcaggcaaatggcagaggtcacggcgaggtcacgggtggctcaagaacaacgtcattgacattcaaaatttcaacgatggtgttttcaaaagcaccgtcttaacttacctgctgcgcaacctacaaagacaggcaccccggtcaacgttgttgaatgtgtcacgcgccatgcacatggcacataaaatggcatttgttagtgagtacgttgtttggcagggtgatgtcggaaatggaacacttttggctgcagtggctgaagctgcattccttattggattagaaaggaatagtcctttttcacaacaaagggatctttatgaacaagctattactccgatagttagtgaagttctagagggatttgattgcactatattcgcatattgtcaaactggtacgagaaaaacctacacaatggaaagggaatgcaagaaagccaagagtggtcccaatggagagttgcctttgggagctggagttattcatagggttgtcaagcaaatttttgaaaaaaaatatattttaaaacggttctttgaaaatctgttttag

SEQ ID NO: 71479 - DNA, 438 bp, Glycine max
  Peptide Sequence Number=SeqID_188257
atgcttgaacatagccatacttcaattgtggaccattatatgaatgagtggagtaatggattgggtcatcgatcggtgtatggattccttgagcctcaatctatacacaatgcaaaggacagacatgggcaatgtgaagaatatattgaaaaatggcttaaggaatcgcaacgacaactgtacataggagcttatttgaatgatgcatataagaaattaaacacgagtgctgatgggaaagttcctaaaactggaccccagtggcttgaactgaagactcacgttcaacgtggaagctatgagtgtgggtattatgtgatgcattggatgtggaacataattggcgcagagttgaagagtgattggagtgtgtggttcggtgatggctcggcactagacccagaggcgatcacaacattacataaaaaatgggcatga

SEQ ID NO: 71480 - DNA, 534 bp, Glycine max
  Peptide Sequence Number=SeqID_188258
atggaggaaggacctattgaggggcttgctctaaattttgtgaaggaccaacaaagaacaattggattttcatcaagaaatttgattttgaacaattgttttatgaagtccatgaacattttagtttgttttaatgcatttaaaaaactgttcaatctttcacacgagatcaatcatgctggtgctaggggattgtgggctgagcttgtgaggaatagtggttttgaagctggaggctctagtgatcccttaaatatttatccatggtctattattggagatgattcaaccatattcgtctcaactgattgtacctcttgctttgagcgaaataaagtcgcactaagtatgaaagttctttgtaatgaatctaatccttgcccatcgggtggtgttggcatctcaaatcctagttattggggcatgaagtataaagtagtcttctatgctaaagcagatggtgcaattaatctagaagtttcatttgttggatcggagaaaggtgaaaagttggcttcaaataacattaggtaa

SEQ ID NO: 71481 - DNA, 495 bp, Glycine max
  Peptide Sequence Number=SeqID_188259
atgaccaagagcaaggacaaggatccacttgaaggacttggaagacctatgacaagggctagagcaaggaaagcaaaggaagctcttcaacaagtgttgtccatactatttgaatacaagcccaagtttcaaggagaaaagtccaaggttcttaggcatcagcctttgggagaccaaatggtgattggctcgatggcttttggagtgacttttggttgccacaatttcagttacactcaaccattaagttcttttaattccctaggttattggatcattactaaatctaagtggattgtaattgcctttaatgaaacatatgtaaaatctgatgtggggctttcacaagtccaaatgcaagctttgacgcaacatttggagaggttaatgaagaaacgagatgatgcgctccatgagaggttggatcaaatggagaatagagatcataatgaagaagaaaggaggagaaaagggaatgatggtgttcctagataa

SEQ ID NO: 71482 - DNA, 402 bp, Glycine max
  Peptide Sequence Number=SeqID_188260
atggagtataaatgtggttatacttcgtccattgaggtggagtcactaccttatgttgttgttagacgggctccagttattgatactggacaatctcgttcttcttgcagtagttctctcctcttccatattgatccaagtgttaggaatttggatgtgttgattagggagagaggcttcttaaactatgttggtggtgggcttattggctgtggagtggagtggtctatggacgagtcttctgagactggactggaaaagagggtctggacgcttcatgcttcttctttgttcgttgctccttggcaacaatctcttcttcctcatcttactattggcttgcttcttggtctggaccttgcctttctgctccctagggatccttttgatcttattggctaa

SEQ ID NO: 71483 - DNA, 570 bp, Glycine max
  Peptide Sequence Number=SeqID_188261
atgggtttgaaggtgaaagaagtgatggagaacatcattgttgatcttgagtggggagtggtggtggtgattgggatggtggtgggaggtttggcggtggtgggtaaagggtgcaagagtggatggaacacttattggtggttgaggttggacgggtggaagcagcattggagtagcagcaacagcactgaacaaatgcatttgggtctgttagaggttcacaaggagagattcaccaagactattgaattgagtagtgatagcttgttgcatgaaaagttttccattgctagtctaatcatctccttgactttagtcttagtcacaacttctagaggagcaaaattgattggagtgggtccagaggttatggaatggatagtaacaaccattgtgtccttaaatgtggcttcatgtgaggttggttcaattggagtctcatctaccttatcttttgacttctcagcaactatgattggaatggaattaacaacttctagtgctttagcaactacaacaataggtttggaaactagcttgttaggtcttgtcttctcagcttctgcctaa

SEQ ID NO: 71484 - DNA, 342 bp, Glycine max
  Peptide Sequence Number=SeqID_188262
atgcctgatcaggctactgcttatccctttggacttcacatcaacaaatgcactaccatcaagatgatgcctaatagaattgcccaaggctactcatttgtgataagggaagaagaaggacttcaaggctcttccaactctaagaacatgcctgccacgaaccaaagggattccattcaagtgttgggtccaactaaagtgtaccactttgatgatgtaaacacttgttttatgaagaacgttgaggatgacatccttaagcatctgaagaagctacccatcatcttcagtcatcacatcttcgacctcagcaagataagcatggaggaattggaagcctga

SEQ ID NO: 71485 - DNA, 492 bp, Glycine max
  Peptide Sequence Number=SeqID_188263
ggatcgcacccacaaagacacccagtggacctgaagaagtccaacagggccctggggtttccagctctggttacgggcctctgtcggccctacagggcgcccgttccccccagcaagttcatgtcatcgtggcattgggatcgtgcccgcaagacatccagtggacccgaagaagtccaacagggtcctagggtttccagctctaattacgggcctctgtcatttctacagagtgctcatcgcccccagcaagggacttcatcgagaaatactgcaccccccccgcaggcgcaacaaggccaggcaccacaacagcctggggacgaccagcagcaggcaggcggccaaccacagggagcacctccagagcaattcgaggttgcaataacatggcccgaagattggcctaatttctcttcaggcacctccggagagggagacagcgcccagaaggatgaggacatggccgacatgttggacttcctcctgtga

SEQ ID NO: 71486 - DNA, 747 bp, Glycine max
  Peptide Sequence Number=SeqID_188264
atgttgtcatctataccctttgtcgaagactcaatgtttgtcgatagagactactttagtctccccttcatcatccagagacaatcaagtctgatgacacacagaggccaatgtggtcatctgctccctttgtcgaagcttttgcccgcaaaaaggttgtcgtcccttgcaacggacacatggggtgctaatacctttctcttgacttacggtgctgaacgtcaattacagtgcaaagcaaggaaccatttagtgtttcgatcaggaaggcaaaagatatcaagaaaggagggcaaaagggtcttttccttgcttttcctggaccctagctcgcccaggctagcctctagctcacctgggccaccaaatgacttcaaggttaagaaactagctcacctgggcaagctgcaattgccccaagtaggttgcaacaacatccaacagaaaaggcagaagaagttggccaaaactattgctagtgaagaaaaggcactagaaacctttggcttagccaataagatcaaaaggatccctagggagcagaaaggcaaggtccagaccaagaagcaagccaatagtaagatgaggaagaagagattgttgccaaggagcaacgaacaaagaagaagcatgaagcgtccagaccctcttttccagtccagtctcagaagactcgtccatagaccactccagtcaggagaaatcaaagacaaatttctgagcaagcctccaaggcttagaagctga

SEQ ID NO: 71487 - DNA, 621 bp, Glycine max
  Peptide Sequence Number=SeqID_188265
atggcgatggcggacacgatggtggcaatcttcagtggtcacgaggtaacgagcgcaagggagagaaagtcgcgaggagaaaaggttttcgacaagaatgcacaattcaaggatcaaaagaccataatgtctaaggtctttgggaagaagaaagttgcttatgaagagcaagttccaagagctttatacaaggagaaaagtgctgagtatgctggaacaaagaagcaactgcctttcaaccttccacgcatcgtcttcatcaacattctcatgaacttgaagacgctaggtggaagggatgacatattctatgcaaccttggtcaacaagctactttgggaacaaggtgtttaccatattacttctgatgaggacaaatccttgcatacatttggcattgctgaatgtgttaataggataatgaaagagcaagccatcaagaggagaacaaggaagcaggcacaacaaattgaacaagaagaagagctcctcgataaggaaaagaggacaaagaagagacatgaggaactagtggtgtccactctttcacgtccattacctactactgagaaactaaagactactccttctagaaaaagtccaaggaagctagtggaataa

SEQ ID NO: 71488 - DNA, 306 bp, Glycine max
  Peptide Sequence Number=SeqID_188266
atggccccaagaaagctcctcgcgaagaggtccaggaaggacaccaccggagagggctccagcactgccccgcaagctgacatggacttcgacaggcaccggttccggagcgtagaacatcagcagcgttttgagaccattaagggatggtcattcctcagagaaagacgagtccaactgagggacgatgagtttcctgactttcagggagagatagcccgcaggcactgggcaccgcttggaaatgaaacaccggaaagcgcaccaggtcgtcaacctaaagtactaaacctcgatccctcataa

SEQ ID NO: 71489 - DNA, 408 bp, Glycine max
  Peptide Sequence Number=SeqID_188267
atgtccttttatactcttatcttgagggttgtctttatagatccagcacggcaaagtcctgttgttataattcaaaggaacagggggataaactttgttgctattgatctaaacaagccactaccagaacaaggtcaatttggggatttaattgctgacttagccattgaagctactacaacagtaggtgttgagattgaccaagaaggtcccaggtgggcagctggagtattcgagagttctcaagggagtcatgataaaaaaaaagatgtggtttcccctggcaaaatgtccaaaaggttgttaacccacgcatcattcttcttgattctccccttgagtacaaaaagggtgaaaaccaaacaaatgccgaactgctcaaagaagaagactggattctcttattga

SEQ ID NO: 71490 - DNA, 288 bp, Glycine max
  Peptide Sequence Number=SeqID_188268
atgaggaaacaaattggtgcagctgcttacattgagtgcagttcaaagaatcaacagtgtttgacactgcaattaaggttgttctggaacctccaaggaggaaacaaatggcatggaagaaaagtcatagaaggtctggttgctcatttgtggactattattcaatggcggtcaaaaagagacccgtcgttatctgatgatgtcgtgaatacaacgacggtcacaaaccgccccgatgttgattgtcataattcaactacgttcataatccgcccgacgttgacatga

SEQ ID NO: 71491 - DNA, 399 bp, Glycine max
  Peptide Sequence Number=SeqID_188269
atgaaggaacttgaaagagttcaatttatagtggagcatgcaactgaacttatgtctttgtatgctgctgagagacaagcacaaatggaagccttcaccgttcctgaagacatggatcctaataatctaccctacattggaagtagagaacctgtgttcgaagtgtttccagctcgtcgaattgttcaaccaaaccctaactatcttatttttgaacataggcttaatgaaaggaaggtttatccccctgaagccatcatctggatgagcaatgaattagaacctgaggacatgtctttctcaactccattagatcttcaacaacttttggcacttatgcatgctttaaacattattcttccttgggatcacaataagccaagtgtgactttccaatag

SEQ ID NO: 71492 - DNA, 292 bp, Glycine max
  Peptide Sequence Number=SeqID_188270
aacttgtaaaggttttttgcaagttagtggaaccctcaagcgggttgcttggggactggacataagcacaaggaaaagggaaatcacattcctcttgaccctaagaagaaggagatccccagggaaaaaaggacggatgatcagaaatcaacattccttttcaactcacgcaccagaaacgccctactgtgcactctatcatagtaagaacattccaaagttcacagctttagaagtgccaaatagatctaggccactttggctattacctatgaagggtcctatggggtaa

SEQ ID NO: 71493 - DNA, 450 bp, Glycine max
  Peptide Sequence Number=SeqID_188271
atggttattatattgacacatgccagaataaaagatgtgcaaggaagttatccagcttcagtgagcaattccttcaaggcgtcaaaactattgattaatgatcctatattggaaattcaggaatttaaagagaggcttttagatttaggcgttgaggtgagtccagttttactacctggcgatcaagcaatttcacaagtttcagggggaagccaactatcatcaaaggattcgtttctttcgaaagctgaagtcaaaactatttctgagatcaatggcatttctgaggatgttgtttgtgttacggtgggcactattagcaaaatagtcatggataacaattcatggtgttatctagcttaccttcaatgtcataggaaaactgacatccaaacaggaccattcacatgcggatgtggcaaggataatgatcagcctgttctgaggtaa

SEQ ID NO: 71494 - DNA, 256 bp, Glycine max
  Peptide Sequence Number=SeqID_188272
cgttggattcccgcccgcgctcaatgtcaccgctgccaaagttggcaaattggagatcacgcttccgtccgtgagcaatgtacagatagagccaatcattgtgcaaattgataggctcaatttggttcttgaggagaattttgattttgagccatctgaaactcaacccagttgttccccatcaagtgccaccacaaagggtagcggctatggttttgctgataaggttgactctttcatctctaagtgtaaatag

SEQ ID NO: 71495 - DNA, 267 bp, Glycine max
  Peptide Sequence Number=SeqID_188273
atgcaaggttcattgaaaattatgaaattagtgggagtaaagtttcatgagatgtggaaattaaagaagttagagtgcaagtttgatgagaatcctaaaactacccaaatacagagtcctatgaccaggagtaggaccaaacagtcagtgaataccctccaacaaatggtagcagaaatacttaacgaggctcaaatggagaacgatgaaagctcaaaggcagagacactactaagaatatcaattgttgctgaaggccaagactaa

SEQ ID NO: 71496 - DNA, 288 bp, Glycine max
  Peptide Sequence Number=SeqID_188274
atgttagctattgtcaccaagtaccaagaagaactaaatctagtcacggcccacgagcttagagtggtggacgagtatgcccaagtgtacgcggaaaaggaggctagaggaagagtgatcgactcgctacatcaagaggcaacgatgtggatggaagagcttccccgactactagctaaggccaaggcaatggcggacacctactccacccccgaggagatccatggacttctcagctattgtcagcatatgatagatctaatggcccatataattagaaaccgctag

SEQ ID NO: 71497 - DNA, 411 bp, Glycine max
  Peptide Sequence Number=SeqID_188275
gatgcggcgaggaagagaaacgggttatggagcctaggcgttgcttccaccgtcacagcggtcgctgcatcaatgcttgtaacaacagcaactgagatgaggctagacggtggcctcccccgcgacggttttggccggagagaaacgaagtgtgataggaaggtaacgggaaggagagaagaaggaaataagagaaaacaaagggtggcaaagcttccagctgtggacggtgagagaggagaggggcttgagaaggtagaacggagaggtgttgcttatggtggttgggttgtggcgttgggaataggcttgggttcagctgctaggatttgcggagatgtcggagaagtggtaggcaaatttgcttccatgaacaaggtaatggtgggggaagatggagggaagagatga

SEQ ID NO: 71498 - DNA, 1137 bp, Glycine max
  Peptide Sequence Number=SeqID_188276
atggggtacgaaattatttttaagcacttacgttggcctaattactctcattttggcatgttgagttgtgcatgcttccctgcagttgaacctggtggaacttacatttcccaaaggtttgactgtaaaagcttgaaggaaaacttggataggcttcgcaggaattcattctccttcaaggttaggtcagctagccaatctgccccactttttgttgataataagcgtgattctagcgaaaagctgagacagatgcggcaaactttatcacggaagttcaattcatatgtgctgcctacaccagttgatgggaagagttcaatatctttgaggtcaagtaatcaagtaccttcaaaaataaagacaaatttaaatgagcctgtgaagaatttgtggcattcatccccactggaaaaaaagaaatatgaaaacatttttggagatgggggattttctggtcctgatgttaggactgcacagtctgtactgaaggagagtaacagcaatactgcctactcaagattgccacctcctttaatcgatggtaatttatcctcaaatcatgattatattactgcttactcgaaaaagatcaaaagacatgccttttctggtccattggtaagtaatgcatggccaaccaagccacctgtctcggttaaaagtgtccaattgttttctggacctcttttacggacctcaattcctcagcctccatcatcatctccaaaagtatctcctagtgcttctccccctctttcatcttcacctaaaataaatgagcttcatgaacttccaaggcctccaaccatttccccatccaattctaagtttttaggtttggtgggtcattcaggtccattggtgtcccgaggtcaacagctttctgccccaaattattttgctacatcaaatgcagcatctccattgccgatgcctccttcagccatggctcgaagtttttcaatacctaatattggggataaagttacagaattacatgagtcaagaccagaagaagcccctaataaatcaacaatatctgaggatattgattctcctcctctgatgcaaattgctttatctactagtcacccatcatcagatggctcggacactgttgctcaggctgtctag

SEQ ID NO: 71499 - DNA, 762 bp, Glycine max
  Peptide Sequence Number=SeqID_188277
atgaagaggtctcttagaaagttgggagttctggcagtagagaagcatgagcgtgaccgcagaaacattatgcctttgtcccagctagaggagctcgctcaggctacccagaattctcagagtccttgggagatttgggctcttgccttctggagaaaaccgccttgcatgacgacgaagaaagcgcgctctcatatcacccagacaattaccattccttcggactctcttctcaatgaacttcgaattgttgaggagatgaagcaacaatgtgatgaaaaaagagaagtatatgagtccatgttaacaagatatagagaaagaggtaggtctagaagcggaaaagcagagagtatttccttgcagcagttgcaaattgctcgtgatgaatatgacgtggaggcgacattatttgttttccgcttgaaatctctgaagcaagggcaatcgtggagccttctaacacaggcagcacgtcaccatgcagctcagttatgtttcttcaagaaagcagttaaatctcttgagactgcagagccacatgtaaaatcagtaacagatcagcatcacattgattaccacttcattggtattgaaggagaggatgaggatgaagatgaagatggtgatgtagatcatgacgatgagagtcatgatgagaatgatgatggtgagctgagttttgactatgcacaaaatgaatgcgagcaagatgtttctacatttgagaactcaatgaaggtaactgactaccttctataa

SEQ ID NO: 71500 - DNA, 569 bp, Glycine max
  Peptide Sequence Number=SeqID_188278
gctatcctatgagaggtgcaccgtcagaggagatcatcgcacctttcatcgcatggggtttcaatgaaggcaatgccaaaatacttcaaagaatccgtaagctcccaaagccaaaaagtctaagttggaaagaagctgaagtccctgaggaaagcgaagaagtgcaagccttgaaagtggagcttgaaaaaattagagcagtcaaggaaaagctaaagacaacaatcactagggtcaagaaagagtgtgatgagctaagaaatgtcaacatgactacgatcgaagcattagagcgggaaacgaagagggcccgaaaggaagaatggagcaggaacaagttccgaagggctctatggggcagtagcaacgagctcaagcttagaagggccgaaagggatgagtcaagggtggaaaacatggagaaggtaaacctagctgctattcatgggcagagactagaggatgagcatgcaaaggttcgctctcactctgaatgggggtcaagagcttccaaggttattagccagagccaaaggcaatgggcagatgtatactcgactcctgattga

SEQ ID NO: 71501 - DNA, 1719 bp, Glycine max
  Peptide Sequence Number=SeqID_188279
atgtgtcatccaactcttgacgtcaccagcaattgcaaatgctgcagcacttctcctcctgattgcccaatttcaatcaaggaccctttgatctccaaaaatcaaaacaacaacacatcatcactaccaccacctccaccacctcaacaacataacaacacaacaacaacaacaacaaaaacaaaaacaccaccaccaccaccaccaccatcaacaacaacaacaaaaacaaaagcaacaacaacatcaaaaccccataatttccctgaatccatcaaagaagtgttctcaatatccaaaattgcaatcccaatgatcctcactggcctcctcctctattgccgctccatgatctccatgctcttccttggccatcttggtgagctagctttagctggtggctctctagctgttggctttgcgaacatcactggctactcaatcctctcaggcctagctgtgggaatggaaccaatttgtggccaagcctttggtgccaaaagattcaccctccttggcctctgcttgcaaagaaccattctccttcttcttttcacttccctccccataacacttctttggctctatatgaagcaaattctcctcctttgtggccaggatgaggccatagccacacaagctcaacaatatcttgtttactccattcctgacctcatagctcaatccttcctacaccctttgagaatttacctcagaacccaatccattaccctccctctcaccctttgtgcaagcttttcaatcctccttcacatacccatcaactatttccttgttgctcacctcaagcttggaatcaaaggggttgctcttggtggggtgtggacaaacttcaaccttgtggcttccttgattctctacatagtcttctctagcactcacaagaaaacatggggtggtttttcctttgaatgtttcacacagtggaagtctcttctcaatttggccattccaagctgtgtttcagtgtgcttggagtggtggtggtatgagatcatgattttgttgtgtggtttgttggtgaaccccaaggctactgtggcttcaatggggattttgattcaaaccacttctttgctttacattttcccttcttcattgagcttcagtgtgtcaacaagagttggcaacaagcttggtgcacagaagccctcaaaggcaaggctttctgccatcgtggggttgtcttgcagcttcatgtcaggtgttttggcattgttttttgctctcatggttaggaacacatgggctagcatgttcacaaaggacaaggagattataactttgacatctatggttttacctataattggtctttgtgagcttgggaattgccctcaaacaacagggtgtggggtgctgagaggcacagcaaggcctaaagtcggtgctaacatcaacttgggatgcttctaccttgtgggaatgcctgtgtcaatttggttggcgtttttcactggctatgattttcaagggctctggcttggccttcttgcagctcaagggtcttgtgcagtgaccatgttggtggttctttgtagaactgattgggaatttgaggctcaaagagctaagaaactcacaggaatgggtgttgatcacaaccatcatgaggttgatgatccagagaagccactcaaacatgaaagcaaggaagattctttgctgctagctgactctgatgaaaatgaacagtga

SEQ ID NO: 71502 - DNA, 255 bp, Glycine max
  Peptide Sequence Number=SeqID_188280
atggacaaaggtttcttgggtgaagaagaagacgacgattacaaggacctttacaatgacatcgacgttggcgaagggctccttcaatcgttgcacaagaacaatggttcgaggttccaaaacgacgatgtcaaagaaaataagcctttgttgtcgctaccgattccgaatgccgctggggtttcgattctgggtatcagtggtggtgtagagggtgttgatggtggtggaggaagcagagttgtggaatctagg

SEQ ID NO: 71503 - DNA, 1338 bp, Glycine max
  Peptide Sequence Number=SeqID_188281
atgaaagaactcggcgttgctcaccagcattttgctggctttgaacggtttcagctcagttgtaaggctgccgtattcgttatcccagccgtaggtgtcatcggttttaccctgcgtgacgcgtccgcctggcatcgccaccaatgtattggccggtaccgaggcacgatcgtggcgcgcctgcggacacgccggccagtgcggctgcggttttacccactcaagcggcagctggcggatcagcacgctggaggtttcaaggtgaatacgctcatgctcaatgcccatcagaatcacccacgccgggctgtcccagtcaatcggcagatccagcggcatggtgcggatgaattcacttaccacggttttcactttgccgcggtagtcgcgcacctcggccacgtccggccagctgtaatggctgtcgtcgagatcgtcccagctcatctcatccacgccgatcgccatcatcgcctcgatgcgatcgtcaatgcgctgctgcagataaccgcccgccatcagcttattaatgtagaaagtagcggtatggccaaagtagaagatcagcggatggcgcagggtgatggctttattaaagtacgcgcgctcatcggcgaggcagtcgaacaggctttcatacagctcccaggtctgggtgaaataggccagcagttcggcgcgtttggcgtcgctgctgctgccggaaagccggacggtgcgggtgggcgcaggcaattgatcgtgaagatgagcggttgtcacagtgaactcccgtttccagcggcgcagcaggcggcttttcaggccggtatcgaagcgccagatgtgatcgaaaatgcgcagaatgccgggtttgccgtgcgccgacatcgccacggcgtggaagcgttgctgatggtgacgctggcgctgtttaatggtgctgacgatgtcgtccggcagacgctgggcgataaaatcggaaacgatcaccgcatcggcttcctgccactgactgccctccatacgcgtgaccaccgcagacaggcaggcggccagatcggtgccgccgcgaaaacgctggctgagaaaacggattgcctgctcgatgccgttatcagcggtcagctcatagccaatcacttcgtgagcaaacagcatgatgtagcagcgccgcctgtcggccagcgccaccttcagcagcgccagacaaaacgctttggcgcagcgttcattgaaaccgcccatcgaaccagaggtatccacgcagacgatgaacgggccgcgcggctgagcttcgtgctgctgatggctggccgggcgcagcgtcactttctcgtgccaggcatcgccctgtaa

SEQ ID NO: 71504 - DNA, 516 bp, Glycine max
  Peptide Sequence Number=SeqID_188282
atgatgaaaccactagctgatgccattagaatcattgaagacatgtgctctaactcctacaacaattatggggatgggagaatcatgaagaggaaaattgagaaattaaccagtctaagccgaaggaagcggcttgttcagctgagccgacgccttcttgggagcggcggtggcagccgcagcagcagccgctgccttgagttgctaggcggcgatgagttgagaaaggtcctcagcgttgtcacccaacaaatcaaaagggttcatggttgccatatctcagaattttttgttttcccaactccaaaacgacaccgtaggttcccaaacacaaggccgcaactaacccttgctactaaacacggaacatatccatcagagatcaaagagaagaagaaggttgaaggaatggagaggctgaaagtgaaaaacccaaaccctagccgcaataagagagaggagagtgagtgtgtcagagaacagacagggccacctaatcttttattcaggacctag

SEQ ID NO: 71505 - DNA, 195 bp, Glycine max
  Peptide Sequence Number=SeqID_188283
atgagaaaaccaggaacaaatgtatatagagcacctgagcttatatttggtgcaactgagtacaccacgaccattgatatctggttagctggttgtgtacttggtgaactattgcttggccagcctctattccctggtgagagtggagtagatcaacttgttgaaattaccaaggttgtttgtagacatccataa

SEQ ID NO: 71506 - DNA, 498 bp, Glycine max
  Peptide Sequence Number=SeqID_188284
atggcatcttcccttgtgctttcacataaagcaagaggaactctttctccaacccacggtgggcacaacccgagatcaaaactttcaggattctcaaccaaacgcttgaagcaaaccctaaccatgtcggggtacttatcgaaaaccctcaaaacaacggcgattgccttcttcctaacgaaaaccctagtggtggagagcaatttgaaaaccaaacggggtcaaatcgggagcaaggtcgagagtggcgatctagaggtccttgtggagctggttggtgatgaggagcactggagtgtcgtcgtgctaaccgatcctcttgtgtgcgtggagggagatgatggtgtttcaaacaacggtgttttggtgcggcggtggggtttggaggaagagttggtgggcaaaggggaggaagagccgggtgtcgtagagccggtggaaggcggaggagacaaaggggttacggaggaaggagccggaggaaggcggaggagatga

SEQ ID NO: 71507 - DNA, 515 bp, Glycine max
  Peptide Sequence Number=SeqID_188285
ggaagctgtctgcagggaagctaagtgtgaagtatgcaatcctacataggattggcactgccaactgggtacccaccaatcatacttccattgttgccacagaatcttttgctgtcaaattacccattgccttcccaactgtattgtgtggcattatgttgagtcaacatcccaatattttaaacaacattgactctgtgaagaagagagaatctcctctatccctgcattacaaactatttgaggggacacatgtcccagacattgtctcgacattagggaaagctgctgcttcaggtgctgtgtccaaggatgatttgattgctgaactcaaggacacatgcaaggtgctggaggcaaccatcaaagccaacacagagaagaaaatggagctggaacgcctggtcaaaagactctcagacaatggcgttgatgatggagaagcagctgaggaagaagaagatgcagcagaggatacagaatcagatgatgatgattctgatgccaccccatga

SEQ ID NO: 71508 - DNA, 330 bp, Glycine max
  Peptide Sequence Number=SeqID_188286
atgtcacaaaatgtaacattttttacctccttcttaatcttcctctccttcctcctttggttcttcaacggacaaatcaaaattggttgcactattgaaaatggagaacacggttgctgggttgaatgcattgagcatggcgaacacggtggtaacgacgacgcacaacgcaagagcgcacttgaagaactgcgagcgcatggcagtgcaggtgaggatgatagggagttaggcactgaaatcgacggagttggcgcagctgccgacaacaaaggaaccgttctcaaagaggctttgcggaaagttctggatttggtggaaagttgttaa

SEQ ID NO: 71509 - DNA, 1545 bp, Glycine max
  Peptide Sequence Number=SeqID_188287
atgcgaagaactgtgatgctcaacatgttgcaaactcgtcacccccaatttctagcgattattccctttctctttttatatactttgacatgctccgaaaccgcaacaaccacttccatcccacaagagcttcacataggcttctcggcgacggcagagtcttcaacgacgccgtttcaggcagttctgagcgaccatagtggcaacttctctctaggcttcctccgcgtgaaccaaaaccagctggcactggcggtcctccacgtggcatcctcggagccattctgggtggccaacccaacccacgcagcatcctggtccgacaccacgcgcctcttcttcaacggcagtcttgttttgtcagaccccgaaacgcgcgtttcgtggtcaaccgccacaaacaacggcgaccgcgtggtgctcctcaacacctccaatttacaagttcacgacaaaggcggcactcccttgtggcagagttttcactttcccgcaaataccctcgtccaggaccagaatttcacctccaacatgactcttttgtcctccaacggcatttattctatgcggttaggcaacgatttcatgggcctatacgaaaaccacgactcgttatattggaaacgcacgccactgggagcaaaagcggaagtaaaggaagggcagggaccgatttacgcccgagtcaacccggagggttacctcgggatgtatcagacaagcgacgagaagcccgcggatgttcaaaagttcaacacgttccaactaacgtcgtcgtttttgttgctgcggttggaaccggacgggaatctgaagggttattactgggacggttccaggtggatgcttaactaccaggcgattactgaagcctgcgagctcccccgctcctgcggttcgtacggtttgtgcacgccgggtgggtcaggatgctcctgtttagataaccgaacccggttcgaaccgggtgggtgttttaatgatgcttcttctggagacgcagacttgtgtagtagtgaaggaattggtggaaaaagtagttactgggtgctaagaagaaccggagtggaggcagcgcataaggagctactaaggcacgtaacgacgtcgtctctggcggagtgtgagggattgtgccagaacaactgtagctgttggggggcgctgtatagcaacgaaaccgggttttgttatttgttggagtatacgatccagaccttgctgggtaccggggatggatcaaaagtgggttatttcaaggttaagaaagaggaacgaagaacgaaacgggtttggatacgggttggggttgtggttacggttttggttggggttggggttattattattggggtcgggttttgcgtgacgagatggaaaaagaagagaggggtgaaggaagaggattggggttcgcccggcccgtataagaatctcgaatccgcaagttttagatccattgaaatgagcaatagtaccggattgtgttggttttctcaccaaccaggggcgcaactctcgcaagtggcggtttcaaaaacatga

SEQ ID NO: 71510 - DNA, 498 bp, Glycine max
  Peptide Sequence Number=SeqID_188288
atggctgaaactcactcatttactcacactcccttaatcacacccactatcagccccaccagaagcaaaccatgcaaccctccagaacacagcatcaacttgatggttgtgttagcagtcatagtgtgtgccttcctatgcgctcttggtctcaacacaatgctgcaatgtgtgttccaatgtgccaatcgcgttctcacggagccccttcagtggattgcctcaaggaggctcaattctggcctcaagaagagagaaatggtggctttgccaacctcaacttacactcattcttgtgcctctccatcttcgccctccaataatatttgtgccatttgcttaacggaattctctgatggggataggataagattactaaaacttaagatgattttgattccagagactcatcaagatctagacgaatctcaaggtttcaaaagaacttacatattacctatgatcaataaagattctcacctcgacaacaaaaattaa

SEQ ID NO: 71511 - DNA, 1266 bp, Glycine max
  Peptide Sequence Number=SeqID_188289
agtgggagagtggtgtacccagttgagtatggtgcagaccctacaggggcacaagaaagcagtgaagcaattctaaaagctgttggagatgcttttgggattctgagtgaacttgagttggtggcaggagttaaagaccttggaggggttgtgattgatcttcaaggtggaaactacacaatcagcaaacccatcacatttccttcatccggtggtggcaatattctggtaaaaggaggaacattgagagcttctgattcattccctactggtcgacatctagttgagttatgggctccaaattcccaaaagcttccaaaaacatcagttttgaacagcataaaacttcagcaacctaatggcatttactatgaagacataacatttagggacatcctctttgattctagctacaagggtggagggatattcattgttgattctgttagaacaagaatcaacaactgctttttcttgcatttcaccacagaagggattctagtccaaggtggccatgagaccttcataacaagcagtttccttgggcagcactcaacagttggtggagatccaggggagagggatttctctggcactgccattgatcttgccagcaatgacaatgcaatcactgatgttgcaattttctccgcagccatagggattgttcttaggggtcaggccaacatgctcactggggtgcattgttataacaaggccacaggctttggtggcattggcattttggtgaaactagcagggaattcacaaactagaattgataattgttacatggactatacaggtatagtcatggaagatcctgttcaagttcatgtcactaatgggtttttcttaggggatgctaacatagttttgaagtcaattaaggggcaagtttctggtttgaatatagttaacaatatgttcactgggaaccccaataataaggttccaattgtgaccctagatggccaattcagtaacattgaccaagtggcgattgataggaacaatgtgattggcatgagcttgagatcaacagttgggaagttaactgtgactggaaatggcacacagtgggtggctgatttttcaaacgttttgctattcccaaataggattagcaattttcagtactcattttatgcacaaggggagccaaagtttttggcacattcggtcaccaatgtgactaataatgttatagttgtggaaagtgagaaatcagctcaaggggttgtttccttcttcgttgaacaatga

SEQ ID NO: 71512 - DNA, 420 bp, Glycine max
  Peptide Sequence Number=SeqID_188290
atggatgccagagatatgagtgattttgaatcagggtcttttggtgctgttattgacaaagggactcttgactctatcttggtgagtgtagtgatggtaatgctcattggaatgctttgtggaaataattcaaggcagaatgctacaaaaatgcttgaggagatttggagggtcctcaaggataaaggagtttatgttctggtgacatacggagctccactatatcgcctgcgtttgctacgggaatcatgctcttggacaataaaacttcatgtgatagagaaacttgcctcagaagagaaatctgataatccagtttgggagctgacaaaaccggttccactcaacgatgatggaagctctgtggaggaagccctaggacagaatccggatgtccattatatatatatttgcaccaag

SEQ ID NO: 71513 - DNA, 357 bp, Glycine max
  Peptide Sequence Number=SeqID_188291
atggcttatgtttcaaagaaacgaagttctgccatgaattcttggcgtttggggcaataccatgcaactgcttttgctgaaccaagtacttgcaatgcatattccaaagcaaatactggttccagtgcatgtatcggccaatcagggttcttcagatcaactgtaattcctgaatcaactctaaaactgacgggaccaacgatctgcaagatacacataaaaggtgttttggttaacattatggcaagcattaagaaccaaatgcttgaaaaattttgtagtgcaagattagaatcatcatatcagaagagcacagatagaacgagctggaggacgagaccacgagaggcaggatag

SEQ ID NO: 71514 - DNA, 495 bp, Glycine max
  Peptide Sequence Number=SeqID_188292
atggggggggtgaaggaggggagtgaagttaagttaccagttatcagaaaaggggagggtgagaagacggtggagagagaggccgtggggtttggcgcaggagggaatgagaggggcgtgcatgaaacggtgcatgaattggagctgtctgggtctggaaagccttgtccctcgcgagagagacaagggaagagggtctccagggacgggacatgccaacccatcaagggtttggggagtggaaatgtccaaatcccagaaccctcctccgtccattacccatctcagttttctcgtagtcatcacacttcaatccaatggaaatggaatggaatcaatcaatcaatcaatcaattgtttcttcttcttcttcttcttcttcttcttcttcttcttcttcttcttcttcttcttcttcttcttcttcttcttcttcttcttcactcactcttctactatcttttttcgcactcactcttcagtcttcagtcatag

SEQ ID NO: 71515 - DNA, 822 bp, Glycine max
  Peptide Sequence Number=SeqID_188293
atggtgaggataaggcaaaatgcaaaagtgaggaaaagaaaatggaagggttccaaccccatgcatgcattgtggaagaggatgaaactactaatcatgtttcaaagaagcagaacaaagagaatttctcatgaaaatcacgcgcagaatacagcctctggaatgccagaaagatatcccagcagatttggagacaaatctactggtatgtccaataagagttcagatgtaatgccagagaataaagttgaaaatgtggttgagttgcatccaaattcgatgcaatgcagtctcagtaagatgtctacacaagtgatatcagtcacaggtataatccataaatatttttcaagtttcaatgggatcgacaattttagcagctcttcaaactcagatattacatctaaatctattcatagtgagattgaagttcattcaaacaccagagaacacagttgctcaaagagacaaagcgattccttgccacagttcactcccaaaacacccccacatgtcttgcatgctccatttcatgttgaatcggtttccataaaatcagggtgcaaaaatagaaaatcaaattttgggaaacatcttaaatcaggtggcaaaaatagaaaatcaaaagttgggaaacatcttctatcaggggacgaaaagagagaatcaaaaattgggaattgtcttcttgccgcttcacggagtcttggggtttctatcactaagcatgatcctgcactttctttctgcagatttaaggatagaaaactactgcaggacaaatctcaaatgaaggaagggtttgatattttctatcagtga

SEQ ID NO: 71516 - DNA, 942 bp, Glycine max
  Peptide Sequence Number=SeqID_188294
atggtggctgatattcaggtgagatttttgcagaggtttttttcctctgttaagagcagtaaggagaagccaaaggagctttcctcttggctgaaaacctttgggagacatctacaggataaatccttgtatgcgttgggtatctcttcagagttccagttagggatggatgatactttactttttggcttagatgcatatgaagatacagaaaagcctcgtgggaaagcagtctttcatcataagtttccagatcatgatctaacagttgaggcagtttatcctggactttttgttgatacgactggtaattactgggatttaccattttcaatggcagttgatcttgcttctgtgactaccagtgattcttccaccgcttaccatttgtgtgcacgctacacttcggggtcacccaagcagtttgaaaatgttcaaaatcaaaatgatagagtaccaccacctactctacttcctggcttggccttcaaaagtgccttttcttacaggaaaaaagttgatatttggagaagtgaagctaaaaagttgaaattggtacaaccgtatgacatatttctttcgaatcctcatgtgtcagcctcggggattattggtgctgctgcaaccactgcttttggggataattcggcaagagcacaagtagaagatggtagtccaggattttttctccaggcttctggaataaagtcttcctttctggcagatatatttgcatccgtttcatttacagcccaacatggaaatttccaaaggctttttctagatcttacccgatttcaggcccgactggattttccttctggtttcaaatttctttcagccgcaactggtttaacacaagatcttctcaattctcaaaagcccagcatggatgctgttcaggcgattatacccaatgctacactatcacttcagcagcag

SEQ ID NO: 71517 - DNA, 336 bp, Glycine max
  Peptide Sequence Number=SeqID_188295
atggacggtgctagagcgggcctcccttcactaatttatatggcagttggcaaaaatctgccacgctattctgacatggcaccgccatttaataaaactgtttggaaggaagttgaaatggctggagaggtaaaatgccataagtatagtcgacgacgcccttcagatggatggacttttacagtagagaaattgggacatcagggaaagcgtggaggtggtggtggctggaagtttgctagcatgccagatggatcaagccgaccactgaatgatatggagaaaatgtatgtgaagcgagagacaccacgccggcgacgcaggattcttccttga

SEQ ID NO: 71518 - DNA, 705 bp, Glycine max
  Peptide Sequence Number=SeqID_188296
atggctgccattactgatcaatggatgcagttctatcaacaacctctaatggatagccatggccatgatcatcatgctttggcaccaatttccacagaattaggcttctctgatgcaaccgtgactacgacaactagttctcccacccccaccatgccatcatcagagagcaatagcatcttgagccaattgagtccaaagggtaatgtgtccaaaccaataagaagaaggtctagagcctctaagaaaaccccaaccacactcctcaatgccaacaccaccaattttagagcattagtacaacaattcacagggtgtcatagcacaaccatgccaacactaggggtccaaaagggccctattaccttgaatttccaacaaggaaatagtagtggacaaaaggtcaccactacacaagtagtaggcaacagcaactacaaccaggttcatcaagtgccttcaccgtttccaaatgggcagaagcaagaagatgaagaacaacgacaactgcctcagcagagtggttactcttttgattatgtgaagaacagtggttttcttccaagttcgggtaactcaataaggcctaccactactagcatggatcatgtctctgatggtttgctcttggataatgattttaacttggctgatctaactgttaattgcttccccaatgataccttttataagagtgaattatag

SEQ ID NO: 71519 - DNA, 177 bp, Glycine max
  Peptide Sequence Number=SeqID_188297
atggagagggaagcggcagactcggatcctgtcgtccacgaaaaagatcaaaatttaaacgcagagaaatggtcccatgtctgtgtacaaatgtggcctaaagtgaaaccaccaatggaagacagccgagtttgtcttgctgatgcgtgtatagtgtctccgatgctacctttttga

SEQ ID NO: 71520 - DNA, 1743 bp, Glycine max
  Peptide Sequence Number=SeqID_188298
atggaggaccatcatcgtcaccatcatcagtatggcatcactgatctgaggcaactcgttaacggccctcggccgactcatttccccaccatgccgccaccgcccaaggcggagctgttccccggcgactccaacctgcaggctgcgacacaacaacactacgagatgatgatgtttggtcgtcaagtagccgacataatgcctcctcgttgtcttcatgacttcgcctccaccgattccgccaccaacatcgccgttgccactcccaccaccacccctagcgcctccactcctccgcttagttgcttagaggccgagaccgcaggatgcatcggtggagacgcctccactggaagatggcccagacaagagactctcactctccttgagatcagatctcgcctcgactctaaattcaaagaggctaatcaaaagggtcccttatgggatgaagtttctaggaacatgtctgaagaacatggatatcaaaggagtgggaaaaagtgcagggagaagtttgagaacctgtacaaatattacaagaagacaaaggaaggaaaagctggaagacaagatgggaagcattacaggttctttcgtcaacttgaagccttatatggtgaaaacagtaaccaagcctcggtgccagaaaccaattttggcagtggtagccttcgtttccacacaagcagccacaataataacccttctcaaacaaatcaagaaatgtttcagtctcagaagcattgtgacagcctaagcctcaccaactccactgatttggacacttcatcatcggatgacaatgatcaaaatagcactggcagggaactcaacaaggacaatgactccatggagaagaggagaaagagggtgagtggaagaagctggaaggtgaagataaaggacttcattgactcacagatgaggaagctggtggagaagcaagaggagtggttggataaactcacaaagacactggaacagaaggaaaaagagagagtgttaagagaagaagagtggaggagacaagaatctgtaaggttggagagggaacacaaattttgggctaaagagagagcatggattgaagcaagggatgctgctttaatggaggctttgcacaaattaacacgaaatgagataatgaagagtactcattctcacgagggtctaatggtaactggaattcaaatccacagtgaaaaccagaatgaagatgggagtgaaatactaaatagcactgctgccagaggtgctgaaagctggccagaatctgagattgcaaggcttcaacagttgagagctgagatggagacaaggtatatgcaaagtgggttttcagaagaggttatgtgggaggaaatagctaccaaaatggcttgttttggttacgaaaggagtgctttggtattcaaagagaaatgggaaagtataagcagcaactatgcaaggagtgccaaggatggaagcaagaagcgcaaggaagactcaagaagttgtttttacttcgataacagtgaccaatcttctctgtataaccaaggaggtgcctattgtgatatcaatgatcaaaggcacgagactgggaggctgcaaacaaatgacggttcttcaccttccaattcaaatgttggaaatgcagttgcgggtgataactgctttcccttcttgatgactgagggtggaaatttgtgggagaactatagcttaaaggttaataaagcatgccaaaaccagtga

SEQ ID NO: 71521 - DNA, 318 bp, Glycine max
  Peptide Sequence Number=SeqID_188299
atggctgaaagacccactagtagctttggcgccaacacggagaagaacccaaaggaggaatgcatgacgacaaagaaggagagaaaaaggaaaaagataagaaggaagaagagaaataaggtcttaacctctaagaccaaaagccagctagctcgagtggctaggaaagaagagccatcagcccctctaaaggagcccccatatcctttagttcaaggggctaaagataaccatgccatttggggaagccttgcagtagatgccactctacgccaaattcatgaaggacatcttcaccaagaaggggatgtacattga

SEQ ID NO: 71522 - DNA, 294 bp, Glycine max
  Peptide Sequence Number=SeqID_188300
atgtcggcgacaccatcggtgaagccacaaaagaggaaggatggcgcgttgaagaagagggagggaggagagaagtcgtcgttgcatgtagtgtcgttggtgagggagcattgggtgaggcactatagaggcagacttggggaaactaaatgcaaaattgcagtatgcattgtattggccactagggttgactctgctcttgaggacttcaaaattgaatatggcaccttatccctacttctgtcagcaacgatggcatcgtcattgctgaaagcaagagctttacatccatga

SEQ ID NO: 71523 - DNA, 1014 bp, Glycine max
  Peptide Sequence Number=SeqID_188301
atgaatcctcaaggtgactctgatggtcaaactaataccaacaacagatcaaacaacgaaaacgaaatgatgcctctttcaccatttgaaacattggagttgcttcctttatttccgctctcaccagaaaatgcagggcaagtagaagatatgcctggagccgatgatatggctccattgctcggacaagagagtaccatgtttagacaagttggaacttcggttgggactccttcatttaatttgccccagaggctcaatcatttagagccaaggcaattagtatctggatatgaggacgataatggtagagttcgtaatgaagcggttgtgtaccaccttctgaatgaccaagctggcccttcaactttgagaccttcacagtcacaaagattgaactactctggtggagcaagtagctctagaactcataactatcataatcaagtgcaagtattaggaactggagttccaccttacgtccaacatggaccctcgttgtcaccactaccatcatatccttctgcggaagagagaagaaggctttcatcttacgttcactctatcctagaagctctacgcagtggtccatccgctgtaatgtttgatatagattttgacacaatggaattcaggagcatcgaccacgcacttgtgtcacaatatgggtttcagaaccccgaagaatttgatgcattaccccagggacttactgtcgaaacgatcgtgcagcacctggagagtgaaacttatgtgattgttaataaggatgctccagaagaagataaggaaaaatgccccatttgtctggaagagtttgaagagggaaacttaattgggaagcttcattcttgtatccacaagtatcaccgtcactgcatccgacagtggcttttgtgcaggaacttttgcccagtgtgcaaaagagttgggctggaaaccaacaataatgttaaaagtgaagctacagcagctgaagttaatattaatgaaaatgacaatgacaatgtttag

SEQ ID NO: 71524 - DNA, 482 bp, Glycine max
  Peptide Sequence Number=SeqID_188302
atgttattggtgttgtggaggaggttgtctttcgccaagtttcaggaaaaggtagaagggtagtctttaaactaaaggacttgagccagcaattgctatcttgcactttgtgggatgattattgcttgcagtttttaaagttcttagatgattatgaaggtgatggcccaattagagttctattgacccatggtagaataaaggaagctcagggatcttatcccccatcggtcagcaattctttcaaggcttcaaagttaattattaaccaacccgtgatggagattcaagaattcaatgaacggcttgcagagttgggcattgaggcccgatcaggttttaaatcccatggtgaagggagtacacaactttcaggttctatccaattatcatcaaaggaatcattctttgggaaggctgaggcaaagactattgctgacattaataccatctctgaagtaatcatcttatatagattttaa

SEQ ID NO: 71525 - DNA, 225 bp, Glycine max
  Peptide Sequence Number=SeqID_188303
atgtggatttatataagagaaaaagaatacacttatagagctttatacaacaaaaggacttgcagcatatatatagcacatagtaaaaagcaacagcagcagctagcagctcaaaccctacctaattggtgggacgaactgaagcaaaacgctctccaactccaacccagttatccaacacacaccaccaagctgtcttacaccctaatccttcacacaccgtag

SEQ ID NO: 71526 - DNA, 369 bp, Glycine max
  Peptide Sequence Number=SeqID_188304
atgttgttcaagccatcggaaacaggcaaatgtgaatttcttgtgaagttgaaagaagaagcaagctatgaagggagcacaaagttgattttgccgaggcctgccatgccggtgacaccatcagtgaagccacagaagagaaaggaggactctttttatcttggtgaatctaacttcaaattcatattgttgcaaccaacccttcggcgggagggcgaggtgagactcaagagtgcgtcttcaaaaggaaaacgcgtgggagttaccaccaatgtttgtttgaggaaaacattagaaaaaccaaaaagggggtctgtgaattttaagaataagggttcgggagttatttacgcatggggaaggtattag

SEQ ID NO: 71527 - DNA, 450 bp, Glycine max
  Peptide Sequence Number=SeqID_188305
atggaggccatgaaagaagagatggccacaatgatggaggccatgatgagcatgaagaagataatggaggtcaatgcgactgcagttgccgctattagcgttgtttctggggtggacccgactcccccgtcttgcctcaacctaataaatcatccaaccgcggatacgggagacccccattttgtgcaagcccagaacaagcaggttttcccgccatatggtttgcctccaaactatactccacccaatgagaatgtcaataacttcacttctatacccattgagagccaacaacctcaatctgatcatgcacatgtctctcaacccatgggtgagccacatgaaatgcgccaccataatctagccgacttccagccttgcttcagatatgccactgaagggcaagcagttggtggtatacccctgcaaaacactttggaaggcccttag

SEQ ID NO: 71528 - DNA, 327 bp, Glycine max
  Peptide Sequence Number=SeqID_188306
atgcaaaacaatgacagagcctctgaatcacacgcggcacacactggtgaatatgcagcatcaacttcaactaattggtacaatttcagctccaatattccctacttgcttatacagagcaagggcaaccaatataattcttctcataattgcacgtcatatccaaccacaaagaagcgtttaattctaagcaaaagggtttattcaactagaactcgtggtcgttctggtcccctacagtcactggctcgaaaacttggtcgattcaaggtccgagcagtaattgtagacgacattgcaagcgaggaaagcaatagaaaaagatga

SEQ ID NO: 71529 - DNA, 429 bp, Glycine max
  Peptide Sequence Number=SeqID_188307
atgaagaagatccaaggattcgcacttggattgagggattcgcactacctcctgagccttaacttggtccttctgctgctcgtgtcagcattaagggaagttgtgtcaatccctcaaggcaagaccctgacacgggtgactcaaagaaatgtggcttgtgtgtcgacgagaatcctccccacttggtttcccttggaagaatttatgaggggtcgacaaccgtccacaacgtccctttgggcaatgatcaagtcaaggcatatgactgagacaagtatgcgagcgggtaatgcctctgtgtatggattccttaagccacaatccatacaaagatctggacaatcgcaatttgaatcagaagattatattaagaaatggatgcataattcacatagagatgtctacctaggagcctacttgaatgagtaa

SEQ ID NO: 71530 - DNA, 255 bp, Glycine max
  Peptide Sequence Number=SeqID_188308
atggttagaattgatgcaaattttaaggaaaaaactagtatcgatgagttcaacatcttttttgagggcggtgagggtgaagatgcagctagagggagggagtggaggcccgaagaaagggagagaggcttggaggaagaaatggattgcagttcgtcaggtgaaggcgatggcgaagaagagcgtggggcaccagagaggggtgtaggaattaagggtgaggaggtgggaaagtcatggggcatagttcggtga

SEQ ID NO: 71531 - DNA, 477 bp, Glycine max
  Peptide Sequence Number=SeqID_188309
atggagaacttggaacatggccatgggatacatcctaattggtctcctacctgtggtctaattctagatcaaattaggcaaaggagaaataattttgtgttcctgggatcatggacaattgatataacgatccaaattcttgtgctccaatccttgagctaccttaaggcatcctttgtgcttgatacaatttgttcaatgacttttgtccaaatggaggttgctagtggttcatcatggaaatttccaagcttagtgtggtataatattaacattgatgatgttgttcatatttctgataatgaagccgattgtggtgaagttatctgtgaccatgagggacaatatgtgttggggttcaaggtggatcgtggaaagatttcagtggttaatgttgaactgtggggtgtttttcatggcgccaggctcgctttagacaaaggaatgaacaatactattgtcaaaactgagtcttaa

SEQ ID NO: 71532 - DNA, 381 bp, Glycine max
  Peptide Sequence Number=SeqID_188310
ggtttgattttggatcttgttactggcttcgacaaaggaaaccttggtgtcaccattgatgaaggagatctggttgtcatggatctagcgcctcattgttgcgttgtacgcacacattgcctcctatgtcgtgttgaaggtgcagtggcaacattgccctatgtagctgtgtatcttcgtcgaccacctcccccatggaaacttcctcactcttcgctaggtcttgctcacgtacgacacaccatatgtcttctatggagtctcttaaacatgcggcgacaacgtgattcagaaaaaggatatgctctcccatcacagttttgtagcgtagcttctgtgatgggtgtaacatctccccaagttccacttcctctgttgtaa

SEQ ID NO: 71533 - DNA, 318 bp, Glycine max
  Peptide Sequence Number=SeqID_188311
cattcgctaagcacaacactcagtggctaagcgcgagcaagaatccagaagaagatgagctattaggttcgctgagcgcaccactccagatcatcaagcgcaccacttcaactcatcttctaagcgaaagaggtggaggagacatcctcaccacttgtatttttgcaatctttcatcctgctcttctctgtgttgtaaaggaggtttccggactatggaaagctaaatcctctgttggatcttcccttggaaactggtctgattctaaagtccttgatagtacggggctaagttgttgtactgccacgaggaatcggg

SEQ ID NO: 71534 - DNA, 1257 bp, Glycine max
  Peptide Sequence Number=SeqID_188312
atggaggaagaagccaatcaccacgcaatagacatctcaaatataatagacagagagaggcttgcttcgatggagctcaagatttcggagaatcccaagtttctatgcaaagccgcggggaagagatcttgctgcatcttccgggtcccacagagcctagttgaggtaaacggaaaagcttatcaacctcgtatcgtgtcgataggaccatatcaccgtaaccaacctcgcctcaacatgatcgaggagcacaagtggcgttacctcggttcccttctctccagaacaaacaccatcggtttcgttctagaagatttgttcaaagccattgcacccttagaatccgaagccagagagtgctactccgaaaccatcaacctcgactctcacgacttcatccaaatgatgatcctcgatggctgcttcatcattgagctctttcgcaaagtcgccagattagtaccctttgaacgcgaagaccctcttctcaccatggtgtggatattacccttcttttacagagactttctcaagcttgaaaatcaaatcccctttttcattctgaaccagttataccaagttacaaaactacccggagaaaagtcaacgccaacactgtcaactctcgcgttgctcttcttcaacaactcgttgcaaaagccagacgaatccttgcaaaacgacgtgcagggaaagcatttacttgacttggttcgttcgagtttcattcccaaaaacgatgaagaaacagagccacgaaaaagagtcatgacgccaacgcacgtgatcctctgcgtgtcgaagcttcgtcgcgcagggattaaaattaatccaagcaaggaaagtgagagttttctgaacgtgaagttcaggcgcggcgtgattgaaatgccaagccttacggtggatgatttcatgagctcttttttgctgaactgcgttgcgttagagcagtgctacagcggttgctcgaagcacttcactgcctatattaccctcttggactgtctcgtaaacacgtatagggacgttgagtatttgtgcgatcggaacgtggttgagaaccaccttgggacggagggggaagttgcaagcttcataaacaacgcgggaaaggatgtggcgtgggctagcttcaagcacacttactttgatacgccctggtccttcatctcgcttctcgccgcctccattttgctgcttcttaccgtggctcagacttacttttcggcttctcagtattttcatcagacttaa

SEQ ID NO: 71535 - DNA, 369 bp, Glycine max
  Peptide Sequence Number=SeqID_188313
atgaccataactgctgcaagtgaaatgttagtcttaaatcaacttcctcaaccagaaacaccgccgaacatagatataccatccacagattgtccaccacaacaatcgattgatgagaattacgtccatgcggtgccagtgccaccaagcatcgcaaaagaagaagaggaaggagaaaggaaaatgacccgtgttagtaagcttgtgaatcgcgttttggacaagtacgagaaacttccggcgagtcttaaagaccacataaatttagaggaaatgttgggaatgaaaatgaagagacgtgttgaaacacaaaacaccacttcccgtggtcctcagcatcctattaatgagaagcttgagcgcttcaag

SEQ ID NO: 71536 - DNA, 735 bp, Glycine max
  Peptide Sequence Number=SeqID_188314
atggatggcaacattgatgttgccattgtgaaggagttctatgctaacctttatgacccagaggataaatcacctaagcaggtgagggtcagaggtcatttagtgaaatttgatgcagatgctctgaacacttttatgaagacccctgtgatcatagagttgggggaaaacctgcctgcctactctaggtttactcagttgaggccaaatccacaggaactagcagcccgattatgcatcccagggaaggaatttgagcttaatgctgatgggctgcccctgaagattctgaggaagaatctgaccactcttgctcagagatggagtgttctctcattctccaacctggttcctacttctcacacatcagacattacactggacagggccaggttgatttacaacattatccagaatatggacatgaacttgggacatatcatctcaagtcagatttccttgattgtacaacatgactcctcccaagagcctaagctagtagaggatgatgttcctcctgagccatttatcatcgagactaatccagtacctcaagaggaagcagatgctcaggagcctacttctccaattcctttctctccagcactagttattgatgattctcagccatctgtgccagcatcggagccagagcagcctattgttcaggatccactagctgctccggtgttggatcttaacgagcatgcaaaggatcacccacaggaggattga

SEQ ID NO: 71537 - DNA, 1680 bp, Glycine max
  Peptide Sequence Number=SeqID_188315
atgatgacaagtgctgggttgctcaattatatatcgggaaagggaagtgagagctacgtggcgtttggctcagagagagcttggacaaaatatgcaacatctggtctccctcactcactcaacattattattatggctcagaagtacttgcacgagctacttgaggaggatcaagaaccgttctttctaaacaagtatatttccgataggcgaacccagatgaagaggccttccccgaagacgagtctgcaagtgaagaaacgcaaatcaaccaatccaaacacaaacttcccgagaaatctctgcaaaagcgcttgtcttttctctctcacagacaccccagacctcagaaaatcaccactcttcgaattcacttccccagtcaaaagcccttgcaaatcaccaaacgctatttttctacacatcccttctagaaccgctgctctgcttctagaagccgctctcaggatccagaaacactcctcacatgttacttcaaagcccaaaacaaaagcccattccttcggcctcttcgggtcactgtacaagagactcactcaacggaaccagaaaaagcatgagatagagagtggtggaggcgttaagatttccgtgaaggatgttttgaagtgggattcttctgtggggcgaagaaaagtttctaaagccaacgggaaatgcaaggagcaagaagaaacagtgaatgtgaatgtgaatgtgaatacgtgttcttacaatggtagtagtgctctttggtcagagagcaatgaagataacaaatcactagacatggaaacctcaagtagtggctactactctgaagagattcacttcgtaaccaatcacaaacagtactccacgtgcttctgcgaaagcccgttccgttttgttctccaaacaagttccccttcctccggtcatcacacgccggagcttccctcgccgagtcgccacccaactgaggagaaagaaagtaatgaaggtgagagtgtgaagaaattcgaatcaggggaagaggaggaggaagataaggaacagtgcagtccagtgagtgtgttagaccctccattcgaggacgatgacgaagggcatggaaacggtgatgaagaagaagaggaggagggtggttttgatatggagtgcagttatgcgattgtacagagagccaagcagcagttattgtacaaactttgtagatttgagaaactggcggagttggatccagtagaacttgagaaaagaatgcaggaccaagaagaggacgaggatgaaacatttatggaagaggaacatggtgatgatgagaacaaccaagcatcatacaaagaaaatgacttcatagaactaattttccaagctctgtgccaatcaagggtccatgacagacagcaaatcccagaggactttaagaagctggtatctgatctcattatggaagaagagagagcacttgattccttagaagatagggacatggtgataagaaggatatgcaagaggctggaattatggaaagaagtggagtctaacacaattgacatgatgatagaagatgacttctctagagaggatggtgtgtggaggaaaaatatagagcagataagaaatatggctggggagcttgagcttgctatctttggctttctggtagaggaattttcagaggaactagtatgttaa

SEQ ID NO: 71538 - DNA, 420 bp, Glycine max
  Peptide Sequence Number=SeqID_188316
atgattggctttaaaacaccttactggcataatttatggcttctttcagggaaaacccttgctgtaaaatcttcccatgattctgattccttgtcttctgcgattgccgaatctgataaagtacttattcctcaagatcaagataactctgcatccttgacagatcaacttgaaactcctgatataacctcagaggatgcacagaatactatggttagtaccaaaattaacatcttttccagttattattgcacatatactaatagtatattactgctcttattttctaccgataattatcataactgccccctaactctcagttcccatcatcacacttctggtgaaaattcagccttgtcccttaggctgaaagtaggaaactggtacttcctcgttatcttttatccacttcagtag

SEQ ID NO: 71539 - DNA, 534 bp, Glycine max
  Peptide Sequence Number=SeqID_188317
atgcagagtgagaaccagaacaaccagttggtggtgcagaattcggggagcctgagcttcagcagccatttgtcgaaggaagacgaagagatgtcaaggtctgctctctccaccttcagagccaaggaggaagagattgaaaggaagaagatggaggtcagagaaaaggttcagcttcagttaggtcgagtcgaagaagaaactaagcgtcttgcaaccattcgtgaggtgaagaagctcctgatggaaacaactttggaatatcaggagcttgaagccctggcagatccaatgaggaaagaagttgcacttgttcgaaaaagaattgattccgtaaacaaagaattaaagccactgggtcatacctgccagaagaaggagaaagaatacaaagacgcccttgaagctttcaatgaaaagaacagggaaaaagtacagctaatcaccaagttaatggagttggtgggtgaaagtgaaagattgaggatgaagaagctggaggagctgagtaagaacatagattcgatgcaatga

SEQ ID NO: 71540 - DNA, 462 bp, Glycine max
  Peptide Sequence Number=SeqID_188318
atgaggaaggttcattacgagagaaggagttgtttcggagaaaaacgggaagagacgcagttctgcgatcgccacggaagctcaagttgtgcagcgaaggaaaaaccggaaatcgaattcccgagatggtgtaaaccatatttctttgttcttagggtttactctctggtagagaatgagattgagaagataataggatgttctctctcagaagcagaagaagaacagatccagagtttcgacgagtgtgttgagttcgagaaatggaaattatacggtgaagggtggcgctatctgggtggaggtgacaacgagagtccaaatagcatggcgatgggagttatggggcccactgggcccagttctttaattctgatcgtccattgtctctcccaaacaaataataaggccttgctgggatatgaaatgtctggctatggacgcgcctctttgataatataa

SEQ ID NO: 71541 - DNA, 552 bp, Glycine max
  Peptide Sequence Number=SeqID_188319
atggtggtgcatatgtgctccaacggcagcaagcttccagcaagaggccagaatgaggatggtgaacaaggtggtgggattggttgtgctacaggcattacttacagagagtgggcacctggagctaagtcggcagcattaattggagacttcaacaattggaatccaaatgcagatgtaatgaccaagaatgaatttggtgtgtgggagatcttcttgccgaacaatgtggatggttcaccaccaattcctcatggttctcgggtcaagatccgcatggatacgccctctggaatcaaggactcaattcctgcttggattaagttttctgtacaggcacctggtgaaattccatatagcggaatatactatgatcccccagaagaggaaaaatatgtcttcaaacatccactgccaaagagaccaaaatcacttagaatatatgagtcacacatcggaatgagtagtccggtgagcaagtttttctttcttaatgtgatattaataagtgagggcgagccctggtacagcggtaaagttgtgccttggtga

SEQ ID NO: 71542 - DNA, 270 bp, Glycine max
  Peptide Sequence Number=SeqID_188320
atgaaagagctcaacttaaccatgcctatcattggtgttgtccttaacaacatctacactcacaccatctatatcatcctcggtcacatcatcttcatcgattgcgaaatagagagatctggcttcgtctaccacacagaatcctcaaaggtgacaacgcgaaacacacggttcaagcaccacaaaaacgtgcaatttaggtgcgtgagcgatgcaactctctcagatgtcactgaggccaagggcggcaaccaaatcgttgcttcctag

SEQ ID NO: 71543 - DNA, 222 bp, Glycine max
  Peptide Sequence Number=SeqID_188321
atgaatggatttcttcacttaagcttgcatctgatgcatatggtcattggagaattaatgctagcattaaatgcacattgtcgcaacctacccttcggcgggagggcgacccgtgactcgcaggtgcgtcttccaagaaaggaatacgcccggagtcgccaccaacgtttatttgaggaaaacgttggaaaaaccagaaaagacgtggtctacgaactttaa

SEQ ID NO: 71544 - DNA, 213 bp, Glycine max
  Peptide Sequence Number=SeqID_188322
atggattttgtgggtgatgttagggaggtttttgtggttgattgggcatgctcgatcggatgggcgttgggcaggagggagatccgatattggccgagtaattgtattgatgcgggagatattgttatggttatggcatgggcatctccatcctttttcttatctccacctgttccagtcctcctattggcagcatttgttgaagcaacataa

SEQ ID NO: 71545 - DNA, 390 bp, Glycine max
  Peptide Sequence Number=SeqID_188323
atgcgaaaaataccaaaaatagcggccaaaagggttttttccttggttttcttggaccctagctcacccaggctagcctctggctcacctgggccaccaaataacttcatggtgaagaaaccaactcgcctgggcgagctcattgcttcaacactaagtttcagctcacctgggcgagctacctttgccccaagtgcccattttcctataaataggcatgctagggaggcagaggaagggttccaacattcagcattgagagattttgagagaaataagggagaagaagaagaaataagtgaaaacgaagtcgaggcgctgccgaatcatgattgtaatcaacctctacatcattcttcattcagtgttcttctttcgtcatccagttag

SEQ ID NO: 71546 - DNA, 1551 bp, Glycine max
  Peptide Sequence Number=SeqID_188324
atggtcctgccgtttcaacctctttcactcgcattcaatgacgtgaactactatgtagacatgcctgctgaaatgaaaagtcaaggaatcaatgaagatagacttcaactactacatgatgctagtggtgcttttagaccaggtattttgacagcacttatgggtgttagtggtgctgggaagactacccttatggatgtattagctggaagaaaaacaggtggatacattgaaggaagtattagcatctcaggttatccaaagaaccaagcaacatttgctcgtgtcagcggttattgtgaacaaaatgacattcattctccatatgttactgtgtatgagtcactattgttttcagcatggcttcgccttccttcagatgtaaaagcacaaaatcgaaagatgtttgttgaagaagttatggagttggttgagcttaaccaaatcagaaatgcacttgtgggccttccaggagtggatggtctatccacggaacagaggaaaagggttactattgctgtagaattggttgccaacccttcaattatcttcatggatgaaccaacatctggccttgatgctagagctgctgctattgttatgcgtactgtaagaaacacagtggacactgggagaaccgttgtttgcacaattcatcaaccaagcatagacatttttgaagcttttgatgagttacttttgatgaaaagaggaggacaagttatctatgctggacctcttggtcaccattcacaaaagctcatagaatattttgaatccattgcaggggttcaaaaaatcaaggatggttataatcctgccacatggatgctcgaggttagcactccttcaattgaggctcatcttggcatagattttgcggagatttacactaactctactctttaccaaaggaatcaagagcttatcaaagagctcagtactccaccacagggttccagtgacttgcgcttcccaaccaaatattcccaatcattctttgttcagtgcaaagcttgcttctggaaacaatattggtcgtattggagaaacccttcgtacaatgcagttcgattgttcttcacaatagccattgggataatgtttggtctaatcttctggaataaagccaaaaatatcaaaaagcaacaagatttgtttgatcttttaggagccatgtacgctgcagtgatgttccttggaacctcgaacactatgggagtgcaaccaattgttgacatagaaagaactgtattgtatcgtgaaagagctgcagggatgtattcaacattgacttatgcaattagtcaggtggcaatagaggcaatttattctgccactcaaacgaccatcttcagtgtcatcatctactccatgatggggtttgaatggacggccaggaaatttctttccttctactacttcatgcttatgtgtttgatctactacacattatatgggatgatgattgttgccgtcaccccaagttttcaaattgctgctgtttgcaattccttcttcttgaccatctggaacacgtctgtggcttag

SEQ ID NO: 71547 - DNA, 768 bp, Glycine max
  Peptide Sequence Number=SeqID_188325
atgttctctactgtgatgttcctaggaaccatgaacgctgtgggagtgcaaccagttgttgacatagaaagaactgtactctatcgtgaaagagcagcagggatgtattcagcattgccttatgcgctcggtcaagtggttatagagataatgtacagctcaattcagacggtcatgtacactatcatcattcattccatgatgggatttaaatggaatgttgggaaattcttgtcgttctactactacatgctgatgtgttttatttacttcacattgtatgggatgatgactattgcactaaccccgagttaccaaattgcttccatttgtatatcctttttcttgtgcatctggaacctgttctccggctttttcattcctagggtggaaatccctgtatggtggagatggttctattgggctactcctaatgcttggacgatatatggacttgttacctctcaactcggcgatgaaattgcacaaatagatgtcccaggagcaaaaagtatggggctgaaggaactcctcaaggaaaatatgggttttgactatgacttcctaccggtggttgctattgttcattactttgcattgaaaagtaatttaaatagcgcttgttgcacgtgttgctcagtgatggggaggtgcaattgttttcagaaccgtggagggtcattgaaaattgcctgcatgcagggaacagctcattatgaaaaattgaatactgctgatgctttaggacatcttatcaaactcaattaa

SEQ ID NO: 71548 - DNA, 1344 bp, Glycine max
  Peptide Sequence Number=SeqID_188326
atggcatccacatcagtgagaaatgatttggtcagcggaaaaagaaaccagcggagctggccctcatcgagtttcagagcagcaagttggagtgcatctccattcacaaagagtgctggacgcagcagtggagaggataatgaggaggatctcaaatgggctgccatcgagcgtttgccaacgctagatcgcatgagaaaagggatgatgagtgtagtgcttgacaacggaaaggttgtgtgttgccaagttgatgtcactcatcttaagttgcaagacaagaagcaactattggatactgtactcaaatatgttgacgatgataatgataagtttcttcgtaaacttagagacagaactaatagggtggggattaaaattccaaatattgaagtcagatacgagaatttatcggtggagggaaatgtgcatgttggaactagagcacttcctaccctgcttaatgttactctcaacacctttgagaggattctggagttgtttcgccttgcaccttccaagaagaggaaaattcatattcttaaagatgttagtggaatcgtcaaaccatcaaggatgaccctacttctaggtcctccaggtgcagggaaaacaacattacttttagcacttgcagggaagcttgacccagatttaaaggtttcagggagaataacttattgtggccatgaactgaaagaatttgttgctaaaaaaacttgtgcctatattggtcaacatgaccttcactatggagaaatgacagtgagagagacattagatttttcaggacgttgtctaggtgttggcacaaggtatcaaatgttggaagaacttttacgaagggagaaacaagcaggaattaaaccggatcctgagattgatgcatttatgaaggctacagccatatatggtcaaaaaactaatttgcaaacagattatgttcttaagataattggattggatatttgcgctgacactttggttggtgataacatgagaaggggtatctccggtggacaaaggaagcgtgtcacaacaggggagatgctagtaggtccggcaaaggcactatttatggacgaaatatcaacaggattggacagttccaccacttttcagatatgcaagttcatgaggcaaatggttcatataatggatgaaaccatggtgatttctcttctacaaccagcaccggagacatatgaactatttgatgatgttatccttctttcagaaggtcaaattgtataccaaggtcaacgagaacatgtgctagagttctttgaaaacatgggtttcaaatgtcctccaagaaagggagttgctgactttttacaagaa

SEQ ID NO: 71549 - DNA, 444 bp, Glycine max
  Peptide Sequence Number=SeqID_188327
atgtatgatgctcatgttggaaacacttttttgttgcgtgcgatgatattttgcacaattaatgactttccaggttatgggaatttgagcgaatatagtgtcaagggacaccacgcgtgtccaatctgtgggaaaaacaccagtttcatccaactaaaacatgagaagaagacaatatatacaaggcactggagatttctgaaacattatcacccgtatcaccgattgaagaaagcattcaatggaaccaatgagactgaaggtgccccaaaaccgttagctggacatcaagtgtatgatcgggtgaaggacatcgtaaatgttttcagtaagacacgaaggaaggatcacgctgacaagaacatttggaagaaaaggatttggttgagatgggtatacgacatcagttacatccgcagcctcaaggtcgccgaacgtatttga

SEQ ID NO: 71550 - DNA, 176 bp, Glycine max
  Peptide Sequence Number=SeqID_188328
atgttcagcccttctggtattaagaaatctctcgaaatttgtgagaaaaattgtttccgtgagaaaaatccaagccgaggtgcttccgtaacgcttctgagacgtttctgtaagcaatttcgtggagattcttcaccgttcttcatcgttctttgtcgttcttcggtcttcaaccg

SEQ ID NO: 71551 - DNA, 843 bp, Glycine max
  Peptide Sequence Number=SeqID_188329
atgaaaaatcaaggaatcaatgaagatagacttcaacttctgcgtgatgtcagtggtgcattcaggccaggcatattgacagcacttatgggtgttagtggtgctggcaagacaacccttttggatgtgttagttgggagaaaaacaggtggatacattgaaggtagtattagcatctcaggtcacctaaagaaccaagcaacatatgctcgagttagtggatactgtgaacaaaatgatattcattctccctatgttactgtatacgagtcattattattttcagcatggcttcgccttccatcacatgtaaatacacaaacacgaaagatgtttgttgaagaggttatggaatgggttgagcttaaaccaatcaaagatgcacttgtgggtcttccaggcatagatggtctatcaacggaacaaaggaaaaggcttactattgctgtagaattggttgccaacccttcaatcatcttgatggatgaaccaacatctggccttgatgctagagctgctgctattgttatgcgaactgtgagaaaaacagtagatacggggagaactgttgtgtgcacaattcaccaaccaagcatagacattttcgaagcttttgatgagttattgctgatgaaaagaggaggacaagttatctatgctggacctcttggtcaccactcacagaagctcatagaatattttgaagctattgcagggattcaaaaaattaaagatggctataatcctgccacatggatgcttgacatcagcactccttcaatggaggctcaacttgacatagattttgcaaagatctatgttaactctacactttaccagtaa

SEQ ID NO: 71552 - DNA, 1139 bp, Glycine max
  Peptide Sequence Number=SeqID_188330
atggccactgttagagttgttcttgctctggcatcgattaatcgacgacatctccatcaattagatgttagcaatgctttcttacacggggacctccgggagaacgtttacatggagatccctcctggcttgcttggttacacatcaacaaaaaaatggtatgaaaaattatctaatctattgctgacttgtggttgttcgcatgcccatgctgatcatagtctatttatcaaggctcataattctgaatttactgctataattgtatatgttgatgacattgtgctgaccggtaattcccttgctgagattgaacgcattaagcgtattcttcacactaattttcacattaaggatttggggaaactgaaatattttttggggattgaagttgcacattctgataaaggaaattcattatgccaacgtaagtattgtttggatttactgaaagattctagtatgcttgggtgtaagccatcctccactcctatggataattctcttcgactccataatgattcctctagttttcttgatgatcccctatcttatagacgcctagttggaagactgttgtccgcgttcttcaatatcttaaagggtgtccaggaaaaggcttatttttttccaaggacctgctctcctcatctacttgggtttagtgatgctgattgggcaacgtgtattgactctaggcgctctattactggttattgcttctttataggcaattcgcttgtttcatggaaaaccaagaagcaaactatagtctcatgttactcttctgaggctgaatatcgagcacttgcttctgcaacttgtgaattacaatggctttcttaccttctaagagatctactgattcccctttccaagacttccatactctactgtgataatcatagtgctcttcacattgctgccaatccggtctttcatgaacgcaccaaacacttggacattgattgtcatctagtccgtgaaaagtcccaagctggactcatgttactgctccgagtcccttctttaaatcaacttgtggatatattcacaaaggctctccctcctcaatccttcagcaccaatctttccaagccgcagttacaaaacatttttgcacctccagcttgtcgggg

SEQ ID NO: 71553 - DNA, 327 bp, Glycine max
  Peptide Sequence Number=SeqID_188331
atgccaaagcttagagttattggtgttggtggtggtgatattgttggtagatgggcttctatcctttccaactatcaagtgaaaaaggccttccttcaagttagccaaaccaatcatcttcaatgtgctcatgtcctgtatttcacaagaaattttagaaagatcactagaaaaagtaatatgacatgggaaatctctgagcttgcaccaccaggtccagaggatttgctgagaagattcatcaattgttggtattgggcaattgtaggatcgtcctcaccagatgagtcggaggtagccatagggagatggcggctggaagcttag

SEQ ID NO: 71554 - DNA, 2616 bp, Glycine max
  Peptide Sequence Number=SeqID_188332
atgggttcattctctggcacttgtgaaatagttgaagcaaggggggagctaaatacaaggaaagctcctggggtttatcagtccagttctgagtgtagcacatctgagaaaaatcataaactttcggtgctgaaattgggatacaaggatgatctagacgatgatatcaacaagctttttgaatcgattgctcttaaatcttcatcaagggatttgagccttttccaagatggtacaagtcctaggctgaaaagtgcattaaaaaagccaattacaacgggtgttcctcggtccccaagagttgggacttctgagtccgttaatttgaagcaagcattaagagacctttgtatatccaaggcatcagaaatggctgctatgaaacgattatcaaagtcaacaacagcttctcctagattatctgaagttgggaagatacagacattgtacaattcagttgtagctgaaacctgtcgatctgggtcttcctttgttgagagcaagggacatcaaattgaaatatctctagtgccagaaaaaggcaaatccctttccttggagaaaacctctcaatcttatcaaacttcccaaattgcatcgtcgagccgaaacattcattcttcttgggaaattgctgttgcaactactaaatatgatgctgggagttcattgatacaaagtgatttggcatgctcatcaagtaaagttgggattcaatcacaacgagtggtacctgttgaaacagaagaacaagcatctgcctcttctccctctctttataatacatttggaagcaaatcagaggtgcccaaaaatgcttcctcccctaaaaagttgggaaataaagcatatatgtcaaatactgggaagaaaggtaggttgcaaacagtatcgtcatctacttctgtaaatgacaacagagttaacaaaccgccatgccatgcccctcgcactgttaaatcggtcatcaagaacaagaatctgagtaagaagaaacaaaaggaggattcaggttctgctttgcatggtcctacacccaatgaagtcaataagccagttcctggtacacctcggctaatttgtgagagatgtaggtgtgctttggaaaatacttgcgaagaaaaaaaccaagatattgtggcattggactctatcagtcctggagatggagtaaacttgagtaatgtacactctggttcaaataaacctggtttggtgtcaagtagtgttaataaaagcaaaacaggtgcaaaagtgaagaacaccaagttgaaagagcaaattgatttttcacaaagttcaaagagtagtcaaggtgagtacagtagtagtacaagtaccagtgatgagagcaacgtaagtggttcaagtcgtagcactaggcctcacatgtcaaaggatgtcaggtgggcagccatacgacatgctcaaatgcagcatggagtcttgggcttgagacacttcaatcttttaaagaaacttggttgtggagacattgggactgtatatcttgcggaactaattggcactagctgcctgtttgctattaaggtcatggacaatgaatttttggaaagaagagagaagatgcctagggctcaaactgagagagaaatattaaggatcctggatcacccttttcttcccacaatgtatgcacaatttacatcagataatctatcgtgtctggtcatggagtattgtccaggtggagatcttcatgttctacggcagaagcagcttggtagatatttctcggagccagcagcaaggttttatgttgctgaagttctccttgctttggagtacttgcacatgcttggagttgtttaccgtgatttgaaacccgaaaacattcttgttcgggaagatggccacattatgctcacagattttgatctgtccctgaggtgtgctgttaacccaacgcttctgaaatcatcttctgatgttgaccctgcaaaaatttcaggtctaagtgcacaagcaagttgcattgagccattttgcattgaaccatcttgtcaagttccatgcttcagcccaagattgctacccgctgctgcaaaagcaaggaaactaaaagttgatcttgcagcccaggtcagatcattgccacagcttgtggctgagcccactgatgcaagatcaaactcatttgttggcacacatgaatacttggctcctgagatcatcaaagaagagggacatggagctgcagttgactggtggacatttggtgtttttctctatgaacttttgtacggtagaacaccctttaaaggttcaaacaatgaagaaacattggccaacgtagtgttgcagggtcttcgattccccaagcacccaaatgttagtttccaagcaaaggatctgattagagggttgttggttaaagagcccgaaaaccgtttgggttcagagaaaggagctgctgagattaaacagcaccccttcttcgagggccttaactgggccttaattcgttgcgctgtccctccagaacttccagacttttatgattttggagtttcagacatggtgaacccacagggcaagggtgctaagtacttggagtgtaaagtaggagagcatgtagaattcgagttgttttaa

SEQ ID NO: 71555 - DNA, 2505 bp, Glycine max
  Peptide Sequence Number=SeqID_188333
atggtctgcgaaattgacttaactgttgatattaccccactgataccagcagttactgttgcatcttctagtcgtgctatgataccactggtaccagagaagagctctagtgttaaccatatagcagtgcaaatcatgccatataatgaatttggacctcctctttctaatgttacaaaactcacatttgaaggaagaactgatgtcagtgttcaagctctttgctcagctatttctggtagtggcaacttcccctctctacattctagagataagcgtttgaaatctgtggtgtctaattttgaaatgctgcatatgggtggctgcagggggttgtcccttacttatatattctatctttgccttatctctagccaatgtgagacttgggtttttctcaatataccccctcatgcccaacacttttgggcttggtgcgtggataatatggtgggtgacccgtttaatggatctaagatagactctaataccatcttagaatgtgggtttgagcctaattcaaccccaaaagctaacccatggggtattagtgagtcatctctactagagcttatgtctcaagcacaagttttgaagagtttatgcctgagatggactgacctggttgaccaggcactgtacaattttgtaggttcttccttggagatgcttgatgtttctgataccaaggtaatatctgatatgattgtgatgaactttgtcacatccttgaaatacttgcaagtattagctctgtgctattgttttggtgatatatccatgtcaagcttcaaattccctatgcaaaatctaagaaagttgaggcttgaaagaataaccccatggatgacaaatgatgacttggtggttctagctcaaaactgcagaaatttgttagagctttcattgctagggtgtcctcttctcgacccagaagtaacggctaatggggcttctgctcttcttgactgcaaagctcttgaagatatcctgctgcgtcataatggccctgggctacccagaaacttcatttgttatgctgcttcagagatgccattgcttcgaaaattgtcactggatatatgcgatgcaagtgaaggtgattttgacattccaaatcagtatgcagacaaatactttttgagtaccttgaagatagctagatgcaaatctcaaagatgtgcttttaatctcccagcccctgccccaggggttcatagaagatctgtgcatgttgaaactctggtgcttgtgtggaacagcagagatctcatcagaacagtgtcgccggagctggagacggcgagtttcagggatgcgtggacggcggcgccggacatgttcaacatgagtggccgccacgctcttgaagacgacgaggaagagctcaaatgggccgccatagacggcttgccaacttttgaacgcatgagaaaaggcgtgctcaagtacgtgcatgacgatggacatgtgggtgatgtgcatgttggaagtagagcacttcctaccctgcttaatgctaccctcaatgcttttaaaagtgttctgggaatgttttgccttgcaccgtccaagaagagagaaattcagattcttaaagatgtctgtggaattgttaaactgtcaaggatgactctccttttgggtcctccaagttctgggaaaactacattgcttttggcacttgcagggaagcttgatcgtgatttaagggtgtctgggagaatcaattactgtggccatgagctaaatgaattagttccacaaaaaacctgtgcctatattagtcaacacgacattcactatggagaaatgacagtgagagagacattagatttttcaggacgttgtctaggtgttggtactaggtatgaaccgttggtggaactctcaagaagggacagagaagcaggcataaagccagatcctgagattgatgcattcatgaaggctatagcattgtcaggtcgaaaaaccaatttggtaacgtattatgttctcaaggaacataagcttagaacagaaatgtcagtgggaactgttcaagatggacaaaagttctttggagcattattctttactctaataaatgtaatgttcaatgggatagcagaactatctatgactgtttataggcatcctgtcttttacaaacaaagggatttcaagttctaccctgcatgggcatttggtttgcctatatggcttctcaggatccctctgtctattatggaatcagggatatggattgtcctcacatattacacaatagggtttgctccttctgctagcagatttttccgacaattcttggctttatttggcattcatcagatggctctctctttatttcggttccttgctgcagctggtagaacactagttgttgctaatacactgggtaccttctccctccaattggtatttgtgctaggaggttttgttattgccaaagatgacattgagccatggattatgtggggatattatctaactcctatatga

SEQ ID NO: 71556 - DNA, 1706 bp, Glycine max
  Peptide Sequence Number=SeqID_188334
atgaggacgacatcttcatctaaagacatattaatccaagaggataatgaacaagatctcaaatgggataaaatccaacgttttcctatgtttgatcgcttgagaaaagggatgctgaggcttgtgcttgataggggaaatgttgtgccttaccaagttgttgatgttaccaatcaagggttgcaggacaagaagctattactagagagtgtactaaaagatgacaatgagaaattcctacgtaaatttagagaaagagttgatagggtggggattgaaattccaaaaattgaagttcgatttgagaatttatctgtagagggagatgtgcatgttggaaggagagcccttcctaccctacataatgttactctcaacgcttttgagttcgcatctttcaggaagagaaaaaatcatattctcaaagatgtcagtggaattgtcaaaccatcaaggatgaccctacttctgggtcctccaggtgcagggaaaacaacattgcttctagcacttgcagaaaagcttgatcgggatttgagggctttcgggagagtgacttattgtggccatgacttaaatgaatttgttgctaaaaaaacttgtgcctatattagtcaacatgaccttcatcatggagaaatgacggtgagagagactttggacttttcagcacattgtctaggtgttggcacgaggtatgagatgttgaaggaaatctcaagaagggagagagaagcaggaattaagccagaccctgagattgttgcattcatgaagggtattgctatatcgggccaaaaaaacaatttgataaccgattatatcatcaagatacttggattggatatttgtgcggacataaaggttggtgataacatgagaaggggtatctctggtggacaaaagaagcgtgtcacaacaggtgagatgctagttggaccagcaaaggtatttttcatggatgaaatatcaacaggattagacagttccacaactttccaaatatgcaagttcttgaggcagatgattcatacaatggaagtaacaatgttggtttctcttctacaaccagcaccagagacatatgaactatttgatgatattatcctactttcagaaggtcaaattgtataccaaggtccacgtgaacatgtgctagagttcttcgaaaacatgggattcaaatgtcctgaaagaaaaggagttgctgactttttacaagaagtaacgtctaagaaagaccaacaacaatattggtctcgtagaaatgaaccttatagatatgtttcagttcctgaatttgcaggttctttccatttgttttacgtaggaaagaaacttgcatcagagattaaggttccttacgataagagccaaaccaatgaagctgccttagtgaaaaaaaagtatggcttcactgtgttctttagaaccgaaatgccagttggtactgttgaaaatggacaaaagttctatggagcactattttttactttattcaatatgatgtttaatgggtcttcagaacaagccatgattgtttcaaggcttcctgtcttttacaagcaaagggattttatgttctaccctgcctgggcgtttgctttacctgtatggattctcaggatccccatttcctttctagaatcagggatatggattgccctgacatactacacaactggatttgctccttcaagtagcag

SEQ ID NO: 71557 - DNA, 597 bp, Glycine max
  Peptide Sequence Number=SeqID_188335
atgtatgttgagaaaaattcaagtcccacatcggctagagataaagctacaatagaatatataagtgggagacaaccttctgttaacaactcattgataagtgcaccaaattgtcccaaaaaaactcaagtcccacatcggctagagaaggccacaatagaatatataaatgagaggcaaccctcaccctatgagttagcttttgaggttgagttaggtccaaatccacattctaagaatatgtgggcaaagcatagcaagtcttttgggaaacttccatatgacctgctattatctttagtaaagcatcctcatttgactgttgacagtgagttgcatctttctgatgcacttcttctctggcttgaaagtaacactgaaaatttggagaggccaagcaaatccgaagagaactgctatgaagttttgaaacaaggtaaagatggaaaaggaaaaagtagtaatctgaataattgtgaatttgtgagatcttatgatgatgataacaagcattggcagaaactgagggggttcaatggtgcaactggctcctttcactgcctcacctacaatgcttactctgaaatgatgccctaa

SEQ ID NO: 71558 - DNA, 1074 bp, Glycine max
  Peptide Sequence Number=SeqID_188336
atggcagtgaaaaattctacagaaattgctacttcttcaaaccaagatcctagcagaggaatgcttctaccttttcaacctctttcacttgcattcaatcatattggcaactacgtagatatgcctgcagaaatgaggagtcgaggaatcattaaagatcgacttcaactactacaagatgttagtggtgcttttagaccaggcatattgacagcactggtgggtgttagtggtgctgggaagacaacccttatggatgtattagctggaagaaaaacaggagggtacactgaaggaagtgttagcatctcaggttacccaaagaaccaagcaacatttgctcgtatcagcggttattgtgaacagaatgacattcattctccacatgttactgtatatgaatcactactattttcagcttggcttcgccttccttcagatgtaaatgcacaaacgccaaggatgtttgatgaagttatggagttggttgagcttaaccaaatcagtgatgcacttgtgggtcttccaggagtcgatggtctatcaacagaacaaaggaaaaggcttactattgcggtagaattggttgccaacccttctattattttcatggatgaaccaacatctggccttgatgctatagttgctgctattgttatgagaactcaaaattttcatttatttacatctgttgcacatatatttctgggtatcctaggggttccaaaaatcaaggatggttataatcctgccacatggatgcttgatatcagctatacttcaatggaggctaatcttgaggtagattttgcagaggtttatgctaagtctaccctttgccggaggaatcaagaacttattgaggagctgagtaccccagtaccagattccaaggacttgtacttcccaaccaaatattcccaatcgttttttgttcagtgcaaagctaacttctggaaacaattctggtcctactggagatatcctcagtataatgctgtccgattcttcatgaaaatagtggtgggagtaatgtttggtgtgattttctggaatgacgcccaaaaaacttaa

SEQ ID NO: 71559 - DNA, 318 bp, Glycine max
  Peptide Sequence Number=SeqID_188337
atggataatgagtcttctcttctaaacttatttgtgacagttaagccactatccacattgcttcaaagtctaaatgaatatattggagccaatttgaatctcgtccaacaatatgccacttccattcattcccaaacctccaatgcttctatgtccaagtctgaatttgtagattctgaaatgcaagatgagttttatgatgcaattagtgctgagtcattatcatcagatgaagaaagtgatgaggatatggaactagatcaggtttcctttttcaatctacttatcaatcacaagaaagtttttactagaaattga

SEQ ID NO: 71560 - DNA, 192 bp, Glycine max
  Peptide Sequence Number=SeqID_188338
atgttagtgaaaaacctcatcgggcgcctaggagtacatgacaagacaaactacacactagcaagtcaagtcactctcactaggcttaaaggagcactcaaaccgagtgtatttacccccaaggcctacactccaaagagtccgttagggcctctccctcttgattcaggtccaacccagaaaacattttag

SEQ ID NO: 71561 - DNA, 765 bp, Glycine max
  Peptide Sequence Number=SeqID_188339
atggaagttgaaactcactccctctcccccacctttgaattaatccaccttctctcccaatccaccaccgacacctacttccctcccaataatgccgccaaccaaccttctctcggccacgccaccgccgtgctcaagctgcaaaaggtctaccgtacccgccttgcaggttggccgactccgccgttgttgccgaggaggtggcaagccatagactatgtaagggtaaaccacagcaccatctcgttctttaatttgccggaaactgctgcgtcgtgctggagtcgggttaaattgaacgctgccaaggtgggtaaaggtttgtccaaggatgccattgcacaaaagtgttggctttccagcattggatcgaagctattgatccacgacatcgctatggacataacttacaatactactataaagaatggtgtaaaacaaatgctggccagccgtttttttttattgatttttcacctgcgtatgttgtttcagtacaataagttgaactgtctgcaagagagagaacaatatgaatacattgtgcgtgaggacaaaattatcaacaagcaatatggagatttgtttcatacaaatgaagattctgaagatgcaaaatggatatttgtcatgagcacctctaagaaactttatgctggcaagaaaaagaagggattatttcatcattctagttttttggctggaggagctacattagctgctggaaggctggtggcagagaatgaaattcttaaggtgaattaa

SEQ ID NO: 71562 - DNA, 270 bp, Glycine max
  Peptide Sequence Number=SeqID_188340
atgaacaacgtctccatgatggatgcggaatcggagaagcgctctgcttccaccatctctttttcttcttcatcttctaactcgtcttcctcctgccaccgtttggatcggctcgtcgacgccgaggagattcaagcggcggagactctcgcgcagttggcaatgcgcgactctcattccgccgataaatggtgcaccaaacaggacacaacccgagtcactcgcgagtcaccgactcttcttcattcggatctctcacttgggcctggg

SEQ ID NO: 71563 - DNA, 249 bp, Glycine max
  Peptide Sequence Number=SeqID_188341
atgggcccgaaatctaccctaaggctcataagaaccctaggaccttctcttgcatctctggcccaatctacttggagttttctatccaatgcccttgcgagaggaaagaactatctaaaagataattctaaggtaattggaggagatcctcttctcaagctcatagtagttgattggttaaaagttgacaaatctatagacaaaattgcactacaccatagaagtttggttcaggttgttatgaattaa

SEQ ID NO: 71564 - DNA, 297 bp, Glycine max
  Peptide Sequence Number=SeqID_188342
atggccgagttgtgcttagtgcctgacatcattatccctctaaagttcaaggtgtcggatttcgataagtacaaggggacttcttgccccaagaatcacctgaagatgtactacaggaaaatgggggcatacgcgaaagatgaaaagttattgatgcatttcttccaggaaagtcttacaggggcagccgtcgcctggcagtatgagtataattttgatatggctccggatagaatgcatctacaaaacatgtgtaagaaggagcatgaatctttcaaagaatacgcccataggtga

SEQ ID NO: 71565 - DNA, 714 bp, Glycine max
  Peptide Sequence Number=SeqID_188343
atgggggagcgagaattggaaccactggaaatcaacgatgaggctggaccaatcgctagagaccctgggaagaaggcaaatgaggctttgattaagaagagtgaaaaagagaagtttgttaggattgttggggcaagagatattaggttgaaggtcgacgacaaccgcggacacgccgctgtagaaaccgaggatgcctttggactggaaggttttcacaattgtgtcgcgagtgtttttgtaaatttgtgttgtgcccttggtctacatcttggttttgatggcgtcgagggggaggaggcagacgtaagtgaaggcgctgacgaggccactcgcggcggtgtcgatgaggacatgatcaaggacaaagagggttttgaggaggggctttgggctgggctttgggctgggccgggcccatttggaggtggaggcgaaggggagagtggggggaggccgagagaggatgagaagcccgaagggatcacattgttagccacaacagatttgccagagtctgttagcctgatggagaatggtgctttaagtggtgaacctttgctgagtttccaaattgcaccccatgatcgctgcatggaataccatgaggctgaaaatgcttccttgagttcaactttgtcaagatcaccattcccatcctcgtattcagcacaaactgcaaaatattcggggttggatcctaagtccacgtga

SEQ ID NO: 71566 - DNA, 612 bp, Glycine max
  Peptide Sequence Number=SeqID_188344
tcgctcaagcgttctcggttatcaattgtggtatttctagtactctctagagctcctcctccggttgctctattagggttcccaaacgttagagagaaggagaatggattgaagcctccattccatggtcctatatgcgatgcatatttcttcctccacagacattacattgcaaatcccaacggtgaagaattaaacagaaaatcagatgtcagtgaactttgtgaggaatatactgctgagtgcatcgaattggtggatcattatgccccacgtttcttcttagaaattgcatcagttcagcctggagaactctgcaaacagatccacatctgtcaatctgcaaagatttcttcagaagttgaaggaaatagctgtgactcttgcaaagatactgtttcagccttactggttaagttgaatgatcctgataccaagcttgaaataatggaggcactgttgaaggcatgcaattctatggacaagttttccaagaaggacattattgtcgctgcaccatccagaggatggtccaaccaaataaatgaaataatagtgcactgttggaattggatagactttttcttttgtggtgctacagcagagttgtaa

SEQ ID NO: 71567 - DNA, 441 bp, Glycine max
  Peptide Sequence Number=SeqID_188345
atgaatcgacttcacaaacaacaagttctggatcgaggccctaatccttccttggttgttcttcgtttaatctccaccaccttcatgtcctccttggtgttcctcccaatccccatcccttctagtcatacctgtcgacagcctctccagatcacttttcagcttttacagcactgtggcctccagtggaacgtgacgccgtggcgcggcaccataatcattgtcgttgttgtttccttcaataagagattttttggtgatgggagaggccttcaagaagaatctgatggttactatgtttgtaacacgaagagtaggggcccactgtggatcgacgttggccgaaaggtagaggacgtgggagtggttgaaggcggtggcacgaagaaggaattggttgtggaaaaggatggagagagagaggactttctcaatgtttga

SEQ ID NO: 71568 - DNA, 186 bp, Glycine max
  Peptide Sequence Number=SeqID_188346
atgattgaggcttccttgttgctaactgcagtggaagcagggcaggcatgtaatgtagtgcatatatctgctgttttcaggaacttctctgccttgacaagaatcaaaggtaagaaagaagtagctcaagtggcaccgagtgtctttggggaatgcttgatccaggttgcactgcctaaacgttag

SEQ ID NO: 71569 - DNA, 222 bp, Glycine max
  Peptide Sequence Number=SeqID_188347
atggtttcagggcacgacaactctgaaaagggaaactcactggcttgtgcggtggtgccacaagacgagatgtcggacgcgcgacaatgcactacgcccttcgaccgaggtcacgggggtgcgacagagatgcaggcaaatggcagaggtcatggcgaggtcacagtagatcaaaatttcagagaaacagggaagcgggagctcgagcgcgagtgttcatga

SEQ ID NO: 71570 - DNA, 332 bp, Glycine max
  Peptide Sequence Number=SeqID_188348
ggatcgcgcccgcaagacacccagtggacccgaagaagtccaacagggtcttggagttgccagctctgattacgggcctctgtcagttctacggagtgcctgttacccccagcaaggtcaccaagccccctactaaccgagctttcatcatgaagtattgcgcccccaggcatccacagggcgagacaccacaacagcctggggatagtcagcagcaggcaacagatgcactgccgccacctccaaagcccctcaactcatctacaaaagcaggagcgtttcctacgacctgtggtcgactagcaggcgaccaagtccaaagtcaaagataa

SEQ ID NO: 71571 - DNA, 1689 bp, Glycine max
  Peptide Sequence Number=SeqID_188349
ttcaatctggcgaagagcaactcaccctcggacaacctgagtccggcggacgacatagggcacggcactcacacggcgtccacggcggccggagcagcggtgaagggtgcgagtctctacggcattggcaaaggcacggcgaggggcggggtcccctcagcccgcgtggccatgtacaaggtatgctggttagacgactgcaacgacatggacatgctcgccgcctttgacgaagccatcgccgacggcgtcaacatcatatccatctccattggaggcccctcccatgacttcttcaccgacccaattgccattggatcgttccacgccatggggagagggattctcacttcttgctctgccggcaacggtggccctcgccccatgacggtcgagaatgtcgctccctggcttttgacggtggctgctagcgccgttaatcgccagttcactacacttgttgctttcggtgatggaaagaacataacaggactttctattaatacctttgcccccaagaaaaagatgtatccattgactagtgggctccttgcgtcgaaccttagtggagaaggctacggcagtgctagtggttgtgattatgggactctaagtaaggaaaaggtacagggcaggatagtgtactgcgttgggggaacaggcactcaggatttaaccatcaaagaattagggggagcaggtgccatcataggccttgatgaggaaattgacgcctcctacaccacagtcattccagggacatttgttgaagccagtactgtgggcaataccattgatctctacatcaattccacaaagaatgctagagcggttattcacaagacaacaactacagaagtccctgctccattccttgcttctttttcatctagaggtcctcaaacaatcaccccaaatatcctcaagcctgacttggttgccccgggagtgaacatactagctgcatattccaaattggtaacactaacagggtaccatgaagacaatcgttacgatgtatttaacatattatcaggaacatctatggcatgtccacatgccactgcaaccgctgcctatgtcaaatccttccaccctgattggagtcctgctgcaattaaatctgctctcatgaccactgcaactcccatcaaaatcagtgacaatttcacggaactgggatctgggtcgggtcagattgaccctgtaaaagcattacatcctggcctggtttacgacatgagaataagctcctacatcggcttcctttgcaaggcaggcttcaacaataccaacattggcatactgataggcaaaccaaatttcaattgcacaagcattaagccttcgccaggcactgatggaatcaactaccccagcatgcatatccagctcttgagtgcaagtgatagaatttctgcagtttttcttcgaactgtgactaatgtaggatctcgaaattcaacttacaaggctaaagttacaacacccaagggtctttctgtgaaggtcaagccaaatatattgaagtttagtcggttgcaccaaaaactgtcgtttaaggttgtgctgaagggacctccaatgccggaggacacatttgtggaatctgcatcacttgaatggaaagactctgaacacactgtcagaagtccgatacttgtctttaagcctatgactgtgtattga

SEQ ID NO: 71572 - DNA, 489 bp, Glycine max
  Peptide Sequence Number=SeqID_188350
atggatatgcctcctctaaaattagcaacttaccatagagtaaaggatattcctacgataaaaattcatgcccatgcccgcactaacaatctattgggccaagctattgcaggtcagtatccagatgaaaagatatccactacaactgtagaaacagaaatgtttcagcaggatgactgctcgagacacatgaaggtggagcaggatgctgatgtattacctaacacaagttactccttagttcgaagccgcaagtcaaggcgaaatttaactgaggaagaaaaagaagtaaggaggatacgtaggatattggcaaatagagagtcagctagacagacaattcgccgtaggcagtttgtgcgttctaatcatcagttctactttagggatcttcagatttacttatttattattcattccctccttgatacagttgttcattggacatggcttattcccactgtaattattaattggatgacgatctaa

SEQ ID NO: 71573 - DNA, 996 bp, Glycine max
  Peptide Sequence Number=SeqID_188351
atgtttcaggctttgtgtgaggagttaactagaaaagctgcctctttggtggtggagaatgaaaacctaaagagggagaagcaattggctttgaatgagtatcagtctttggagactacaaataagcacttgaaggcacagatagccaagtcaataaacactgaagtggagaaaactcctgttgagcctgggtcatctgtggctgaggtaacacctttgtctggtaacggtccatggttcctttataaccattttccagttccacagatattttggccttccatccttcagttttctaatccggttcatttacaaaatacatcattgaattccttctccattccacctaatgcctatgttccttgttcttccgaatctgaatcacgtcacaagcaaaataaccttataaatgataatcgaacacaaaatccattttacatgtttccatgtccttggttattccctcttccacagtttggaaatcaacaatcatctccttccagtagcctgaaagatgaacaagataatctatctctaggtaaaccatgtagttctagttcatctttgaatacaatggcaaatgtggattatcaagcagcgttacctatcaaacttaaaacagcagcttctggctggacagaggccatatctattaatggccctggttgggccactccaagatcttctttggatggaggtgagaagaaaacaggatgttacattatagaaaaatatcatgaaccttcacttggttgtaatggtcatgcttctgctgtcaaacaagaacatgaatttcaattacattctgctcctaacaataaagtatcttcaacagcttatattgcaacttcttcactggaaaagaaacaaggacagtgcatttgccaggggagaaatctagtggatgcagttgctgctgcagaagcaagaaagaggagaaaggaactaacaaagcagaaaagcatccataaccgccagtcccggatgcactgttga

SEQ ID NO: 71574 - DNA, 199 bp, Glycine max
  Peptide Sequence Number=SeqID_188352
gttcagcgaaggggacctggtgttgaagaaagtctcccaagccctgaaagacaataagggaaagtgggccccgaactacgaagggcctttcgtcgtaaaaaaggctttctccggaaggtcccttgtgcttgccaacatggatgacgaggaactaccttcgccggtgaactcagacgttgtcaagcgatactacgcttaa

SEQ ID NO: 71575 - DNA, 471 bp, Glycine max
  Peptide Sequence Number=SeqID_188353
atgggagaactaccggtggctagaacctatgccgtggagagccaccaccacaacttgctagaggctgcgattggagacaagcaattagccagagagtccaaaatacatagttatggaaagagcttcaacggattcgttgcacgacttttaccacatgaggcggagaaattgcaagaggaggacagtgtggtatctgtgtttccaaatacacaccgtaaactacacacaacaaggtcgtgggactttttaggaatgcccctaaacgtgaagagaaactccaaggtggaaagccatatcattgtgggcgtgttagatacaggtatttgggttgattgccccagtttcaacgctgagggctatggacctcccccacgtagatggaaaggcaaatgtgaaacgggagcaaactttactggctgcaacaagtattgttctatgcatcacttatatctttgtgactttgtccaatga

SEQ ID NO: 71576 - DNA, 2868 bp, Glycine max
  Peptide Sequence Number=SeqID_188354
atggaggttttcaaatactcccacatcaaaaatctacttcttgctaccttcatggtatcatcagcagttctagcaattgatgacccttactcagaggcactcctaagcctaaaagctgagcttgtagatgatgataacagcttgcagaattgggtggtgccctctggaggaaaattaactgggaaatcctatgcatgttcttggtcaggcatcaagtgtaacaatggctcaacaattgtaacttccatagacctttccatgaagaaactgggaggtgtggtttcagggaagcaattcagcatcttcacaaacctcactagtctcaacctgagccacaatttcttctctgggaatcttccagccaagattttcaaccttacaagcctaacaagcttggacataagcagaaacaacttttctggtcccttcccaggtggaattcctagactccaaaacttgattgtgcttgatgccttcagcaacagtttttctgggtcattgcctgctgaattctctcagctagcatcccttaaggttctcaatctagctgggagctacttcagaggttcaattccatctgaatatggttctttcaagagccttgagtttcttcatcttgcaggaaattctctttcaggaagcatacctccagaacttggtcatctcaacacagtgacccacatggaaattggctacaacctataccagggttttattccacctgaaataggtaacatgagccagcttcagtatcttgacatagcaggagcaaatctttctggccttataccaaagcaactctccaacctcagcaatttgcaatcacttttcctcttcagcaaccagctcacaggatcaataccaagtgagctcagcaacattgaacctctcacagatttagacctctctgataacttcttcacagggtccattcctgaaagcttctcagacctcgagaacctgagactcctaagtgtcatgtacaatgacatgagtggcactgttcccgaaggcattgcacaacttccatccttggaaacccttctcatttggaacaacaaattctccggctcgcttcctaggagcttagggaggaactccaaactcaagtgggtggatgcttccacaaatgatttagttggaaacataccaccagacatttgtgtgagtggagaattgtttaagctgatcctgttttcaaacaagttcactggtggcctttcatcaatctccaattgttcgtccctcgttcgccttcgcctcgaagataacttgttctcaggagaaatcactttgaaattcagccttcttcctgatatcttatatgttgatctgtccaggaacaactttgttggtgggattccctcagatatttctcaagccactcaattggagtatttcaatgtctcttataatcagcaattaggggggatcatcccttcacaaacatggtcattgccccaacttcagaatttttcagcatcttcttgtggtatttctagtgatcttcccccatttgaatcctgcaaatcaatttcagttgttgatctagatagcaataacttatctggaacaatcccaaacagtgtttccaaatgtcaaactcttgagaaaatcaacctatccaacaacaatttgacaggtcatatacctgatgagcttgccactattcctgttcttggtgtagtggacctatcaaacaataacttcaatggcaccatacctgctaagtttggtagttgttctaatttacaacttctcaatgtgtctttcaacaatatctctggttcaataccagcaggaaaatcattcaaattgatgggaagaagtgcatttgttggaaattcagagctatgtggagcaccattgcaaccatgtcctgattcagttggaatattgggaagcaaatgctcgtggaaggttacacgtatcgtgctactctctgtagggttgctaatagtccttctgggacttgcttttggaatgtcttacttgagaagaggaatcaaaagtcaatggaagatggtctcattcgccggtctccctcaattcacggcaaatgatgttttgacaagcctcagtgccacaacaaaacctacagaagttcaatcaccatcagttacaaaggctgttctgcctacaggaataacagttttggtcaagaagattgagtgggaagagaggagcagcaaggttgcgtcggaatttatagtaagactgggaaatgcaaggcacaagaatttagtcagattgttggggttttgccacaacccgcatctagtctatcttttgtatgattacttgcctaatgggaacttggctgagaaaatggaaatgaaatgggattgggctgcaaaattcagaacagtagttggaattgccagaggactttgcttccttcaccatgaatgttacccagctatacctcatggtgacttgaaacccagcaacattgtatttgatgaaaatatggaaccccatttggcagaatttgggttcaagcaagtattgaggtggagcaaaggctcatcaccaaccagaaataagtgggaaacagtcacaaaagaggaactgtgtatggatatctacaagtttggggagatgattctggaaattgtgactggcggaaggttgacaaatgcaggagccagcatacacagcaaaccatgggaggttcttttgagagaaatttataatgagaatgaagggacttctgcaagttcattgcatgagattaaactggttcttgaggttgcgatgctttgcacccaaagcaggtcatccgatcggccatcaatggaggatgttcttaagcttctgtcagggctaaagcatctagaagatggcagaacttcaaaagaaggataa

SEQ ID NO: 71577 - DNA, 1647 bp, Glycine max
  Peptide Sequence Number=SeqID_188355
atggagctagagcttgaatcttttacactgtgcactctgatgcagctcttcaccaacatcccctttggcagcacactgtgtctttcactggccattatcatcatcaccctcgtgatcctcactaccttttcttcatctctcttccttcgctggccaaaaataatcactttcttctgtagctgcgaaacatgccaggcctatctcacttcaggttggtccaaaaccttcgacaacctttgcgattggtacgctcacctcctccgaaactcgccgacaaaaaccatccacatccacgtcctccgaaacaccatcaccgccaaccccgacaacgtggaatacatgctcaagaccaggttccacaacttccccaagggaaaaacgttctccaccatcctcggcgatttcctcggccgaggaatcttcaacgtcgacggagaatcctggagcttccagaagaagatggcgagtcttgaactcagcaagaactcgataagatccttcgccttcgaggtcgtcaaattcgaaatcaaagaccgactcatccctctccttgttctgtccaaacaaaatgactgtgttttggatttacaagacgttttcaagagattctcgttcgacagcatttgtagattctccttcgggttggaccctatgtgtctggagctgtctctgcctatatcggagtttgctatgtcctttgacttggcgtcgaaactgtccgcggagagagccatgtcggtgtcccctctaatatggaagatcaaacggttcctcaacgtgggctccgagaagaagctgagaaaagctattaaaatgattgacatcttagccagagaagtcataagacaaagaagaaaaatggggttttcatcaatttcacctcataaggacgacttgttatcacggttcatgagaaccatcactgatgacacatacttaaaagacattatcgtaagtttcttgctagccggtcgtgataccgtggcttcggctctaacaagcttcttttggctcttagcaaaacacccagaagtggaatcccaaattcttctagaagcagagcaagtaattggatcagactataacaaagaccttacaagctatgaagagcttcaacaactgcactatttacaagctgcggcgaatgaaagcatgagactttatcctccgattcaattcgattccaagttttgcttagaagatgatgtgttgcctgatgggacttttgtgaagagaggaactagggttacttaccatccctacgcgatggggcgtttggaggagatatggggttcggattgctttgagtttaggccagagaggtggttgaaggaaggacttttttgccctcagaatccgttcaagtatccggtttttcaagcggggataagggtgtgtttggggaaagaaatggcactgttggagctcaagagtgtggcgctttcgttgcttcggaggttccacatcgaattggcggcaccaccaccgcatcatcatcatcacagtaccccacgtttctcgccaggcctcactgcaacttttagttgcggtcttcgcgtaaaggtgctgagccttgcaccactagaatgctgtcagtgtatttctgctcgcgttattctaccggattacacaagtaacattgaataa

SEQ ID NO: 71578 - DNA, 606 bp, Glycine max
  Peptide Sequence Number=SeqID_188356
atggctctctccgcggacagtttcgacgccaagtcaaaggacatagcaaactccgatataggcagagacagctccagacacatagggtccaacccgaaggagaatctacaaatgctgtcgaacgagaatctcttgaaaacgtcttgcgaaggatcttatcgagttcttgctgagttcaagactcgccatcttcttctggaagctccaggattctccgtcgacgttgaagattcctcggccgaggaaatcgccgaggatggtggagaacgtttttcccttggggaagttgtggaacctggtcttgagcatgtattccacgttgtcggggttggcggtgatggtgtttcggaggacgtggatgtggatggtttttgtcggcgagtttcggaggaggtgagcgtaccaatcgcaaagcgaaggaagagagatgaagaaaaggtagtgaggatcacgagggtgatgatgataatggccagtgaaagacacagtgtgctgccaaaggggatgttggtgaagagctgcatcagagtgcacagtgtaaaagattcaagctctagctccattgatggattatggataaagattgaatacagggcagggttctga

SEQ ID NO: 71579 - DNA, 594 bp, Glycine max
  Peptide Sequence Number=SeqID_188357
gatgtgcggaaaaaggcacaggccatccagaaacagaacaccgccccccacgttttgtctcatgggggttatgaatatttagagcagaagctcctcgctgagaagacgaagaaaaagctggaggaagctgcacattcaggaagcattgatgacgtcatcgaccctccatcccccattagacgccacgtgaagtggaagatggcccgtaccaagaaaacaggggagatgacgactgaggccgcaaaggaaatcgctgagaagatcgattcctttgaggagcaggcgacacagggatccttcgtcccccatggacagcaccctggacgtgtccgtgctgctggagccggggtcaccatcaagcaatacttcggatcggctccacgaacgtctcacagctcatcctccttgcctcctgaagaattgcaacaactgacccagcaaatcagggaccagttagaggagtcgatcacagaaaaagtgactcgacaactcatggcatcgttcagtcagatgcagtcccagattcagtctcatatgcaatctcagggacttgcactacctcctaagcctctggttggtccctcaggtcctcat

SEQ ID NO: 71580 - DNA, 291 bp, Glycine max
  Peptide Sequence Number=SeqID_188358
atgcgacaatttggtgcacttgccaataggttaacatctagcacaaaacaaccccaacagaaattaacaatttggacaaatattcaaacaagaataaaagatacaaaactaagttttgattggaaggctgatggacaagataaaacatcatcaacttctgttgggacagctctgttagatcctatgtcaactaacaaagccaaatctctatgtatgtttgaactggaggacactccacaactttcttctacacttgccagtaatgatggtcatgaagatggaaccgcttaa

SEQ ID NO: 71581 - DNA, 849 bp, Glycine max
  Peptide Sequence Number=SeqID_188359
atggagtcttttatcactagtggttctgatagagacttctgcagctttgtcaataaaactaagtatttgagagtgaaatcgccaatcccctacagattgaggaaactgatgccgcaacatctgaaatatgggatgaactttgcgtttgggggcactggtgtctttaacacgtttgttccactcccaaacatgacaacacagattgatttcttggagcagctcatcaaagacaaagtgtacaattccttagatctcaccaattcggtggcccttgtctctgtcgctggaaatgactacggtcgttacatgctaacaaatggctcccagggtttaccatctttcgtggcctcagtggttaatcaaacagcgaacaatctgattcgcatcaaagggctgggagtgaagaaaatagcggtgggtgctctacaaccccttggatgccttcccccgcagacagccacaacctcattccaacggtgcaacgccacctcaaacgccctagtacttctccacaacagcctcctgaaccaagcagtaacaaagttgaaccaagaaattaccaaggagcgttccagcttcgtaatcctcaaccttttcgacagcttcatgtcggtgttgaacaacccttccactcacaacattcggaacaagttgacgccgtgctgcgttggcgtgagcactaactactcgtgcgggagcgtggacaagaacaatgtgaagaaatatagagtctgtgatgaccccaaatctgctttcttttgggatctggtgcaccctacgcaggctggatggcatgcagtgtataacaagttacgaaccatgaatgatcttcaacacattctttactag

SEQ ID NO: 71582 - DNA, 102 bp, Glycine max
  Peptide Sequence Number=SeqID_188360
atggcccatgttaacaatggaaggataattaggcaagctttggaaaatgttgttatcaccttctcgctaagccaatctgctggcttagcgagtatccgctaa

SEQ ID NO: 71583 - DNA, 888 bp, Glycine max
  Peptide Sequence Number=SeqID_188361
atgacaggtggggacttgggacaaacagaatggactgcatcaaccttaaaacacgttgacagcaacgactatgacgtgttcttgttaccaggagacctatcttatgcagattcccaacaacctttgtgggactcttttggtcgtttggtggagccatatgctagtaaaaggccatggatggttacagaaggcaaccacgagattgagagtttccccattatctacccacaaggcttccaagcctacaatgctcgctggcccatgcccttccaacaaagtggctccacctcaaacctctattactccttcgaggttactgccacccacttcatcatgctaggttcctacactgattttgacgctcaatcacaacaatacacgtggcttcaatctgacctcgccaacattgatagggccaagacaccttgggtgattgtgttgttgcatgcaccttggtataacactaatgaggcacaccaaggtgaaggtgaatccatgagacaagccatggaggagttgctttatgaggcacgcgttgacttggtttttgctggccatgttcatgcttatgagcgcttcactcgaatttacgataataaggctgattcatgtggaccaatgtacgtgacaattggggacggaggaaatcgggaaggccttgcgttaatgtttaagaaccctccgagcccgctctcattgtatcgagagccaagctttggacatggaaggttgcgaatactaaatgaaacacatgcacattggtcatggcaccgaaacaatgatgctgatgcggttgtagctgatggtgtttggatagagagtttaagcagctcgaaagcatgctcgaagacaccagaccaacaagatgctgctaacgaagagctataa

SEQ ID NO: 71584 - DNA, 528 bp, Glycine max
  Peptide Sequence Number=SeqID_188362
atggcgttcccaatcctcctacacaccctatgcttccttttgttcccacaaccactactttctcaggagaattttgttcgtcaaccagctggccaactcatcatcactccccaccatggctcccattcagacccccaacaggtgcacatttcattggtggggaaagagaagatgagggtgtcgtggataaccgaagacaagcacacagaatctgtggtggagtacggaacaaaggcaggggaatatagagaaaaagcaacggggttgcatacctcgtaccaatattttttgtataactccggcaagatacacaacgttgtaattgggcctttgcagccaggcacgacttacttctacaggtgcggagggtcgggccctgacttttccttcaagacacctccacccaagtttcccattgaattcgtcatcgttgttcttcaagccgccgtcgtgggacaggataaggattatacaccacctgtccacagttgccaaacttgcctaaacaaatcaatagccaatcattag

SEQ ID NO: 71585 - DNA, 600 bp, Glycine max
  Peptide Sequence Number=SeqID_188363
tgccgcaagtggcaggcattcaccgacaatgtcaatgctcctctcgtgcctttgaacgtcgtggcaaccccttggtcgttctctatgtgggggatagacgttataagggctaacgagcccaaagcttcgaatggacatcgcttcattttggttgccattgactacttcaccaaatgcgttgaagcggcttcgtacgccagtgtgacaaggagtgtggtggtcaggttcatcaagaaagagataatctgccgatatagtttgcctaggaagattatcatcgaaaatgccaccaatctaaacaataaaatgatgaaggaaatgtgtgaggatttcaagatccaacatcacaattctacgccttacaggcccaaaatgaatggggcagtggaggttgctaataagaacattaagaagatagttcagaagatgaacgtgtcatacaaggattggcacgagatgttccctttcacgctacaagaggttccctctctgagaattctagccgagtcagggttggaggagttggaatgggccaaagctcgctttaatcaggtgaatcttataggagcatggatgatgaagaattacctttgcccgtga

SEQ ID NO: 71586 - DNA, 165 bp, Glycine max
  Peptide Sequence Number=SeqID_188364
atgaagatgcaaatgcgcgtgccagggttcttgttgttcttgctaaccatcggaatcttcgaagtcgatgccgtttatggttacgttcgaccaccacctcgtaaaacactttttgttccacatgcaaatcaggattcccactcgcctcaacagtttattgcttaa

SEQ ID NO: 71587 - DNA, 240 bp, Glycine max
  Peptide Sequence Number=SeqID_188365
atgtggtgtctggttcacttatatggttgctcgtggtctactggtgtaaaatctcctcggtgtttatcctcatcggctgcacaacaattggtatcagagccgatgatccgacttgatgatcaactcaaacaagatgacggtgacagatccctggatatggagatcccttatatcgaaagtcttcctggtgggtataatgtcaagttcacttatatggttgcttatgacccattggtgtaa

SEQ ID NO: 71588 - DNA, 3657 bp, Glycine max
  Peptide Sequence Number=SeqID_188366
atggccgaatccagcaacgatcgtgttgaggctgccttagcccgactcacttcacgcatcgaggaccttctgcaacacgttaccccctctacttcccctccctttccacctcgtagcccgatacctgcactttcacatagaatcaagttagatgtaccgcgttttgatggtacggatcctcttgggtggatttttaaaatcacccagttctttgagtaccacggtaccccggagcatgaccgcatcaccattgcagcattttacatggagggaagagcccttgcttggttccagtggatgtcaagcaacggacaattcacttcatggcccgtatttctacaggcactgcaaactcgttttgccccaagtcagtatgaggacccctccgggtctttgttcaaactcacacagcggacaacggtgacggaatacttatctgaatttgaggaattggccaatagggtggttggccttccggctccattcctgctcagctgcttcgtatctggactcgcgccggagattcgcctcgaagtgatggtgaaccaacccctcaccgtggcccaggcggcagggctgacccgtctccacgaggagaagctccgcgaccttcgttttgacttccgacaactcccacgccagcgtgcgccgccgccgccaccattagcttcaccacagcctccgtcactcacaccctttgcctctccccgcctctcaccccttcctcctctcttgccctcgccgccgcgtccgtctccgccacccatggtccgccgactgaccccagaggagctcgcatcccggcgtgagcgcggcctctgcttctcctgcgacgagaagttccataaggggcataggtgcgcccctagggttcacctactgatagcagatgcggacgaccctctcgaacacgtgggttctaatatagacccagttgacccaggcgacccgactccaggcccaattgacttacccgaaaccccagcccacatcagcctcaactccctcgcgggccaccttgccccgaagactctgcgactcgtcggtcacatctctggccactccgttctggttctgattgacagtgggagtacccacaatttcattcaggaccagctcgtggcccaattggggctaccctgtcggcccaccactccattgaaggtcctcgttggcaatggccagcacttgcagtgccacacgacttatgattccatcaccatcgacctgcagcaacattccttcgtcgtcgacctctatgtcctttcgattgccggcgccaacgtcatccttggcgtgcaatggttacaatctctagaccctgttttaactgattatactaagcttagtatgcagtttttccatgatggcaggatagtccagctccaaggtgatccggtggctcaacgggacttgctttcctcccctcaattccgacgtgtctgccgcaatcagcccaacaacatttgcttccacatcacggtgctccctgaagattccgaaccagtgatgcccagcccaattgaaccgcaagtccaacatctcctccaacagttttccgttctctttcaggacccgacacagctccctccggcacgcgatactgatcaccaaattcacttgcgtcccgatgccacccctatcaatgttcgaccatacaaatatccttattatcaaaagcgcgagatcgagacccaggttgagacaatgctccaacgcggcatcattcagcccagcaagagtcctttctcttcgccggtgctgttggtgaagaaatccgacaatacctggagattctgcgtggactaccgagcattgaacgccttaacgatcaaggatcgtttcccaattcccaccattgacgagctcttggatgagctcggcggcgcgagttgcttctccaaactggatttggtgcaagggtatcaccagatacgcatgcaatcggaggacattcccaaaactgctttccggacacaccacgggcattttgaatttaaggttatgccctttggcctttgcaacgcgccctcttcgtttcaggcgacaatgaacactctcttccggccgtaccttcgctgctttatcatcgtcttctttgacgatattctcatctacagcgtctccctcagcgaccacttgcgtcacctccaaactacctttcaggtgctatatgacaatcacttcgttctgaagctctccaagtgccttttcgctcaacctcaggtggagtatttgggtcacctcgtctcgcaccgcggcgtccaaccggtggcttcaaagatagccgccattgcacagtggcccaatccacgctccgttcgtgctctacgaagtttcttgggacttgccgggttttatcgccggttcatccgtggatacgccactatcgcggcccccttggtcaaagccaccaccgttgagcccctccactggactccggccacacaaaccgcctttgacaccttgaaggcagctctgacatctgcaccggtcctcgccctccccgacttcaaactacccttcacagttgagactgacgcatcggcaattggaatgggcgccgtcttatcacaacagggccaccccattgcattttttagtaaacccttcagtcagaaaatgctccgagcttccacctatgtcagggaattgtgtgccattaccatcgccgtcaggaagtggcggcagtacctcctcggacacagcttcactatcctaactgatcaccaaagcctgaaagaactcatgacccaggtcgtgcaaactctagaacagcatacctatctcgcgcgtctaatgggctacgattatcatatccagtatcgcttagggagccataatcaggcagcagatgccttatccaggttaccggaaggagcttctcaagcctttctcattctctccgtcccttgcctcacttttctagatgagcttcatgaccagctacgcaccaattcgacctttcagcaaaagctgcttgatgttcagaatcatctcgatcaccatcctgagttctccattgctgacaaactgctgttgtataaaggtcgtatctggttgccttccgatatacccatcatcaccacccttctgacagagtatcatgccacccctaccggtggccacgccggcgtcgccaaaaccgtggctcgcctcatgaccaatttttattggcccggccttcgagatgacgtctctcgttttgttgctcagtgtgttgactgccaagtcaccaagtacgaaactaagaagcttgcagggcttctctgtcctcttcctgttcccagtcaaccctggtatgacttatccttagacttcattaccagcttaccggcgtatcgtggcaacaccgtgatccttgttgtagtggaccgcttttctaagggaattcatctaggcatgctgccgccgagccactccgccctcacggtggccaaactattcttggacatagtggtgaaaatccacggcatgcccagaagcctggtttcggatcgtgatcccctcttcgtcagtcaactttggcaggagctattcaaggccagtggaactcagctccggatgagttcggcctaccacccacaaagtgatgggcaaaccgaggtcatgaacagggtcgtagagcaatatttgcacgcgttcgtccaccgatga

SEQ ID NO: 71589 - DNA, 960 bp, Glycine max
  Peptide Sequence Number=SeqID_188367
atggaatcacgtgggtatttgttttttcttctccaaggcttagtgtttgcagcccttgcaacctcagctttctcacaattgtcacctaactactatgactactcctgccccaatgctttgagcaccatcaaaagtgttgtggaggctgcggtgcagaaagagcaccgtatgggtgcatccttgctacgcttgcacttccatgattgctttgtcaacggttgtgatggttcagttcttctagactccacatcctccattgacagcgaaaagaatgcagcggctaatttccaatctgctagaggatttgaagtggtggatgacataaagaaggcagtagaccaagcttgtggaaaaccagttgtttcttgcgcagacatattggctgttgcagctcgtgattcagttgttgcgttaggtgggccatcatggaaggtgagtcttggtagaagagactccaccacagcaagccgtgaagcagcagatgcaagcattccagcaccatttttcagcctttcagatctcatcaccaacttcaagaaccatggtcttgatgagaaggaccttgttgttctttctggaggccacagcattggatatgcacggtgtgttacatttagagaccatatctacaatgactccaacatcgatgccaactttgcaaaacaacttaaatacatttgcccaacaaatggtggtgactccaatctttctcctttggactcaacagccgcgaactttgacgtaacctattactctaatttggttcaaaagaaagggcttcttcactctgatcaagaactcttcaatggtggttctactgatgaactggtcaaagagtacagcgacgataccgaagatttctacgaggacttcgcaaactcgatgattaagatgggaaatattcagcccctcactgggaatcaaggtgaaattcgggttaactgcaggaatgtgaactaa

SEQ ID NO: 71590 - DNA, 420 bp, Glycine max
  Peptide Sequence Number=SeqID_188368
atggttttcataaaatcgctctggtttatgcttcccactccaatgcttcggatttcaacactccaacgcttcggatttcaccactctaatgcttcagaaagcccacaaaagccagattctggaggtggagacatcaatgaaggaagcggtggcgtttccgttctccgggacgacgaggttgatgaaggaggtggttttgatgcacaagcgtcgaactttcaaggaagggctttaagatctcttctttggcaactcaactccctcatgttctctgtcagcgcctgtgatggcattggcgaagtcatcgacatgacgaccccaaaaattgtgaaaaatcttgaacgcttggagaaggaggaaaacatactgccaagtccagacattgatggattcatgaaggttgtctcatctgctaaataa

SEQ ID NO: 71591 - DNA, 1012 bp, Glycine max
  Peptide Sequence Number=SeqID_188369
atggttagaactaaaggtctcggtcaggctttagtgatgatgatgatgataatgatgcccccaacggcgcatgttgttgaggatcctccgatggccgcagaggaattgaatgaagagcaacaacaaccacctattgaagaaggtgttactaatgttaagggttttccaagaatggagaggtatgaacgtcttgagctgaagctatcttcccatggaaggaagatggctaagtttgggaggcttgctccagaaattgaaggccttgaaactagtagtttccatttgcccgacgaagaggtgactatcaccttggatgacatggcgtcgttgctacatttgcctatcgtaagggcgttccatacctttgagctactttatgtcgacgacattgtcgatatgttggtggaattactcgagagtggcacttacgcttggggcactgtaacacttgtgcatatgtatgataatttaaatgaggcgtcaaagagcacagtgaggcaacttgcaagatatatcactctattacaggcactacctgtgtcgacgtatcgcaggcgtctggacaaactaacccctgatgttgtgtactggattccaaatggtgatcaccgttcatttagagaatttgaggttatctccttgttttccggccatctcagatggggtcccttaacagtcattcaccgacctaagaaggttgtacgacaatttgggtacatccagactattccaccacatcttgttgtgccttcagcttctgttgaagaaatggatgctaaatggatgcagttcggtgactacattgcacatcaaccagtggcggcaggagcacctaatgaagtagacgttaatgtgcatcgtcctggacatgtagtggatggttatgtagcaattgttgataagttggagaggctactgaatctaaggatcccgactgaaggaataaaaccctgtattgttgttgaaaaatgtctgagcatcgcaagaagctacattggccaaccaactatag

SEQ ID NO: 71592 - DNA, 216 bp, Glycine max
  Peptide Sequence Number=SeqID_188370
atggcttttggcttttatcctcgggtacaagaagaacaggatcctcctgcagaattaaaacgagttttggatgacaatgatccaattgaggtggtggcgatgcatggcgacgaaggtggcattatggtcggagcatgtgaggtggcggttaggggtgggaataggtcaggccaggccaggccagactttaaaaggcctaagcttagcctacgatga

SEQ ID NO: 71593 - DNA, 228 bp, Glycine max
  Peptide Sequence Number=SeqID_188371
atgcttcaagaaagtcacgaaattttcgtttgcatcaaaggagattgcaaaacaactcggttagtaagggccaaattagccttcaagtcccaacttgggtatgttggtgcccatctaactgtgccagggagaattgagtttttttttttttctgaacccatgtgggacaccgaatgtcaatttcaaggtggcaaggaaaaatgcttgattgcagactggttcccttga

SEQ ID NO: 71594 - DNA, 342 bp, Glycine max
  Peptide Sequence Number=SeqID_188372
atgacggttattataacaaccgtctttgaaagtgaaaaattttcaaagacgagtaatgggatttccccaataaaaaacctggcaaaagctcctggaccagcatatggaaagaccattccccaccagaatgtcacttccaatggaaaagatttgcatcaattccaaacctacacctacagcccagtttcggtttttgaaagtagcagttcgtcctcagttgagaattccaacttcgatcgacctgtcatcccagtgaagcaggctcgtagtaacgtcagcatccttcaaacttcagtcctctatgagacaatgacttccacattttgtattatatttttttaa

SEQ ID NO: 71595 - DNA, 120 bp, Glycine max
  Peptide Sequence Number=SeqID_188373
atggcgagtccgatgacatgcgggggtaccttatggttttactttcatcatccagagacattcaagcccgatgacgcacaaggttcttctctgctaggcagggatgatcaagttcggtag

SEQ ID NO: 71596 - DNA, 1116 bp, Glycine max
  Peptide Sequence Number=SeqID_188374
atggcgatttctcctgaaacgttcccaacccgaaaacgacgacccgaaaacatggcgtcgtttatgtctccgaagataaacgaccttaacgttttgtgctccttgcttcaactcacggaccagatatgttccctaaacctcacaaccaccctcttgaaccgtgtttcctcttccaccatccgcaaaacgcagctcctaggtgtcgttttcgaggagctcgttcgcgtttcaaatctgaactccaattcttccgttctattcctctgcctcgaggaaatgtacatcgttctgcacaatatcaaaatcctaatcgaagatttctccaacggaagcaagttcaatttgctcatgcagatcgaaaccgtggctgataatttccacaggctcaccggagaactctccacgctcctcgacgtgctccctctccaagagctcgacctaaacgacgacgttagggaactcgctctcctcgtcagaaaacagggctcggaagcgaaggcgttcatcggagccgaacaaatcagcctccggaacgacgtcgttttcgtgctcgaccggatcaagaacgagatcgtccccgatcaagcgcatctagcttcgatcttcgagaagttggagattcgcgacgcgtcgagctgcagagcggagatcgagagcctcgaagaggagattcacaaccgtagcgaagaacaaccgaaaacggatctcgtcgcgttgatcggcctcgtccgtttcgcgaagtgcgttctttacggcgcgtcaacgccgtcgcagaagaccgtcactatgcggcggaatcagtcgttggagctaacaattcctgcggattaccggtgcccgataagcctagagctcatgcgcgatcccgtcgtggtggcgacaggacagacgtacgatcgtgcatcgatcaagctctggatggattcaggacacaacacgtgtccaaaaacgggtcaaacgctatcacacaccgagctaatccccaatcgcgtgctgcggaacatgatagcagcgtggtgccgcgagcagagaatccccttcaaagtagaaacggttacagggaaacacaacagcggagttaccaacaaagccgcattagaagccacgcgaatgatg

SEQ ID NO: 71597 - DNA, 153 bp, Glycine max
  Peptide Sequence Number=SeqID_188375
atggatgaagccaaacctatggcaacctttatgcatccttccatagtcattgataaggatgggaaaggtaatgatactccagaggcaattgatgctgatgttgcgtgtcaatttcttggaaaatcactggcttcttggtcatctaagaactaa

SEQ ID NO: 71598 - DNA, 300 bp, Glycine max
  Peptide Sequence Number=SeqID_188376
atgaccatcacaccccctcatgaaaaaggaattatgattaggtcccccaagaagaaaagctctgtggaggctgagaagttaggaaggaagaggcaaagagctgatatgaagcccctgctctatttcaagacaagaagcttcaagagaagtttggtgttggatggtcaacgagaaagtggtcaatggaaggtatggaccgacttctttgaaatccatgagccaatgtatcctagactggttagagcattcttctctgcaactaaagtagaccaatacaacttcactctgaaggctacataa

SEQ ID NO: 71599 - DNA, 449 bp, Glycine max
  Peptide Sequence Number=SeqID_188377
aactgcatcaactacaccgtcattgaggttctcaaactcgaggcccaaaagcccaaccgcgccgatgaacattccttggttcaagttcccgcagccggtgacagtgttccaaatcacaatttttcccagcgtgattgtttcgagagcgagccagcctttggtgtaggagtcgtcgccatgggagatctagtaatggcagcgacactggtggaagtcgacatcatcgagctggtcgtagacgttggaggagcaagggatggtagtgaagatggctggcattggacccatatgtcatcacttccagagtcaatgtccatgtattggtacgttgcagggcttccgattcctattcacacgaagtactctccactcccttctttcgtggtgatgtgtcctctatctagggttggccttggggttcaaacaacgagagaaatcaatgtggccct

SEQ ID NO: 71600 - DNA, 594 bp, Glycine max
  Peptide Sequence Number=SeqID_188378
atgtggtcatatgcaattcgttatgctcttgtatgtgtcggagtctgtgggtggaagaaagctttcaagtgcgagaacctgataatgcaatttcaagctcaattaattatccagaaaaatagaaggcatgttattatcaaccaatcacgtgaagatattgttcagttgctccaaattgataagttagagggtgctttttctagggttgatcagctgtataaagacacatgtttgttgactgcatatgatctaattgataatttctgtgaatgcatcatctccaacatgtccttcattagcaaatgcagttctgtacacaacttgtctacaaatgttgttgtggcaattgcaagtctcacatatgcttcttcaagatgtggtgaattgccacttttgcatctgataagaaacttgttcagagagagatatggtagggattttgacattaccaatgtggaactatttgctggaaactatgtggacttgccgttgaggaaaaacctgagcatctatagtgtaccagaagacgagaaactcatgttattaaatgatatagctctagaaaacttcaacaaagaacttgagatactatga

SEQ ID NO: 71601 - DNA, 207 bp, Glycine max
  Peptide Sequence Number=SeqID_188379
atggcctcatgctgtactagcaagaccaagaacatcaaggtggaagtagaaggtgaaggtacatgtggtgcaggaagttatactagaagcttgagggataggtcagagttggaggatgcattccagcgaggggtgttatttgctgccatcacaaagaggatagccaagatagctgctgaaaaatgtacgggggatgtacccaaatag

SEQ ID NO: 71602 - DNA, 372 bp, Glycine max
  Peptide Sequence Number=SeqID_188380
atggggtcacttgacagaattacatgttgcttacaagcattatggggaaagaaagaatgtttttcctcgtgtctatttgtttgctatgatttgatcccggcagacattgctcttgagttagcttggatgaacaatatgattgactttgccttcccatatcttctacagtttatccgtgagtacactggaaaagttgatgaactagtgaaggataaaatagaagcgtcgaaccaagtgaagactaaagagcaagaagaaaaggaaaatatggatgctcagttgttgcctcttaatttgcctgcaccaccaatgggtggtttggggatgcctccaatgccaccttttggtatgccacccatgggtagttactaa

SEQ ID NO: 71603 - DNA, 633 bp, Glycine max
  Peptide Sequence Number=SeqID_188381
atggcttattctctagtggatgacacctcctctcacctcttctcctttatcttctattgcaactccatggctaaaattaatggtgaattggttcctaaagaatgggatgagaaaacaaaagtgcaacatgatcaaaaagctggaaacattttaacttttgggttatctttggatgaattgtttcatactgcaagaacatcaaacaagattcacccacatagtaaatcacttggactcagaaagacgtttgaagatgatgaactaaacatcaagatctccaactgtcttaaaagaacttgggaacaaaaaatcacatcgatcaaggaatccaaggacttggcatcaatgccaatggaagctctcttcggaaaactgcttgcgtatgaatataagctaattcaacaatctcacgtgaaagatacaaaaaagaaaaataaatggattgtactcaaagctagttccttaaaggaaaatcacaaagaagaatctagtgatgatgaagatgcacaaaaattgaatttgatggtcaagaagtttggcaaatttctcaatgggtccaaagacaaaaaattctctaaaccttcaaagaaggtgaaaaacaacagcaacaccttcacaagcaagacctcatga

SEQ ID NO: 71604 - DNA, 471 bp, Glycine max
  Peptide Sequence Number=SeqID_188382
atgcgacaacagattagtagtccttggatgctaattggagattttaatgaaattataagcccctcaggtgtctctggtggatcctacattgtccctcgtgcttgtcttatggctgatatgatgatgtcacatactgtcagcaaggttgctgctatagtgaagaaaattcctctgtacaaggtttggtggggatgtacatttcaggagacaatgctatcaaatgaggtgaaggaccattttcaggagttcaagggattggctcttaatactgtgaagctctttcctctacctccttatcccagagaggcagattcaggacaacacttgaaaaggacccaagtaacatggggacaacttaggattgattcttttagacacaaaatgttggcgttgtggacgcagcttcaccaacaacaaacgtggcttgacggtgatgggcatcgacatacttcctgtgcccgatgcaaatga

SEQ ID NO: 71605 - DNA, 174 bp, Glycine max
  Peptide Sequence Number=SeqID_188383
atggagtccatgatggagatgattgtggagaacaacataagggcatccaaggacttggaagatctacttgcttgctacctttctcttaattcagatgagtatcatgacctcatcatcaagacatgttctgtggcggataggaacaagttcacaagagacatgaacagcgtatga

SEQ ID NO: 71606 - DNA, 396 bp, Glycine max
  Peptide Sequence Number=SeqID_188384
atggaggagaaggtaaagctgaaaattaatgaaggtttaaggagcacctacttgaagctcttgtggagaagaggtgagaggaggcaccatccactagagaataagccatggaaggagaagcttcaccaccaagatagtgccttggataagaagcttagaaagggagcttcagtggaggaagtgaatgagagaaagagagagagaaagtggaatggaaaattgaaggaagaaaggaagagaacccaggggcccaaaatctaccctaaggctcatgagaaccctagggccttgtcctgcatctttggcccaatcttgttagagtcttctatccaatgcccttggggggtaggattaggttcactctcaatttctagagaagctacttcagatatctaa

SEQ ID NO: 71607 - DNA, 255 bp, Glycine max
  Peptide Sequence Number=SeqID_188385
atgttggcaacccattccgggtatcgagatacgaccaagaagccagcgtcgaattgcgtcttcacttattcttttatcttcagggacatctcgggcttcatcctcctcaacttctactttatcggggagcactcgggatttagagctcgcctaggcgagctgttgcttcaacctaaagtaaccttgctcgcccaggcgagcgcagctcgcccaagcgagctggttacttcacccctaagctatttgggggcctag

SEQ ID NO: 71608 - DNA, 576 bp, Glycine max
  Peptide Sequence Number=SeqID_188386
atgtctggtctacgattgacacatgtaaatccaaatgcactagagctgctctcaaaaatctcaatttggcagaagatagatctattccaagggtacaagctcatttctttcctaagaatatcatattgggtcaacattttgtctgagttagtgtgtaaagcaaaagaactagtgcaagcatacaagcttcaaaatgtagttaagactgcagacaacttctgttcatgtttgaagcttgatagaaacacagatgttagctatagtaatatgaggaaggctgcttcttgggaagatttgactgacaactatttattctgttctaaagctgtagatcctcagtacaaggatttaaggcattttcagtggcattgggaaaagggggagcctgtcattgtcagcaatgtgcttgaatgtacatctggtttaagctgggaaccgcttgtcatgtggcgtgcattacgtcatgtaactaataccaagcatggccaacatttggcggagaaaacaattgattgcttagattggactgagagtcatcagaacagaatgtccttgaaatatttcgtgaagtactga

SEQ ID NO: 71609 - DNA, 726 bp, Glycine max
  Peptide Sequence Number=SeqID_188387
atggggcctaatgttgacaatgggtgggcctttcaggtacacatatctcaagtgggccaaaacaagatgaggatatcatggatcacagatagcccaactcctgcaaaggtttcgtatggtccatctccttcggttaatgcatcctctgccataggaactacctcctcgtaccgttatctggtctacgagtctggtgaaattcacaacgtggtaattggtcccctcaaccccaacactgtctactattaccgtttgggtgacccaccctcttcccaaacatacaactttaagactccaccatcccaacttcctatcaaatttgcagtagttggagatcttggacaaacggattggaccagatcaaccttggagcatgtgaataagtcaaactatgacatgttgttactgcctggtgatctatcctacgcagacttcatccaagatctatgggactcctttggtcgattggttgaaccattagctagccaacgtccttggatggtaacccaaggcaaccacgaggttgagatgattccactgattcacacaacaccattcacggcatacaatgctaggtggctcatgccattccaagaaagtggatcaaactcaaatctctactattctttcgatgtggctggcgttcatgtcatcatgcttggctcttacactgactttgactcttcttctccacaatacaaatggcttcaaaatgacttgcagaag

SEQ ID NO: 71610 - DNA, 531 bp, Glycine max
  Peptide Sequence Number=SeqID_188388
atgctaataccttcctcaagcgtaaatacaactcccgaacttaaaattttcattttgaccagtttccttcggtttttccgacgttttccacaaataaacgtgggtggcgactccgtgcatctttcctcctttggaaagcgcacccgtgagcctcgccttcgctcgcccgcaaaagggcacgttgcgacacaattgaaaaatgatgatgatgttaacacaatgttaatgtgtaatgatcaattcttatgtgttgtctcgattgagttattatgcaccattggtagaacactggagggtatattaaacttacttcaagccactatgacccattctcatgatgccctattatattacaatgggaggtggaacatgccacgcaaacacgactttggagattactcgttcataggaaaaaatctaaaaaagtttgacattcctttgggatgtaccatcgatgaactgaaggatttgatcaagcaagttggatctcaagggattccccttacggtattcatgaatcacaaacagtaa

SEQ ID NO: 71611 - DNA, 231 bp, Glycine max
  Peptide Sequence Number=SeqID_188389
atgtacatcacaatcggagatgggggaaaccgtgaaggccttgctactaagtacataaatcccaagccaacaatatcaatattcagggaggctagctttggacacggtactttggaggtatttaatgtatctcatgcacgctggacctggcataagaatgataacgatgaagcagttattagtgattttgtgtggcttacaagtttttcctctaatccttcttgtaaatag

SEQ ID NO: 71612 - DNA, 231 bp, Glycine max
  Peptide Sequence Number=SeqID_188390
atgggtctaagaatgtgtgtgccagggttcttgcttttactaatcatcggaatcttcgaactcgatgtcgtttctggttacattcaaccaccacctcgtcaaacactctttattccacatacagatcaagactctcattctacacaacaggtacacatatctcaattgggccaaaacaagatgaggatatcatggatcacaggtagcccaactcctgcaaaggttacgtag

SEQ ID NO: 71613 - DNA, 231 bp, Glycine max
  Peptide Sequence Number=SeqID_188391
atggaaaggctgaactcagagttgtactaccagaactgtcacatgatcaaagagaatgaaaggctgaggaagaaagctcagcttcttaatcaagaaaatcaacaacttctgtctgaactaaaaaagaagctctccaagggaaatgcaaaaaccaatgctgctccaaacaccattcttgacctgaaccttggatcaagttctagtcataatccttctggttccagcaattaa

SEQ ID NO: 71614 - DNA, 255 bp, Glycine max
  Peptide Sequence Number=SeqID_188392
atgttctataggatcaagatggtcattccacagaagtctactatgaaacttacaatcctattgcttttcattatgattgcatcagatgtgtgcaagaaatcagatgcaaggaatgttgtcactctccgttgcaagaatcatgactattgtcaatatctttttcgatttagtggttgcaaatgctttgatgcttggtgtagatgtccaagggaagtgacccctttcgtttcaccaacaattaataaccacatttaa

SEQ ID NO: 71615 - DNA, 1620 bp, Glycine max
  Peptide Sequence Number=SeqID_188393
atgcaaaacttcacaaggctttgccaaacaaagagcattgtaactgtcaatggacgatttcctggtcctagaatcatagcaagagaaggagacagaattgtggttaaagtcgttaaccacgttcaatacaatgtcacccttcattggcatggaattcgccaactaaaaagtgcatgggcagatggaccagcctatatcacacagtgtccaattcagacaggtcaaagttttgtgtacaacttcacagtcattggccaaagaggaacattgtggtggcatgcacatatctcatggcttagaacaactctctatggtcccattgtcattcttcccaaaagacatgtcccttacccattccctcaacctttcagagaagtccccatcatattgggggagtggtggaaagcagacacagaagcagttataaaccaagcaatgcaaacaggattggcaccaaatatctcagatgttcacaccatcaatggtcttccaggtcctgtctccaactgcgcagccaaagaaacattccagctcaaggtgaagcctggaaaaacatatctgcttcgtctgatcaacgctgcacttaatgatgagatgttcttcagcatagccaaccacacccttaccatggttgaagctgatgcagtgtatgtaaagcccttcagcacaaagattgttctgatcacacctggtcaaaccgtcaacgtccttctcaaggccaaatccaaggctccaaatggcacatttgccatatccacaaggccctatgctacaggtccagcttcttttgataacaccacagccacagggttccttgagtacaagaaaacttcacatgcaagcaacaagtcaaacaccaagaagcttcctcttcttagagcagtgttccctaaattcaatgacactgtctttgcaatgaacttccacaacaaggttcgtagcttggccaatgcaagattcccagcaaaagttccaaaaaccgtagacaggcacttcttcttcactgttggcttaggaatcagcaaatgctcaaaaaatcaacaatgccaagggcctaacaacacaagggtagctgctgctgttaacaatgtgacatttgtgacaccaaacattgctttactccaagcacattttttcaacaagtccaaaggagtgtacaccacagatttcccttccaaccctcctttcaagttcaactacactggcactccaccaagcaacatctttgtgagtagtggcactaagacagtggtgttgccatacaacaccagtgtggagttggtacttcaagacacaagcattattggagctgagagtcaccctcttcaccttcatggcttcaacttcttcattgttggccaaggaaatgggaactttgaccccaaaaaggaccccataaagttcaaccttgttgaccctgctgaaaggaacactgctggtgtgccatctggagggtgggttgctgttcgctttcttgctgataatccaggtgtttggttcatgcattgccaccttgaagtgcatactagttggggcttgaaaatggcatggatagtccaagatggtaaacggcgcaatcagaagctgccacctccaccttctgatcttccaaaatgttga

SEQ ID NO: 71616 - DNA, 1740 bp, Glycine max
  Peptide Sequence Number=SeqID_188394
atggattccccccactttccttcatttgcatctctcagagttcttctgtttggtttctgcgttataactttgtttcctgagtttgtagtgagcataacaaggcactacacatttaatgtggagtacctgaacgtcactagattgtgccacacaaggaacattctgagtgtgaatgggaaattcccaggacctcgcttggtggcaagggaaggtgatagggttgtggttaaggtggttaaccatgtctcaaacaatgtatccattcattggcatggcatccgtcagataacaactgggtgggctgatggaccagcatatgtgacacagtgccccatacaaaccaaccagtcatacacatacaacttcaccatagttgggcagagagggactctgctttggcatgctcacatatcatggctgagagcaaccatctatggacccatcatcatcctccccaagcacaatgagtcttttccattcgagaagccacacaaagaaatccccatactttttggggaatggtttaatgttgacccagaagcagtcataagtcaagccttgcagacaggagggggacccaatgtttcagatgcatacaccatcaatggacttcccgggcctttgtataattgttcttctaaagatacatacacattaaaggtgaagccaggcaagacatatctgctaagactaatcaatgctgcactcaacgaagagcttttcttcagcatagccaaccacaccctaactgtggttgaagcagatgccagatacaccaaaccatttgacacagacacactcctcatagcccctggccaaaccacaaacgtgcttctcaaaaccaagccatattttcccaatgccacattccaaatgtctgctaggccttatttcacaggccgtggcacctttgacaactccacaactgcaggtaccctaatctacaagcaacccttgaaaaattccagtgtaaaaaatctcacccttctcaaaccaactttgccaccaataaatgccacaagctttgtggcaaacttcacagcaaaattcagaagcttggctagtgccaaattccctgccaaggtacctcaaaaagtggacagaaaatttttcttcactgtggggctagggactagtccttgccccaaaaacacaacatgccaagggccaagtaataacaccaagttcgcagcctcggttaacaacatttcttttgcacttccatcatctgtttccatcatgcaggcctactattcaggccaggccaatggggttttcaagactgattttcctgccacccctttgaaccctttcaattacaccggaacgcctccgaacaacacaatggtcaccaatgacacaaagctggtggtgctcaaattcaacaccagtgtggaggtggtgctgcaggatactagtattcttggtgctgagagtcaccctttgcatcttcatggctacgacttctttattgttgggcaagggtttggaaactatgaccccaacaatgaccctgcaaagtttaacctgattgaccctgttgagaggaacactgttggtgttcctgctggtggctggattgcttttagattccttgcagacaacccaggggtgtggttcatgcactgtcacttggacctccacacaagttggggattgagaatggcatggctagtactagatgggcctgggcccaagcagaagcttcaaccacccccttctgatcttccaaaatgctga

SEQ ID NO: 71617 - DNA, 330 bp, Glycine max
  Peptide Sequence Number=SeqID_188395
atggcacgtggcatcttctactgtcaccacttagctgtcacctactcacaacgctgtgtgaaagctcgcacttttacggcgaattttttgtgggcttgttggattctgaaagaaggggcaaaagggtgtctgaagatagtgttgaattgcaatttggttaagtgggggtgtcattatggagtgggaagacgagtgcagaacgccgaggttggtgcagaatcagattccagcggttttcatctgcccgccgccgccgccgcggaagaagccggtggccggaaagcgacgaccgccgccgaaggaggggtacttccagccaccggatcttga

SEQ ID NO: 71618 - DNA, 744 bp, Glycine max
  Peptide Sequence Number=SeqID_188396
atgcgctgtaaagaagtgaaacgcctacggaaagaagccaaatcacgaatattccaggatgatggaatgcacgatcttgacatagttgaatggaaaaagaaaagaaaattacagagtgatcagttggatttgattagacctaaacataaatgctgggttggaagtttctcctctgaacatgcttcagtgtttgataaaaatccagttttagagagcatgcacaaccacacagttgaaagctccaaacatgaatctgccaaagacagcaatagttttatggaagactgtgatactgccatgtctgtaaatgaagaagccaaacacgagacagattgtggaagttcatacttatatggtaggccttccacttctctgggtaaccactgccctttggatgtatcaacagtaaatagggtaagctatatcgatgaggaagcatttgttgatagccaatgcattccaccttatgatgatgccgatgcacaagctttgatcaatcatgaggaacactttctggggttaggaagcttttcaggtcatgaatgctcagaagatgctgaagacagcaatgaggaccctgtagagaaggaattcgaagattttctttattccagtggggtgaatcctaatgtgtatgtcctttcatctggaagatgggatgtaaatcaagaagctcaatcaagctcaagaccaccaacaattgatcaagagtttgaggagtacttttctatgcttatgctctag

SEQ ID NO: 71619 - DNA, 459 bp, Glycine max
  Peptide Sequence Number=SeqID_188397
atggaggagaccacgatccagcccaagatgacgccgaattggatcttcccggcgagtaattggaagaggcagaaggacattgtggttgacgcggaaagggttcagaacggatctgattttgctccagatttggtcggggtggatcccgagctcgtcgaggaggggttcctcgtcgtcgaagttggcggagccgccggggcccacggcggggccggtgtagatcggccccgaggaggtggacgccgcggcggagcctatgtcgaaggacatgaaggggataccggagttcggctggaacggcggcgtgggcatgcgccgctgctggaggtttggacccgccgcggcggggttgccggcggaggggaaagccaccggcgggaccttgaactctttattggccatgatgagattgagatctggttggaagaaagaggatttcggagtggaactagggtttga

SEQ ID NO: 71620 - DNA, 339 bp, Glycine max
  Peptide Sequence Number=SeqID_188398
atggatttgaatgagctaggcttaagtctcaccttgcaaaaaggaaaaaatttggaaggtgttgaagctgctgtctcgctaagcctcgaccatgtgcttagcgagtatcatctgctaagcaagacatcagcttgcttagcgagtaaaaggaatcttgaagagaatctgtcatgccagcacgccctcagtgtgtcatcagctcgccaaacgagaagtttgtctcttctggcgctaagcgcgaatatgacactaagccaaaattcatttattcgcgctaagcgcgaaaatggcactaagcgcgcctttgaggatagaaagccctttttaagcctgaagtga

SEQ ID NO: 71621 - DNA, 219 bp, Glycine max
  Peptide Sequence Number=SeqID_188399
atgcagaaagaaatgcgcgatgtaacgtttaagatgatcaaaactgcatctcgagctttattgaataatggcagaagtttatatacagagaaacacgaaaggcttttacccagaagcttggacaatcttctaaactttgcttcagcagttcagcagcttcattactataaaaaaacctatatcatattaggactcccaaacaccgcaagatttgtgtga

SEQ ID NO: 71622 - DNA, 573 bp, Glycine max
  Peptide Sequence Number=SeqID_188400
atgaaacaaggcgcactctcagtcacggaatatttcactcgattgcgtgtgatttgggacgaaatcgaaaatttcagacccgatccagtttgctcctgcaacattagatgttcttgctccactttcaccattatcgcgcaacgaaagcttgaagatcaagctatgcagttcttgcatgatttgaatgtacaatacgccaatattcgatctcacgtgcttctcatggatcctatacttgccatatcaaaaatattttcatatgtggcgcaacaagaacgacaattgttaggtaacactgcttcgaatctcaatctcgaatccaaagatatttccattaatgctgcaaagaccgtttgtgacttctgtggacgaattggccatgtggaaaacgtgtgctacaagaagcatggtatgcctcctaattacgatggaaggaacaagagcaataacacaaggtatggaaaaacgtgcacccattgcggcaagataggccacaccgttgacgtctgctaccggaaacatggcttcccgccagggatacaaaccctacaatcaaaacacaactgtgaataa

SEQ ID NO: 71623 - DNA, 357 bp, Glycine max
  Peptide Sequence Number=SeqID_188401
atggggacacagagatccgcgtgcaccatagtattggtcatggcagcagttttaggccgcgtgagtgagtgggttactgtgtttgcggtgttggtggttcacggtggctgtgttggctcggccgatggctgggcttggccgatggtggttttcggtggctgtgttggctcggccgatggctgggctcggccgatggtggtggttcagtggctgtgttggctcggccgatggctgggctcggccgatggtggtggttctcggaggaggaaaggggctgagtggtggctagtggtggctcttggctgttccggcgttttgactgtccgtattcccctctctctctctctctctctctga

SEQ ID NO: 71624 - DNA, 657 bp, Glycine max
  Peptide Sequence Number=SeqID_188402
atgactataagtgattttgatcgtcttggtgtgttgtacgaagaggtgtcatgggaagatgtatctttgcatcctttgtgggagatatatagtttaagaaataactcttggagcagacttgatgtcaatgtggctgattgttgtcaccaaattccaggttatcaagtgtacgtggatggaatgtgtcattggcggggtcatgagggtattccccaagaagaatgtttggtgtcatttgacttgagcaaccaagtgttctttacaacacctatgccattggacatggatgatatgagagcattccttggttcaacaaatgacgattttgattttagtttggacagatacttggtggtgttaaatggatctattgctttaatctcatattatgttgagacaactatttttcacatatcaattttgggtgaagtaggtgtgaaggaatcatggactaaactcttcatcgttgggccattgccttgcgtttattgtcctattggagtaggaaagaatggtgatatattcttcagaagaaaagattacgaactagtttggtttaatttaagtaccaatatgattgaggagcttggtatcaaaggagagaataattcttgtcagataggaatttacaaggaaaacctcatttccattgaatga

SEQ ID NO: 71625 - DNA, 1107 bp, Glycine max
  Peptide Sequence Number=SeqID_188403
atggttcccgtctcgatcatcaaaatgagggaaatgcccaggatgccgagtggaaaaattgaccgaaaaaaactgccggctcctgaaagcttcatcagtcatgagaaaagtgaagacattgaaataaatcctgaagctcctatcgaagaaaaacttttgcagacccttcattggatgtttccaggaaaagagatccaattacatcaggacttttttacggatctgggaggacattccttgcttgctgcaacattagtttctcacctccggcaaaaagcagggattccttacgcttctttaaaagatatttatgaaaacaggccgctttccgcttattcagattgccttaaaaataaacatactgaaaagacatccgatcaggaaccgtttacaagagtttcgtcctttcaatattatgcctgcaatcttgcccagactatttccttactggttgtttttgcattatttagtgtacagatatttttcccctatcttagttattattatttccagcttaacgggtacggaaccggattagccctgttaagtgctattcttttgtatacactcataccaccggtttattctgttattattcttttaacaaagtggcttgttatcggaaaaataaaagaaggtgattatccgttgtggggctggtattacttcagatggtggctttggaaaaccgtaaaaagactgatgccttcagaatttattgttgaaaccccattgtatccgaaatatctgaaattattaggtgtacaagttcatccgagcgcacagcttagccttttacctattgcagctgaagatcttgttaccattgatcaaaacgtaaccacgagctcaggatgtagtattgataatgcatctgtagaaaatggagtgcttaaaataagaaaagtacatattaaagcacacgcttatcttggttcttcagctatagtatgtggtaatactgtcattgaggaattcggagaacttcaggatctcagctgtttaaatgaaggaaatacgatcgggtacggtgaagtctgggatggtagcccggctgaaaagctaagaacaaaaatattatcacaaggtgtctgcaataccgtatga

SEQ ID NO: 71626 - DNA, 366 bp, Glycine max
  Peptide Sequence Number=SeqID_188404
atggaaaatattggaagtgggaggggcagaacatttcaaattgcaggttcaagattaccagattgcatgcacgcttgtggctcatgctccccttgtagattagtaacgggacgtgccacgtggcgctggtgtcgccattcccaccagcaccttcccttttgtctacgtggcgttgaagacgccagcactaatggcaagttgctcaaggcgccagtcaaacgcgaggccctaggattgcagcgttgcatagtgcaacaggtcaaggttgcagcgacgcaggggcagcaagtcaggggtgagggacgcgccattggggattgcgagttgcataaaggaggcgtcattccctccagtgttttgctttaa

SEQ ID NO: 71627 - DNA, 306 bp, Glycine max
  Peptide Sequence Number=SeqID_188405
atggaaaccgcaagcttcaatggcgagttcgtgagcacaggacacgtggatggcaacccgctactactgctggcgatttcaggtagaggcgcgtcccgccagcggtgctggcgatttcaaggttgtgctgaaatcgcagcattgactggcgatttccaagggctacgagtagggtgcagagagagaggcacaaaagccatttccgaggctctgcacggagctgcagctgcagagcagggagtcgccatcaggaactgcgacttggtgaggaaaccaccagcagtgttggcgatttgcattcgttaa

SEQ ID NO: 71628 - DNA, 664 bp, Glycine max
  Peptide Sequence Number=SeqID_188406
atggaatggaaaggtgaccactatagaatggagctctcgaggttgggaattttatgcaatgggcaaaagcctcaaagagcaatgtcaagtgaaggtagaacgcctatggctcatgaacttatatcccaaacaaaatccacctcttccaccaaggatcaagacactaatatggagatccttcaagttccacgtgcaacccctgcatatgcacctcaacctcaaccttctattattcccccttctatagataagaaagaagttgtagtaattaagaaacctgaaaggctttctaaggcagaagcaagaaagaaagccaagtttaacaaaacctttgatgaaaaaggagtcttggagatggaggaatcttcatcagttgaggatgaacaaagaaaagtggtagaggaagaagctttggaaggcgaagatgatgaggaacgaaggatgaaggaactacaaccagtgcaagtagagcctaacacaaatccacatgctaagctggataaggtaattcttcaatatgtgttagttgcatctatcaacgaggatcttatagtggcagatgttgtggaaatagatgatagagtgctaggggttgttccaagaccaatgactgcagaggatgagaagaaagtaattgagaccctagagaagcatatggaagcat

SEQ ID NO: 71629 - DNA, 249 bp, Glycine max
  Peptide Sequence Number=SeqID_188407
atggtggaaaagggaaaatttgatcatatagaggaaaggctcaaggccattgaaggaggtggagattatgctttcgccaacatggtagaattgtgcccagtgcctgacatcatcatccctccaaagttcaaagtgccagattttgataagtccaaggggactacctaccccaaaaatcacctgaaggtgtattgcaggaaaatgggagcatactcgaaagatgaaaaattgttgatgcatttcttctag

SEQ ID NO: 71630 - DNA, 438 bp, Glycine max
  Peptide Sequence Number=SeqID_188408
atgggattgagaatagaaaaaagtgggttggaaaagcaattccaaaatattcctttcgattgtaagggaaacagagagaggacttttgggcaaatttccccatttggggtccttttgcaaacttattccccaaatggggtcattttgaaagaatttccgccatggtgttgttttgtacgtggtttgcatggattttgcatggaaaccgcaagcttcaatggcgagttcgtgagcacaggacacgtggatggcagcccgctactgctgctgccgatttcaggtggaggcacgtcccgccagcggtgctggcgatttcaaggctgtgctgaaatcgcagctttgactggcgatttcagacaggctacgagtctagggttgcagactttgcaggacgtgcaggacgcagttgcagctgattttttgactttttgggcttag

SEQ ID NO: 71631 - DNA, 1892 bp, Glycine max
  Peptide Sequence Number=SeqID_188409
tcagagttgtggtgatcagtgatcgagccacagcaagagccatgtacaagggaagattaggaggcaaggctcagcttggatatgttgaaactgaccctttgggtcgatatggacgtttcagggacattctaggcaaaggagcagtgaaggtagtgtatagggcctttgatgaggtcctaggaatagaggtggcttggaaccaagtcaagcttggtgatgtgtttcattcaccagatctacttccgaggctttattcagaggttcatctcctcaagaacttggaacatgactccatcatgaccttccatgattcttggattgatgtcaactgtagaaccttcaacttcatcaccgaattgttcacatctggcaccctacgagagtatagaaagaagtaccagcgagtagatatcagagcagtgaagaattgggcacgccagattctaagtggcttggagtatttgcacagccatgatcctcctgtgatacatagagacctcaaatgtgacaatatcttcatcaatggccatctggggcaggtcaagattggtgacttgggccttgcagccattctccgtggctcccaacatgcacacagtgtcataggcaatttctcttgctcttttagtacaccagaatttatggcacctgaattgtatgaagaggaatacaatgagctggtcgacatatactcctttgggatgtgcatgatagaaatttttacttctgagttcccgtacagcgagtgctctaaccctgctcagatatacaagaaagttacttcggggaagctaccagaagcctattacagaatccatgacttggaagcccaaagatttgtgggaaaatgtttggcaaatgtctcagagaggttgtcagcaaaggagctcttgttggacccatttttagccaaggaacaactagactctccacttcctagcccaacattacctaaaaaacaagcccccacactcaatttcactgcatcacttgccaaagagttatctcagccaaagagtaaccaaacaaaggactcacacatgacaatcaccggatcaataaatgaagaggatgacacggttttcctgaaagtacaaatttctaacaaagatgggcaaaagagaaacattttctttccatttgacaccatatacgacactgccattgatgtggcaatggagatggttaaagaactggagattagtgacttggaaccattggagattgctaaaatgattgaggaggagatatcagctttggtccctaaatggagggattggggcagtgctgagtatcaaaagcagcatagttttagctatgaagaagagtatgacatgagtaaccaccaccctttcttctcaacatcttctcgctcttcctctcatgcttctcttccagtgtttggttcttcctacaagaataattcccactatcgtgggaatcattacccttttgctcaagattggcctcaagatgaactatttatgaatgatgatgcgagctctcaaagctcaatgaactccttcaagtgtttcaatttcaattgctgtgaccctggcaatgaagatgagcatgatccaactctagtactaggagcagaacacctttactacaccccaaaaggaaacgaaaagtgcataagattttgtcctagagaagaagtgatggatgctgatttcaccaaacagttatgcaacatgagaatggattctcacaggtgtcatggaatgcacaggctaaccaggatccgttccttcgtggacctgaggagacaacaactgcaacgatcactgatggaggagattcacaagaggagaatgttcaagacggttggtgccgttgagaacattgggtttcagaatccagaaggaggcggatgtttttcttattga

SEQ ID NO: 71632 - DNA, 486 bp, Glycine max
  Peptide Sequence Number=SeqID_188410
atggggaatggtggtatatttcttgcacatgcaacaagtcagtgtaccctgattcaaagatgttttttttgtgaaaaatgcaacaaacatgtgacaaatgttgttttaaggtaccgtatcaaggtttgtgtaattgatgaatcagattcagccacttttgtgatttttgatcaggatgctagtatcctttttagcaagtcatgtgctaatatatttgaaacataccagaagagaggtcttgctggaacttttcaaagggagattattaatttagtgaataggtctttccttttaaaagttgaggataagagtggatgcaactcgcagtttgagaaaacttttagagatttgatgcccaagttttttgatgttgttgaaaatgattcgcaatgtggtgaaaaagaaacaactgatttatcaaaggattctaaagagttaacctttactaaacataatttctattgcaaattaacttggatgaattga

SEQ ID NO: 71633 - DNA, 681 bp, Glycine max
  Peptide Sequence Number=SeqID_188411
atgttgtgtactcttttagaagaggagtacacaaaggtacacaacttgaagagtgctaaacaaatatgggataactttgctgtaacatataagggcacctcacaggtaacaacactgagagtgttaaagaatcttgagtctatttcccttgaggaacttattggtaccctgaaagttcatgaacaagagctccagcaagacaaaggtcttgcaagagaaaaatctctagctcttagcagtaagaagaacaagaaagaaccatcatctagagaacaagacgatctcgccttcatctatcacaaaatctataagatgtggagaaacaaaagtgggtctaagtggagaagctcttcaagaagaatgccccaggacaagaaggaaaaagacaaaagctccatagtctactatgaatgcacaaagcctagacacttcaagtcggaatgtccagatttggagaaaagccaagataagaaattctttaggactaaagaaaagaaggggcttatatgcatatgtgcttataaaaacctacgaagagatttcaaaaatctatccaaagatcatttaaagcttgagaaaacctttcaggatcaagtagatggttcactaaacgagtccgctcaagcagtaaaacttgtgaaactcttaaagaaaaagagtccaagttatgcattgagatag

SEQ ID NO: 71634 - DNA, 324 bp, Glycine max
  Peptide Sequence Number=SeqID_188412
atgcctgcatatgctgaagatcgggttggtgatattaagcatctttgtacagtggcaatgctagctgtccaattaactggtcccaacaaattaaatgctaacgtgaggatggcatattcacatgaagagaaaaaatcagaggaaaacaaagtgaaggagaaaaaagcagaggaagaagaaaagaaagaagatgagaaaaaaccagaggaatcaaaagctgacaaggaatccaaggaggaatctgcgccaccagaaatcgtgcaaggcacaaccttcgcaatgcatgaacactttaagcatgatttttggcatcttttaagttag

SEQ ID NO: 71635 - DNA, 300 bp, Glycine max
  Peptide Sequence Number=SeqID_188413
atggaaaaaaggttctctgttgaacgcatggagacaaacttggtgatcaagaacactttggagtcttcgctcaaatccttcacaaggattgttatctacaacatgaatctcatcatgcaacagaggttgcctccatctatccaacaccagtttgcacctccaccaccactaaccattgttgtgcaacctcaccttgagtttcttgcatcaaaggctacaatacctaatgatcttgtgcctatgccttcgcttttgcaaccaaattcaccacctcctaatctctcaaactctgtctactga

SEQ ID NO: 71636 - DNA, 366 bp, Glycine max
  Peptide Sequence Number=SeqID_188414
atggtcttaaaagaagagttagccgcttgctcaaggtccaaaaggaacttgactcagcgtttgtgcgagacagagaccaacatgttagctatcatcaccaagtatcaagaagaactaagcctagccacaacccacgagcatagggtggcagacgagtatgcccaagtgaaaaacaccataactaaacgcgccacaaggcatccctatcgcaccagatccaaatctaggacgatgggtgaccaggaggagacacaggaacagatgaaagccgacatgtcggctttgaaagaacaaatggcttctatgatggaggccatgctaggaatgaggcaattcatggagaagaacgtggccaacactgccgct

SEQ ID NO: 71637 - DNA, 495 bp, Glycine max
  Peptide Sequence Number=SeqID_188415
tgcaaagaaaggaaccattcactgtttcgattaggaaagcaaaaaataccaaaaaataagggcaaaagggtcttttcattgagtttcctggaccctagctcgcccaggctagcctatggctcgtctgggcccccaaattacttcagggttaaggaactagctcgcctaggcaagccagttacttcaggagtaagcatcagctcgcctgggcgagctgccattgccccaagtgcctattttcctataaataggcatgctaaggaggctgagagggggttccagcattcagtagtgaaggaaattgagagaattaggagagaagaagaagaaatgaagctggggcgctaccaaattgtgattgtgatcaatccctacttcgtttcttgttcggtgttctttgtgcgaccgtcgggggcccccttgttattatgtgcatatccatcttctccatctatcatcaacgatctcatttttctttgtaaagttcaatcttaa

SEQ ID NO: 71638 - DNA, 252 bp, Glycine max
  Peptide Sequence Number=SeqID_188416
atgtcaccacacgttatgcaggatggtggaagcagtcaatactggatcatcatcgtgattttgcaaagaatattactcggtgaaacagcagtctatgcaatgatgttggtgttttcaactgaattttctcctttgaaaactattttatttggaaatctttcccaagacaccgttgaaccactgatggaggctttggaggaagattataaagatggaaatgagataaatgaatcaagccagtttattggagga

SEQ ID NO: 71639 - DNA, 201 bp, Glycine max
  Peptide Sequence Number=SeqID_188417
atggagcatgaaacattccttgcaacttggttggcagagattgatttctctcccaatggcttgagattctcaaatttgcaaccacagcctaggttgatcaaccatgaaaaacctatgctatgtgggtggcacaagcttaatcccttgaaaattgagggtaggagatttgccctggattcaactagggactactttccttag

SEQ ID NO: 71640 - DNA, 282 bp, Glycine max
  Peptide Sequence Number=SeqID_188418
atggaagagaaggtaaagctgaaaataaatggaggtttaaggagaacctacttgaagctcttgtgctctgattaccccttgatggaagcttgcttgagaagcttctatggaggttggatctttgagcttcaatggggtccttcaatggtgatttttagccatggagttgcagtggaagataaaggagaagagcttagcacatgggaagcttccttgagaagcaaggaagaaaagttccttgagaagctagaggggggctactcacacccctcaaatatgtaa

SEQ ID NO: 71641 - DNA, 186 bp, Glycine max
  Peptide Sequence Number=SeqID_188419
atggtgaccctctttctcagtcatcaccattggaccctactattatgggtaccccaggaggcaaatgccaaatcttggtcttgtgggaaggcttgccggaaattgaagaatcatgggaagatacgagacaaagttgtcataggagagatggataattatacaaccctagctatgaggaaggactag

SEQ ID NO: 71642 - DNA, 276 bp, Glycine max
  Peptide Sequence Number=SeqID_188420
atgtgcactggtgctgaatctcgaggagatataaatggtgaccctgtgatttcaaaggttggaggagactatgaggatagaatgagaaccatagaattggaaggtggagaagaaacagcttgcaactggggcacatttgttcgagggcttcttcaaggcatacagcatcatctaactgcccttaatctccctagtctttctgcttctgaggaagaaaatgccgagacatctatgcagacaatattcttggagcaagtatttcttttattggtttga

SEQ ID NO: 71643 - DNA, 1359 bp, Glycine max
  Peptide Sequence Number=SeqID_188421
atgactagcctaatgatgtactctcgatctgctgtgtccatgttgttcttgggtcggcaagggaaagtagagctagcaggaggctcactagcacttggatttgccaacatcacagccaattcagtcctcaaaggcctcactatgggaatggacccaatttgttgccaagcatatggagccaagagatggtcagttctcaaccaaacctttctcagaactctgtgtctcctcctacttgttgccataccaatttcaattttatggctaaacatggaaccaatccttcagatgctaggtcaagaccctgaagtcacaaaagttgcccaagtttacatggtcttctctattccagagttgctagctcaggctcatctcaatccattgaggtccttccttagaactcaaggcttaaccaccccagttactatagctgcttcttgtgcagcactcttgcaccttcccatcaactatttcttggccacatacttaaacttgggagtaaagggtattgcattagccactggtttgaactcaataaacatgactttgggtttgttgctctatattttgttctcaaagaaaccactgaagccttggcaaggtgctacacttctctcagcctttcatggatggaaaccattgctgagtttggcattgcctagttgcatctcagtgtgcttggagtggtggtggtatgagataatgctctttctgtgtggcctgttgagcaatccacaagccacagttgctaccatggggatcctcattcaaacactagggttcttgtatgtgttcccattctcactaagcatagccttgacaacaagaattggtcactctttaggtgcagggcaagcatccaaggcccaaagcacagccataatagggtttctcacagcattcaccttgggcctcactgccttcattttgctgtttcttgtgaggaaatcatgggggaaacttttcactaatgagacacaaattgttgagctggtcacaaccatacttcccattctaggcttgtgtgaggttagcaattggcctcaaacagtttcatgtgggattttgtcaggcactgctaggccttatttgggtgccagaataaacttgtgtgcattttatctagttggattgccagtttctgtttttgctacattcatatataaatatgaattggtgggtttgtggtctggaatggtggctgcacaggcttcatgtctttgtatgatggtttacacattgattcaaacagattgggagcagcaatgtaagagggcagtggagctagctcagaaaacaacagagcgggaaaataaaaatgatgatgaggaaagtgggttgcttggttctgatcaatga

SEQ ID NO: 71644 - DNA, 366 bp, Glycine max
  Peptide Sequence Number=SeqID_188422
atgcaaaactggatttatactggttcggccacaactcatgcctacatccagtcctcaagcaaattccacttgagcattttcactaaccttgtaaaaccctttacaagcaatgcaccacaaaggacttctctcctttgtgttcagtgtttacaccaagaagcaaattccacttcttgcaatgaaccccaaaggaccttcctcctttgtgttcagttattacaccaagaggcaatcacacctcttgcaatgaaccccaaaggacgttactcctttgtgtccagtgattacaccaagaagcaaattccacttcttgcaatgaacccccaaggatgttactcctttgtgtccaatgattcaaccaagtag

SEQ ID NO: 71645 - DNA, 837 bp, Glycine max
  Peptide Sequence Number=SeqID_188423
atgtcattccagttctgctttgaggttccagattcgttgcacttgtctgagtctattctttacgcacttaggggagctaaacaccaccgtcacacgcggaactccacaaagttcatgaccaagggggtggaggaagaaaaaggagcatcctggggtagctgtcatagcttgagtcgtcgattcaacaccgacaggcggtggctgctagggtcccgatgcactttggcacgggggagcgaaggttgctcgaggtgttgtttcactttctggtgttgttttcacattgtaatgtatttggaatctgagcaaagacttgaaaaatggtactctttgaatccatgtaaggtaatcattgctactggattcatttcaagcacacctcaaaatgttagtgaggctgtgattttgaagacaccgtctttaattcacaacaagcaaatgggtggactccaagccgcgagggacaatgcgaaaacgtggatcaccgttcagcctgtggagggtgccttcgttgtcaatcttggagacctctgtcataaagttggacgatcactcttctgtcttgggttgcttatctgttatggcaatcaattgttagcaagctccatactcattgatgttggacgcagtgtcagattgtttatgaagtatctctttgtggaggattttgttgtcaaggttagatcactgcaggcactaggatttgttctaattgctaggcctgaatatatgttggaaaatgatgttggaaaaatactggaggaaacaatatcctctacgtctgatactagcattaagattcaaggattgcaaaacatgtttgagtatctcttctag

SEQ ID NO: 71646 - DNA, 1613 bp, Glycine max
  Peptide Sequence Number=SeqID_188424
gcgccggcatgatcgacgcggagctgacgcagctggaggccttctaccggctgggcgtgcgcagcatcgggccattctggaatctgccgaacgccttcggcaccggcgtcagcgggccgttcccgggctcacccgataccggccccggcctgacgtcagccggcgaggcgctgatccatgcctgcaaccgccgccgtatcatgatcgacgtctcgcacatgaacgaaaaaaccttctggcaaactgccgcgctgagccgcgcgccgctggtcgccacccactccaacgcccacgccctctgcccgcagccgcgcaacctgaccgacgcacagctggacgccatcggccagagcggcgggatggtcggcgtcaatttcggcaccgccttcctgcgtgcggacggtaaacgtgacagtgcaacaactggcttaacagaaattgttaaacacgttgagtatttgatcgctaaacttggtgaagatcgcgtgggatttggctctgattttgacggggtcaacgtaccgcaaccgttggcggatgtcggtggcctgccgctgctgacgcaagcgctggcacaggccgggttcgataaccggctgctggagaagctgacctggcgcaactggctgaacgtgctcgccgccacctgggtcctcggttcggcggctggcggtggctttccgcagtggaactgtaactgcgccaactgcagcgggctgcgtaacgacacgctccaggcgcaggcgcgcacccaatcctcaatcattgtcagcgataacggtaccgactgggtgctgtgcaacgcttcgccggacatcagccagcaaatcgcccggacaccggaactggtgaaacacggcgtgctgcgcggaacggcgattggcagcattattttgaccgacagccagatcgatcacaccaccggtctgctgagcctgcgtgagggctgcccgcatcaggtatggtgcacgccggaagtgcatgccgacctcaccagcggcttcccgatttttaccatgctgcagcactggaacggtggcctgcagcatcgggcgctcacgccgcttgagccgtttcgcgttgatgtctgcgccagtctgcaattcaccgccattccaattctcagcaatgcgccaccgtattcgccgtatcgcgatcgtccgctgccgggacataacgtggcgctgtttatcgaaaacaccaccaacgggcagacgctgctgtatgcgccaggcctcggcgaaccggatgcggtgattatgccgtggctgcaaaaagccgactgcctgctgatcgacggcaccgtgtggcaggatgatgagctgctgaccaccggcgtcggcaaaaataccggcaaagctatgggccatctggcgctggcggaagagcaggggctgatggcgctgctggccgcgctgccggccagacgcaaaattctgattcacattaacaacaccaatccgatcctcaacgagcattcgccgcagcgccagttcctgacgcagcagggcattgaagcgctgcgtgccaaaggcgcgtattaccatattcaccatccttaccatatcgcgatgcacaacggtgccgcgacgcgcgagcagattcagggctgg

SEQ ID NO: 71647 - DNA, 204 bp, Glycine max
  Peptide Sequence Number=SeqID_188425
atggcccagcccaatgtcgcgctcagcgcgcaactcgctctaagcacaccgagaattagcagtcgcgctaaacacacagcacgcgctaagcgcgcaacgccaaaacaacatgcgctaagcgagctcttgcttagcgaggcagggcgcgctaagcgagcatacgaaggcccaagggttaggtgctcgagagagggtaacttttaa

SEQ ID NO: 71648 - DNA, 666 bp, Glycine max
  Peptide Sequence Number=SeqID_188426
atggatgaaacacatgaagctccccaagaccatactctaaccagtattcgggtttatccgggaaatactattgaaggacattcattttctggtatcctggtgccaaacactctgggggttcctcagtatcgaccaccatcacaacccttgcactttgggatgggaggaaagccttctgttgtggttgagaaggaaaattttgatcatatagaggagaggctagggccattgaaggaggggggaaattatggctttactgacatgtcagaattgtgtttggtatccgacgtggttattcctccgaagttcaaggtctactcttggaaggatcttatggatgccttcatcaagaagtatcaatacaactctaacatggctacagatagaatgcaactacaaaacatgtgcaagggagataatgaatcattcaaagaatatggccaaaggtggagggacctagttactcaagtagtacccctcacggtagagagagaaatgataaccatgataatggacacattgttggggttctattatgagaaaatgataggttacatgccttcaagttttgtggatctagtgtttcctagtgagagaattgaagtaggtcagaggagaggaaaatttgattatgttgcttctgtgagttctgatgtcgtcaagtga

SEQ ID NO: 71649 - DNA, 258 bp, Glycine max
  Peptide Sequence Number=SeqID_188427
atgcggggagggagagagagggggggaaggaccttagagggggaagcaaaaaggacaaaaaaagggattggggtcgctgagacggagagaagcaatggagacatcgactgtttgagtcccagaagtagaggcgcgaggcttcgccctaggcaaggaggttccgggaagcgacggtggtggtggcaccaccatgatggccggatttgtaaactgcaaggggcacaccatcagttatcaaaattgcttcacctgagctag

SEQ ID NO: 71650 - DNA, 462 bp, Glycine max
  Peptide Sequence Number=SeqID_188428
atgccatcattcaagcgacaaccatatggagaagaagaagaagaagaacacaatgaagaagaagaagcaacaacaaccaaacaaaggtgccatcattcaaacaacaagtcaagacattacttacctcgaaggagaacccacgtagaagaagaagaaacaaaaatgcacgaagaggaagaagaaccacgaatgcaggaacttgacgaaagcacgaacgagaagaagcaccaaaatgaagaagtcctatggagcaggaagccgaagaggaagcaggaagcggaacaggaggaagaagaagcgtatacgtttcctcatgaatcaaagatcataatgcacacatatttggtttggagcaccagtgtgaaggagatggaaggagcgaacaacggtggtgcagagcttgaaacctacaatttcctcctcgatcaacgatcacgatctacaatttctgaatcaaactga

SEQ ID NO: 71651 - DNA, 404 bp, Glycine max
  Peptide Sequence Number=SeqID_188429
ggattgcgcccgcaagacacctagtggacccggagaagtccaacagggtcctagggtttccagctctgattaccggcctttttcagttctacggagtgcccgttgcccccaacaaggtcatcaggccccctaataaccgggctttcatcaagaagtactgcgccccccaggcaagcgcagggcgagacaccacagtagcctggggatggccggcagcgggcaatagacgcaccgcctccaccttcaaagcccctcagctcatctacaaaggttggagctttgcctacgacccatggccgaccagcaggcaaccaagtccaaagccaaaggtaagcaaaagtactaggtccgtgaccgacaagtcatcacgcgtccagctcaagacattaaagaagcgctactag

SEQ ID NO: 71652 - DNA, 465 bp, Glycine max
  Peptide Sequence Number=SeqID_188430
atgagtcaactagcaaggatcaaaagatcaacaaacgatagtccccagactaaattagggtatgacaaaggggaaggggtcattgtggttgaggcaaagggcgtggtggttgggggcagaggaagaggaggggtgtggtggttgggtgcgaataaagggaaggggcatggtgaaattcacatactggcatacgaatcacctgctaatagtgtcgacgagtatgttagacttgtcaactgcactacaattgaatgcttagaagcttttgtaaaaggtgtgaatgagatatttggggatgagtatttgagaagtccaaacaacaacgacatcaatcacctgcttcaaattggagaggcacgcaggtttccaggttcaaacaataacactaacgtgttaaaccaatcgcccgtgtttaatgacgtttttcaacgtcaagctcctccagtgcaatttacaattaattga

SEQ ID NO: 71653 - DNA, 501 bp, Glycine max
  Peptide Sequence Number=SeqID_188431
atggctagctatagctacttagttatgtcattcagccttaagaatgctggagcaacaaatcagaggctaatggacaagatattcaagaaccaactcagaaggaacttagaaatatatgtagataacatagtgttcaaaagaaggaacaaagtgggacaaggaatgcaaaggcccacttttagaaactcaaagagttcctcgcttcaccacctatcctcactagacctcaatcggctaaatggagactatcagactaaggatcctcagatgacaaggtactaccacatagctacccagcttaaagaggcattcactaagtttaagcttaaacacattgtaatagaaaacaataagatagtcgacttgttgtcaaaactcgttggtagaaagaagaaaggtcaatacacaacaatcatccaagaaacaatcttggaaccaagcttgaacaaggtggtggtgagtgtaactctcataaaccaagaatggatgactgagatttag

SEQ ID NO: 71654 - DNA, 417 bp, Glycine max
  Peptide Sequence Number=SeqID_188432
atggcattgaagtatggtctcttttcaaacagtctatgcaagaaatcgcctctagaggattcacctggggaggaagttcaaacttggcatgcaagcgctatgtgtgcagccttaagtctatcaacttggtggaggccgaaagaagggtgcccttcactcaacgagctaggtgaaatcatctcaactccttatccggtgatgaaatttccaagtgaaagtgtaaaaattatcactatcagagtcgaccaaatgaccacaagggaatgttatgttgtgagccttaaaattgctaaaggaaaaaaggtggcagagcccaaagtacaactggtagcatgcataactctcaacaacaacctgggagaagctaaattgatccaagagaggcaaacccgagagcaaagcctactaaaaaggtaa

SEQ ID NO: 71655 - DNA, 417 bp, Glycine max
  Peptide Sequence Number=SeqID_188433
atggggaggattttgtgcgctcctgcagaggaatctagtgttcctctgagtgggaccactgtcgttggtggtgcgacctgccttaaagtcgatgttgctgcccctgttagtggcaccactactattgaaggagggctccaccctaactccggcatgcatgaaaatcatggggaggatgaggtacaattgcctttgcctaatcctcctcctaatgtcattaatttggactcaaaggctattgttgtgcaagtcacaacaccttgtcctttccttcctcttcttccttcacccaaaaaacctagtaaggccaaaaggtttccttttatcgtccttccaagacacacctgggttcatggtgaggctaattcttactttactaattttttaacatacaagtctatcaccaaattcctttaa

SEQ ID NO: 71656 - DNA, 393 bp, Glycine max
  Peptide Sequence Number=SeqID_188434
atggtggagctggtatcgattaccattctttctgctatcgagaactaccctactttcctatccatgaaggaaaatgtctcttctctatgggttaaggattccaatcctttgtgctctcatccaatcctttatgctcaggcagtcaaactgaggtatgctaagggaagccgaccctcgagcgttaatggattccattgcgcatttccaagcacagacttaagggatgacgtcgagtttcaaagggaactttttgaatgtgccaaggttgaaaaagccatatccaaggctaccaaggcaaatgagacattggtacaatcgaccaaggattcttggaagtctctagaggatacaaagactaagttagaagaggctgaatctcgagaggaggcttaa

SEQ ID NO: 71657 - DNA, 1044 bp, Glycine max
  Peptide Sequence Number=SeqID_188435
atggctatgaatgaagagatggaatcccttctgaagaaccaaacatgggatttagttgagctacctgaaggtagacgagtattgaggtgcagtggatcttcaagaagaaatttgaatcgtccactaaaaaagtcatctgctataaagcacgtctgccttagtggcaactctagacatggaattagagaaactcatgtcaaaactgtctttctccatggaagactggaggaagacattttgatgcaacaacctaaaggcagtgttaccagagattcgatgagttcattgtctctcatgggtatatcaaaagtccctctgactcgtgtttatcatagcaaggtgaaggatagttctcacatctatctactactctatatggacgacaagctcatagcatctcaaaatttgttggcaattcagaagctaaagtcactacttagtaatgaagttaagatgaaggacatgagatttgttgaaaagattttaggcatggagatcaaaagtgatgtaggtagtcttatatatgctatggtatgcaccagagcaaacctagcacaagcaatcagtgttatgagtagaattgatattgaactcgtctatcatggagacatgtcttgtgcttttgcttgttactcaaattctgactatggtgcaaatttggatgcaaaacgatctatgactagaggtagagtacatggttctggcaaaaacagcaaaggaaggaatcaaggtctgattagcaatattgggttttcacgagaaaatgctatcattttctacgacagtctgagtgcaatctacttagccaaggatcaagtccatcatgagaggactaagcacattagcatcaaataccacttcatctgttctgagaaaagggtcgaagtccagaaagttgatacgagggagaatccaattgatatgttcatgaagcctattccaagaagcaaggtggagattgttgattgtttgacaatggacgatagagatagggtggacgacaactttggtcttctggttcaatactcttgtcttttatattag

SEQ ID NO: 71658 - DNA, 297 bp, Glycine max
  Peptide Sequence Number=SeqID_188436
atgacaacatcaaactgccaacaagccaccacaaatatgcacctccaccaaaccaaccacaaggacctcgggccaaaaggaaatcaaaatggaaagaatgtgtcgcaacatgcccttttgcgggagcgcgaggcaaggctctcgggtgcgctttccaaaggaggaaagatgcacggagtcgccaccaacgtcgacaaaagcggcgctcttgctcctacataccctctatcgaagaggaaatcagatctacgtagttcttttttaggggtgaatcaagcgattctttttacttgcaag

SEQ ID NO: 71659 - DNA, 2091 bp, Glycine max
  Peptide Sequence Number=SeqID_188437
atggtgaaagtgggagaagataccaccaacaacaatggtgaggatgaacacaagaatgaagaaggggagactcgtgacccaacaaagggagcacgaaaacagaaacacgagagggagaggatgggcgctcgtgtcacatgtcctcagggcgacgagcaatccacttacacattgcctgagcgcacacaaggaggatcacacgatgggaccaccaatctagataaagatctggatgccttcttgactcaggaaaatctatacaccaatgatgatgcgatcctatgttgtgtcatcccaacgtcttttaaggcagcattgaattggttaagtggacttcctcaaaggtccatgtgcgttttcgacactcttgccaagcgcttcagcgcgcaatatgtaaccaactggtcacatcccatgacatcggccgcactggctagcctgcgacaagcagacaatgaatctctccagaaattcatggctaggtttggacgcattgctgtccaaatccgcaatctcaacccagaggtcacattatactccatgctcttcactctatggcctggcaagtttgcggataaaatgtccagattcaagaacgaagttatacaagttagacaaaaacgtgaaaagcgagaaggaagcaacaagactgactcacataagttaaacaagaggcacatgcaagacaagcgaaagcctcttccaaaagggcccaagtacgagcgttacacacccctgacaaccaatcacactacaatccttgaggaagctttcaacttggaggtacccatcaggttacctctgacaaaacctccagggccggggttaggtgcgaccaaatactataggtaccatcacggtatcggtcataatacagaacactattgggccttgaaggacaatatagaaaagcttatacaaactggacaatctaaccagtcttgtaaaggccatcttcacaccattcgggacatcgacatcaactttgtcaacacaccattagaacgaagtttccctcctgtcactttcacgaatagagttcaaagctccatagacatcctatattggaaaaatttccagaggctcaaagtctcccttgacattgtccaccctcacgtcggtccactcattggcttctcaggagaaagagtagagaccagaggctacgtgaacctaatgaccactttcgagccatcgcctccatgttctcatctgaagatgaaattccctaccctgacacaagagattgtgactatcaaggcaaatgaaaagcaagcacgacagtgctatggagaaagcctaaaggtggcaccttatcgtcccaccagggagccttgcaagcctcactctatagcaactaaaggtactcaattcatgagcatggacgaagggcctcaaatttgggccctgaccatctaccaagcaagcctagatgacgaatgtgagatagatctacgtgacgatgcttctgacagaggtccaaagcctatcaaagagctcgttaagctagaagttagattttccactttgctcaccaacgttgtcatggtcacaaaggccaatgacaaatggcgaatgtgcaccaactatactaatcggaatagggcatgccccaaagatgcataccctctgcccaacattgataggctagtcgatggagcgtctgggttccagggtcatgccctttggcctaaaaaatgcaagtgctacataccaaatattgatgaaccaaattttcaagcaacagaacagaagaaacttcaagcactaccaaatgatagagaaggtggtgctagaactcattacctcggcccggcgactcagaccttacttttaaagtcatcaaatggtagtcaaaacaaaccaccctatcaaacagacttcctggcagaattcattgggaacaaccaaaccaccctagactggtggagcctctatgttaatggtgtgtccaacatgaagggaaggagggcaagaatcatcctcgaagctcttatactcaacttcaaagcctcaaacaatcaagtcgagtgtgaggcactcattgctagtctaaaattagcgagagatgtcaagaccaagaagctatga

SEQ ID NO: 71660 - DNA, 1590 bp, Glycine max
  Peptide Sequence Number=SeqID_188438
atggtgacagtgaatggtcagtttccaggacctcgcattgtagccagagagggagaccgtcttcttatcaaagtgactaaccatgtttcgaacaatatcaccattcactggcatggaattagacaacttcaatcagggtgggctgatgggccagcatatgtgactcaatgccccattcaaagaggccaaagttatgtctacaattacaccattgttgggcagagaggcactctctggtggcatgctcacatttcatggttaagatcaactttgtatggtcctctcatcattcttcccaagctcaatgctcaatatccttttgccaaaccccacaaggaagttcctatcgtatttggagaatggtggaatgcagatcctgaggcagtcataacccaagcccttcaaaccggtggaggaccaaatgtatccgatgcttacacaattaatggacttccagggccattgtataactgctctgacaaagatacattcaagctgaaggtgaagccagggaagatttaccttctacgtttgatcaatgccgcactgaatgatgagctattcttcagcattgcgaaccacaccctcacagtagttgaagcagatgcagtttacgtaaaaccatttgcaaccaacaccatccttattacccctggccaaaccactaatgttcttctcaaaaccaaatctcattaccccaacgccacattcctcatgactgctagaccatatgctagtggccttggcacttttgacaacacaactgtggctggcatactgcaatataaaaccccaccaaatactcatcattcagctgcttcactgaaaaatcttccactcctcaaacctattctccctgcactcaatgacacttcttttgccacaaaattcaacaacaaactccgcagcttagcaagtgctcagtttccagccaatgtaccccagaaagttgatacgcactttttcttcacagtgggccttggcacaactccctgcccacaaaaccaaacttgtcaaggacccaccaatgcaacaaaatttgcagcatcagtgaacaatgtctcttttatacaaccaaccactgcacttcttcaaacccacttctttggacaatccaatggagtttacacagctgacttcccagccaaaccattgattccattcaactatactggcactccaccaaacaacaccatggtgagcaatgggacaaaggttgtggttcttcccttcaacacaagtgtagagctagtgatgcaggacaccagcattcttggtgctgaaagtcaccctctccatttgcatggctttaacttctttgctgttggtcaaggttttggtaactttgatccaaataaggaccctgcaaacttcaatcttcttgacccaattgagagaaacacagtgggagtcccatctggtggatgggttgctatcagattcctagcagataatccaggggtatggttcatgcattgtcacttggaagtgcacacaagctggggtcttaagatggcatgggttgtgttggatggaaaactcccaaatcagaagctgtttccaccgccagctgatcttcccaagtgttaa

SEQ ID NO: 71661 - DNA, 183 bp, Glycine max
  Peptide Sequence Number=SeqID_188439
atgagagccttcaacaactatctctccagtaccagaggcattcctatctcagattgtctggccaatagtccaacttccttatgtaaggggggtgatacctctgatattggtaatggtgatgctgcagatgctggagctaatgatgattatgttgcagacatcattgttgcacaagaagcttag

SEQ ID NO: 71662 - DNA, 3537 bp, Glycine max
  Peptide Sequence Number=SeqID_188440
atggcttgcatcaaaggggtgaatcgatcagcgtcggtggcgctggcgccggacgctccgtacctggccgccgggaccatggctggcgccgttgatctgtccttcagctcttccgcgaatctcgagatattcaagctcgatttccagtccgacgatcaggaactgcctctcgtcgcggagtgcccgagctccgaccgtttcaaccgtctctcctgggggaagaacggttctggctctgaagacttcgctctcggcctcgttgccggtggattggtggatggcaacattgacatctggaatcctctcactctgatccgctcggagtcaaatcaaagttctcttgttggacaccttgtaaggcataaaggaccagttcgtggtcttgagtttaatgtcattgcaccaaatcttcttgcatctggggctgaggatggtgaaatttgcatatgggatttggtcaatccttcagaacctacacattttccaccactaaagagtactgggtctgcttcccagggagaaatttcattcttatcttggaacagtaaagtccaacacatattagcgtctacttcatacaatgggaccacagtggtctgggacctaaagaagcaaaagccagtgataagctttgcagattcggttagaaggcggtgttctgttttgcagtggaatcctgatgttgccacacaacttgttgttgcatcagatgaagacggctctccttctttgaggctttgggacatgaggaatacaatttcaccaataaaggagtttgtgggacacactagagtggacagtatacagcccatgttgccaaatgtgcctgaattggacaatttgcctgaaaatcaaggggtaattgcaatgtcttggtgtcccaatgatagctcttatttgcttacctgtggcaaagatagccggactatatgctgggacatgatttctggagaggtgattgcctacgaattgccagctgggaccaattggaattttgatgtgcattggtatcccaggatacctggagtaatatcagcatcttcctttgatggaaaaattggtatatataatattaagggttgccgtcaaaatgatattggggaaaatgattttggtgcagtaccactgagagcaccaaaatggtataaacgtcctgctggtgtgtcttttggctttggaggcaaacttgtgtcatttcatcccagggcatctgctgcaggttctccagctggtgcttcagaggtttatgtgcataacttggtcactgaaaatggtctagttagtcgttcatctgagtttgaagctgcaatacagaatggagaaaggtctttattgagggttttatgcggaaaaaaaactgaggaatcagaatctgaggaggaaagagaaacatggggctttttgaaggttatgtttgaagatgatgggactgcacgcacaaaacttctctcacatcttggtttcaatgtacctagtgaagcaaaagacacagttaatgatgatctttcccaagaagtaaatgcacttggacttgaggacacaactgttgataatactggacatgtgtctactaatgaaacccctattttctctactgataatggggaagatttctttaataatcttcccagtcctaaagctgatacccctgtatctacttctgctggcaactttgttgttgcggaaaatgccaatggttcaaagaaaatccaagatgatgtggaagtggaggagagcagtgacccttcatttgacgacagtgttcagcatgctttagttgttggggactacaatggggcagtaatgcaatgcatttctgcaaataaatgggctgatgcattagttattgctcatgttgggaatgcttccttgtgggaaagtacacgggatcaataccttaaaatggtccgatcaccatacttgaagattgtatcagcaatggtgagcaatgatctcttgagcttagtgaacaccagaccactgaagttttggaaagaaacccttgcgcttctttgtagttttgctcagagagatgaatggactatgctttgtgacacacttgcttcaaaactcatgggggctggcaatacattagctgcaactctgtgttatatatgtgctggaaatattgataaaactgttgaaatttggtcaaggagcctgtcaaatgagcacgagggaaaatcttatgttgaccttcttcaggatttaatggaaaagactattgttcttgccttggcaactgggcagaagcagtttagtgcttctctgtgcaagcttgttgagaaatatgctgaaattttagcaagtcaagggctgttgactacagcgatggagtatttaaaacttttgggttctgaagaactgtcgcctgaactaacaattttaaaggatcgaattgctctttctacagaacctgagaaagacttcaaaactactgcttttgaaggttctcaatcacacagtgggtcctattatggtgctgataattccaattataatagcaattattatcaggagccagtacccactcaagtgcagcatggtgtttctggaattcaatatcctgacagctatcaacagtcatttgatcctagatatggaagaggctatggtgctcctactcatactccaccccagcaacctctacagcctaatttgtttgttcctccgcaggctactcaggttgcgcaaactccccagccgactttctcaaatactgctgttgcaccaccacctttgagaacctttgatcctcaaactcctcctgtgcttagaaatgtggagcgatatcagcagcctacattgggttctcaattgtataatacaaccaatccaccttaccagcctacaccccctgctccatcacaagtggccttgagtcatggccagaacttgtcacaagttgtggcacctaccccaaatccaatgggattcatgccagtctctggttctggtaatgtccaaagacctgggatgggatcaatacaacctcccagtccccctcaagtgcaacctgtgcaaccacctccagcacctccaactcctcctcctactttgcagactgctgatacttcaaaagtacctgggcatcaaatgcctattgtcacaactttgacaaggcttttcaatgagacatcagacgcccttggaggttcacgtgcaaatccagctaggaagcgggagatagaagacaactcgaagagacttggtggattgtttgccaagttaaatagtggagacatatcaaaaaatgcttctgataagctccttcagctttgtcaggcattagacaatggtgattttggtactgccctacaaattcaggttcttcttactactaccgagtgggacgaatgccagtcctggttaggttcactcaagcggatgatcaagacaagacagagccatcttgcagtagtgattgctgatcctcctatcaatctttcacatcgattgttattaaaagctgttactgaagacgcactagtttcaacgggctgtccatggcgcttggggcctagcgtgatcatgtag

SEQ ID NO: 71663 - DNA, 510 bp, Glycine max
  Peptide Sequence Number=SeqID_188441
atgaaggccgatatggaggccatgaaggggcaaatgacaacggtgatggaacaaataatgagcatgatcaagatgatgaaggagttatgtgaggatttcaagatccaacaccatgattcgacaccttatcgacccaagatgaacggtgcagttgaagagattccttttttgagacttctgtcagaagtgaagttggagggcctagaatgtgcccagacatgttttgaccggttgaatcttattaaaggaaagagattggatgctatgagtcatgggcagttgagaagaatcaagaatgctttcggcaaaaggatgcgcttgcgcaaattcaatgaggtagaccttgttttgaagaaggtgtcacatgttcaaaaagatctccgagggaaatggaccccgaactatgaaggaccttttgtgacgaagaaggaattcttagatggaacatggatactcataaacatggatggtgaagagctgcctttgcctgtgaatttggatgttgtctag

SEQ ID NO: 71664 - DNA, 255 bp, Glycine max
  Peptide Sequence Number=SeqID_188442
atggcgcaaggaataacctgtgaaataaaaaagatcatgcaaggtctagccaagaactttgcggccaccatagttgaggcaatgccatggcacttgacaaaaactcatccatgtgaggtgagccaaactcaaccatggtattcaacacaaaaagatgcacagagagacacaatcgcgaaaaataagcagaaaaatacctacttacaatggcgagggcacgatagcaataaggttgcaaagagagcaaagccatga

SEQ ID NO: 71665 - DNA, 177 bp, Glycine max
  Peptide Sequence Number=SeqID_188443
atgatattaaaggaaacgggccgggtgaggagcaggtgtgaagatctggaagcaatggagaaaaagttgaaggagaagaatgtgaagtacatgaaaaggactctggagagagaagatggaacgacaatggatcaaattttcttcaatgacccagatgggttcatggtggagatatga

SEQ ID NO: 71666 - DNA, 1956 bp, Glycine max
  Peptide Sequence Number=SeqID_188444
atgcaacttataggttattcagatgctgattgggcaggctgtatggattctagaaaatccatatctggatattgtttcttcataggcaaatctttagtgtcatggcgtgctaaaaagcaagcaactgtgtccagatcatcttcagaagcagagtacagggctctgtcttcagctgcttatttgagagttcagcttaccagaactccaactctttactgtgacaaccaaagcgcagtccacattgcctcaaatccggtttttcacgaacgcacaaaacacttggaaattgattgccatcttgtgcgagagaagcttttgaagggcactctaaagctactaccagtttcaacaagtgatcaagtggcagattttctcaccaaagcattggcaccacccaaatttcatgattttgtctccaagcttagcatgatcaacatctaccatgataagcttgagggaggttaccatccaactaggcatggcattcgacagcttcgatcaggttgggctgatggacctgcctatgtgactcagtgccccattcaaacaggccaaagttacgtctacaattacaccattgttggccagagaggcactctcttttggcatgcccacatttcatggttaagatcaactctctatggtcctatcatcattcttcccaagcaaggagctccatatccttttaccaaaccttacaaggaagttcccgtcatctttggagaatggtggaatacagatcctgaggcagtcataacacaggcattgcaaacaggtggaggaccaaatgtgtctgatgcctacactattaatggtcttccagggccattgtataactgttccgctaaagatacattcaagttaaaggtcaagccagggaagacataccttctccgtttgatcaatgctgcactcaatgacgaactcttcttcagcattgcaaatcacaccctcacagtggttgatgtcgatgcaatttatgttaagccatttgacactgacactattctcattgcccctggacaaacctccaatgttcttctcaaaaccaaatctcactatcctaatgccacattcttcatgagtgctagaccatatgcgactggccagggtacttttgacaactcaactgtggctgctatccttgaatatgaagttccaccacattttgttcactcaacaacttcagtcaagaagctttcactcttcaagcccatcctccctgcccttaatgacacttctttcgcaacaaacttcgccaacaagcttcatagcttagcaagtgctcagtttcctgccaatgtaccccagaaagttgacaagcactttttcttcacagtgggccttggcacaactccctgccctcaaaatcaaacttgtcaaggacccaccaatgcaacaaaatttgcagcatcagtgaacaatgtctcttttatacaaccaaccactgcacttcttcaagcccacttctttggtcaatccaatggagtttactccccttactttcctattagtccattggttccatttaactatacaggcactccaccaaacaataccatggtgagcaatgggacaaaggttgtggttcttcccttcaacacaagtgtagaactagtgatgcaggacaccagcattcttggtgctgaaagtcaccctctccatttgcatggctttaacttctttgttgttggtcaaggttttggtaactttgatccaaagaaggaccctgtaaacttcaatctcgttgatcctgttgaaaggaacacagttggtgtcccatctggtggatgggttgctatcagattcctaactgataacccaggggtatggttcatgcattgccatcttgaagtccacaccagctggggtctgaaaatggcttggattgtattggatggaaaacttccaaatcagaagctgcttccaccaccagctgatcttccaaattgttaa

SEQ ID NO: 71667 - DNA, 855 bp, Glycine max
  Peptide Sequence Number=SeqID_188445
atgcgtgtttgtgttatatttagacagatttctgtagggggtcagaatttgggtccatggaagaatggcgtcacacaagtagctcaagcagcacgtcctagaactaagggtactcttgtgctagcagcaaacaggaccaataggcctgacattctacacggatttcgacgttatcaaggtggttgggacattgcaaatcgtcattactgggccctaggcaatattaattttcctcacgcttgcggcatggtaaatatggtgaatcttgatgctgaatcagttggattcactggtgtggctggtttaacccttgctgtcctatggtttatctcatttggcttggcacttgtgattcatctatgctgcggatggggaattaacatcaaggataaaggttcaaatcgtttgcaaagaatttggactggatgcatcgttctttcttttgggcaggataaattccatggtgaggcagtggataccctccattatgtagtcaatcagtcagactacacagtgcagactctaagaaatgtcacagagtatctcgcgcttgccaaaactatcgctgtggcagagatgtttcttccatctaatatcatggatgatattgataaattgaatgtggatctaaattctgcagcaaatacactttccgagcagacaaaagaaaattcttttaaaatacgaaaagcgtctagctttgattatgatgtcagcaatgatgcttctactggctctaattgggttaatcctgtctatccttggatatcaacacgcaatcctcgtatttgttatcagtggatggctattggttgcaaccacattcattctttgtggagtgttcacaatccttaa

SEQ ID NO: 71668 - DNA, 840 bp, Glycine max
  Peptide Sequence Number=SeqID_188446
acaatggtcctgagttccttatgccagatttctatgcctccaaaggtatattacaccagactagctgtgttgactctccccagcaaaatggcagggttgagagaaaacatcagcaaattctaaacataggtagagctcttcttgttcagtctaatctccccaagtctttttggtgttatgctgtttcccatgctgtatacatcatgaatagagtccctgcaccaaatttacaaaacaaatctccttatactttattgtataatactgcccctgattttgatactctcaaagtgtttggttctctagcatttagtatgtcaatcacacactgcactgagcctcaatcttatgaggaagctagtaagcatgaacactgggtaacagccatgaaggaagaattaaatgctttggctaaaaattgtacctggaaaattgttgaactcccacctcatactaaacccataggatgtaaatgggtttataaagtcaaacacaaagcaaatggccaaatagagagatacaaagccagattagtagccaaaggctacaatcaagtagaagggattgactattttgagaccttctcccctgtggctaagattaccactgttaggactcttttggcagtagctgccataaagaattggcaccttcatcaactggatgtcaataatgcttttcttcatggagatcttcaagaagatgtttacatgaaaataccagatggggtaacttgtgccaagcctaattctgtttgcaagctacaaaagagcttgtatgggttgaagcaagcaagtaggaagtggtatgaaaagctgactaatttgcttctcaaagaag

SEQ ID NO: 71669 - DNA, 237 bp, Glycine max
  Peptide Sequence Number=SeqID_188447
atgtttagggacgtgtcaagctgcaacacgtacaactacggcgaggctgtgtattgggacgcgcgctacatccaagaggatggttcctgcgattggtaccagcgttattctgctctcaggccttttgttcgcaatttcatccctctttcttccaggattctcatggttggttgcggcaattctggttggtactacaattccccttctctcccgtctcttttatttagggtttcttaa

SEQ ID NO: 71670 - DNA, 123 bp, Glycine max
  Peptide Sequence Number=SeqID_188448
atgccttgtgtgaaggagacaaaagtggactctattcatgatgtatacagcatgggaaacagcataacaccaaaaagacttggggagattagactgaacaagaagagctctacctatgtttag

SEQ ID NO: 71671 - DNA, 399 bp, Glycine max
  Peptide Sequence Number=SeqID_188449
atgtttgtggtgtgggcaaccatatattcttattcagttgtgtgtgaggttccatgccatgccattatgaaccaaagacttagttgtttgttgtatgggcaatttttgacgcctttggagcccataaagaaactcgcttaccagaatgaccctttcatcatggcagaacaagctaaacaggcattttatgttcaagacccttgtgatgaaagatggtcagtggttctacacggaaaaacaattggtgttaatgttgaagatgatgattcatacattcatacttatgttactcctttgtcaacacaaatgtggcctaacatcgttggagaagaagaagctggcaacgttcatgctaatcgtaatgatcatgatgaaggagaattaattaacatcatctaa

SEQ ID NO: 71672 - DNA, 405 bp, Glycine max
  Peptide Sequence Number=SeqID_188450
atgaatgtcagagatatgagcttgtttccagatgaatcttttgatggtgttattgataaaggaactcttgattcattgatgtgtggtactgatgctccaattagtgctgctcagatgcttgctgaaattacatatggggatccaacagtaaggatgcctcatataagcagaccggtgttcaattggaaaattacgctgtataatatcccaagaccaggatttcaaaagcccgagagtagtacaccatcaagaaaatcatacttggagcccatcgctcttactgaaaagggcttactttcagcagatttcgttctggaagatccagattctcactatatatatgtttgtaaaaagataaatgacacagagatagacaataatacctgcataccaattaacagctga

SEQ ID NO: 71673 - DNA, 198 bp, Glycine max
  Peptide Sequence Number=SeqID_188451
atgttcgtttatatgcatgtaaaggacaaagttgtcacagaaaatgaattgtttgagaagatgaaagtggaagctgagaagtgcttaacccagactgaaagaattgccaatgagaggctagaatttgaatctgaaatctatgcaaagcatggctcagccctgtgtcaagaaggcacaatggtcctggcaaacttctga

SEQ ID NO: 71674 - DNA, 552 bp, Glycine max
  Peptide Sequence Number=SeqID_188452
atgccaccgcgtatagcaccaccgccaccggcggatccctctactgatcctactagtccgttctttgttcatcctagcgacggtccctcctccgtcaaggtcacaccactcctcgatggttccaactaccattcttgggcgaggtctctgcgacgcgctctcggagccaaactcaagttcgaatttcttgacggaacaattccgatgccggttgatgccttcgatccgtcgttccgagcttggaatcgctgcaatatgttgattcatagctggattctcaactccgttgaaccttccatttcccgatccatcgttttcatggataacgcttccgatgtgtggctcgatctgaaagagcgtttctcacaagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 71675 - DNA, 279 bp, Glycine max
  Peptide Sequence Number=SeqID_188453
atggaggctggactaggagaggaattggaggaggacattggtgacggtggcagaggttacacgcagaacctgcaactgttggaagagttgcacttcgccaccaccgcgagaaaactcaagtttgaatgtcatttggactctgacatcattgattttaaggtactagcttcacttgtaattgtggtttgtttgattgagatggttgtgcttgcgggaacctttggcaccaatgtggttaacattgcaatgctgaatttgtattatgtgatgctgagatag

SEQ ID NO: 71676 - DNA, 135 bp, Glycine max
  Peptide Sequence Number=SeqID_188454
atgttgtggtgtgcccagaagtctaggctctcaaatatcaaaggtataaagacatgcttctatccttatgggacattgtcaaagattgctactgttgcaaaaaaacaagccaatatcttctgtagaagcatgtaa

SEQ ID NO: 71677 - DNA, 444 bp, Glycine max
  Peptide Sequence Number=SeqID_188455
atggcggaacaagctaaacaggtattttatgttcaagacccttgtgatgaaaggtggttagtggttctacacaggaaaacagttggtgttaatgttgaacttgatgattcatacattgatacttatgttagtcctttgtccacacaaatgtcacctaacatcgtcggagaagaagaagctgacgatattcatacaaatggctacaccacccagctccctcctcctcctcttactggtgcagcatcacagttgtcatctaccttgaagcagacaagaaaaaccacacaactaagatcattggcgactagaccaattggggcagagagaccgctggtccatgttgatcctacgaccgggaaagccaaaggtccccacagaaagaagttaagaacatatttggggatcgtcatatgtgataaggtggatgtcacatacaagaattag

SEQ ID NO: 71678 - DNA, 228 bp, Glycine max
  Peptide Sequence Number=SeqID_188456
atgagaagtgcaagaagcaatattgagaatgcaggaagcaacaacctacttgagaaccttcctaatagtatgaaagctcatacggatttgagtatggtcgtggagctcacaatggaatgtcgaaacaacaattttgcagaagagaatgtggttcgtgaagctgcgttggggctagagagcaccgagaaactcatcaagttgttgtcgcagacccaacaacaattctag

SEQ ID NO: 71679 - DNA, 183 bp, Glycine max
  Peptide Sequence Number=SeqID_188457
atggtgaagcacttggtgaaagagggcatgcccctaatattgcatttcagacttattcttgctcacatctcggttaagtgtttcactttatggtctgtaattaatgtctctggtggtgcagagcaagaacttctagtttctagagaaagcaagaggcgtggttctagagcttgcagaaactag

SEQ ID NO: 71680 - DNA, 210 bp, Glycine max
  Peptide Sequence Number=SeqID_188458
atgccatcaacccctcccacctcagactcacctacgaggatgtgtggctccaacccgatgatggtgttcgccttcacgcttagttcatcaagctcttccctaattgccgagttcgatgctgatccaattgatgtcttgatacctaccaacattgttttagtgaaagagaggacagattatgaggatgataaacggaacatagtggtttaa

SEQ ID NO: 71681 - DNA, 231 bp, Glycine max
  Peptide Sequence Number=SeqID_188459
gagaaggggtattgttattccaaattgggacttcaaatgccctctgtgtggtttgacagaggagtcagtagctcatgtgcttatttcgtgcgaggtggcttgcggcatttggtgacaccgctacaacacttttggcaacacatcattaatcaaggtaccggaggacgtgaacaaaagatggaggattatatgggtggcagtagcttgggtgttatgaaattggaggaataa

SEQ ID NO: 71682 - DNA, 183 bp, Glycine max
  Peptide Sequence Number=SeqID_188460
atgaatttgagtttagagtctgccaaggaaaatgaggccaatgtgattgtgtatatcacgtataataccaatgtgattttgtatactagttttaagaaaatgaggccagaagggactgagctgcagaaagagtatgacggcagagaaaaattctttgttactccagcagagaaaaatgtctaa

SEQ ID NO: 71683 - DNA, 165 bp, Glycine max
  Peptide Sequence Number=SeqID_188461
atggcctctggtaatcgattaccaaggagtaacaggccactggtaatcaattaccagtcatgtgtaatcgattacacagtgtatggtgcaggtttccatgttctgaagctgtgtaactcgagtttggcctcagtggttatgggacgcattgtgttgctaccgtag

SEQ ID NO: 71684 - DNA, 312 bp, Glycine max
  Peptide Sequence Number=SeqID_188462
atggcatccggggcttccataaaattttcaaaaaccttagaaattttcctcaaaaaggctctgggtggcaagcacctccccatttctcctataaatagggggaggaggctgagtttcgaggatcccaaacccctatgctatgcatttcagctgttttgggtgaaaaaaacatgtttccgtgaagaaaatccaagccgaggtgcttccgtaacgcttccgagacgtttccgtgagcaaatccgtgaagattttccgccgttctttaccgttctttgtccgttcttcattcgttctttggtcttcaaccggtaa

SEQ ID NO: 71685 - DNA, 135 bp, Glycine max
  Peptide Sequence Number=SeqID_188463
atgaggtcttgttttgaggacttggactggtttgaggacttggttgattttgttgatattggagagtcttgccaagtctatgtggtgtctgttttcatgggtgctctgagagtaaacagtagcctagacacttga

SEQ ID NO: 71686 - DNA, 420 bp, Glycine max
  Peptide Sequence Number=SeqID_188464
atggcacccacattgctgctcttgaatccattttgcccatgtgatcacagcaattctaagaacgtgggcaatgtagaaattcctactcccaatgatggagttggtaggggttatggacagggtaagggatacggtgcaagtgaaggaaacaatgtagatggtgctggcggagtaggaggggaggtggtggtggtggagaggggtggtggttttggggttggggtaggaattggacatgatggaggaggaggaggtggtggtggaggtggaggtggtggtggttcaagtaatgtttcaagctttataaaccctaatttgaggaagaagcaagtgactagaagaagctttataatcacacactttagtgccacgttggatagtctatgtggcactaaatttgccaacaatgcacctcactaa

SEQ ID NO: 71687 - DNA, 699 bp, Glycine max
  Peptide Sequence Number=SeqID_188465
atgaaatcagtcaccaaaactgcagagggaaagccacctcagcatgggcctcagtggattgaagctaagagtcatgttcaaacaggaaattatgagtgtggatactatgttatgcattggatatggtgcatcgtaactggtggattgaaggatgactggattcactggttttctgatcgatcaccgggtggtggtgacaaggactacaaggaggtacccccacctcctttgtttcaaaaggtgttgactgcaattggaaacttctgcatatgttcaattgttgtggggatggttattgagattattgttatgtatcccattcaagatcgagaatatcgcccgggaatcgataaccttcttgtgcttcttattggtggaattccaattgccatgcccactgtcctctcggtgactatggccattggttctcacaggctatcacagctgggggctatcacaaagagaatgacagctattgaagagatggcaggcatggatgtgctttgcagtgataagactgggaccctaacactaaataagcttactgttgacaaaaatcttatagaggtttttgcaaaaggagtggatgcggatactgttgttttgatggcagctcaagcttcaagacttgagaatcaagatgcaatagacactgccatagttggaatgttggctgatcccaaagaggttagtcattga

SEQ ID NO: 71688 - DNA, 201 bp, Glycine max
  Peptide Sequence Number=SeqID_188466
atgttcacgggtgaacgtcgtgggggaccaggtcatgtccttgaaggtgggaaaaagtcgacccaaggatgcaaggttgaaaaggttattgatgaggattggtactgtcaggaacagtggacagacatgaggaaagaacaacggagaagagacattttcctttctttttataagataatctgtaatcctacacttacctga

SEQ ID NO: 71689 - DNA, 339 bp, Glycine max
  Peptide Sequence Number=SeqID_188467
atgcatgcaacctcaacctctgtttgcaccgccacgggcatcttccctgttgcacggtggggtggtgttcacacagccgcgcagtggtgctgtggcgagtatatctgttggtgtggggtgctatttgggtcatccgataatgttcttgatatggcgatagcttgggtgactgatgacagcagtggtgtgatggatggtagtgatctagtgtttggctcatggaggtcttggtggtgtttgatgatagctatggttgagaatgtgaagtgtctaccccatgtgacaactaggaatttcagaccaagagtcccctcagagaatgatggtccggggggttga

SEQ ID NO: 71690 - DNA, 513 bp, Glycine max
  Peptide Sequence Number=SeqID_188468
atgagtgacatagagcaagtacaagagcaaatgaaggtcgatatggaggccatgaaggagtggatgacaacgatcatggaagcaatggtgagcatgaggaaaatgatggaggtcaacgcagctacaactgttgctttagtactgctactgagagggactcgattcactcgttcagatgtagtaggccaaggaggcgagacggcagaaaaatcatatgggcctcattatgtccaggaccagaaggagaggctgagggccattgaaggaggaggaaattatagctttgctgacatgtcagaattatgcttggtacccgacgtggttattccttcgaagttcaaggtgccagaatttgataagtacaaaggaaccacttgcccaaagaatcacctaaaaatgtattgcaggaagatgtgggtgtatgcgaaagatgaaaaaatgttgatgcatttcttccaagagagtctcgctggggcaattattacctggtatactaacctggaaccttcctaa

SEQ ID NO: 71691 - DNA, 441 bp, Glycine max
  Peptide Sequence Number=SeqID_188469
atgtgcaagagagacaatgaatctttcaaagaatacgctcataggtggagagatctggcaactcaagtagtgctcccgatgacagagagagagagagatgataacaatgataatggacacactgccggtatgaggaaatggaaatttaatgatgttgcttctgcgaatcctggtaataggggacttgggagaagtggagaaaggaagaaggagggagaacctcatgttgtggctgcacttcctgcgtggccaaactttccactagcccttataatctcatgtaccaatatcctccctagaaatatcactactcagccaatatcagtctttcccattatccaccacctaccaactaagaacacccaattagccacaaagctcacccctaaaatggacacaaaatccacccgctgcacatccaagaccaaacactacccatga

SEQ ID NO: 71692 - DNA, 1368 bp, Glycine max
  Peptide Sequence Number=SeqID_188470
atgggcttctctcaggatgctaatttttataggggttccttgtgctgtcagctaattctatttttcatctggcttcctactttccaatatgtgacagcacgggaaatacatgctgaccatagaagaatttctactctggtagagttagctaaggaacctgcttctggagaatctgggctctttgaccccatagaaatatcacctgctgtattaccaaaattcccatatcccactgagtctttaccacccatgtaccctaccttcccaaccagatatgaaccagttttaactggaaaatgccctgtaaacttttctcattcaggtatatcaagtatcctagataaaacagcatctgattgctctggacctttggcagcccttgtagggaatgtaatatgttgtcctcagttaagtagtttgatccacatcttccagggttacttcagcatgaaatctgatcatttggttttgccaaatgcagttgctgatcattgtttttctgatatcattagtattctagccagtagaggggcaaatagtacaatccccagactttgttccataaaatcatctaattttacaggcgggtcatgtcctgtgaaggacgattctacttttgagaaaacagttaactcaagtaagttacttgaggcttgcagcactgttgatccacttaaagagtgttgcaggcctgtttgccaacctgcgataatggatgcagccttacagatttctggaagacaaatgatgattaacaataatgaaaatatggccggggaagtgaatcacactgattatcttaacgattgtaaaagtgtggtttattcatatctttccaaaaaactatcatttgaggccgcaaatactgcattccgtatactatctgcttgcaaagtcaacaaagtttgtcctttgacttttaaggagccaacagaagtaattaatgcatgttggaatgtagctgcccccagcccttcctgttgtagttcattaaacacatatattactgggatacaaaagcaaatgttaattacgaataagcaagctataatatgtgcaacactttttggatctatgttacgtggaggtggagtgatgacaaatatttatgagctttgtgacgttgatttgaaagatttcagcatacaaggctgtttacttcgaagcttgcctggagatgtgatatttgacaattcatcaggctttagctttacatgtgatttgagtgataacattgctgcgccctggccttcttcatcatcttcatttgcatctatgtcactctgtgcacctggttgtaattctggtggagtgggattgcttctgcttattttttcatttttcatcttcagtacactgttgtattga

SEQ ID NO: 71693 - DNA, 639 bp, Glycine max
  Peptide Sequence Number=SeqID_188471
atggctcaacaggaagaagggtggcctttgggattgagattcttgaactcgagaattgagctgatgagaaatggttccgggtcagcctccttcagcactgtgctcactgcttctcacaccccttcgactgattcttcctcagatcttgacaccgagcaatgtccccttttcggttattgcaccatttcctattcagctgatctaaacttagacatgctttactctttcatgctgtccactggatcattcttccatgacaatagcattacacttggcagcctcattggtatctctagcttcttagaactctcaaggagatcaaccaggggaagaatgatggaaccctccaaggacaacaaaaggattcacaagctgaagccttggttgttttcactttgttcaaggctaagtactgatgcagtgattgggaatgatgcaccctctcttggccactaccttgaagctgagagaagagctgcaagtacttacagaaggaaccaatgtcctaccacctatggacccaatggtttctcccctattcaagactcaacctcactattagtgcggagtcaaattgatcattggccatctgcttcactgggtggtgaacatgatcttaacagagaaatggaagagtga

SEQ ID NO: 71694 - DNA, 609 bp, Glycine max
  Peptide Sequence Number=SeqID_188472
atgattttcttctttagtcttgtcatttccataatttccaaaattttgtggattccttggtcaccacaagcaaatctgttaagtgagctcaatcaggaagcaaaagccttactggaaaaggccttactagaagctaacagggagagggagaagaccatactaaaggagactgacatgcctccatccccactgcattcagagagtgaagatgataacattgcctctgaggctagcgatatggagttatgttgcatatgctttgaccaagcatgcacaattgaggtcagaccctgtggccatcaaatgtgtgctcattgcaccctagcactatgctgtcacaaaaagcctgatcctgctactgccggcctttctggaccagtttgtccattttgccgtggcaccattcttcaattactggttgctaagattaacaaaatcagtgatacagaagtggaatctggccctatgaagccaaggagatcacggaaatcaaatttcagtgaaggaagcagcagcttcaagagcttgtcggccatgggctcatttggaaggattgctggccgcaattccgggaagattacagatgaaaagcaatgggaggtttcttga

SEQ ID NO: 71695 - DNA, 141 bp, Glycine max
  Peptide Sequence Number=SeqID_188473
atggcacgatcccttgacctcttctcttcttcgacgcaacctgacttgagaacaaaagcgagtgataagaacgccgacttgtcgttcaagattgaagaaggctttggacccaatggattggggattctatccgtcactgat

SEQ ID NO: 71696 - DNA, 633 bp, Glycine max
  Peptide Sequence Number=SeqID_188474
atggaagattcaggagcgattctcgctcacatttcatctctgaaggaaatgctggatcaggtaaacgaagaaatcgaggctaatattcaggttactcgagagatcgaatccagcatcgtcaaatgcgaggagatcgaggctgatttggcaaccagggaagccgagttgatcagaaccagtgccatgttgcagttcgacaccgttggatacgtcaccgtcgctgctgatttcagggattcagtaagtaccttggagaaggagttatgctgtcttaaagtgaagcgggatgagatcgttagtaaagtagatgaaaatcgggaaaatttcacaacgctatgtctagaatttcagagagaaattgacaagagagaagattgtgaagtgagagtcttgttgtccgagaaacattcccttgaaaatgaaattcaacttttggataagaaaaataatgttttgaaaaattcagtgttggcatttgtggaggagattcttgaaaatcttcatagttcgaactcagcattagaagttcagatacagaggaggaactgggagaatgagaaattgcttaaggatatcaatgatttgaagactacactactttcagcaattgggaccagcgatgatgttctataa

SEQ ID NO: 71697 - DNA, 231 bp, Glycine max
  Peptide Sequence Number=SeqID_188475
atggccactgagcacattaggaaaactaagttatggtcacaaagtcccaggcgccagatagaggcagcaactgtatcaagagttcaagagcatgaagcacgtattgttgctccattgaagttgacaggcaacaaactctttgcggtgatgcagcttttcgcgtttggatacagttggcgcctgaggattatgctgcctcacatgatgtgggctttggccactagccactag

SEQ ID NO: 71698 - DNA, 1104 bp, Glycine max
  Peptide Sequence Number=SeqID_188476
atgtcagagacattcatattcacactttctctggttatgctatgtgctgcttcagcttttgcagcagttccacacaggttgccagaagtttacctcaagaatggtaactttgaggagaatccaaaccccaaatacctcaagaaaacgacactgattgggaaatatgctcttccaaaatgggagatcagtggtcatgttgagtatgtctcaggggggccacaacctgggggtatgtacttcccagttagtcatggagtgcatgctgtgaggcttggaaatgaggcctcaatctcacaaaccattaaggtcaaacctggcaagtggtacgctctaattctaggagcctcaaggacttgtgctcaagatgaggttttaaggatctcagtgcctccacaatctggagaggttcctttgcagaccctttatagcctcaatggtgatgttatcgcttggggtttccgtcccacttcttctgttgccaaagtgatactccacaaccctggaattcaagaagaccctgcctgtggtccactcttggatgccgttgctatcgcagaattctgccctccaaagcctacaagagctaatttggttaaaaatccggggtttgaggtgggtccattccctattttcaactctacaaacggtgttctacttcctcccgaacaagaagatcatgtgtctccactccctggttggatgattgaatccctcaaagccgtgaagttcatagatgcaaaacatttcaatgtaccatttggacagggagcagtagaacttattgcaggcagggaaagtgtcattgcccaaattctcagaacagttcccaacaaaatttacaacatgaagttcacaattggagacgccagaaatggttgtcatggatcaatgatgattgaagcgtttgcagcaaaagataccctcaaagttcccttcaaatctgagggaaagggcgaattcaagactgtgagtttcaagttcagagcgattgaaaacagaacaagaatcacattctatagctccttctaccatacaagaattcatgactacggatctctttgtggccctgttattgatcaagttatagtgtatcctgtcgcctga

SEQ ID NO: 71699 - DNA, 342 bp, Glycine max
  Peptide Sequence Number=SeqID_188477
atgggcgagggagagcaagcagattcacacgcaatagtgattgatcttcattgtattgcaatcgtccactttcctacatccctctttgttgtcgggtgtggcaaaagcaataacgtgacgccgagggtgggtacccatatggagaaaaatcgaaatttcaatgttttcatagctgaaacgcgagtgaaggatctaatcggaaacagtgtggtcgtgccagcagaggagcatggctatgcagcgtccgaagatgtagaagcgcgtcttctgctgctttgcaaccagatagcaccgttttcgaaggcttgttttccggcaagattgggagagagtcatgcttag

SEQ ID NO: 71700 - DNA, 411 bp, Glycine max
  Peptide Sequence Number=SeqID_188478
atggttatgaattccattccagcctactcttttatcttagatgaaaaattaggcaacaaatttctggttgatacttcgatgttgagcacttgtgctttactaagcacagaatggtttcgtacggcgaccagattttgttacaaatcagatgcttcgagtgagattccgacacagatttgtccaaatattttaaaaggatctttctatgccaatcccatacttgatacacctacaacagaggcttctttgatacaacggtatccatcatattgcggctcaaatatatggcctagaaacgctttaccagaacttgaagtggctttcaaagcacttgggaagctgatatttgacattggattgatgttggcatatcactgcgatcaatatggtaagacagcaatcaatatttaa

SEQ ID NO: 71701 - DNA, 249 bp, Glycine max
  Peptide Sequence Number=SeqID_188479
atggattcaagcggcaatggtcatgattactcaaagcacaagaaggactatgaggattatgagattaacgataagcagaaggaaagggtaggtaggtctaggaagcttggtaccaatggtgaagatgaaagcgagggttccaacagaggtgtcaaaaggaagtgttctagcaaagccaccacggatggtgacaattacaatttgcgctctaagcaaggggcaaagaaaaggcagaaagagagaacctag

SEQ ID NO: 71702 - DNA, 1941 bp, Glycine max
  Peptide Sequence Number=SeqID_188480
caccttgatcacaagaatgtcttaaagaatcctaaaatgcagcttgacattgttggtgttattacccatcttgctcaacaaacaagggttcaacaatctgtggctataattggtgcattgagtgatatgatgagacatctgcgaaaaagcatacattgctctcttgatgattcaaatttagggtctgaaataatacaatggaaccagaaataccgaatggaagtagatgaatgccttgtacaattaacaattaagattgcagatgcaggtcctgttattgataccatggctgtgttgttggaaaacatgtctaatattactgttatggcgagaaccttgattgctgcagtctatagaactgctcaaatagttgcttcaataccaaatttgtcatatcagaacaaggcaagattagcattccctgaggcattatttcatcagttactcctggcaatggtccatgcagaccatgaaaccagggtgggtgcacaccgcatattttctgttgttcttgtgccatcttcagtttgtccacaaccttcctcttcgggaacccctatgacacatgcagctgatattcaaagaatgctctcaagaaatgtgtctgtgttttcttcttcatctgcactctttgagaaattggagagaaagcaaaattccttgccagaagatagtcatgcagatggaaatgttaatgataactccattttgaacagattgaagtcaacttatagtcgtactactagtacaagaaaatctgctttgaccagtgctgaatatactgataacaggaactcaaaggttcataattcttctatgatgagtagattgaagtctagttacagccgtgctactagtgtgaagaagccacaaatacctacaactgtggaagaaaatactacaaatacttcaaataaacaacaggtattacccattaggctcagtagtcatcagattacccttttgctatcatcaatctgggcccagtctatctatcctctaaacacatctgaaaattttgaagcaattgctcatacctacagccttgtcttgctagttgctcggagtaaggttgatccattcctgcaactggttaatgatagcaagttacaagcggttactgatacagataagcagccaagtaaagtttatggatcaaaagaggatgatgaagatgctttaaagtcactttcagcaataaagttaactgagagccagtctaaagaatcatttgctaccatgatagtgcagagtctgggaaaatcgtctaatgaatcatccatcttaagagaacggctgctgaatgatttctcacctgatgatgcctgtcctttgggagcccagttatctgccgagacaacaggaaatatgtaccagtctggactaaaagaagataaacttcctgatatggttgatatttcattatttactattgacgatgacattccaccttgtggtttggagagccaagctaattctgattcaatgcaacagccctcacaaaatctaagcctgctgagtgttgatgacattttgggttcagtttcggagacaacacatcaagtaggacggatttctatttcaacaccgtttgacatgccttacaaggaaatggctctccattgtgaggccctcctcgtgggaaagcagcagaagatgtccactttcatgggtacccttccaatgcaaggatattcatttaggattcctgctcctgaatactaccagcaaaaggacgagtcctcaaattccagcgttcaacagactttatcttcgagtggaaatccgtttttggattcaaacttcgactcgaattcacacaacacattgcctgacactgctccaaggctttgtgcaacagcataccagcatcaggctgccttctttcaactgccagcatcacgcccgtatgataatttcttgaaagcagccggatgttga

SEQ ID NO: 71703 - DNA, 1128 bp, Glycine max
  Peptide Sequence Number=SeqID_188481
atggaggaacttcaagggtctcaaacccaatcatcgctcggtcaagaagatgaaaatgaagtgattactgaaagttcagcatttgttaaaggggaaccggcaccagaattcagtagtaaccccccaaaagttgattctgaagttgaagtccttcatgagaaggtcaccaagcaaatcattaaggaaggccatggccagaaaccttccaaatattcaacttgcttctgggatatggttgtagtccattacagggcatgggctgagaaatcagaacacaagtttgaagacacatggctggagcaacggccaattgagatggtcttaggaaaagaaaagaaagaaatgactggcttgagcgttggtgtggcaagcatgaaagctggggagcgggcattggtgcgtgtgggctgggaattaggatatggagaggaaggaagcttctcttttccaaatgttccacccaaggcagatttagtttatgaagttgagctcattggctttgatgaaaccaaagaaggcaaagctcgcagtgatatgactgtggaagaaaggattggtgcagcagaccggagaaagatggatggaaatgctttgtatcaggaagaaaaactagaggaggctatgcaacagtatgaaatggccatagcatatatgggagatgacttcatgttccagttgtttgggaagtatagagatatggctctggctgtaaagaatccatgccatcttaacatggcagcctgtttgattaagctgaaccgctacgaagaagctataggacaatgcaacactgtactgggtgaggatgagaacaatgtgaaggcgttatttaggcgaggtaaggctagagcaacacttgggcaaacagatgctgccagggaagattttctaaaggcaactaaatatgcccctcaagacaaagcaattgctaaagaattgagattgcttgctgaacatgacaaggctgtttaccaaaagcagaaagagatatataaaggaatatttggaccaaggcctcaaccagttcctaagccaagaaactggctcatacttatttggcagtggttgctttcagtattctatggccttgtcacgctcttcaagcgtgaaaggcataaatctgactaa

SEQ ID NO: 71704 - DNA, 369 bp, Glycine max
  Peptide Sequence Number=SeqID_188482
atggctactccaatgagtactgcttgctacttggataaagatgaaaccggtcagtcaatagacattaagaaatatcgagcatcctctccaagcttcttatccaaggcacattcttggtggggaagctacttcttccaaggcttattccctagtggttggcgtctcctctcactttttttcctttgtcttccgttgcacctccatggtggaaaatcaccattgaaggacctcattgaagctcaaagatctagcctccatataatatttacaagcaagcttccaccatttacaaaacctctccccaaagacaccttctttgctattagaagagagttaggacttttagatatcaatgacttaaataaatag

SEQ ID NO: 71705 - DNA, 165 bp, Glycine max
  Peptide Sequence Number=SeqID_188483
atggtgagaatggtcgccctggcagatgcggggaggatgtcagtacaaaagagcctgtacagcaaacccatccacaagctgggcattgttgttttggttagcagcttaaaagcaagacgaactacaacaacaaatagatacaactacggatcaggactgaagtag

SEQ ID NO: 71706 - DNA, 489 bp, Glycine max
  Peptide Sequence Number=SeqID_188484
atggatggaacagtaaaagctcaattttttgctaaactccaaggcttgaaatgtgatgttgtgctctctttcagaagaagagtacaccaaggaacaaactcagtctcctcacctgtaagtataaacttttctccatcgatgaaaatggtgacatacaatgaagtggagaccatatataacaatgttgagagcattaaagacaaaagctcaatagtttgctatgagtgcaaaaagcttggacacttcaagtatgaatgcgaaaatctgaagaaaattcaagataagacgaaattcttcaagactatagaaaagaaggggtttaggagcatgtgcgaagacccagacgaaaccttgtctgatgaagacgatgaagaagccaacatatgcctgatggaaaacacaacttctgaaggatctgaatcagaccaggaagatgagcttataaaaacctacaaagagatttcaagaatctatccagagatcatttaa

SEQ ID NO: 71707 - DNA, 174 bp, Glycine max
  Peptide Sequence Number=SeqID_188485
gtttggtttatgggtgaattcacccatatctcagctgaattcgacaatgttgtttcagttgttttggaaaattatggggatgtcaaagaagattctcaaaatgagaatgctatgaggctttattcttggagaatggtagtgaatgacagaggagaagttaacgtgcccgtgtaa

SEQ ID NO: 71708 - DNA, 345 bp, Glycine max
  Peptide Sequence Number=SeqID_188486
atgaagaagaagaagatgagcgtgatttcacgaaacatatggccggtttgcggaagcctttgctgtttctgccctgcgttgcgagagcgatccagacatccgattaagcgttacaagaaatttctcgctgatattttccctcgcacaccggatgaggaaccgaatgagcgtatgatcggtaagttatgcgaatatgcctccaagaatcctctccgtgtccctaagataacgagctatctggagcaacggtgttatagggagttgagaactgaaaactaccaatctgtcaaagttgtcatctgtatttataggaagttgttgatttcttgtaaagatcaaatgtga

SEQ ID NO: 71709 - DNA, 629 bp, Glycine max
  Peptide Sequence Number=SeqID_188487
gtagtggagaagtggagaagttcctgaagaaatacttttcggaatctaagactgtagaggccgataggaagatcaagttgaaaactccagaagaagccatggaactgatagagaatatgacagccagtgatcacgccatcctccatgatagagcccatacaaagaaaaaccttcttgagctcacttctcaagattctatgtttgctcaaaataagcttctagtcaataccttggaaaccctcacggaaactctgagtgctcatgagtcaggcgcatgcatggttcaaaatgatacaactaataaggtcaactacatgggaaatcagaatcgtcaaggattccatcaaggcggaccaccgggcttttatcataaagcaatcagaaatctggaggttcaaatgggccaattagctcagaaaatagctaaaggacccactaaaacctttggggccaacactgagaaaaatccaaaggaagaatgcaaggcaattgatgcaagcaaagaagagcatgctaaggagaaagagaacaatgacaaggtctcaacacagaagaccaaaagccaactagcccgggaagccaggagagagataccaccagctgtgcttatggaagcaacgctaccataa

SEQ ID NO: 71710 - DNA, 2067 bp, Glycine max
  Peptide Sequence Number=SeqID_188488
atggcaatagctataacgcaatgttcagaaaaactaggctaccttatacttcaattaggcaaaaatttccttgtgttcatggccatggtggttgcatgcaatggtgtgcatttcctactaaagccttgttcacaacctcgcgttacttccgacataattgtaggactaattatggggaacataccttttttacgtaaactatatgatgaattcaacagtacctttggatttatcatggattttggcatgatgtgttacatgtttgttttgggtatagagatggatccttacgtgctattgaagaaaccaacaaaggatgctcaaattgcttatgcaggaatattgtgcaccttcatcatatcaagttccttgacttcattactccgttacttcacagtgcaatcgggactagcagtcagcatctccctctctgctcttctctccagcacggcgtctccggttctgacgcgtgtaataaccagcctcaaaataggaaaatcagacattggaagccttgtgataggggccgggatgcactcagatttcctctgttcattgcttctttcagttggctacattttcttgtcatcggatatatactgcctgggccctaaaaaagacaaggctctcatggcagtcatcacaatgagcgttgcagttctagcacagacgttgttcacggcggtggtttcacccgtatttatggcgtgggtgaacaatgagaaccctgaagggaaacccatgaaaggatcacacctggtactgtcaattgccttcatggtcatgatttgtgcctcctcaactctatacaactatagtccggttctaagtgcatttatgacagggatatgtcttcccagggagggaagactttccaaatgggttatcaccaaaatcaattatctcttggcaaccatcttctttcctatcttcttcttgtggatgggctatgcagctgatatgaccaaattcaaccccggagaccctataacgtggataagattgtttttacccgtagccgtagcagtcctgggtaaagttattggcacacttgttgctggggcactgcttggctttcactggcctgaatcaattgcagtcggattgctcctcatcaccaagggccattttcaaatctacttgtctatcaaagcggcaagtatcttcctcatttctcttctctcttcaccaattaattacttgcattgcattaatgaatcatcaatctcattgtttgtttgtccttctcttgtattaattaccttccagctgaattgtggcacctccggtactccctcctctgccattgttccggtgattgcaatatttctcacattggtgcatgcacccatagttgtggcacatatcatcaaacgtgccaggaaaagagcacctactcacagcaacgccctccaattgctggacccattaagtgagctaaggatactcttgtgccttcacggacttgataatgttcctgcttccatcaacttcatggagatctcaagagggtcagcagactctagcattctggtatatgttgcagaaattattgaattaactgatcaaatagcagcaacattagagagtggtgaaggagtgcatacaacaactataaaagacaagcaagtgatagagatgagagaacaaataactagctcctttcaagcctatgtagatagagacggcaatgggattacattcaaaagatcattggcagtgtcaacaatcactagcatggcacagaacatctgcgttttagcagaggacttgatgattgccctcatcatacttccattccacaggtaccagcgtcaggatggaaaactcgatggtggcaatccaggcttcagatatgtgaaccgaaagttattgaagagtgccccttgttccgtggggattctagtgaacagaggttttgggtccgtggagaatatatcaaggtttgagccattgctcaaagtggcaataatattcgttggtggaagagatgacagagaagcactggcctatgtgggtcgtgtagcatggcattctggagtaaaagtgacagtaattagattcctg

SEQ ID NO: 71711 - DNA, 450 bp, Glycine max
  misc_feature (35)..(35): n is a, c, g, or t
  Peptide Sequence Number=SeqID_188489
atggaacttcaaggacttaatcaaaatgaagaacncgacaaaaagaaaagaagcatagcacttaaaacctcctcatcaatgcaagaagaaaatgaagaagaagaatcagaagatgaagaagacttctcactctttgtgaagaagtttcaaaaatttgttaagaagagaagaatcgagaggcatcaaaacttcaacaatggaagaagatctcaagaagactctcaaattcttagatgctacaaatgcaaccaacttggtcacatcaaagcaaattgtccctcaaatgaggaatggcctgataagagtgataagaaaaggtatgaagaaagaaggaccaaaaaggcttacattgcatgtgatgacaatgactcattcgatggttcagagaaggagatcaaccttctaaccaaggactttgagagtgatgagaacatctctcaagaagattaa

SEQ ID NO: 71712 - DNA, 1479 bp, Glycine max
  Peptide Sequence Number=SeqID_188490
atggaattgggaagcataaccgacttccttcagaacaagaacattttggtcattggtgccactggcttccttgccaaaatttttgtggagaaggtactgagagtgcaaccaaatgtgaagaaactttatctacttttgagagcaacagatgccgaatctgcctctcaacgattgcacaatgagattatgcggaaggatttgtttagattgttgaaagaaaatgttggtgcaaagttcaatgcctttgtttcagaaaagttgactcttgtgcctggggacatttctcaagaggacttgaatttgaaagatcccattctacgcgaagaaatttacaatcaaattcattgtatagtcaattttgctgccacaactaactttgatgaaagatacgatgttgcattgggtataaatacattcggagttaagcatgttttgaactttgccaaaagttgtattaagctaaaggtgcttgtccacgtatcaacagcatatgtatgtggtgagagaggaggactcatagtagaggatccatgccaattgggtgtgtcgctaaatggagtgcctggactagacattggcatggaaaagagagtggtggaggataagatgaaccaacttcatgaagagggagccacggaggaggatgttaaaatggccatgaaagacttgggtatgaaaagagcaactttatatggatggccaaacacatatgtcttcacaaaagcaatgggagaaatgcttgtagaaactctaaagaaaaatatgtctgttattattgtacgtcccacaatgattaccagtacttacaaagaacctttccctggatgggttgaaggagtaagaaccatagatagtgtaattgttgcttatggcaaaggaaaactaccatgcttccttctagacatcaacgcaatttttgacgtgataccagcagatatggtagtgaatgcaataataactaccttggtggctcatgcaaatcaaccttgtgataatattatatatcaagtaggttcctctattgcaaatccaataagataccacaatctcaaagactacatctatagatatttcaaggcaaaaccatgggtgaacaaagagggaaatcctgtaatggtcggcaaagttactgtattggacaccatgactagcttccagagatacatgttcattcgttacttgcttccattgaagggactagagctagccaatgtagccttttgtcaatattttcaaggaatgtgtcttgacattagaaggaagatccatatagtgatgcaattggtcgacctttacaagccctacgtgttcttcaaaggcgtatttgataatatgaacacagaaaagttgcaaacagcggtcagacaaggtgaggtagagatggaatattcgttttactttgaccctaaaatgattgattgggaagactacttcatgaatatccatattcctggtatagtcaagtatgtcttcaagtaa

SEQ ID NO: 71713 - DNA, 252 bp, Glycine max
  Peptide Sequence Number=SeqID_188491
atgtcaggacatactcaaaatgaaagtgatcggttgaacaccaccacaatgacagtgatgtataggcttgcacgatgcaaaggatctttaggattatgtggaggaaagtttccatcaacaaatccgagtttgtttcttccaccaagagccatgaacattgctcgtttccatgagttccaattctccaatgtgagaggatacgagaatcaaaccgagactatcagcattattgatgatgtaaggatcatatga

SEQ ID NO: 71714 - DNA, 1146 bp, Glycine max
  Peptide Sequence Number=SeqID_188492
gctcttctaatgaacgcgctgagcacacaccttcatgctaagcgcgagtttaggagggctaagcgtgcaccatcgctaagcccaagaagagcaagggcgctaagcgcccactggtggcttagcgcccaaacacgagacaccggaccacatcgagtcagacatatggagaggattccccctgggattcctttcagttcgtatcagagaccgcatggcataggtactgtcacaacctacccttcagtgggagggcgacgtgtgactcgcgggggaggagcttgccacccagctcgcccaggtgagctaggttgcttcctccagaagcaaccaccttctggaggaacacctggaaggcccaagtgggcccggtaccaagagaacattcatcttcggaacatccttccggagaggaacatagcgcttgcccctaagatgtatgacgagttttatggtgagatccacaggcgttactggcatagatgcctcaccatgcttcccgagaagcaaattgatatagctctgacattgaaaaaattcctagggaccctagtcaccatcgccgagggggagcagctgaccacatatgcccgatacctccactcccatccagattacaaggccattgcgaccaagctatgcatccccgaaaggcgatttcagttgaatgccgatgttgaactgtggaagattttgcggaaggatctcaccaccttggcccatacttggagcgtgttatcctacttcaacatcgctctgaccttgcatacgtcaaacattaatgttgaccaagctcgcctaatctatgggctcgtgatgcagatggacatggacggaattgactcagacacactggcattcgagtccctcagcccggcgagtccgagcccacaccactcaggatgcaccaccaccataaccaccagtggtctcacctctagccatgccttttacaaccagcccttcttcctcctcctcagcccagcagaagcctcttgcacagatgatgcagtgtctttatcacgaccaacgcctgatcatccagaacatgcatcagttattcctccacctcgccatggatcccccgttgatgacgccagaggatttcatccatcaagtagcatggccaggattccaaccctcctctga

SEQ ID NO: 71715 - DNA, 1179 bp, Glycine max
  Peptide Sequence Number=SeqID_188493
atggattcatttccctctattcaacgtgctttctctttggtgattctagaagaaaagcagcggaaggacaagcaacaaaacaaagtgattggcaagggtaaccttcatcaagttctttaccacttccaaccacacagtgaatatgcgtgtagttccatgcacactgttggtttgagtcaatgtaataatgttgcatatgccaatgtttggcatgcccgaatgggacatttatcagataatgttccaaaaattctgagcaataaaatttcatttcatattccaaaagatttttcatctaattgttgcttaatttgtcctttgccaaaatttaaacgtttgtcttttgattctcataataatttttcggagtcaccttttgacttgatccactatgacatttggggaccatttcctcatgacactcatgatggcaagaaatatttcttaacaatcgtggatgataattcacggtacaattgggttcatttgatgagaaacaagtctgaggcaccacatctattacaagctttcttcaagcttgttcagacacaattttccaaaagcattaaggctatgcggtctgataatgctaaagaattagctttgactgagtttttgcataatgcaagagtagttcaccagttttcttgcccacacagacctcaacaaaattcagtaatagagaggcgccatcaacacctattgaatgtagcacgtgctttaatgtttcaagctcagttgccaatttattttttgggagagtgtgtatccacgacagcttacatcatcaacagaacatcaagctcaaatttgcagaaccaatcaccatatgagttgctatatggtaaagtaccagcctatgatttgataaaggtgtttgggtgcttgtgctatgcagccactgtccctgctcaaagacataagttcactcctcgggccactaaatgtgtgttccttgggtatccatttggttacaaaggatacaagctctatgatttagacaatcgtaaattccttatatctagagatgtgactttccaggaaaatagctttccttttgccacaagcacatatataacatctgattcgtttccaaaccttgttgtacccagacctttgcctgacatgctgcctgatccaaaccccactcatcaaccaccacctgaacctgaaccataa

SEQ ID NO: 71716 - DNA, 3621 bp, Glycine max
  Peptide Sequence Number=SeqID_188494
atgggatttgacaatgagtgcatagtgaacattcaatctcttgctggagagtacttctgtcctgtctgtcggctgctcgtatttccaaatgaagctttgcagtcacaatgtactcatttatattgcaagccgtgtttgacgtatgttgtgagcactacaagggcttgcccatatgatggttacttggtcaccgaggcagattccaagcctctgacagagtcaaataaggcactcgctgaaactattggaaaaatagcagttcattgcctttatcacaggagtggatgcacatggcaaggaactttgtctgagtgcacatctcattgttctggatgtgcttttggcaattctcctgttgtttgcaacaggtgtgggatccaaatagtgcattgccaaggtgtgcaaggtcaggcaggcattacacaggatccttcagctactagtgctgtcacttctacagatcagaatcagaatgctgctccagttgcagcaacggcatctcaaactgctgtcacaactactatgcctgggcaggtttcaaatcagctgcccaacccagcttcccaaacccaagcttcagttcaaactgctgggcagccaacggcagagcaatggtatcagcagcaacaatatcaacaatactaccagcaataccctggacaagatccataccaacagcagtatcaacattactacccctatcaacagtctgtggttccgcagtaccaacaggcctatggtcagccccaacctcagtctcaatcacagccccaaggccagcttcaaccccagccccagccccaatctcagcctcaatttcaaccacaacaacaggcacaaggactgtcccatccacctatacatattcaggctcctgtggctccaccatctcataatcagatgcaagttcaacaaccatcacagcaacttcaacctgctgtgcagccacatggtcagacaagtcatgcaccaggccatggtcaagccttcccccagtctcaggctcagccttatccttacccccaagttcagccacattctgtccaacctcaaccccaacaacctatgcaaatgcctccttatcagcagcctcatccccaaatgcagcattcacaacctcaaattcaacaaccagttcagaagtatcctgttcctcaatctcaagttcatgcacaactgcaacctaatgctccaattcaacatcactctcagctccccatgcctcctcaccagcctgtgactcctaatgtccagcctcaagtgcaaaatgcaacgtcgcattcagtgacagggcatcactcttatccccaacctccgcatcacccaaatatgcaaccaggagtccctcaacatgctattcacatgcatcctctaagtgggcctcaatcccaggcccaacaccctatccagatgcagaatcagtttcctccacaaattccaacagcacgtcctaatcaatctcatgctatgtttcctaaccagcaacagccagctttgttgccttcatcagttcaaggccaaactacccctcctttgcaacaacagtcggtatatacccataatcaaccacctgggcaaatcaaccaacatcctactttgccaccggttcaacaaatacctcagcagctgtttgcacagcaccaaatgcctataccatctcatttacgaccacaagatccagcacattcatttccaaagcatgcatatccacagtcacaggggaatactgcaggaaggcctttagttcccaaccatgcaggacacctacagccatttgcccaatctgccaataccattccagttagacctgggcaaaatggtgctggctacctgcctgaaaatcagaaattgttggttggggccaataatcaagtacagttgccttcagaactgcagtccagggcaccagaatcaattgaaagacaaggtgatgttgttgagcaacagactgactctgcctctgggaaacttagtaaagtttttaaagatttggacaatgtgtctggatcagcaaatgaattgaaatctgaaaaagttgaagcagatctgaaaccaacagaggttggaaataagcaaaatagtgaagatccacactctctgaagacttcagtcccaaatgccaatgcagtagaaaatgatgattctgtgaataagaatcttgggatgggggaggctgctgaaagcaattggaagccttcaagtggtgcaatgcatggggttcaaaatgatagtaatgagcattctgtccaaggcaatgaatttcaagatggacatccaccgaagacagagactaaactccctgagtcagaaactaataaattgcataatggtgacaatcctgaaccatctgtctctcaaagcaatggcggttttgctcagctgtctcacccagccactttcactgatctgagtaagcatcagcaaccaacaattagttatggtccgccttctgtccagcagagatcttctgcaataacatcacaattgccacatccaacagttcccaatcagtcactctcttcagtgcactcttcgacccttattaggaatcatggaactgcccatgctcttcattcaggacagcccttaaccgagaattttccgccaaccatgtttaagcaaccacaagattctgacattcagtttaatactccagggcgaagcttgcaacctcagtctcttggacccccacgaccatttaaccaagtacatgagcctccttcccatgctggaacatctaatttgcctcgtcttggagggcctcaatttggtgcaccacttcctggagatatgcatggtcgaatgacagccaacttaccacgacatgctcctgaaggttttggtttacaggatgaaacgttcaaaccttttcatgctctaaatcaacaaaatattgatagaagagagtttgatgatgatcttaagaaattctctagtctgccttcgaattctgagcctgtttctaaatttggaaattattcattaggcgcacatgatgctggaaagagaccagttggtattcatgacgatgtcattaagaaatcaggttctgctcttcatcctggttatcttgaaccaggtcctggatatgggagacatcatatggatggtatagcttcaagaagtcctgttagtgaatatgctgagatgtcctcccggagattggggccgcacgctggcagtcttgttggtaaggcaggtatagatgattttgagggcagagttgcacgtcgttttggtgaattccatgatagtcggtttcctcatttgcctagccatttgcatagagatgattttgatggttttggtaactttcgaatgggtgaacatccaaggagtggtgatttcattggtcaagatgagtttggtggccattttcggaggggtgaacatttggctccacataacttccccagacatttgcagcttggggagcctattggttttggtgcccaccctggtcatatgagagcagttgaacttgatggttttcgtggttttgaatctttcggcaaaggcggccggccaggtcatccgcaacttggtgagcctgggttcaggagcagcttttcacttccaggatttcctaatgatgctagatttttaacagttaagttttga

SEQ ID NO: 71717 - DNA, 2517 bp, Glycine max
  Peptide Sequence Number=SeqID_188495
atgggtatggagacagtttggaattcccaaagcaactggaccattgcctcgggctctatccgcgactgcatcaccttccaatcctctctctcactcctccacgatgacgatgattctgaatccacccccactcctctccttcttcaccccccttcgccggattccactccttgcgagatcaaaattacttttgcggagaaacacgagctcagacaaatctacgttcggagcacggctcgcgtctacgagatttactatgcgcccaattctcgcaccaacaacgactatctctctactgtccgatgcggtatcgctgttagagacgatcaggttcttcgttctccttctattcaaaatctgagcgacgataacgttaataagactgaagatgattgggttgaagtcaaagttcctgattctccttcccaaaccaaaccctaccccaattccaccaaaacctctctgtctcagtctcaggatctttatgaggctacagcagagattaatgatgcaaatccttgcatttctgttactcttcgtctgctctcgcttcagaacaaaggccgtgtttacgttgatgagatttatgtgtttgctgatcctgttgattcagttgattcagaaagccaagaaaaccataatgaaaactcatctagcagttctctcatggctatgtttctccctttaatgcaattatctaagacaacagggcttagcaatctaaattctcttagaaaggaaaagctacatgtttcggaggatgatttcgaagtaactctcacaagtgattctgtaattaaaactcagctaaaaggaaacactagcataactgatcctcaagaagtgaagttgaatgaggtaaaaggaggttgggtgggtccttcccagccagatgcactctcacaagatgctagaatagagagcaatcatgctgcagtatcctcacaaactgctaaaatggacagcacttgcagtgttgtaccctcaaaaattgccgaaatggagaacaaccacagtgctgttccctttcaatttgctaaaacggaatgcaattgtagtgctgttccttcacaaggttctattcctgagagcaatcatggtgattatttgggtggcaaagttgaaagggccctggaacaacttgtatcccgcatggacaggatagaagaaatctgtcttggctttcaagagaaaatggtaatgcccatgagcagcatggaggcaagacttcagcgagttgagctgcaactggatactctgactaagaaattgcagacttctgctttgccatcatgttctagaatttctgctcccgatgcttcttgtattgaatcagatgccaactcttttgaagaatgtcctgattataccgtcactagggaaaatgaatcagatgagaaacatttacacacagaggtaccatatgactcagctctcatgtctgattcagaaaatgctactcaattgctcccaggtcttgtagttacagctcctgagtttcctgatggtgaggatgaagacggtgatgcatcaggacaagaaataaactcttcgaaagataaaggaaagcagtcaattgatgatgctttatcttctgctttagctagttttttgtcttctttgtctttagactctccaaagtatactaaaagtttaagtgttaaagcccctgagttttcaaatgaagatgaagatgacaacgagagtaataatagtgagatagcaaaaaattaccaagttcatctaactgacagtgaggaatttagtctcatccaagtgttggcttcatccagtacttgggaaaacagtgagaagataaacccagattctaatgataaacactccaaaaagactgcccaagaagctgaagaaaatgaccagctttgcagtgcagaaggagatcaagatgaggtgtgtgtaaaaactggttttattgacagctttgaagaagacaaaaatggtaaagtcaattgtcagaaaagtgacatttcagatgagttggttgacaatcagaccccctttggtcatagtatcaccaaggaaggaccatcttcaggaactgaacttactgttgcagcagaggtccctagaaaaaccttccatgagaacatcatagagaatgttcttggatttgcacttgcttcctctgttgtagattttgaaaacccaatattggatgtgaaattcatttctcagagaagtcctgctaccgagcgtttccttgaagaccttctagtggggacacaagatcaagagaccagttcaagagatcaacctgtcaaggaaagcaatgatgatgttaacgttaaggaacaactgaaaagcaatggtgatgtctcagttgaggagcagtctaatttgatttcaatagaagatggggaactggtgattccagctagcgatagccattttgctgtggacaaagacgtgtgtgcttcttcgataattgcacctgtgaacaatgaagatgacaatctgccactgccggaggatcataaacgaaaacgtgatcaataa

SEQ ID NO: 71718 - DNA, 297 bp, Glycine max
  Peptide Sequence Number=SeqID_188496
atggaagagttgctggaggtgatagcatggtcccaactaggaatacatgataaaccagtgggtttgttgaatgtagatgggtatttccacagcttgctgtccttatttgacaagggagtggaagagggttttatagacaactctgcaaggcatattgtagtcatagcagacacagcagaagaactcataaagagaatggaggaatatgtccccaaccatcacaaggttgcaacaagacaaagttgggcaagggaccaattattatttgagcctactgaaactggggagatcctatga

SEQ ID NO: 71719 - DNA, 186 bp, Glycine max
  Peptide Sequence Number=SeqID_188497
atgatttttcagtcatcgtcttcttctactccgacaacaaatttggcttcgacggtggttgttgacgtgccatgtgcggcggaggaggttaagcacacgtgcaagtttaactttaaggaaatgaggaaggagcatattgtgaagccggaaccgatggtgaaggacgagaagctcaagaagatttga

SEQ ID NO: 71720 - DNA, 222 bp, Glycine max
  Peptide Sequence Number=SeqID_188498
atggaagaagtaaaggtgtcaccagaaaataagcacaaaggaaggttccaacgaatatgtgtattctgtggtagcagggttggatataagtcttcatttagtgatgcagctcttgagcttggtaaattgttggttgaaaggaagattgatttggtttatggaggaggaagattaggactaatgggtttgatctctcaaactgtgctaaagggaggtcgccat

SEQ ID NO: 71721 - DNA, 648 bp, Glycine max
  Peptide Sequence Number=SeqID_188499
atgaccttagtagcacaaaagttgaaggacctaagtgagattgttgaagatgatgaagggttggtgcaaatggctctacaaaaaaggaaagttgcttctccaaaagcctttgctccaaagaaggccaagaatgcccaatcagtcattaaagcatgggcatcggtcattccctctaccattccacgatgcataaagatgagggtgaccgaggctaatccaaagatgggtgataatgaaatgggggtttccttcattggaaacaaggaacatctgaccttttcctcatcaaatagtgagtccactagtgacactcctaccttgcccccccacaagcatgcactattcagaggagcagctataaaggaaccattagctgatgctcaaagatttccattggccttcgataaaggtaatcctacacttgtaacccctttctctaaagtcattttctctaaacctgtgtttagggaaacagaatttgttcaagcacctagctggacacgatatgactatgtgcatactgcatctaaggcctttaagactctatcatcagatgatataattcatctttcacctctacaatggactcatctagagcaaccaattattgttaagatgcctccccatatgctagcacctgaaacttaa

SEQ ID NO: 71722 - DNA, 333 bp, Glycine max
  Peptide Sequence Number=SeqID_188500
atggaacaacaaaagctcaatttttcactaaactccaaggctcgaaatgtgatgttgtacacttttttagaagaagagtacaccaaggtacacaacttgagaagtgccaaacaaatatgggacactcttgttgttacatacgaagtgacgtcacaggtaacaacattgagagtgttaaagaatcttgattcaatgtctcttgaggaacttattggtaccctcaaggttcatgaacaagagctccagcaatacaaaggtctcataagagaaaagtctttggctctcaatactcggaagaacaagaaagaatcatcgtctagagaacaaatctag

SEQ ID NO: 71723 - DNA, 423 bp, Glycine max
  Peptide Sequence Number=SeqID_188501
atgatgctaggaacttctagagtcagattgtgtgaatggattcttaaaaagcctccacttttggctatgatggaagtgacaatgttgtgcaccacgaggttcttcaggtgttacgttctgttaggaacttccaatcttaagtataaggggacttatgacttgaaaaaggtggcagaagcccagatgaagaagaaggctgaagaagaagttatagctattgctgagaaagaacttgttgcttccgtccaagctgaagcatttgctaaatttatggacaacaccattatgcattgggtcatcattgatcttacaatcactggtgtcatggacgagactagtgaagcgtccaatgcaactatgattgatgaagttgaatcatatattcaagatcctacgtccaagcagtctacaacttcaaattag

SEQ ID NO: 71724 - DNA, 2091 bp, Glycine max
  Peptide Sequence Number=SeqID_188502
atggatagttacgaagctacaagagttgtgttttcaaggatccaaaacttggaccctgagaatgcttccaaaatcatgggtttacttctgcttcaagaccatggtgagaaagaattgattagattagcatttggtccagaagcacttgttcactctgtgattctcaaagcccgcaaggagttgggtttaccttccaactctccgcacacaacctccactcttccttctccttcaccatacctttctaagcaaaactcaacttcttcaaggctcagtgccctcactatcccaaacccttctgcttcatggcctactatgtctgaacttcaaaccccagatgatttggttgctggctctttaacttcttcatcttccttaccctactatgcaaacggaggctcagatccagttgatgagttccaacttcaagaccagcttgctttcctgaatgatggttctaatactagcacttctcacaagaacaacaacccagatttgttttaccctaataataactcagacttgtcttcaagtcctactactgctgctgaccctacactctttccttccgacggttggggagggtctctccaccgtaggagttgctcagtcagtgatgcttgtttgggctctgaggaccctaattccggtttgggatggaagccttgtctttactttgctagagggtactgtaaaaatgggactagttgcaggttccttcatggtggacttggagatgctgatgttggtggtgctgctgctgcaatggttggctctcccagcaagattgagatgatggagcagtgccatgagctcttaagatccaaatcttttcagcaacaaagattggctgctgcttctcaactcatggcctcttccatttttccgtactccccaaagagcatgaatttcctgttgcagcagcaacagaatgatactcaaagagcggcagctgcagctctgatgatgagtgaggatttgcataaatttggacgatcaaggcttgaaagaaatgatttttctttgaacagtcctgttatggtaaacccagcttccaggcagatctacttgactttcccagcagatagcactttcagagaggaagatgtttcaaactacttcagcatttatggcccagtgcaagacgtgaggatcccataccagcagaagcgaatgtttggctttgttacctttgtttatccagagactgtgaagcttattctatccaaaggaaatcctcattttgtgtgtgatgctcgagtgcttgttaagccttacaaggagaagggcaaagtcccagacaagaagcagcagcagcaggtagatagaggagatttttcaccatgtggtactcctactggattggatgctagagaccaatttgatcttcaacttggtggcagaatgctctacaatactcaagacatgctgtggaggaggaagctggaggagcaagctgatttgcagcaagctcttgagctgcaaagtaggaggctaatgggtctgcaacttcttgacatcaagaagcatcaccagcgtgcactctccactggaagcccaattccttcccccactcactctcctaacatgttcaaccaaaatattgttccttcttttcacatcaattcagaatccccaaaggagagtggttcaacttctgctccagctagtactgcatcagtttctgctggtcaacagccggtcaacatttctgttggcaaggaagtggttgtcaatggcgagaatggatataaggaaggcaatggcaagcagagctctagtcatgacgattgtgatttgcaagaatgtttggagcataatctccctgatagcccttttgcttccccaacaaaagctgctgttcctggagacttcatggctcccttctccaatggacccaatgtagccattgatactgatgcctcagctgcatctgtcaacttcaaatttggcactagcacattgcttcctgcagcatcccctcttgacatgggaactttcaaatcctataactgccaaataccaaggttctcttctggtcatggaactattgggatgttcactggcaccggtggaccgattggcatttag

SEQ ID NO: 71725 - DNA, 105 bp, Glycine max
  Peptide Sequence Number=SeqID_188503
atggcaaagcgtttcgtttggaggactgataagcctcaagctgatctgcctcagacaccaaactctcgttacttaaggtttagtttctctgtcccagccggttaa

SEQ ID NO: 71726 - DNA, 237 bp, Glycine max
  Peptide Sequence Number=SeqID_188504
atgagacttgagatcaaggaggtcaagctcgtcaaagagatggtggcattgttctccactgatactaaggtcagcggttactgttgtggccgatggcgctatagtcagtcacaaaaagcatatggagaaaaagaaaaagttgacgcttcttatggtataatgctaaaagcatacatggcaagtggccaaaatggccataggccacaatctcctccattcactctcaaaagggcttag

SEQ ID NO: 71727 - DNA, 180 bp, Glycine max
  Peptide Sequence Number=SeqID_188505
atgggggcattaaaaccgtgtcccaatcaaggtttccatcagcacaaattccaatacatcatgcttgaagcatcaaggcacaatcagcaccgcctcaaaataaaagaatttttcatgtggaataattctcaaacagcagcagctcatattggttggaaagaggatgttgcccatgagtaa

SEQ ID NO: 71728 - DNA, 1527 bp, Glycine max
  Peptide Sequence Number=SeqID_188506
atgaagaaaatccagcttcgcagtgcaagcacgacactatttttaatgaggagattgggatatactgcagatggtgtggtggattctgaaagatgttgtagaagggtgtcatctggtggagggaacacctcacagtttgatggggatctaatgaatctggtgatgactcagaagcagttcggtctcacaatgaagagggttgacccatgtagtcaaggtgggtgcattgtttctcatgctcctggaacaggaaagacaacgctgaccatggtgtttcttcagacatatttgcaattgtttccaaaatgtctacctattatcattgctcctgccaacatattgcttacatgggaagatgagttacggaagtcgaacattggaattccattccataacttgaacaattctgaattatcgagagaagagaaactcattaatgaagttgactggtctggcaatcaaaagcagaataaggatgccatacgtatggtgaagttgttttcatggtacaaagagaagagcattctattaatcagctacaatttgtatgagaagttagctggggccacatctgaaggtgatgggaaaaaagagaagaaaaatagcaagatgaaaaaaaaaaggagaaacgtgcaaggccaagggagtacattgaaagtggaatgggaaaggttctgtgtgactatcctggaaaggaaagatgtgagctgggattgggaacctgattcatctggagatacagctgatgagaaaataaaccagctaaaattgctgatgaatccctttgttcatgttcacaaaggtaacattcttcagaagaaccttcctgggttgagagattgtgtgctggttttaaagccagacattttgcagcaagaaactctagagagcattgaatgttctcagattgcactgaactttgaacacaagttggcctgggtctctgtccatccatccctattcctcaactgctctctgtcaaaaaaagaagaatctgttgttcacaaggataagttggaaaagcttagattgaacccttatggaggggaccaacttgagtcagccatcaactggtctgtagggacggaagtgctgtatatgtatggcaagcttgaccaaaagcaaaaacagtccctcattcaatgtttcaatgattcaaatagccaagcaaaggtgttgcttgcttctgtaaaagcatcttctgatggcattaacttaattggagcttcaagggtcatgcttcttgatgttgttaggaatccctcagtggaaaggcaagctatttgtcgagcatatagacttggacaaaagagggttgttttcacatatcatcttcttgcacagggcacccccgaatgcacaaagtattgtaaacaagcagaaaagaaccggttatctgaacttgttttctcaaatagaaatgctgaaagtgataagctcaagagtagtggagtaaggtttgaggatagagttcttgatctcatggttcagcataaaaaactcaaggatatgtttggtgaatgtctg

SEQ ID NO: 71729 - DNA, 1461 bp, Glycine max
  Peptide Sequence Number=SeqID_188507
atgacacatagtagcagaaatgaaggccataggaaagatatcagggccaacagctctcaccggtttaatcatatattcgagagccatgatctccatggtcttcctgggctacctaggcgagatggagctcgccggaggctccctctcgatcgggttcgccaacatcaccggctactccgtgatctcgggcctggccatgggaatggaacccatttgcgggcaagcctacggtgccaaacaattgaagacactgggcctaaccctccagagaaccgtcctccttctcctctcaagctccctccccatttccctgacgaccatgagatctccagcacagcacagaccttcatcctcttctctatcccagacctcttcctcctctccctcctccaccctctgagaatctacctcagaacacaaagcatcacattacccctaacctactgctccgccgtctccgtcctcctccacgtccctctcaactttttattagtggtccacttaaaaatgggtgtgtctggcgtcgcaatagcgatggtgtggaccaatctaaacctcttcctcttcctttcttcctttatttacttctccggggtttataaggactcctgggttccccctagcactgactgcctcaggggatggtcttccttacttgcactttctgttccaacctgcgtctccgtttgtctagaatggtggtggtacgaactcatgatcattctctgtggactccttctgaacccaaaagccaccattgcctccatgggtatcctcattcaaaccacttccttggtctacgtcttcccttcttctctcagcctcgccgtctccaccagagtcgggaatgagttaggcgccaaccgccccgccaaagcacgcatttccatgatagtctcactcgcctgtgctgttgccttgggcgtcaccgccatgctcttcaccactttaatgagacaccgctgggggagattcttcacctctgaccaacaaattctccaccttacgtccattgctttgcccattgttggcctctgcgagcttggaaactgcccccagaccacgggctgcggcgtcttgagaggcagcgccaggcccaccgtcggtgctaatatcaatttgggctccttttatttggttggcatgcctgtcgcggttcttctcgggtttgttgggaaaatgggctttcctgggctctggcttgggttgcttgcggcccaaggctcatgtgctgctctcatgatattcgttctctgcaccactgactggaacgcccaagtgcaaagggccaacgagcttactaatgctaattctgctccttccaaattacctactacggagtgtaacaatgttcgtcttccagagattcttgtcatggacacggaggatcatcatgatgagattattaccaagacaccttctcttgaaacagaccctctcattatacacacttccaaatga

SEQ ID NO: 71730 - DNA, 663 bp, Glycine max
  Peptide Sequence Number=SeqID_188508
atgtcaatgttcgcaagcacgccccaagagaatgtcgagaaatcgttcttagcgttctacgaggggtggcttgcgcgtcaagagaatttgctgaaacagcttctcagcgtggcgcgcaatggtcctctctcactaccagcaatttatggaagagaaatccaacgtggcaaacgacgacgtttaccttctcttttctccaccctggctttccgcgtacgaaagggctctcctctggattggggactacaagccctctctaattcaccgtttagtagacggcgccgtgaaggggttaacggcggagcagagggggagggtggagagaacgagggacaagacgaagagggcggagagggagctgacggaggcagtagcttcagttcaagagagcatggcgagtcggcggatgctggaactgacgagggtggtggtgggtatcttgagtccgccgcggacggtggcgttgctggcggcgacgatgcactttcagatgagggtcaggatgtggggtttgcaaagagccgagaattaacatcaaagcttaatccaattcaaagtttcgaaacaatcacatacagttacgatgagtggcgaggtgaggctctgttagtgttgcttgcaacttgctcacacgatatttcatacgacaggatgaatagttga

SEQ ID NO: 71731 - DNA, 576 bp, Glycine max
  Peptide Sequence Number=SeqID_188509
atggctattggtaatattcttggatatgcaactggatcatacagtggttggtacaagtctgctttctttctcgacattattttcattgctatcaccacatatataagcattgtggcagctaaagaagtgcctctaagttcaattggagcacaccctgttgaagaagcagcagcaggagaagctttcctgtgggagctatttgggacattcagatatttttcgacccctgtatggacaatactgtctgttactgctctaacatggattggaatgggggcacttggcttactgcttaattcagttgttcttggagtaacatcagtactgatggagaggctatgcaggaagcggggacctgggattgtcaatgggagtcctaaatcttgcaattgtgttcccacagtggaccatgggatcagctatttggtggaggaaactccagcctttggtgtggcagctgttgcagcccttgccagtggactcatagctgtcttgtttattccccgacctggtggtcaaaagccaagcctagaagcccagtatgaggtattatgttctttctgcatttggcactga

SEQ ID NO: 71732 - DNA, 1030 bp, Glycine max
  Peptide Sequence Number=SeqID_188510
gacccgtagcaagcggaaaattgaatctgtgtctggagcttctttgaagcgtgaaagggtatctgaacgaggttttgattgtttgggagggcatgcaggtgaccctattgaaatcagtgacagtgaggctgaagagggcattaggcattctgagaagaagaggtttctggttcaaaaggaaagcaagcgtgaggagggtaaaggctgtcctgtatttgttgataaagttgaaaactttggcaatgatgactattcttgtgtacctgaaaaccggataagtttgccggatgagaaggagcattgcgtggataaaagtgaggattgtgcgaccactggtgaagattttcaggttgattatggtgagagtgattgctactcgagcagtgaggacagtgattcttcttatgatgatgatgatgatgctgatgaggatgagagagggggatacagcaagaccacgacctctagtaaatctgagatttataagcaggaagcaatgaatgctgcacataaagcaaagagagtagaaagtgtcaatgctgatgcgcaagtctttggggagcactggaaaagttcaggttgctctatgaagagaagagatagaggtcatcaaagtgtgtcattgccgaaaaagacagaatattcaactgtgatcaagaagaatcttgatgaccatgaaggaaaagagcatcatcgcgtcaaaggaacaggcaggaggagtgtttctcttttgccaaaaagccaagagaagataggagattcagctaaagctgcaagggtggtggatgatgaaactggtgacagagatgagctgcatgaagttctaaggatgccatctagaacaaaaaaccgatgttttaaattatttaatgaattcttttggggcaagaatgattctgttaaagatgattcaaattggttggaagaaaaggatgatgatgttggtcagggtcagactcagccattagcttctagggaaacagattctttgaattggaactttatgaagaaagaacctagtagtgtttaa

SEQ ID NO: 71733 - DNA, 156 bp, Glycine max
  Peptide Sequence Number=SeqID_188511
atggcttctaagggtaagactaggtggtcgcttacttggtttttcagccaaagcaataacaacaaggaaccttgccgaggaagtatgactaatgaagtgggtcaaggtcgcaggaaccaggcgagggataatccacgttgccacaattatctctga

SEQ ID NO: 71734 - DNA, 1761 bp, Glycine max
  Peptide Sequence Number=SeqID_188512
atgtcgtttcggtgggagaacgagaaccctaaccctaactctccgttgaagaaacgttggtccctaaaccaaatggtaatggcgatgaagctccagtccctctcttgttctcctggcatcaccgacaaaagcaaccctattctctccccattcccacttcctatcaccgatcgaacccttctcttatctgacgagcttctcctcaaaatcattgcattagtctccgattcctccactcagcgaaactccaactctctggtctgcaagcgctggctcaacctccaaggccgcctcgtccgctccctcagaatctccgactggaacttcctcctctccggcagactcatccaccgcttccccaatctcaaccacgtcgacctgctctccgccgccttaatttcccccaaatattccgacgttctcttaacaaaccgagtcatatccatgcatcttagttcagactctttccctaattggtgcttctgcgaggacaacatgctccccttccaagtcatcgacaacggcctcacctccctcgccgccggctgccctaatctgcgccgcctccatgtcatcggcgccaccgagatcggcctcctcaccgttgccgaggagtgctccactttgcaggtactcgaactgcagcgctgcagcgacaacattctccgcgggatcgccgcgtgtgggaatctgcagattctgaagctcgttgggcacgttgatgggttctacaattcggtggtgtctgatattgggttgactattcttgctcaggggtgcaagaggctcgtaaagctggagcttagtggctgtgaagggagctttgatgggattaaggctattgggaagtgttgccaaatgctggaggagttgaccttctctgatcataggatgggtgatgggtggctcgctgcgatttccttctgcgagaatttgaagactttgaggtttcagtcttgcaagaggattgatcccaatccgggtatggaggagtatttgggctgttgccccgcgcttgaccgattgcatttgcagaaatgtcagttgcgggataagaagagcgttgccgctttgttttctgtgtgtagggttgttagggagattgttattcaggactgctggggattggataatagcatcttcagttttgcaatgatttgcaggcgggtaaagttgttatacgtagaagggtgctcattgctaacaacagaaggtttggagtgtgtgattcattcgtggaaggagcttcagagcctcagagtagtgacatgtaagaatataaaggacagtgagatctctcctgcgcttgcaaccttgtttaccactctcaaggagttgagatggagcccagataccaaatcacttcttccatccggtgttatgggaaagaaagaagagaagaaagatccaccgatgaagaaaaataaagagaaagagaaagagaagtgcgtggctgtgacaagccctgtgagtggcgaagacagcgatgataagcaacgccctgcctttccctcggtcagattctcttcccgcaacgcttcttccaaatacgatttcgtcaaggtgaaggtgtggttgggtgataatgcggatcactactacgttctctccagatttttgctcagcagaatgctaacggtaaccaagattccaaaccacgtagctatcaaaattgctctcgaattgaagaagctgctcacagataacagccttctagatgtgtatgttgctttgcatctcttcctttcccctttttcctga

SEQ ID NO: 71735 - DNA, 948 bp, Glycine max
  Peptide Sequence Number=SeqID_188513
atgaggagcaatcatgtgcgtttgaactgcggcattacaatgcctcttattggattaggcacttattccttcccaaatgataggaaggcaacagaacttgccgtccacaatgcccttgagatgggttataggcattttgacacagcaaaaatatatggttctgagccagcactgggcaaagccttaaatgaagcaatctgcgagggagaaatagagagagaaggcattttcttaacatccaaactgtgggggagtgatcaccatgatcctgtttctgcattgaaacaaactcttgagaatctgggcatggagtacctagacatgtacctagtgcattggcctgtcaagttgaagccatgggttaactaccctgtacctaatgaagatgactttgaaaagttggaccttgagaccacatgggcagggatggagaaatgcctagaaatggggttatgtaggtgcattggggttagcaatttctctagcaagaagattgagtgcctattggattatgcttctacacctccagctgtaaatcaggtggaaatgcatcccatgtggaggcaaggaaggctgagaaagacatgtggggaccaaaagatccatgtaagtgcttattcgccacttggtgggccagggaatgcatggggatcaacagctgtggttcatcactctataatccgatcgattgccttcaaacacaaagcaactccagcacaggttgcattgaaatggggactatcaaagggctcaagtgtgattgtgaaaagcttcgatcaagaaagaatgaaggaaaatatgggatcgtttgatctgagattggataacgaagatatattggagattgagaaattggaggaaatgaagattatgaggggagaatttcacgttaatgaaaccacaagtccctacagaacaatcgaagaactttgggatgatgaaatttga

SEQ ID NO: 71736 - DNA, 360 bp, Glycine max
  Peptide Sequence Number=SeqID_188514
atggccattaaatctgagcatgaagatgatttcaagaagtcaaggttagaagaaaaacaaatccttgtgacaatggaataccgttacaagatgatatatggtgaaagacatacttccaagaaagctggaatagtaaaagggggaaacaggccaaagaaacaagagctgttggtgtatgaaagaaagaaatgtgtaacagcaactgagagggaattagaagagagagaagaggggcataacagaatggacagctggcagggggaggttggaggggaggatacgggaatcaagcagcaagaggagagaagggagtacattggagggagaggaaattggtcgggagcatcattcatctggaga

SEQ ID NO: 71737 - DNA, 825 bp, Glycine max
  Peptide Sequence Number=SeqID_188515
atggtttatgaattgttgcgcacatcaacagatgcaccattggcatcaactccagtatgggcaagagacttcagttcatcagaggagttaataactgaattttgcagagaatgcagggttgttcgcaaaggtttggccggtgatctgaaaaaggcaatgaaagatgggaagccaattataatcgaggggatacatttggatccaagcatttatttagtagatgatgacaataaatcaccttctggtgtacattcagaaaataaagagataaatccagcatttatgacattggatgataatgctactgcacaaataaaagacagtcatgtgagtagcagtgatgagagtaatggtggctccaggattttgagctctgatgaaggagtatctgcggaccaggttgatgcagtatcaaattctatggcatccattggcctagctgaaagcatccctgaacataaagttgcttctcttagggagctggagacagacaaaactactattagtaaggagaagtcaggtcccaaaccaataattgtgcctattgttttgaagatggctgaatttgatcataaggcattacttgaggagtggatctctgctcgcacatttaatgacaaatgtcctgacctggataatgagaagcttatagccaacttgaaaaccatacaggattatctgtgctcgttcacatcacaggggttgactgtggtcaatgtatcggcaacaacatttcctcaaacattggattggctgcatggttaccttcttcagtgcatcgagcaaggtattgaagaaaatgttacaccagtagctccagcatag

SEQ ID NO: 71738 - DNA, 921 bp, Glycine max
  Peptide Sequence Number=SeqID_188516
atggagaagaacaacagtaaagtctgcaaaatctgcagtaagtgcttttccagtggaaaagccatgggaggacacatgagatctcactttgccaagttgccaattccaccaaagcccaaaaccaagaatcaagcactagacaactcgaccgagttgacccatcttccaactcaatctgcttccccattgacttcttatcctcaaaagcaaccatcgcagaatttccgatctttgaagcacaacgtttttgccttcttggcaaactcaaatagagaaaatgaatccaggtcttaccctaaaaaccctacccgcaaaagatccaaatgccaccgcagatttattccagcggctgaaatgaatgctgaagctgaaccaaaacaggtgagttcgaaacttgactctcttattgcagaagaagctgcttggactctattaatgctttcccgggataaatggccggaaagcaaagagaccaagaagcaaaaaatgaagggaaaagacggagaaaatggttgcaatgacttgcttgttcaaactcaatctcgagccaagttccagtgcaagaggtgcgggaaaacatttcaatcttatcaagctcttggtgggcacaaagcaaaccataagaaaaatgagagtatatgccaagaaggtggtgactctaacgatgatggaagtgacaaaaatagtgttattgtagatgagaaagtgtttgagtgcccatactgctccaaagtgttcaagtctgcacgagcactcggtggacacaaaaaggtacacttctccaagactataattgctaatgctcaaactactgcaaatgagtttggtggcaggttggtagtagatctcaattttccagctcctagagaagatgaagaggttagccatattgaatttttagcagcgttcggtgaagtatga

SEQ ID NO: 71739 - DNA, 255 bp, Glycine max
  Peptide Sequence Number=SeqID_188517
atgaagggaatcctaaaacgaagcgagcgttatggtaagggaaaggcaagtagagttaagttcaaaggttctgataggcacatgtctgaagtgtggagtggggctaacaaaaacattggcagaggcagaggccacgccacagttaacagcagtagttgggacccaactggggcattggtttggtggagagtgctctcgtgggcaccacaacccctttcatctgtctcccttatacccctcacactttctccttaa

SEQ ID NO: 71740 - DNA, 3093 bp, Glycine max
  Peptide Sequence Number=SeqID_188518
atgaaacattttcttctctttctcatcacattctccttcctctgccaaacacacctactcatacttctctctgccacaacaaccctgcccctccaactcgttgctctcctctccataaaatcatccctcctagaccctctcaataacctccatgactgggacccctccccctcccccaccttctccaactccaatccccaacaccccatatggtgttcctggagagccatcacatgccaccccaaaacatcacaaatcaccaccctagacctctcccacctcaatctctccggcactatctccccccaaatccgccacctttccaccttaaaccaccttaacctcagtggaaatgacttcaccgggagtttccaatacgccattttcgaactaacagaactgagaacactagacatcagccacaactccttcaattcaacctttccaccgggtatatcaaaactcaaattcctcaggcacttcaacgcctacagcaacagcttcaccggccctctcccccaagagttaaccacccttcgtttcatcgaacaactgaacctcggcggaagctacttcagcgacgggattccaccaagctatggcactttcccgagactcaagtttctagacttagccggtaacgccttcgaaggtccactcccaccccaactaggccacttggctgaactagaacacttggaaattggatacaacaatttctcaggaacactaccctcagaactgggattgcttcctaacctcaaatacttggacatctcaagcactaacatttcagggaacgtgattccggagctgggaaacctcaccaagctggagacacttctgctgttcaagaacaggttaacaggggaaatcccatcaaccttaggaaaattgaagtcacttaaaggccttgatctgtcagacaacgaactcactgggccaatccccactcaagtcaccatgctaaccgagctaaccatgctcaacctaatgaacaacaacctcacaggggaaataccacaggggattggagaactacctaagctagacactctgttcctcttcaacaactcactcactggaacactccctcgacaacttggctccaacgggttactgctgaaactagatgtttccacaaactcactcgaaggtccaatccctgaaaatgtgtgcaaaggtaacaagctcgtgagactcatactcttcctcaacagattcaccggttctctcccacattccctcgccaactgcacctcactcgctagggttcgcatccaaaacaattttctcaacggttcaatcccccaaggcctcacgctcctccctaacctaacatttctagacatcagcaccaacaacttccgtggtcaaattccggaacgcttaggtaatttgcagtacttcaacatgtccggaaactccttcggaacctccttaccggcctctatttggaatgctactgatcttgcgatcttctctgctgcttcctcgaacatcactggtcaaattcctgatttcatagggtgtcaggcattgtataagctcgaactgcagggaaattccatcaacggtacgattccgtgggacattggacactgccagaagctcattttactgaatctgagtcgaaactcactcaccggaatcattccctgggaaatctccattctcccttccatcaccgacgttgatctctctcacaattccctcaccggaaccattccttcgaacttcaacaactgctccacgctcgagaatttcaacgttagcttcaactccctcatcggtccaattccttcctccggcattttcccgaacctacatccttcctcctacgccggcaaccaggggctctgcggcggcgtgttggccaaaccctgcgccgccgacgccctcgccgcctccgataaccaggtcgacgtccaccgccagcagccgaagagaaccgccggtgcaatagtctggatcgtcgcggcggcgttcggtatcggcctcttcgtgctcgtcgccggcacgcgctgctttcacgcgaactacaaccacaggttcggcgacgaggtagggccgtggaagttaacggcgttccagcgtttgaatttcacggcagaggacgtgctggagtgtttgtcgttgtccgataagatactggggatgggatccacgggaacggtttacagagcagaaatgccaggtggcgagatcatagcggttaagaagctgtgggggaagcagaaggagaataatatcagacggaggagaggggttctggctgaggtggaggtgttgggaaacgtgaggcacaggaatatcgtgaggttgttagggtgctgcagcaacaatgagtgcaccatgctgctttacgagtacatgcccaatggcaatttggatgatttgttgcatgccaaaaataaaggagataatttagttgctgattggttcaataggtacaagatcgccttgggtgtggctcagggaatttgttatctccaccatgactgtgatccggtaatcgtacaccgtgatctcaaacctagtaacatattattggacgctgagatgaaggccagagtggcagattttggtgttgccaagttgattcagaccgatgagtccatgtctgtcattgccggttcctatggctacattgctccagaatatgcttacacccttcaagtcgatgagaagagtgacatttacagctacggagtggtgttgatggagatccttagcggaaaacgttcggtggatgcagaatttggcgatgggaacagcattgttgattgggttaggtctaagataaagtcaaaagatggcattaatgacatattggacaagaatgcaggggcagggtgcacctcagtgagagaagagatgatacaaatgcttaggattgcattgctttgcaccagtagaaacccagcggataggccttctatgagggatgttgtgttgatgctgcaagaggccaagccaaagaggaaattgcttgatagtgttattgtgggtcgatgtgctggggacaatgtggttggtggtggtgggggtgacattcctttgccacaaaagccaaccgcggatcaatgctaa

SEQ ID NO: 71741 - DNA, 180 bp, Glycine max
  Peptide Sequence Number=SeqID_188519
atgtctgacatggccctccctaaagctagccctacatttacgccaatgtgcagcaaagctcccaacccaaagtcttcgtttacggccaatgattttcgagggagctcttatggaatgcacatagatatagattcatgcatccaccgttcttgccttccatttattccacccatcccatag

SEQ ID NO: 71742 - DNA, 960 bp, Glycine max
  Peptide Sequence Number=SeqID_188520
atgcaggctgaagaatctaacatggaggagaaactgaaggggcttaaagatgaggttcatgcagctgagtcaaagctgaagagattgcaagaagaagaagctttgttactggataacatacataggcaaaaggatgaaatccgaaagatagctgataagattactgtttttggaggaaataaagtgttagatttgttacgtataattgagaactaccaccaaaggtttaagatgcctccaattggtcccatcggtgcccatctgaagcttcttcatggtaataaatgggcacttgccgtagaacatgctattgggagattgctcaattcttttatagtgactgatcatgcggattgtcgtcttctgaaacaatgtgcgaaggaagcacactttggtcaccttcaaattattgtttatgatttttcaatcccaaggttgacgataccacagcacatgcttcctgatacagaacatccatcaattctttctgtcttacaatgcgagaatcaaactgtgattaatgtcttagtggatcatggaaatgttgagagacaagtgcttgttaaggattatgaagttgggaaagtggttgtctttgaccgaaggattcgaaatttgaaggaggcctatacagaagatggatgtagaatgatatgttctattgggaaaaatccaagtcctacattggctagagatagtgcgaagatagagtatataagtggagggaaaccctcaccctatgagttagcttttggggttgagttaggcctaaacccacattctaagatggtattagagcctatcctagatccattcaaagggtcacccaccatgttatccacacgccaagctcaaaagtgcttggacgtgagggggtgtattgaaaaaaatccaagtccttcattgactagcgatagtaccaagatagagtatataagtggagggcaaccctcaccctaa

SEQ ID NO: 71743 - DNA, 442 bp, Glycine max
  Peptide Sequence Number=SeqID_188521
atgtgccccgccaaatttcgtgacaaacaacctacggcaaaggcatactttgaaaaatccatgaacatggaccatgacggaaggtgtggtgaagggtttgccttgaaaccttcccgtttttccatgtgcccggtggtcggttttggcccgtggctaggtcttggcaagccgttggttgaaattttgccccccggtcaacttcgtggtttttgcccgttgttggcttggctagggtcggcggtgctggggtttgttggtgatttggaggggacgggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 71744 - DNA, 150 bp, Glycine max
  Peptide Sequence Number=SeqID_188522
atggagagtagaagtctccccaaagacaaacagctgttcttattcagtcagttttcaatgtacataatagaattagaaaagcataagggatcaccatttcaggtccatccgcaagcatgctcgtcgaaagccctcccggctaagaaataa

SEQ ID NO: 71745 - DNA, 318 bp, Glycine max
  Peptide Sequence Number=SeqID_188523
atggctgccttggcgttatgtcttgccacgtgctgctttgggacttttaagcacaaacacgaccccattttggcattgcaccttcatttccagatacgtttcaaagcagagttaccaaagaacattatccattccgtaagacatccagtaacaaaacttgcagaggaaaataacaagactagaaatccaacactaatcaagccacaaattccttcccgacatcagaagccaattaaagtttgtagtaaagtgaccgcacccaacggaaccaatatcgacaccgcgcaccaaacactagccaacagaggaattaggtga

SEQ ID NO: 71746 - DNA, 261 bp, Glycine max
  Peptide Sequence Number=SeqID_188524
atgtcttaccgtaacgaaacgcagaagcacgatgtaattggatttcgtggtttagagaaacgaagatatgagttgggtgaattgctatattctatttcactgaaactgagagtcgatattttaactccacaagccctaacaccgctgcggaagatgaaggccaagattcattctgggacaaccataacattagatagtcgtcttacgaatggatatgtcaattatgtacacatcggaaaggagatttgttcaacattctga

SEQ ID NO: 71747 - DNA, 1992 bp, Glycine max
  Peptide Sequence Number=SeqID_188525
atgaaggcaactggaacggccattctgtggttcaagcacgatcttcgaaccgacgatcaccctgcgctcctcgcagcctccgcatttccatcactcgttcctatttacgtcttcgatcaccgcattctttcgcgtttttccgatgagacgctggaactggttctgcttgccgtggaagatttgaggaagtcgttgaaggatcgcggttccgatttggtgatcagattcggcaatgcggaaaacgtcattcagcaacttgcaacagaggttgttacttcgacggaacaggtcaaagccacttgtgtatttgcggaacaagaggtggagtatgagctacgtttcatcatagatgtggtcaagcagcgtttgaaatccgtcagtgttccacaagggagtccaaggattgaattatggcgaactccattttatgatataaaggatctggaaaatcttcctgcatcatatgatgagtttaagaaacttcgactctctgtgactacaccacttcagttgtcagtgtcaaagttacctggtgcagaaatagaactggactggggtgttcttccttcgtatgacgacataaagggatttttgactagcaaccaacagaaatcaggagagaaatggagtttaatgaaggagacatcagctgaaaccattttacgcagaaaagtattgaaatctggcaataacattgaaaggagttctaggtttgggctaacgcaatcaagggaacgcaatggatctgtttttgtgacacaaaaaggaaatattgtaggaggtagtacaaacaatgtactgaatgcattggctgcatatctgagatatttggagggaacagctcgtgatgactggcaggaggtacatgaaaaagtgcgtgcttctgaaagtcggaatggagcatcatttattggactttttggccctgccctatctcttggcattatatctagaagaaaagtacattatgaagctatcaaatatgagaaagaacgaaatgcaggtttcttatcaccctttggatattcagctgccacaattgcagcagcagttgatgctgtgtgctcaatggagtggtattggcttctggctttgaaaaatcagaaaaataatcacggaatacactcaacacggatatggaaatggaaaggatttcttatccagtattcagttgctggtgaagatggtcctgctattcttcttgtgcatggttttggtgccttttgggagcattaccgtgacaacatacatggtttagctgaatctggaaatcgagtttgggccattactattttaggatttggcaaatcagaaaagccaaatgttgtatatactgaactcttgtgggctgaactattgagagattttattgttgacattgtgggtgaaccagttcaccttgttggcaactcaattggcggttatcttgttgctattgttgctcgtgtttggagtgatttgatcaaatccattgtcttgatcaacagtgcaggcaatgtcatcccaagatattcattcataccattgtctacaattcaggatagacaaacttcaggggcttcctggttgggttctcgcattcttgtattctacttgaggctaagaactcaagaattacttaagaaatgttatccaactagggttgaaagagcagatgattttctcataagtgagatgctaagagcatcatatgatcctggcgtgcttgtggtgttggaaagcatcttcagttttaatctttccatacctcttaactttcttcttgaagatgtcaaggaaaaggtcctaattatacaggggatgaaagatccaatttcagactccaattcgaaggtggccatgctaaaagaacattgtgatggagttatgattaaggagttagatgctggtcattgtccacacgatgaggtgccagaacgagtgaatactatcatttgtgagtggatacttggtgtggaaagtaacaacattttggcagagtgtgcagtgtaa

SEQ ID NO: 71748 - DNA, 1137 bp, Glycine max
  Peptide Sequence Number=SeqID_188526
atgaagccgccgccgctgccgcgcgccgccgcgaacaacgcgcagcagctgctccgggaagaacgcgtgctgcggaatcgcgtggagagagagggtttcgtggtcgatccggtgagtttaagcgccgagagggagtggcagagcgagaggttcgatttcgcgccgaagaagccgctgattgtggtgacgccgacgtacgagcgcacgtttcaggcgtatttcctgaatcggctggggcaggtgctgcggctggtgccgccgccggtggtgtggattgtggtggagatgaaggcggcgtcgatggagacagcggaggtgctgaggaagacgggcgtgatgtataggcatttggtgtgcaataagaatttgacggatgtgaaggacagaggggttcatcagaggaacacagcgttggaacacattgagcatcataggcttgatggaattgtttactttgcggatgatgataatgtgtattctctcgagttgtttgacgccttgagagatatcaggctcaatatatataaactttgcaacaagcattttataagaaaagaactaggaagccgctttggcacttggcctgttgccatgcttgtgccaagcaagaacaaggccattttggagggtcctgtatgcaatgcaagccaagtgattggatggcatacaaatgagaaaagtaaaagacttcgtagatttcatgttgatatgtctggatttgcattcaacagcacaatcttgtgggatccaaaacgatggcaacgcccttcttcaaatcccatacgacagttagacacagtgaaggagggttttcaagagaccacctttatagaacaattggtggaagatgaaagtcaaatggaaggttcacctcctggttgttcaaaaatattgaattggcatctccatttgactgcccataatatagtttacccaaaaggttgggtgcttcagaaaaacctagatgctgtcatacctgtcaaatggacgcatgagatagccagcattggcactaatgcattgtgtcgccgggcaagacaggaacaggaacaggacaaaaaagcaaagataaaatttgagacagcaagacataatggccaaatcgatagatgctatttcaactgccatgctaaatga

SEQ ID NO: 71749 - DNA, 492 bp, Glycine max
  Peptide Sequence Number=SeqID_188527
atgtggtatgatactgaccaagtgattgtaatttggaaaaccaaacagtttcaacaatatggtaaagttgagaggtggctagaagatatttgggtgtggatgcttaagttcaaggatgccgtttttgggattgctctggagtcatctgctgagattttaggttgcgcaccactgataatgcgtataactaatcaagttctaagtttctatcaatccacgcctggttctgttggaataaagttgctggcactgaaattcttggaaatgtttgtattactcttttcatctgacttcaatgatgctgagaaattagccgcaaaaggaattaggcaagctgttaatgtctcatggttggttggtcaccctcaccctgttcttgatccagtggtgctcatgtcagatgcaaataggactattggcattctattaaatttattgcagtctgttggcagtcttcctggttgcttgactattgcagttgtaaattggtga

SEQ ID NO: 71750 - DNA, 2955 bp, Glycine max
  Peptide Sequence Number=SeqID_188528
atgaatgcgggggatgctgctgatcaggtcattcggcaagtcgacaaaatgattaaaaatggtgatcgttctacccgcgatgcacgggttagcaaggatgatcaaccatcagctcagtcacctgtttcaggggaattatctagaaaaagacctgttcctctagataatgaacaattggccaatggtcatgataccatctctaagcggattcgttctggttctggttctgactctcactctactttaccaactcaaataaatgattctgggcaggatgttaactctgttaatggagtatcagctaatgttcctgtgctggatagcgaactaactgctgtggagcaaatgattgctgtgattggtgctttacttgctgaaggagagagaggtgctgaatctcttgaaattctcatttcaaagattcatcctgatctgttggctgatattgtcataactaatatgaagcacttgcctaatactcccccaccactagcgaggattgggaatttaccagtaacacgacaattaagctcccaagtcagtcaatcacaggttatagcagcttctgttccaataaattctgtccagtccttgtctggtactgcccaagcttcattcccttcaacttcaaccactgtcactgctactgctaccacttcattgccatctgacacctccagcttcagtaaccagcctgctgattctaaacgtgatccacgacgggatccccggcgcctggatccacgacgtgtagtggtaactcctggagaagcaactgcatcaattgcagatgatactggggccacaaaattagtgtttgatgaacctgtgtcttccattaagcctgtttcacttcctgttgggactgctgatgacaatactccatcagatctgacggtcaaaataataaatgatgatattgtctctgaaggttccccagtttcaggacctgatcggctaactccaaaaacagaggatctggaaaggcttggagatattcatcagattacagaagcagatacttccttggatctcccactttcttctacttatttaagagatgaggatccaagtacagtgaagttgccagatgatactgaaacaattgggacagattcatcaattttcgagtttgatcagttttctcttgatgttcaagttgaatctacattggaagacacctgtctggagttaccacaacttccaccttatattgaactatctaaagaacaggaaagtaaggtgaaaaacatggctgttatgcgtataattgattcatacaaacatttgcatgggaccgattgtcagcagttttccatgccactacttgctcgactagttgcacaggggcatgaacttgtactgcatgttttgtatcatctgcactccctcatgatagtggattcagtgggaaatgcttcatcttctgctgttttatatgaaaaatttctcctgggagtggccaaaactttgttggattcttttccagcttcagacaagtcttttagtagacttcttggtgaagtcccacttttgccagagtcatccttgaagattttgaacgatctctgctattctgatgttattggtcatgatggaaaaattatccgtgacattgaacgtgtgactcaaggcctaggtgctatctggagtttaattttggggcgtccgcaaaatcgtcaagcctgcttaggaatagcattgaagtgtgctgttcacccacaggatgatattcgagcaaaagctattcggctggtgacaaacaagctctttcagcttaattacatatcaggagatgttgaaaaatttgcaacaaaaatgctgctttctgcggtagagcatgaagtttcagatacaggtcttttgcaatctggacatactgaacaaagagccgaggcagagcttccccagttaatgggatgtggcttggtcattgttgtgcctgataaactgattattggtagtgtatacttaattttacagattgaaagtcatgaaataagtacttcacaggtagaatccacaatttctgaaattgactctgctatagttgctaaaccatcaattcaaagcgttccatctatatcattttctgaagctcaacgcctcatttctttgttttttgctttatgtacaaagaaatccggtcttcttcagattgtatttagcgtgtatgggcaagccccgaaaactgtaaaacaggcttttcatcgccacattcctattgttgtgagggcgttagggcaatcttattctgaattgctccgtatcatatctgatccaccacaaggaagtgaaaatcttctgacattggtactgcaaatattgacacaagacacgacgccatcttctgatttgatatctaccgttaaacgtttgtatgaaactaaatttaaggatgttacaattcttgttccgttactgtcttcgctttccaaacaagaggttttaccaatattccctcggcttgttgatcttccattggaaaagtttcaaagagcacttgctcacatactacagggttcggctcatacgggtccagctttaacacctgtagaagtgttggttgcaatccatggaattgttccagagaaggatggccttgcacttaagaaggcatgtctactaccatctacacttatgcttcaaataacagatgcttgctcggcttgttttgagcaacgcacagtgttcacacaacaggttctggcgaaggcattgaaccagatggttgatcaaactccactgccgctacttttcatgagaacagttattcaggcaattgatgcttttcctgcactggttgactttgttatggagatactctcaaaacttgtgtctagacagttgccacctcaacaactggaaagtgcactcaacaggcatgctaatctcagaggtccccttgcttcttatgccagccaaccaactgtaaaatcatcacttagtaggtaa

SEQ ID NO: 71751 - DNA, 201 bp, Glycine max
  Peptide Sequence Number=SeqID_188529
atgtacttgaaggtgcgtgagagattggtagcgtctttatccttcgacatggcagctgcggaaatgaaaatgattcttggatcagatagaacatacgttagatttggcaatgtagacgtatctggtacgttttggagagagagtgaaatacctagcttagcttacccaggacggtggaggatgaagaagcggttccgttga

SEQ ID NO: 71752 - DNA, 2175 bp, Glycine max
  Peptide Sequence Number=SeqID_188530
atggccgtttcaaccactttctccgctcccaaattggaggccctattcctcaaatgctcttcctcctcttcctcaccatcgccttcaagggcatcattcaccacttttccccgccaaaacagaagaaccctcattcagagagggtttattcgctgcgacgctctggcctctgatgcatcatcggttgctccaaataatgccaccgctcttgagcagctcaagatttctgcagctgatagatatacaaaggaaaggagcagcattattgtcattgggctcagtgtgcacactgcacctgtggaaatgcgtgaaaaacttgccattccagaagccgaatggccaagagctattgcagagctgtgtagtcttaatcatattgaagaagcagctattctgagcacctgcaaccgaatggagatatatgttgttgccctgtcccaacatcgtggtgtcaaagaagtcatggaatggatgtcaaaagtaagcgttgagtttctttcacagatgcaccggtttttactttacaacaatgatgccacgcagcatctttttgaagtatcagcaggtcttgactctcttgttttgggggaaggtcaaattcttgctcaggttaagcaagttgtcaaagtgggacaaggagttagtggctttggaagaaacattagtgggctattcaagcatgcaattactgttgggaaaagggttagaactgagactaatattgcttctggggcagtttctgttagctcagctgccgttgagttggcctatatgaagctacttgaagcctcacatgataatgcaaggatgttggttgttggggctggcaagatgggaaagcttgtgatcaaacatttggtggcaaaaagttgcaaaaagatggtggttgtcaatagaactgaggagagagttgctgcaatacgtgaagaactgaaggatattgagattatctacaaacctctttcagaaatgctcacctgtgctggcgaagcagatgtagttttcaccagtactgcttcagaaagcccattattcttgaaacatcatgtcaaggaccttcctcctgcaaatcaagatgttggaggccgtcgctttttcattgatatctctgttccccggaatgtgggttcatgtgtctcagaccttgagtctgtgcgagtatacaatgtcgatgaccttaaagaggttgtggctgccaataaagaggatcgtctaagaaaagcaatggaagcacaggcaatcattgctgaagaatctaagcaatttgaagcttggagggactcgctggaaactgttcctactattaagaaattgagggcttatgctgaaagaatcaggcttgctgagcttgagaagtgcttaggtaagatgggtgatgatataccaaagaaaacacggagagctgtggatgatcttagtcggggtatagttaacaagttgcttcatggtccaatgcaacatttaaggtgtgatgggaacgacagccggactcttagtgagacactggagaacatgcatgctttgaataggatgttcaaccttgagacggaaatatctgttttggaggagaagattcgagcaaagatgcaatggcgatatgaccgtgcagagcctaagtcgctagtcctaatggcgatacgcagaagcagctgggaaccgccagtcaaactggcgagttccatggtacaggcgtgcaggcgcttttgcaggggtgcaggagcttgcttttcagaaaagggagttgcaactgccattggcgagttgcctgcaagttgcaactcccattggcgggttgcacaagaagaaatagccatcaccaatggcagaaaatatattgccttgcaaatttgcgatgacgaagacgttgaaacgatgctagaaagttttaaacaacaacaagaaatgtcagttctagaattgtacatagaaaaggatgtggctggtggttcaatgtttcattctgcaaattcccttacatcatgtggaaattatgtatctaatgattacacacaaccgccaacaaatatgagcaatttaaatcttgacgaagatgatgatcatgatgatgatgattatcttgtgtctaactcatacgttgaagagtcgttagacgaagatgacagtgttgacggtatatcagatacagacaatgaagtccccgacatgattccacca

SEQ ID NO: 71753 - DNA, 1221 bp, Glycine max
  Peptide Sequence Number=SeqID_188531
atggagagaataacagagaatggatcagatagtagtgtgagtttgaggagaaatacatctaacaatgggcgtcgagggttgccaatgatccaaacggattccgaagtgtgccacgacgacagcacccctctcagcaactccaatccatcagttcaggtttatgtgaatgatcaatttctgaattgggatccagaacacagaatcaaagtccgaatagtatctgcaagagcttatcattccctatttatgcacaatatgtgcatccgacccactcctaaagagctagaggaatttggaactccagacttcactatatacaatgcaggactgttcccttgtaatcgttacacacactacatgacttcatcaactagtattgacatcaacattgcaaggaaagaaatggtcatccttggcacacaatatgctggggaaatgaaaaaaggtctctttggtttaatgcactacctcatgcccaagcgctatattctctccctgcattccgggtccaatatgggcaaagatggcgatgttgcactcttttttggattatcaggtactggaaagacaactctttctacctatcagaaccggtatttaattggagatgatgagcattgctggagtgaaaatggggtgtcaaatattgaaggaggttgctatgcaaaatgtgttgatctttcaaaggataaagaaccagacatctggaatgccatcaaatttgggacagagaacactcgtgcagcatatcctattgagtacatacccaatgctaagataccgtgtgttgctccccatgcaaagaatgtcatcctactagcttgtgatgcatttggggtgctccccccagttgcagggacagaggatggtataaaagaaccacaggctacattctctgcttgtttcggggcagcatttataatgatgccccctaccaaatatgcagcaatgctggccgaaaagatgcagaagcacggggctactggatggcttgtcaatactggctggtcaggaggaagtcatggattaggcaatcgaattaagttagcgtatactaggaaaatcattgatgctattcagtctgacaagaagacctaccaagatacactcttgaaactagcaagcctattcaagaagaattttgatggattcacgacctacaagataggaggggatcaaaagttgactgaagagattgtctctgctggtcctatattctga

SEQ ID NO: 71754 - DNA, 615 bp, Glycine max
  Peptide Sequence Number=SeqID_188532
atggcaaagagttacaaaaatttgcaggcaaaactccaagaactccaatctatactcgaccaagcgttgctgcttggccccgagactcagtcccaggactccatctccaacgacatcaaacataaactcgctttcataggaaacctgttagctgcccaagtttcttctcatcatccatcaaaaccccatcatttgcaccacatttcagagagattctctacttgctcttgctccgattcgtgtctcaacaatgatgatgaaactgatttgattgcttttgaagacccagaaaggcttttgcttgattccaattgtgagaaggctatggtggaatatagtggtgctgtggctgaggcaactggctatgttgatgaagagaaacagacggaagaaatgaagaatggatttgacaagttggaatcttttgattatgaagacgcagatgattttttagaagactttgccggagacaagggacttgtggaatttgagggtgcattacttagaaaacctgagggtaagaaggaaaattatttggaaacagaagaaagtagacacagtacatttggggagagatgttgtgcactggctgctggagatttgtcattggcatga

SEQ ID NO: 71755 - DNA, 2268 bp, Glycine max
  Peptide Sequence Number=SeqID_188533
atgggtactggttggagaagagccttctgcacccgcgaccctgcttctaccatatcggataaacagcccagaagcccgagccaaagcccgagcccgagcccaagaagctgcgccagattgggttttctctccggaggtagcaacccttccaccccacgcttgcgttgtacaacaacagcggaaactgtttctcaaacagttacagtaagtgagagtcccagagttcatagcaagaataccacccccagagcagcgaaatcaccaaaaacgctatcggtctcaaatccaacttctcctcgctcccctctcaagctctccctcttcaggaacagcttcaaattcaggagtagctgcggaatttgcttgaacagcgtgaagacgggacagggtacggcgatttacacagcggaatgtggtcacgcgtttcatttcccgtgcatcgcagcgcatgtacgcaagcatggaagcctggtgtgccccgtatgcaacgccacgtggaaagacgtgcctctacttgcggcgcacaagaacctcgctccagaatccgccacgcaaaacaacgtcgtcgtcgtccagagggtcgcagaaagtccttacaccaatgctgccagcgacaaaaagccaacagagaataataatgcctcccccgttttcaaagcctacaacaacaacaaccacgtggagccaccggcaaagcattccgatccaagcaggtcctacgacgacgatgaaccactcctctctcccacctccgacggccggattattcccattcccgaagccgacgaggacgaggatgaagaccccggcgagttccagggctttttcgtcaatccaaagaactcatcctcttccaaatcctactccgattcgttgcaaaccagcgacggagattccagaacagttcaggtgaaactgatgccggagtgcgctgtcatctcagtttcacgagcacacgagacctacgctttggtcttaaaagtgaaggctccaccgccgccaccacctccttcgcggagcagcgcggcgccgtcgcagcgcgcgccaatagatctggtgaccgtgctggacgtaggtggaaacatgaccggcgggaagcttcacatgctgaagcgcgcgatgcgtttggttatctcatcgcttggcaccgctgacaggctctccatcgtggctttctcagccacctccaaacggctcttacctttgcgaagaatgacaagccaaggtcagcgcgtggctcgtcgaatcgttgaccggctagtgataggtcaaggctccagcgtaggggatgcgttgaggaaagccaccagagtgttggaagatcgcagagaaagaaacccggtggccagcgtcatgctcttatcagacggtcaagaagaaaaggttcaaaatcagagaggtaataataatcagaggaagtcatcgagccacgtttcgtcgacgcggttcgcgcatatcgagattccgattcacgcgtttgggttcggggcgaagagcggttacagtcaggaaccgggggaggacgcgtttgcgaagtgcgtgggtgggcttttgagcgtggtggttcaggatttgaggattcaagtagggtttgaatctgagtcggttgagataagtgcgatttactcgtgcagtggaaggccaacactgatgagctcaggggcggtgaggatgggggatttgtacgccgaggaagagagggagctattggttgagttgagagttccagcatcgtcaggaactggggcccacaaccacgtgatgacggtacggtgtttgtataaagaccctgccacgcaggagatcgtatacggtagggagcagggtcttctggtgccgccgccccagagttccggtacaaggattgagaggctaaggaatctcttcataaccgcccgagccattgcagagtcgaggaggctccttgagcatagccctgacttcaccagtgctcatcatttgcttgcctcggcgcgtgtacttctcatgcagtctaattcggcttcggctcaggagtatgttcgcggcttggaggctgagctggcagagcttcactggaggagacagcatgagcagatgcaggtccaggtacagcagcggagaagaggggccgagagagaggtcatggcgctgctggacgagaacggcgagccgcttacgccgacttcggcttggagagccgcggagaagctggctaagatggcaatgatgaagaagtctttgaatagagtcagcgacttgcacggcttcgaaaacgctaggttttaa

SEQ ID NO: 71756 - DNA, 99 bp, Glycine max
  Peptide Sequence Number=SeqID_188534
atgtcaggtatggagcctaaacaagtgtctcagttgtccaatccatcactatctgaccctcttgttcttgttcttggcccggtgctatatgatccttaa

SEQ ID NO: 71757 - DNA, 958 bp, Glycine max
  Peptide Sequence Number=SeqID_188535
gttccatcctacggatgaagaacttgttgattactaccttaggaagaaaattgcttcaaggaggattgatctagatgtgataaaagatgttgacctctacaaaattgagccatgggatcttcaagagatttgcagaataggagcagaagagcaaaatgaatggtacttctttagccataaagataagaagtatccaactggaactcgcacaaatagagcaactgcagcagggttttggaaagcaacaggaagagacaaggcaatctattccaagcacgagctgataggcatgaggaaaaccttagtcttttataaaggtcgagctccaaatggacaaaagtcagattggataatgcacgagtatcggcttgaaacagatgaaaatggcactccacaggcaatattcaagaagagagtaacaaccatgcgtaaagtgagtgagcatgactcctcctgttggtatgatgagcaagtctctttcatgcaagacttggactcaccaaagcaaacttgtcaatctaatttggtctaccagcagctaccatatccttgcaagaaagagctagatttgccgccataccaattgcctcgtgaccacttcctccagcttccacttctagagagcccaaaactgcttcaatctgcttctgccatagcacctattaataatcccatggaaggatatgttctagaccatgtaaaccactcaacttctctgcttcccccatcactcatacaacaagaacatgttggtcagcaaaactttcaggcaacctatggcaacattaacaattccaatgaacaagcagtggatccagtgactgattggcgagtgcttgacaagtttgttgcttcacaacttagtcaagatgcttccaaagaaaatatctttcaaggcacggacaatagcagtgtacagttcagacatttggacaaacaaaagctagtgggtacttaa

SEQ ID NO: 71758 - DNA, 660 bp, Glycine max
  Peptide Sequence Number=SeqID_188536
atggctcgcggaaaggttcagctgaagcgaattgagaaccctgtgcacaggcaagttaccttctgcaagcgccgagctgggcttcttaagaaggctaaggagctctctgtgctgtgcgatgctgaaattggccttttcattttctccgcccatggaaagctctatgaactagccaccaaaggaaccatgcaagggctcattgagaggtacatgaagttcacacgaggggctcagcctgaagcagcagcacctgaagcacatcctcttctggaaatgccgttacaggatgcccataaaacaattaatggagagttaaaggttgctaaagaggaaactaacgcgctaaaacaagaaatccaaacattgcaaaagggtatcagttatttgtttgaaggaggaaataagactatggcaattgatgaattacaactgctagagaagaatctcgaaacttggatataccatattcgttcaatgaagatgaacattatgttacaagaaattcaagctttgaaagataaggagggaacacttaaagcggcaaataaatatctccatgacaagattgtggagaatactgcgatttctaactttgctgaatttgctactgatacttcttacccactaattgtacaagatgggggttttcaactctattaa

SEQ ID NO: 71759 - DNA, 1449 bp, Glycine max
  Peptide Sequence Number=SeqID_188537
atgggtttcccgcaaagattgctgtttatattggcaggtaccatattaagtgtaacgggtttgaagcataactatggagaagctttgtcaaagagcatattgttctttgaaggacagaggtcagggaagttgccaccaacacagaggatgacttggaggaaggattctgcgcttcaagatgtctatataattcctgatactactgtcttgcctttccttcgtaaagttgacttggttggtggttactacgatgctggtgacaacgtgaaattcaactttccaatggcattttcaacaaccatgctggcctggagtgtaatagagttcggaaaattgatgggtccagaccttaaacatgcgttagacgctattcgttgggccacagagtatttcctcaaagccacaagcatccccggttttgtgtttgcacaagttggtgacccttatgctgatcacaattgctgggagagaccagaagacatggacaccccaagaacagcctttgctgttagcagggacttccctggctctgaagtttcagcagagatagcagcagcacttgcagcctcttcagttgtatatagaaagtatcatataggctactctacaagacttctccaaagggctataaaggtttttgactttgcagataagtacagaggatcatacaatgacagcctcggaccgtgggacgaattggtgtggggagcagcatggttgttcaaggctactaaacgcccttactacttagattacattgacaaaaacatttataatctgaaaaactttgctgaatttggatgggactcaaaggacgctggcatcaacgtgctcgtctctaagcttctaattaatagtagctctaattctaagcctttcatcctcaataatgcggacaagtttgtctgttctgtgctacctgaatcgccttcagtatcggtctcatactctccaggtgggcttctattcaagcctggggggagtaacttgcagcatgcaacagcaatctcatttctgtttctggtttatgctggctatttgaaaaagacgaataaagagattgactgtggcggtaaagtttttgcttctccaaagcgacttaaacaaatagcaagaggccaggtggattacatactaggaagcaatccagtgaatatgtcatacatggtaggatacggtgcaaaatatcctgaaagaatacatcatcgtgcgtcgtcattgccatccgtagatgagcaccgtgggcacattggttgcaaaggaggatcattttattttcacagccaaaatccaaaccccaacttgcttgtaggagctgttgtggggggacctgatatgaaggattcatacgcagattctcgagcagattttgtacactctgaacctacaacatacatcaatgcaccccttgtaggtgttttggcatacttcaattcacatccatcctaa

SEQ ID NO: 71760 - DNA, 2732 bp, Glycine max
  Peptide Sequence Number=SeqID_188538
ctgcattcaacaatgtcgagagttatttgtaccttcatcctagtgaaaatccagctgctgctcttgtctccccagtgctggactcaaccaactaccattcatggagtcgctccatgatcactgcacttagtgctaagaacaagctagaattcgtggacggaagcgcaccggaaccacttaaaacggacagaacatacggtgcttggcgacgatgcaataatatggtggtatcctggatagtacactcagttgctgcttctataagacaaagcgtgctctggatggacaaagccgaagacatctggagagacctgaagtcgagatactcgcagggagatcttctgagaatctccgatttgcagcaagaagcatcgacattaaagcaaggagccctctcggtgacagaatatttcactaagttacgcgtaatttgggacgagattgagaacttcagacctgatccagcttgcacctgtaatagcaggtgttcctgctcagctttcgccattatcgcgcaaagaaagcttgaggaccgagctatgcaattcttgcgaggcttgaatgaacagtatacaaacatccgatcccacgtattgcttatggatcctataccagccatatcaaagatcttttcatatgtggcacaacaagaacggcaactgctgggtaattcctcttctcccaatcttaattttgagtctaaagaaatctccattaatgctacgaagtccatttgtgattactgtggtcaaatggggcacactgaaagtgtgtgctataagaagcatggtatgcctcccaatcacgagatgagaaacaaaggcaatggaggaaggaagacttgtacacacagtggaaggataggacacactgttgatgtgtgttaccggaagcacggatacccgccgggatataaacccttcaatggaagatccacagtcaataacatggtgacgatggataacaaaaccatggataatcagactcagcatcacgaatcccaggatctcgttcaattttccccagagcaatataaggctttacttgctttaatccagcggccatcaatcggaaacacggcgtcggagcaaaccaaacaagttgcttcaatatcgtcttgcaccactgataagcttcctaacccagttgaaccttcctcctatgccgaagcttctcagcatgactgctggcttaaagcaatgaaagctgaattgcaagctctgcaattgaacgagacttggcagcttactcctcttcctcctcataagaccgccattgggtgcagatgggtatacaaggttaagcataaagcggatggctccatagaaaggtacaaagcacgtcttgtagcgaaaggctacacacaaatggaagggcttgattaccttgacacgttctctccagtggcgaagctaaccaccgttcatctcctccttgctgttgctgccatgaaccattggcatctgagacagttagatgttaataatgcctttttgcatggcgaactcgaagaagaagtctatatgcaggttccacctggtttaacggttacaaatccgaatctggtatgtcgtttgcagcgttcgctttatgggctcaagcaggcaagccgtcaatggttcatgaaactttccggttttctaacagtgcatgggttccaacagtctcactcagaccattctctttttctccgctttaatggttcagtcaccacgatactcttagtctatgtagacgacattattttaacaggtaacagcaacactgccatacaggaggtgctcacattgcttgatcaagcttttaaaatcaaggatctcggaaacttaaagtacttccttggcctggaaatcgcgcgttcctctgagggaattcatttgtcccaaagaaagtacactttggacatattgtctgactcaggaatgttgggttgtcggccaaacacaaccccgatggattcctctaccaagcttcacgccacgacaggaactccattatcggcagaggcttcttcttcttaccggagactcattggccgactcatatacctcaataacactcgtcccgacatcgcgtacgcagtacaacagcttagccaatacatgtctagtcccacggatgcccatctccaagcagcctaccgcatattacaatacctcaagggcacaccaggctccggcatcttcttttccgccaccggaacccctcagctccgagctttcagtgactcggattgggccggatgccaggattccaggagatccaccactggttttgtcgtttatttcgattcttctcttatttcatggcaatctaagaagcagtccaccgtttcacgaagctcgtcggaggctgaatatcgagccctagcctcaaccacatgtgaacttcagtggttaacttaccttcttcatgattttcgaatgacatttgttgaaccagctaccatttactgtgacaaccattcagcaattcggattgccaccaatcctgtctttcacgaacgaacaaagcatatcgagatcgattgccatgttgtccgtcaacaggtcacctcgggtcatctcaaattgctcccagtatcatcctccttgcaactcgcggatattttcaccaaagctctaccttccactatctttcagcctctttgtaacaagctaggaatgttaaatatccattcccagcttgagggggggatattaacagcatctaacaagaaaactgagtcttga

SEQ ID NO: 71761 - DNA, 276 bp, Glycine max
  Peptide Sequence Number=SeqID_188539
atggagaaacttctgaaggagcaccaccatgagcaggcggccaacttgtttggcatgcctaccatgggaacccctaaaaatgggagcccaacaacaatggtaaagatgctatgtcaagtgcctgatgattatctgccagagatcgatgaagttggcacggcatggaggaacgaactttgttggtcactcagcaagtccatagtgtggagaatcaactccatcttttcattgatgacatcatggagacactgctatcacctaggtggaagacgctga

SEQ ID NO: 71762 - DNA, 285 bp, Glycine max
  Peptide Sequence Number=SeqID_188540
atggctaaactctctaacaaatcccctgtggagttgccatctaccgcaacctaccctatgacgagtgtgcgagcgaaaagcaaaagtgcgtcttctaaaaagaaaaaatgcatgggagtcaccaccaacatttatttaaggaaaacattagaaaaaccaaaaaaaaaaaagggaaaaatcccttttggggcagttgaagctcgcccaggagagctgatgcttagctctgaaggaatgagcttgcccaagcgagctgaagctcacctcaacaagctggttgcttag

SEQ ID NO: 71763 - DNA, 1266 bp, Glycine max
  Peptide Sequence Number=SeqID_188541
atggttaagaagggttggtttagcatgtttaagaagctctttttatggaacacacattcctcacaagagaagaaggagaaaagaagaagggcttggatatttgggagggttaagaccaagagattgccttcaattacagctccaccaccaccaccttcaaaagaaacaagactaagtgaggctgaggaagaacacagcaagcatgctttgacagtggccattgcttcagctgctgctgctgaagctgctattactgcagctcaggttgctgttgaggttgttaggctccaatctgctgctcatctacaacttaaagaaaaacaagaacaacttcaattacaacctgttaaaactagccatgatgctcctcagaatacacaccaacgccagaggaagattcaagaatcttcagccatcaaaattcaaacagcatatagaggttacctagcaaggaaagctttgagagcattgaagggaatagtgaagcttcaagctatcattcgtggaagagctgtgagacgccaagctttgagtactctaaagtgcttagagtcaataatggactcaaacagtgagagaacgtgggatgacagcattttgttgaaggaagaggtagatgcctcttgcgtaagcaagaaagaagcagttcttaagagagaaaaagtaaaagaatactcatttaaccacagaaggtcagctgaatcagaaagaaataaaataaatggaagatggaggtactggatggagcagtgggtagacacacaactttctaagagtaaagaacttgaagatttagactcagttttcagctcacattattctagacctggggaggaatgtggaaggagacaactaaagcttagaaattttcagagacaaaaccagattgaagcattagattctccatcactttcttcaaggaaccaaacttcaggggcagaagatcactcagttccaagctctcctgcaattcctacatacatggctgcaacaaaatcaacacaagcaaaagcaagatcaacaagctccccaagagcaaggataggagggaattttgacatcaactctgatagctattcaccatgcaagaataagttacctattgtgacttctattaatggtgaagtgcttagtaatggtaggattggcaagctcagcagtaatcagcaaagatcacctagcttaaagggccttccaagacctctaaaattaagtcaaacattgaggggtcttagcattaattcagattgcccagtgccaatttga

SEQ ID NO: 71764 - DNA, 1581 bp, Glycine max
  Peptide Sequence Number=SeqID_188542
atgatagccacgctggtaaggttccctccaaatcgaatgagcttgtgctcgcagaagaagaataagaagaaaaacatcaacgaaaacaaaacttggaaacagagaaggttggaaagccaagaaagaagaaacggtctttccttcccaaagcccaaatcaaccccactccttatccatcaccgtcctcatcccaaaactaaattggaagcacttgaacaagtcgtcaaagaccttgaagcctctgttgaaaagggcatcaaaattgacccggaaatctatgcctctctgttagaaacctgctatcgcttccaagccattcttcacggtatccgagtccatcgccttatcccaacatccctgttgcataaaaatgtcggcatttcctctaagcttcttaggttgtatgcttcgtgtggttatctggatgatgcccacgacctgtttgatcaaatggctaagagggatacgtctgcatttccctggaattcactcatctcaggatatgcccaagtgggccactacgatgaggccattgcactctacttccaaatggtggaagagggtgtggaagccgacttgttcactttccctagggttctcaaagtttgcgcaggaattgggtctgttcaagtgggggaagaggtgcatcgccatgcgattcgtgctggctttgccgctgatgggtttatcctcaatgcacttgttgacatgtattctaagtgcggtgacattgtaaaggctcgaaaggtctttgataagatgcctcatagagaccctgtttcgtggaattcaatgctcacagcttatgttcatcacggcctcgaggttcaggcaatgaacattttccgccaaatgcttttagaagggtgtgaacctgactctgttagcatatccactgttcttacaggggtgtcatcactaggtcttggggtccaaattcatggatgggtaatcagtcaaggacatgaatggaacttgtccatagctaattccttgatcatgatgtactccaatcatggtaggttagaaaaggcacgttgggtattcaatctaatgccagagagggatgttgtttcgtggaattctataatatctgcacattgcaaacgtcgagaagcccttgctttttttgagcaaatggagggagctggtgttcagcctgataaaataacattcgtttcaatattatcagcttgtgcctacttaggtttgttgaaggatggagagagattgtttgccctaatgtgtggaaaatataaaataaaaccaattatggaacattatggttgtatggttaacctttatggaagagcaggactgattaaaaaggcttatagcatcatagtcgatggaattggcactgaggctgctggtccaactctgtggggagctttattatatgcctgctttatgcacggagacgcaactataggggagattgctgcaaactggctttttgatttagagccagacaatgagcataattttgtacttcttatgaggatttatgaaaatgcaggcagattagaggacatggagagagttagaatgatgctggttgacagaggattggattattag

SEQ ID NO: 71765 - DNA, 226 bp, Glycine max
  Peptide Sequence Number=SeqID_188543
atgccagagcaatgttcgtcgatcgtgaaaatcactacttcgttggcgaaggtgccaaactcctcaacaaaatccggcgaggattgcacaaccttggagaaagaggcgaaacccattgaacttttgatgggtaaatgggatcatcgtccgtggcgaaggttcttccgccgtcgaagatctccggtgcgtcctccgacattctacgacatcaatgcccctcttcctg

SEQ ID NO: 71766 - DNA, 441 bp, Glycine max
  Peptide Sequence Number=SeqID_188544
atgtcggaggacgcaccggagatcttcgacggcggaagaaccttcgccacggacgatgatcccatttacccatcaaaagttcaatgggtttcgctcgaaacaataaagaagacaaaacgcaacgaacaagtatttagttattttgacacagtggtcatggggaacactgctgccatcgccgaagaggaaccactagttcctggcgtcaccgaagacaacctctctgatgactctcaagcatctcagatgccgatcagaaacagagatgcggatttgggtttcatgtttttcagatctgattgtgtagtggatctgcttaattatacaactggtcccttcacacaatataataccaaggtgcaccatgaccgtccaggccagctctatggccacacagagatgagctacaacaagaaggagattagagggttgttaaactga

SEQ ID NO: 71767 - DNA, 903 bp, Glycine max
  Peptide Sequence Number=SeqID_188545
atgtttgtatattgccacagtaatgtgtttgattggaatgattcagctgctgaagaagcttttcaaaatgccaaaagtcattactgggcaaagatcaacagccttccctgtgatatttctctgcctgatccagatacatatattaatcaaatagattggagtccttacattgatccggatctgattaaggaaatagacggagcattctttattgtgccagatgaggaacaagaaaatgccatgaaaaacaaaagaacaaaaacttctcttaatgatgaaaatccttgggaatgtactgatacacctcttagcacagctttagaaaataatgaagtacaaggatggaaccagggaaactctggagatgtggataatactgacaatccatgggagtgtagcattacttgtggaaatggaggattaactgacaatgcttgggaaggtggtcctgttaagtcatggggttggaatgaagaaaaaggccataacaatcaatgtaaggattggaattctggaaactcacaagataaaggatggggtaaagctagggacagttcttggtgccagcagcagtcaaataatttagctaactttggcaactcttcttggcattgcaaatctagtcaacagaatgtaactccaatgaagacaggatggcgaaacagaggagcaaatgtgtcaggatggaagcaacaggaaaaggctggtgtttctagaaggaattatggaggagggtggactgctcagaataagggtaaccagtggaatcagggcaaccagtggagggaaggctctcatcggcatacattaggctataatggctctcaattccaaagggatggttgtcaaacaggtcattactggggtaaagagagaagtaaaaagagggatttcttcccttga

SEQ ID NO: 71768 - DNA, 347 bp, Glycine max
  Peptide Sequence Number=SeqID_188546
atgaagcatagaagggaccttaggggtgagagaggcctcaaagtcgagcttccaattgtggtaataaggaaacgaaggagaagcggtgcggccaagattgacgcagtcggaatgatgggagttagaattatgggaggagagatgggaaaggggagaaggctccatgccggggaagtagtgacaccgggaggatggtcaggaggagaaggatctttgaagagcgtagagctggtggttggagaccggcatggtggtggatgcggtggttggcgcacccaacacggttgcggaaggagacgacaacaacaaactgtgactggtgaggaaggagggtgtcaactgtcaag

SEQ ID NO: 71769 - DNA, 789 bp, Glycine max
  Peptide Sequence Number=SeqID_188547
atgtgtttcaaatatcataattccttctgttattcaacaaactcagatacaccaacaaaaaattcagtgacaccagctttttctcaaccaccaaagccgataccagaacgaacacacacaaaacagaacaaaacaataaagaggggattagctagtgcaggggagctgaggtcccacacagatctggtgacgtcggggccagcgacacgcaatgacgatgcagaggtgcgcacgatgatgggactgggtggttggggccatggtggtaatggcacgcacaataatgagggggctgttgacaatgacatccccacctctgccaacaagggggcacacgcctcgaccatcggcttcaatggctttttcgcgattccgatgaacaaacccccaaagtcattcttcaaacctgattctactccaacccaaactggcctgagtcaaacttgctccaagtcgagctccatgtgcaaccatatctcaatattcatctcctctgccatgggctctgcaagcagatctcaacattcacctccacctccacctccatatagatctcaacgtactgagcttctctggcgtgaaatcgacgttgcagcacgccgtgacctcaacactcatagtctggttgacgatgtggatgcacgcgagcacattcatggagttgttgtgatcggcgacggtgatgccgagcacgtagatgttgctcacgcagtagttgatctccacaccgacaatgacatgtcgctccatgccgcgagggggtcatcgccgatggactttggggcatag

SEQ ID NO: 71770 - DNA, 768 bp, Glycine max
  Peptide Sequence Number=SeqID_188548
atgctgctgcaaactcaattcctctcttgttgggttcaacacttgtctcccgggcaaacccaaggcagattgttcttgagaatcaatatcaaatcagaaaaggcttcttcagatgattctggtccctcaaaaaccggggtggggtttggatcatcggacactgctgctgtgcctgtgagcagtaaaaagaaaaagaaggcgcaaagagaaagggcgtccataattcggcgaagcccgcttgaaaaacctgcatttgtttctgaacaacaagtgggtaaggccaaggaagagaacaaaaatgaaagcgcttttcttcttgcctggctcggtttcggcgttgtcattctcgttgagggcattgctcttgctgcatccgggagtcgtaggagaacccagaacatgacagcctacaccatcatacccgaccacagcattcattcaacggcacaaggcatggcccaagtcctccatgccgttctacgtgtcccctatgctcacacccgatcaacgttccgcgagttcagacggtatttcttgaagaggaggatcatcggcgtgatggaagagtcgcgagttcaagtacgggatttcgaaaaatttcaggtggaagagaggatgaaagttataaaagaaatactcaacttgttggaaggccttgaaatggatagattacttgacagccctaagcaaggtgcaaatccaatggtaagtggtaaacttgagcttataaaagctaagatcacagttcatgacaatgattcgtattag

SEQ ID NO: 71771 - DNA, 756 bp, Glycine max
  Peptide Sequence Number=SeqID_188549
atggggactatcagccttaataaaaaaaatttgagagcagaggggatatacacgagatcaagggtagatgaatctgaggcaaacatcataatagatattttgaatgtttatggtgcagcctctggacaattgattaatttccaaaaatcaaagatcattttcagctccaatacaaattaccttcaaagacaatacctatcatctcccctaggtgtgactgaatctattggcacaagttatgtggagtttgatcaatatgcgttggagctgggtgattccaagtttgacacaaaacatgtttgggtaaatcctagatcttggacacgcttacaacccaagtcttcaggttttgaccgtttggattcacgaaataacttccggagcctaagttatgaactttgcacagaagcagtgaaatatgttggagtaggaattcgcccaggtgagtctcaattgggccaacttgcccaagcgagaaaatttttcctgggcgagtcttacaggttacaacgatgtccaatagcacaaaaatatatgtttttctccgttcttctcccccaaaccctcacccaacaccgcaaacctcctcctccactacccatgactaccggtgaccgtcacaagctgtcattgcttgccattgaaccaccgcaaggagaagaacactttaatcaaagaggaatcttcataatccaacttaaggattcggcagagaacatagctctcaacccttccttcgtggtttcttcgaggtaa

SEQ ID NO: 71772 - DNA, 560 bp, Glycine max
  Peptide Sequence Number=SeqID_188550
atgtttgagcgcagcactaagcttggctctgtttgggttactcttaaacgatcatctttgaaatctaaggtgcagaggaataaattggccgctgccggtgaagcaattgagtttagatgccttatacgtgcaactgatgggaaaaagacaatttctacttcggttgatgataaagatcatcagcattggttatcaaggggaaagtggctggagttctatgacttctatcattatgcagaatataatgctgatactgcatttcatcacttgatttgtggtctgttgggttgggatgtcactaaatccagaatattgtttcaacactgtggtgctggctttgagaatctggcatggggaattgctactggtggagagaagggatcaaaggcctatttactgttggcagcacagtttgatgctgaagtattatgcagaaaaggatgggacatactgttgcagggagggataagggcgagccctggtgcagcggtaaagttgtgccttggtgacttgttggtcatgggttcgaatccggaaacagcctctttgcatatgcaagg

SEQ ID NO: 71773 - DNA, 249 bp, Glycine max
  Peptide Sequence Number=SeqID_188551
atggaaatggaaagaaacttgttagagttgattgaatggtatgggatgagtgcattaaatatggaggttgacccaaaaccacgcttacttaccctatctatgtttggccggaaaggaaatgagcccttatcggaggaaatcaaaaacaaaaacaaaaactactcgatcgtgtcagaaaccaatgaacaaagcaaagcgcgtaaaatcgaagcaagaccaaacatgcgtcgtgaactccctcagtcctag

SEQ ID NO: 71774 - DNA, 908 bp, Glycine max
  Peptide Sequence Number=SeqID_188552
ggaggtggtattaataggtttaaggctcacttggcaggacaaaaaggccaagtagagacttgcaagaaggttcctgctgatgtccaacatgaaatgaagcaactacttagacaaattgaaaagaacaaaaaaagaaaagtgcagcaggaacaatcaaacaaaagtgatacatttgaaatggatgaagaccctatgggaatagttaaggaattaagaggaactccaaaaccaatttcttccaagtctcaaaaggggaagaacactccttatgtagatgattatttcatccctataacaactcctggagctcaacctagcttgaagagtgtcttgcaaaataagcaaattatagaaaagtgtgacaaagccattgcaaaatggatgatagatgctccagtgtcaattaatgcagttaactcgacatattatcaacctatgattgatgctattagtagcatgagtccagggtataaagccccaaatttttatagaatttgtggtcctttgttaaatatgtgggttgatgaagtgaggaagcttgttgaaggttacaaagaagtttggaaggaaactggatgtactttgatggttgatgggtccattgatgcttcgtatgcttctaaaagtactgaaatgttttttaagctttataaggagatggtgttatatgttggagcaaaaaatgttgttcacattgtgaccgataatgctgcaaattatgttgttgttggtagagataaaaggaaagtggaaccttatttggaggtccttgataggcattgtgattcacagctttgcaaagatctatatgcagctggttattggttaaatccggcttgtagattgaatgctaaagaatttaagaagcattggaacacacaatctggcattttggaactcattggcag

SEQ ID NO: 71775 - DNA, 300 bp, Glycine max
  Peptide Sequence Number=SeqID_188553
atggctctcagaactcttgatctgttacagccagctccgtacgacctcttggatgttttcatgtgtaatgcttttgttgcggagctgtggggtttcaaatgcgtggtgtctttagctaaggagcttcatttcaagatggactccctttctgccatccgaatggttctcatttctgttactttcctacaagtgggaatggatttgcatgcaagaataggaagttatttctcctcgcccaagtctgggatatctcccgtgaatgcttccatgcttatttggcttgacatgatatatatctag

SEQ ID NO: 71776 - DNA, 174 bp, Glycine max
  Peptide Sequence Number=SeqID_188554
atgttgtcattccaggaaagaacattggaagagcacatgaagttggtggaaaagattatgaaacatgacaaaaaccgacgtaaaaggatagaggctgctggcgttgattatgaatgccctgagattgtggttaacattcagcctgctccaaagaaaatgaagtttgaagactga

SEQ ID NO: 71777 - DNA, 165 bp, Glycine max
  Peptide Sequence Number=SeqID_188555
atggaggatagtgtgagttttgatgaaagtatctttattatcacggaggagaaagataaacacctacaagggctttgcctttatctgtctcttactagaaattccagtaacgaaagagaaagtctcaatctcataccaacaccaaatgaggaggggaccaagtaa

SEQ ID NO: 71778 - DNA, 1218 bp, Glycine max
  Peptide Sequence Number=SeqID_188556
atgggtgaggatttatcatctacgttggttgtgagagagttcgacctgaataaagaccgagagagagtagaagccgttgaaaggtcgtgtgaggttggacccagcggcaagctttctctcttcaccgacatgctcggcgacccaatttgcagggtccgtcattcacctgcttttctaatgctggtagcggagattggtggagaattagtaggaatgataagaggttgcattaaaaccgtgacatgcggaaaaaggctctccagaaacggaaaacacaacaacactaacgccaaacacgtcccagtgtataccaaagtcgcatatatactaggccttcgtgtttctcctaatcgacgtagaatgggaataggattaaagctagtgcgtaaaatggagacttggttcagggataatggaacagaatactcctacatgacaacggaaaagaacaatttggcgtctgttaaactcttcaccgataaatgcgggtattcaaagtttcgtaacccctccatccttgtcaaccccgtatttgcccatccagcaagggtatccccaaaggtgagaatcataagtctttccccttccgaggccgaggtactctaccgacaccattttgccacgacagagttttttccacgcgacgttgactctgttctgaacaacaagttgaacctagggacgtttctggctgtcccaaatgagtcctacaagtctgacatatggctcggcccagatctttttctgtcggacccaccacattcctgggccatggtgagcgtgtggaactcaaaggaagtgttcacgttcgagttgcgtggtgcgtcgcgcgtgagccgcacgcttgctaagacaacgcgggtggtggaccgggccctgccctggctgcggttaccatcgatgccagacctgttcaggccgttcgggtttcacttcatgtacgggttgggaggggaaggcccagagggcgtgaagatggtgaaggccctgtgtgggttcgcgcacaacctcgccatggaaaaagggtgcagggtgttggccacggaagtgtccccaaacgagcccttaaggtttgggataccccactggaagatgctgtcgggtgaagatttatggtgtatgaagcggttgggcgaggattacagcgacggttccgttggtgactggaccaaatctcaacccggcatgtccatttttgttgacccgagagaggtctaa

SEQ ID NO: 71779 - DNA, 164 bp, Glycine max
  Peptide Sequence Number=SeqID_188557
ttttcttacaaactttccttaaatctagttgtgagtaccaatcacccaggctagcaaccagctcgcctgggctagtactatttcttcagcctctgccatgcaaaccaacaggaagcagaaaagaagaatggggagaagaactcatgaaaaggaatagagcataa

SEQ ID NO: 71780 - DNA, 421 bp, Glycine max
  Peptide Sequence Number=SeqID_188558
atggcctctggtaatcgattaccaaggggcttaaaatgggactggaagattgtggaggcctctagtaatcgattaccagcctgtgtaatcgattacacagaggaacaggccactggtaatcgattaccagtgcctagagggagcttgggagaccctcgaaggcaatacgaggtgccgatttcggggcacgattcgattcacggcgacttcattggtgcatccagaggaacccgcgcgcacgcttcagcgcaccgtggagtggatattacccacgcctacaccataccatctaatggagccagtccaagtgatcgagagggtgatgaggacccactccctgaggtggattctcccgaggacgtcatgtcggcatctgaggcagactctacggaggatagtggccctggagagatggcgatta

SEQ ID NO: 71781 - DNA, 1347 bp, Glycine max
  Peptide Sequence Number=SeqID_188559
atggtggataaaccaatgagcattcatcgaacccggttcccattctcgatcaccaagctcctcttctggtcgcttatcctactcagcttcattgtgctcttcttcttgggatctcccccgtcctccgcttccccttcccaccgccggcgctccctccgcggcggcgactgggagacctccgttcgcgaatccgccaagtccaaatccctccgcgtcctggtgaccggcgcagccggtttcgtggggacacacgtgtccatcgctctgaagcggcggggagacggcgtggtcggaatcgacaacttcaaccgctactacgaggcttccctgaagcgcgcccgcagcaacctcctcgcacagcacaaaatcttcgtggtggaaggcgacatcaacgacggctccctcttaaagtctctcttcaagctggggaagttcactcacgtgatgcacctggcggcccaggccggtgtgcgctacgccatgaagaaccctaagtcctacgtccacagcaacatcgcgggcctcgtcagcgtcctggaggcctgcaagaacgcgaacccgcagccggcggttgtgtgggcctcatccagctccgtctacggcctcaattccaaagtccccttctcagagaaagaccgcacggacaggcccgccagcctctacgccgcgagcaaaaaagccggcgaggaaatcgctcacacttacaaccacatctacgggctttccattacagggctgaggttcttcacagtctatgggccctggggtcggcccgatatggcttactttttcttcacaaaggatatattgaaagggaagcagatatctgttttcgagggtcccaatggacgatcagttgcgagggactttacttacattgatgatattgtgaagggatgtttgggggcgttggatactgccaacaggagcactgggagtgggccggcccagttgcggctctacaatctgggcaacacttctcccgtggcggtgagtaagctggtgaggatattggagaagttgctcaaggttaacgccaacaagaaactcttgccaatgccgcccaatggggatgtttttttcacccatgctgatattagcttggctaagaaggagcttggctacaaccccaccatcgatttggaaaccggcttgaggaaatttctcgattggtatatggactattattcttcctcttcctctctgcccaagagggcttggctatacctaccaatgtctctttctgggtaccgcacgttgaatttcactacggattcatttcatctccccttattttataatacttcttttctatggaaagtcattgctgctctacaatcttcttag

SEQ ID NO: 71782 - DNA, 1200 bp, Glycine max
  Peptide Sequence Number=SeqID_188560
atggatagaactgttgatgccgatattgtgatcgtgggaggtggtatttgtggccttgcaacagcccttgcccttcacaggaagagaattaaaagtctggttttagaaagatcagagaatttacgagctacaggagcagctataatagtgcacgcaaatggctggcgtgcacttgatcagcttggcattggctcaacacttagacaaactgctattcaaatacaagggggaagatttatatctcttaacgaggctgagccaatggaatttccatttggggttgatcaggaacttcgctgtttaaagcgaactgatctgatgaaagccatggccgataatttaccggcggggactatacgtaccaactgtcaagtgctttccattgaattagatcctttaacacgctctccacagcttctgcttagcaatggaagcatccttcaagctaaggttgtcattgggtgtgatggcgtgaattctgccattgcaaatatgtttgggttacaccgaacgaagctcttgcttttctctacatgtgttgcacgaggcttcacaaattttccaaatggtcatgaatttggcagtgagtttgctatgatgagcagagatcaagtccaactcggaagaatcccagtgtctgacaagctcgtttattggtttgtcacaaggccacggacttctaaagattcaacaatttggaaagacccagttcttattagacagtcattaatagaatcaatgaaaggtttcccagaaggggcggtggagataatacgaaattgcaagttgagcttcttgcatctgactgagttgaagtatagggcaccgtgggacttggtctttaacaagttcaggaaaggtacagtaacaattgctggtgacgcaatgcatgccacaggcccattcattgcacagggtggctcagcctccatagaagatgcactagttcttgctagatgcctggcacaaaagaaagctgaagaaactgcagagataaacatcgcagaggcagaggaagcatttgatcaatatgtcaaagaaaggaagatgagaaacttttggctctctttgcattctttccttgttgggaagaagcttgacaccaaatcatccatagtcagattcattatccttgcaatcatgggcattctgtttagagaccccgattggcattcccgctatcattgtggagttctatag

SEQ ID NO: 71783 - DNA, 1944 bp, Glycine max
  Peptide Sequence Number=SeqID_188561
atgacgtggcagatcttgttccgtgtcggagacctccttgacgctcccgatctctcgccggcgatagtcactctcgacattgtcgaggaagatgtcactcgttctcgtgcttctgtctattgtgaccagtgccgagtcgttgggtggagtgggcatccggtgtgtcgaaagcgataccatttcataataagggctgcgagcgatgccgtagaagcatatcaaagaccttgttcaagatgtggaaatcttctccaattatctgaaacaaggtgtagatcgtgtaactttgccatcaccgttgatgaccttgaggattgggtgtatcttcagattgaagataacacacatcttctgcatggtgtcgtccattccaatggttatggtcacttgcttactcttaatggaagagaaggtggctcaaagcttctctctggttctgatatcatgaatttctgggataggctatgtgctgcaatttctgttaggaaggttagcgtgatggatttgtccaagaaatttgggctggaataccggttgcttcatgcaatcaccaacgggcattcctggtatggcaattggggttatgaatttggaactggcagctatgctcttacgcaagatgcgtacaagaatgcagtgaataccctgtcaagcatgcccttgtcatcattttcattccacggtcggggaccaagaagccacctggagtgtgtcatttctctttaccagtctttggcagaaactgaacttttgacgattggacatctcttctcctttatgttgacattgattcatgaatgtcgtaagccagtggccatgaggacatctaagcagaccagtaacatgttgtgtgcatggacgggaaatgatgttgaagaggtgcaacatgctttgataaaggttttgcttgcatcgggtgcttgtactgaggctaaatgggtgacaagacgtgctctcaagggtgcagtatgcaggggtgtttcatctccagagcttctagactactgtcttaagcacttcccagggaaattaactgccaatggaatgatagtttgttcacgatgcaatcccatttccagtggcatcgaattcagattagaaccttggtgtaatggattgagtacaaagtcaagctatccaacagaagttcaactgatctctgatttgacatttttatttaattcaattattcaccctgacaaaatggtgtgctacagaccaaagattatgaggaaaagtgtggctgattcagccaggaagctccttgactgtaaacagtttatgaaggattacaagccatatgaaatggccgttgaactgccttcagtcattaggctgtggtgtcacgtggagctttctgatcagcccaaggatgatccatccccaccaccagagctaattatgctgcctttgaatgctaccgttgctgacctcaggagtgaagccactagtgcatttcaagaggtgtatgcaatgtacaagaggtttcaagctgaggaacttctaggatacgggtcaatcagtgattcgctcaccataaggttcttgcttggaacaagtggatcaattcaaattcaaggtaaatgtccagctaaacatgggctaagtcgatttcgaatggaacgaggaacagaggtgtggaaggtggattgcacttgcggggctaaggatgatgacggagagaaaatgttagcatgtgatacctgtggcgtttggcagcatacaagatgtgctggaattgataataatactgatggaatgccttctaagtttgtttgtatgggatgtgtcaacttgtaccgtgaggaaactaaaaaattaccagcacctggtgaggaagctaacgagacctgtaaattcaacacatcttgcagaaatgaagctgtagcaagggactgtgcaacagtttcatgtaacatagctgtgaattttggtgtgggttga

SEQ ID NO: 71784 - DNA, 1188 bp, Glycine max
  Peptide Sequence Number=SeqID_188562
atgaggtgcctctttcctcttctctttctttgttcgcttggtcttactgttactggtcaagaattcattaagttcatcaacctctgtgagacaactgaagacattttacaagcctcgtcgcacgctgagcttcccttggcagtttcagtgaatgctggaaacctcaatgaggtctctttcagcattttgttagctgaaaaatggctcaggcataacgttcttgcacaataccctgcttcaaatatcaccaccattgttattggaaccactgctttttgccaacagggccatcaacacaacaacctcgctgtggttctgtcttctctgaagaatgtctaccactcacttaagagatggggtttggagaaagccattaaagtttctgctgcttttaatctggactgtttgtctctaaactcagtttcttttaacaatgatttgaaaatggtcaaacccctcatagagtttctcaaagaggtaaactccacatattctgtgatcccacattatggcttctcacatttttctgatgaaagttttagcttggtgtcttcccatttggagtccatgaaaaagcttggattttttcatctcaacagcataaacgttgcaaccattgttccaaaagggagaaaaaccatagcaagaaagctttcagttgttgattttagcccaataggcccattcccagtaaggccagctccaatgccagaagtagccaagtccccaatgactccttctaatgtacctttgcctcctttagcacaagtggtttcttcaccccctccaatactttctcccacttttgcccctgaagagccaccatttggtgttccagctagctctcctcatggcttcacactccctccttgcattccattacacaatggctcaccccaaatattcccgatccagaaactgtggtgtgtggctaagccaagtgttcctgaagaaacactgcaacaggctatggaatatgcttgtggagagggtggtgctgattgcatggagatcacgccacagggaaactgttataatccagacactgtggttgctcatgcctcctatgctttcaacagttactggcagaagcacaagagaagtggtggaacatgcagctttggaggaacggccatgttgatcaattctgacccaagtttccttcactgtcggtttattcttagctaa

SEQ ID NO: 71785 - DNA, 573 bp, Glycine max
  Peptide Sequence Number=SeqID_188563
atgcggaaaaaacgtatgatgttgactgtgttgttgaaaaagcaaaatccagtgggagccacagagatacagtgtagaagacagtgcatcagtgagaaagccaaaaggaagcgccaatctgcattccgcggagtgcgcaaacgcagctggggacgctacgtctctgagataaggctcccgggccagaaaacacgcatatggctcggctccttcggctcgcctgagatggcggctcgcgcttatgactccgctgctttcttcctcaaaggaacatctgccactcttaatttccccgacctcgtacactccctgcctcgacctctctcatcttcccggagggacatacagtccgccgcagctgaagccgctctccactctccgcctcccaaagaagaacaagaatctattttcacttccaccaccacctcgtcctttcacgatgtcatggaagctcctcttatgagtccccttagggtggactccactttcggagatttctcatgggaccaactcttcgatttcaacgatgacattctcatcgtgggatcaacttctgccactcttgtcccttaa

SEQ ID NO: 71786 - DNA, 1383 bp, Glycine max
  Peptide Sequence Number=SeqID_188564
atgaaaattgaggagaagacacaccaaaactcaggttgccataaagaaattgaagttacgataacgaagagcaaccaaaagcgtgagcaaaggcacacaagcacatacttgatggagttagcttggccttttgtagtagccgtttctgaatggacaatgatcaatactagttcaatcaccacaactacaagaccttcattatatattgtgcacaataaactatctattttccaacttcaatattcactgttgttgagtattctaattctaatgaggaacaggggtgtgtgggaagatgcaagcacagcaacagtgcttgtacttgtgctatgttcatcgtatggaattgcagaagtaaagtcacagtcacagaaggtatctggtttgtttgtttttggagattcattggttgaagtaggcaacaataacttcctaaacaccatagcaagggcaaattactttccttacggcatcgacttcggcaggggttccactggccgattttctaatggcaaatccctcattgacttcattggagacttgctgggcattccttctcctccaccttttgcagatccctccactgttggaaccagaatactttatggtgtcaattatgcatcagcttctgccggcattctggatgagtcagggagacactatggtgatcggtatagcctgagccagcaagtcctgaactttgagaacacactgaatcagtataggacaatgatgaatggaagtgcattgaatcagttcttagccaagtctatagcagttgtggtaactggaagcaatgactacatcaacaactacctcctgcctggcttatatggctccagtcgaaattatactgcccaagactttggcaatctacttgttaatagctatgtgcgacaaattttggcactacatagcgtaggattaaggaagttcttcctagcaggaattgggccactgggttgcatccctagtcttcgagccgctgctttagccccaacaggaagatgcgtggacttggttaatcagatggttggaacttttaatgaagggcttagatcaatggtggaccaactcaacagaaaccatcctaatgctatctttgtatacggtaacacttaccgtgtctttggtgatatcctaaataaccccgcggccttcgcgtttaatgttgtggatagagcatgttgtggaataggaaggaaccgaggtcaactaacatgcctcccattacaatttccatgcacaagcagaaaccagtatgtgttttgggatgccttccacccaacagaatctgcaacttatgtcttcgcatggagagttgttaatggagcgcccgatgatagttatccaattaatatgcaacaaatggctaccatttaa

SEQ ID NO: 71787 - DNA, 429 bp, Glycine max
  Peptide Sequence Number=SeqID_188565
atggggacacgtagaactacatccgccagtcaggaaaacaaccgttactgcccatcacacggcagaggtgctcattggcgcgaagggtctgagtcatgccttgtgtcattggctgaatgtcatggtcgggtgtggtggttgaaaaattcttctctttcttcttcttattttcctctcgttttctctcctggtccaaaaacgtcaaggatatcgtctgaaaacacttttgagtcatgtcaacatgcatgtaccgtgatgggacacgttaatattgtcagtgttcggtgcgggttaaagatgctgataatggcgaaagatatggtcttagctttctgttgttcggttctgttgtgttctacgagctctggtcaagatgaatttttcggtgtcagttcagaacaccagtttccagctggaagcctcccttaa

SEQ ID NO: 71788 - DNA, 2670 bp, Glycine max
  Peptide Sequence Number=SeqID_188566
atgaaagctcttcacttgagcttctacttctacatcatcgtcttcacactatccctattcctctcctttcaagtcaacactgtaaaaggggtcaacaacaccagcgccaatgaatctggcaatagaagaattctgcaccagccattgttcccggcgagttccgctccaccgccagcaggcacggcgtcaccaccgccaccaccggcggtgataacccctccatctccggacggcggcaacatccccttcttccacgagtacccggcggatcagaaccaacaagcagcaccgtcgtccacggtgaactcctcaatcgcaaacccaacggcaacacagccaacaaagggaacaaagaaagtagcaatcgcgatctccgttggaattgtgacgcttgggatgctctcagcactcgccttcttcttatacaaacacagagcaaaacatcccgtggagactcaaaagttcgtagctgctgggagtgggaacaacaataacaacaacccaccaaacaggaacagcaacagcaacgaggatgcaaacacaacttcggcaccatcgagtttcctctacattggaaccgttgaacccacggtttcacgagatgctaataagcccaaccgatcgccctatcacaagctcaagcgatccgatcgctaccggcccagtcccgaattgcagccaatgccgccgctcactaagcctcctggcgggaattacccgccagctttgtcttcctcgcccgagtccgacgaggagagccgcgagacggcgtttcactcgccgcagaactcgtccatcgatggctactacacgcccgcttcgcggcatagctctctcgtcaacggtagtcctgcgaagagagaaacgaattccactcccgcacccgttgttccgttctccaagagaacttcgcccaattcacgcgtttccgcaccctcgccggagattagacacgtcatcataccgtctataaagcagcctccaccaccgtcgccgccgccacctaagcattccctaaagccagaattctcggcgcctcccccacctccgaatttgaagcgtcttcagtcaacaacaacaacaaccgacactgctttgcacgtgtcaaggacttcacttaatcctcctccaccaccgccacctcctccgccgccgccacctccaccgctgcagcaaaaatcagtgtctccggcggttagtgcttcttctaattctgcatctgtaaagcgacaatcttggtcaccagttcaatgtagtgtgacgaaaggttcagatggggttgaacaaagtcaaagtgtgagctcttccgagaggcatgaagccaatgacacggatggagccaaaccaaaattgaaagctctgcattgggataaagtgcgtgcgacctcagaccgtgctactgtgtgggaccagatcaaatcaagctcctttcagttaaatgaggacatgatggaatcgttgtttggatgcaaagccacgaattttacccccaaagaacctcccagaaaaaaatcagttcttccttcggttgatcaggagaacagggtgttagacccgaagaagtcacagaacatagctattcttctcagggctttgaatgtgaccagagatgaggtgtctgaagctcttttagatgggaatcctgaaggtttgggcactgagctattggaaaccctagtgaagatggctcctactaaagaggaagagataaaacttaaaaactatgacggcgatctctcaaaacttggagctgcagaaagatttcttaaagcagtgcttgatattccttttgcctttaaaagagttgaagctatgctatatagagccaactttgacgcagaagttaactaccttagaaagtcttttcaaaccatggaggctgcaagcgaggaaataaagaacagccggttattcctcaaactccttgaagctgttctaaggacaggaaacagaatgaatgttggcactaatcgaggggatgctaaagctttcaaattggacacacttctaaaacttgtagatataaagggaacagatggaaagaccacattgctccactttgtggtccaagaaatcattagatctgaaggtgctggagctgaatctgcaaatgataatgtgaagatggattccaaatttaatgaggatgagtttaagaagcaaggtttgcgggttgtggcagggctcagtagagatcttagtgatgtaaaaaaagcagcaggaatggattcagatgtcttgagcagctatctttcaaagcttgaaacaggccttgataaagtgcgattggttttgcaatatgaaaagccagatatgcaaggcaatttctttaactccacaaagctatttctgaaatatgctgaagatgaaattgtaaggattaaagcagatgagagaaaagccttgtaccttgtaaaagaagttacagagtactttcatgggaatgcaacaaaggaagaagcccaccctctcagaattttcatgattgtaagagactttctgaatatcttggatctagtgtgcaaagaagtggaaaagatgcacgatagaatcgttggtggttctggcagatccttccgaatacctccaaatgcatcattacctgttctcaacagatacaatcatccaaagcaggatagaagctcagatgaggagagctcatccccctag

SEQ ID NO: 71789 - DNA, 129 bp, Glycine max
  Peptide Sequence Number=SeqID_188567
atggaagacaccttgaatgttatgcttgtccgaacctgccgacgcagtcgacgagatggacgagtgatgcatggggtcgcaacgtcttcttcttctttctgctttgttccattggccttaggagattga

SEQ ID NO: 71790 - DNA, 449 bp, Glycine max
  Peptide Sequence Number=SeqID_188568
atggctatgactggagtgtcaacttactccagggggaagctaagacaattccttgggtcggctggcactactttgccttccgaaaaattaaagcagaaggagacaattccattggaactcacgtttgaattagaattttatgttaatgctgttttgcctaaatcagtatcttcttttattgctttaataccaaagacagatcaccctcagtcactgtctgagtatggtccaatatcactaattggaagcatcaacaagatcatgtcaaagttactagcgaacaggttgaagaaggctctatcttcaattatttccccaactccgggaagacagattatggacggtgtacttatcactaatgaactggtggactggggcaagcgtttcaacaggaaattccttatatttaaggatgatttccaaaaggcttatggctcagtctcgcttgg

SEQ ID NO: 71791 - DNA, 2457 bp, Glycine max
  Peptide Sequence Number=SeqID_188569
atggatttcctcctgacttttctcaagccttccctatctgtagagtatgaaagcacattagaaaattttggtggtgcccatgattgtctagacaccagtgagccagagcatcgtggagatagacaagcaaatgtggtgcgttctgttgctcccatcttaaatgaggagttgaagccaaaactgttgacacttctcccatgcatttttaaatgtattcagcattctcatgttgcagttagattagctgcttcacgctgcatcacttccatggcacagtcaatgactgtgaaagttatgggagctgtggttgaaaatgctatccctatgttggaagatgcatcatcagtttatgctcgacaaggagcaggcatgttgatcagttttcttgttcaggggctgggtgtagagttggtcccttatgctcctctattggtggttccgcttctaaggtgcatgagtgattgtgatcagtctgtcagacagagtgtgacccatagttttgcttctcttgtacctttacttcctttggcacgaggccttcctcaaccgattggattaggggaaggtgtatctagaaatgcagaagatttgcagtttttggagcaactacttgacaactctcatattgaagattacaagttgtgcactgaactgaaagtaacattgaggaggtatcagcaggaaggcataaattggttagcttttttgaaacgtttcaagcttcatggaattttatgtgatgacatgggacttggaaagacacttcaagcatcagcaattgtggcctctgatatagctgagcatcgaacttcaattgggaatgaggatcttctgccatctttaattatttgcccatcaactctagttgggcactgggcctttgagatagagaagtatattgatgtttctgttatctctagtcttcaatatgttggttctgctcaggagcgaatgcttcttcgggatcatttttgcaagcataatgtcatcataacatcatatgatgttgtccgtaaagatattgattttcttggacagctgctgtggaatcactgcatcttagatgaagggcatataatcaagaatgccaagtctaaagttacacttgccataaaacagctgaaagcgcaacaccgcttgatattgagtgggacacctatacagaataacataatggacttgtggtccctttttgattttttgatgcctggatttcttggaactgagagacagttccaagccacatatggaaaaccacttttagctgcaagagatccaaaatgttctgctagggatgctgaagcaggagcacttgccatggaggcactgcataagcaggtaatgcctttcctccttcgtaggacaaaggatgaagtcttgtctgatctgccagagaaaataattcaagacagatactgtgatttgagccctgtacaattgaaactttatgaacagtattctggttctcgtgtaaaacaagaaatatcatctgttgtaacatcgaatgagtctgctgcagcagaaggaagtagcagttctactaaagcatcttcacatgttttccaggcactccaatacttgctaaaactctgtagtcatccattgcttgtcattggtgagaagattccggagtcactttctactatcctctcagaactgtttcctgctggctctgatgttatttcagaacttcacaaactctatcactccccaaaattagttgctcttcatgagattcttgaagaatgtggaattggagttgacaattcaggttctgagggtgcggttaacgttgggcagcatagggtcttgatattcgctcaacataaggctttcctggatataattgaaagagatttgtttcagacacacatgaaaagtgtcacgtatttgcggttggatggatcagttgagccaggaaagcgttttgaaattgtcaaagctttcaattcagaccctaccattgatgtcttactgcttacaacacatgttggtgggcttggtttgaacctgacatctgcagatacccttgtttttgtggagcatgactggaatccgatgcgagaccttcaggctatggatagagcacacaggttaggtcagaaaaaagtagttaatgtccatcggctaataatgcgtggtactttggaagagaaagttatgagtctacaaaggttcaaagtctcagtggctaatgctgtcattaattctgaaaatgctagtatgaaaacaatgaatacagatcagttgcttgatttgtttgcatcagcagaaacctccaagaagggcgcatctgttttgaagagttcagagaacaactcttatggagacgctaagttagtaggctgtaggaagggattgaaatcaatactcgggggattggaggagctatgggaccaatcacaatatacagaggagtacaatctgcgtcaatttttagcaaggcttaatgactaa

SEQ ID NO: 71792 - DNA, 726 bp, Glycine max
  Peptide Sequence Number=SeqID_188570
atggtggttcttggcaccacctcaccttcaatttcctgcttgccgtcttcaactcaaaccgactacaaggcgcgtcgatactgttcttttccgcaacgcccacgcccacgcccacgcgcttcacgtttcttttgcggatcccctttcgctccaaatgccatccattctccttctctgtctgtgacgaatgaagcactgaatgttatgatttctggggctcctgcttctggtaaaggaacccagtgccacctcatcaccaacaagtacggtttggttcatattgctgctggagatttacttagggcagaaattgccactggaagtgataatggaaagcgagccaaacagtatatggagaagggacagttggtccctgacgaaattgttgtgatgatggttaaggagcgtctcttgaaaccagattcgaaagagaatggttggcttttggatggatatcccaggagcttatcacaggccactgcacttgaggctcttggctttcggcctcatatttttcttcttcttgaggtttctgaagatgttcttgtggagagagtagttggacggagattagatcctgttaccggcaagatatatcacttgaagtattctcctccagagacacaagaaatagccgcaaggcttacccaacgctttgatgatacagaagaaaaggcattcatcaatatatccctatatgaaactacaatcccttctttccactaa

SEQ ID NO: 71793 - DNA, 645 bp, Glycine max
  Peptide Sequence Number=SeqID_188571
atgggaggtccagtggcttttttcatatttttgtttaatctgtcttctaaaaggttttatgttgctgaagttctccttgcccaggagtatttgcacatgctaggagttgtatatagagacttgaagccagaaaatatcctggtacgagaagatggccacattatgcttacggattttaacttgtcactcagatgttgggtcaatccaatagtggtcaagtcatcttcaacaagtgtggatccaacaaagacgtccagctcatgttcgcaggctaactgcatgcaccctttctgtcttcaaccaaattggcatgtctcatgtactcctattttattaccaagtggagcaaaatctcaaaaaattaaggctgaaataagtggtcaggttggtccactgccacaacttatagtggagcctaccaatgctcgatcaaactcgtttgttggaacctatgaatatcttgctccggaaatcataaaaggtgagggtcatgggagttctgtagattggtggacttttggtatactattgtttgaacttttatacggtataactccattcaagggctctacaaatgaggatacattagccaatgttgtgtcacagagccttaagttcccagatactcccatagtgagtttttga

SEQ ID NO: 71794 - DNA, 999 bp, Glycine max
  Peptide Sequence Number=SeqID_188572
atggggagttctggaagtggcaccttattttccttgtctagcctcttgtgtgacgaagaaggagaagctagattgtttaaagaccaagatgagaaccctggcattttttactctcttgataactcatgtttcgttttggaggatgaagaggaatacattgagtatttgttcaaacaagaaacgggatttagatcccagaatcaccacttttttacctctgatgatcattcaaacagacactggttacgaagtgcccgtgttgatgccattgactggattttaaatacacaagcaaaatttgggttcaaagttgaaactgcctatttatcagtgacttactttgatcggtttctttcaaagcgatccatcgatgaatcgaaaccttgggctattaagttattatctgtggcatctttatctctggcagcaaagatggaagagcaaaatgtgccggttttatccgagtatccaatggatgattatcggtttgagaataaagtaattaagaacatggaactgatgattttgagtaccttggattggaaaatgggatcagcaactcctttttcctatttgcattactttgtcggcaagttctgccctggatccaaaccacaaataataatcacaaaagccactgaacacattgtggccatggtcaaagatgttaatttgatggatcaaagaccatctttaattgcctcggcagccatattggcagcttttgatgctacattaacaagaaaagcaatggatcttcgattaagtttaatctcatcgtggggaaatgtagaaagtggacatgtgtttttctgttacaatctaatacaggaaaagatgaaaagcaaagttaagacaccttgctcgaatttaatgtctgctcagtcgagctccacgtgtgttcttgagaaccaatctgacacttcttcgggagctaagagaaaacttagttttgaggacagtgaaaattgtgcgggacaaaagctacatcggccttag

SEQ ID NO: 71795 - DNA, 783 bp, Glycine max
  Peptide Sequence Number=SeqID_188573
atgactagcatgggcgagaattgttttaagcctctccaaaatactaagaaaataactccgatgccacctcccatgccccgttttgcagccacgagttgtccttgtaagtgtttggtgtcaaaaaattcaacaccaccaagagggcgcaacaataatgtctctccagcagcaatagaattttgggagcgtcttttttatcaaggttataaagcagatgtttgcattaatactgataacggtggcgttgtttatgctcattctaacattcttgccatgtctactcctgttttcaggggcatgttgaagcaagcaaattgtcatcgtcgatggcgaacaatctcaattactggggttccacatgatgcagttcaagtttttattcgattcttatacacttccagttatgagaaagaagaaatggatgaattcgtcctacctttgttggtgttgtcacatgtatacgtcgtccctcacttgaagcgtgaatgtgaacagaagttagaactgagtttactcaccatagataatgtggtggatgtatttcaacttgccctactttgtgatgcaccaagacttagccttatttgtcaccgaaaggtgctgaaaaacttcaaagttgtttcagaaacagaaggatggaaaacaatgaagttgagccacccagctctagaaaaggaaattgtcgagtcaatggtcgatgaagacatttgtttggatactcgggaattgaaaatggattttgttcgagggaaagacaaccatgtgaaagaaattcacacgtga

SEQ ID NO: 71796 - DNA, 357 bp, Glycine max
  Peptide Sequence Number=SeqID_188574
atgacaattagccgtttccaagaaagaaaaagaaaaaaattcacacgtcccctcctgcttggattcaaatcgtacttctggcagatgcagctgccacttttcctcgttattatttctatgttgttgaatgaaattttttgcaaggatcctaagcttacttatgctttcatggattgggacctagagacacaaagaaatattaggacacttcgccgatggcacgatattggtcatggtggacgctgtggaatcagcagacaaaatcgatgtcggattatagataatacgggcaacgaaataactcaatcggacgctgtggaacacatatttttggggcagcacggccagcaaaaatag

SEQ ID NO: 71797 - DNA, 677 bp, Glycine max
  Peptide Sequence Number=SeqID_188575
atggagaagaggcttcgttcatctctgcaatcctcagcgcaagagttcatatccttagccacaaagcaaaacctcaaatcttcaaaatcctctctgaaaaccctagtccattccatcaggctctcctcccctctctgctcttccctccctcccactctctccgattccatctccgcctcactccaatccttccaaaaccttctagaacccaactccgccgcgaacctcggctcccctcgcacccctccctccaagcgcccccgccgctcttcccgccgctccgaaccccaacccgaacccgccgacgagaaacataatatcctcgcacgccttgaaattctcggccatatcgcgctgctgtgcgtttcgcacccgagaaaaccgttctccctctacgatctgcttcccggcgttcaggcgctgcacgataatttaatcgtttttgagtcggaaccgtcgctctcgtcggccattgagggtttgtgtgaagaatggtggaaggagaacttggccggaagggaatcgttgatttcgcagagcctcccctttcttctgtcgaggtcgctgacattgaagaagaaggtggacgtgcacagggtctgcgtgcttcgcgaggcgttcgctctgttcgatttcgacgacgagagcatcgaggatttgaagctgttgttggttcg

SEQ ID NO: 71798 - DNA, 1263 bp, Glycine max
  Peptide Sequence Number=SeqID_188576
atggcggaaggggaagagcttcggcctgacttgctgaaaaacacgccttctaacattgcgagattggaggacgtgatcgaacactctaaagcaaggcaaaagtatctcgcccatacttctagctcctctgatggcggtgatgttcgctggtacttttgtaagatctctttggctcccaacgagttggcagcctctgtcccgccaacagagattgtaggcaagagtgactattttcgttttggcatgagagattctctcgctattgaagcatctttcttgcagagagaggaagaattgctttctagttggtggagggagtatgccgaatgtagtgaaggccccagagaacgacaaagttctagttccaaggcagatactgaatcttttatgggacatactcaatcatctcaactatatgaaatagaggaagagagggttggtgtccctgtaaagggaggactgtacgaggtagatttggtcaagagacattgtttccctgtttattggaatggagaaaaccgacgtgtcctcagaggccactggtttgctcgtaaagggggcctcgattggctaccacttcgtgaagatgttgctgaacaactagagattgcttatcgtagtcaggtttggcaccggagaacatttcaaccatcaggactttttgctgctcgagttgatttgcaaggctctacccaaggcctgcatgcccttttcatgggagaagatgatacctgggaagcctggctaaattttgatgcttctggcttttctagctttgttagttttgctggaaatggaattaaacttaggcgtggttactctccatcaaattcaccaaaaccaacccaggatgaactaaggcagcagaaggaggaggatatggatgattactgttcgcaggtccctgttcgacacttggtatttatggttcatgggattggtcaaagattggaaaagtccaatttggttgatgatgtgggcaatttccggcatattacagcaagtcttgcagagcagcaccttactccacatcaacgtggcactcaaagggtcctctttatcccatgccagtggagaagaggtttgaagctgagtggtgaaactgctgttgaaaagataactttggatggagtgcgaggattacgtgtcacgctgagcgcaactgttcatgatgtgttatactacatgagcccaatttactgtcaagacataattaactcggttggatggatttcaacagaacagaagagagatgtaatgtag

SEQ ID NO: 71799 - DNA, 1452 bp, Glycine max
  Peptide Sequence Number=SeqID_188577
atgaacaaggtgcttgaatttggagccttgttagcatctggaggacaggaatatgatattggaaatgataatataaagaacccaaaggagcgactggttcgtcagaagcaaaatcttcgacgtcgtttaggtttggatgtctgtgaacaatttgtggatatcagtgatgtaataagagatgaagatcttatggcatccaaatcagactcacatctgaacgggatagatcgtagactttttacttcttgttctgcacataacatccagaaaatggtttcaaacatggttcctagtgtcaaatcaaagtggccaagcgcaagagaattgaatcttttaaagcgtaaagcaaaaattaactctaaggaccaaacaaaaagctggtgtgaagatggaagtacagaggcgtcaggtgctcaaaatttgacttcgaaaggcacatgtcccgattcagtaaattacagtaaggcattcgtgggtgttaatcacgatgaagatggccttgaacatgatggggatggacaatggcctttccacacttttgttgagcaacttattattgatatgtttgatcctgtttgggaggtacgacatggcagcgtgatggcattgagagagattttagcacatcaaggtgcttctgctggagtatttaaacctgactcacgcatgggtgggaccttgtttattgaattagaagacaaaagtataccaaatatattgaagagagagagggaaattggtttaaatatgcaagtttcaacagatgagtttgtttcaaacttgaagaggccaaaacttgaagatgtatcatcatcaacctctatggatagtgtgatgacttgcaacaatgaagctgatattgaaatcagcattagttctgaaacccatggattcaatttggctttggattatgggaataggcaatttaatggtaattctgttgacatggattgctctgatggcttacatgatgcatgcaaggagcctgctaatatagcagaacagaatggttattctgatgataataaggttccctctgaaaatcttagtgtgctgagaaatcttcctcagaattgtgagctgatgcactcggttaaagtggttagaagttcctggcttcgaaactgtgaatttcttcaagactgtgtgttacgctttttgtgcgtgttgtcacttgatcgctttggagattatgtatctgatcaggttgttgctccagtgcgtgaaacctgtgcacaggctttaggtgctgcatttaagtatatgcatcccgcactagttaatgaaacattgaacatattgttgaaaatgcaggccagaatgggagattcgacatggcagtcttcttggtatcaaatatttggttgccgtacggcaggaagtagtgcaaggccattcgggctcctcctgctccttgctgccactgttttattcccagctttgatgcattga

SEQ ID NO: 71800 - DNA, 702 bp, Glycine max
  Peptide Sequence Number=SeqID_188578
atggctgcatacatctaccctgcccagtgcccagacctcaataagcgggagcctcgtgctttggctcaccttatgtcatacttcatgattcaactaaaggctaaagccaacattttgaacaatgaaatagatttagttcaatctggccatcaattttgtaataaattctttgaagtagctgaatctcagtactggcatcgatacacaatcatacttcattttagtttagaggttattcagagaatagatggtgtaatgaatctgctggcagaaatctattctcaagaagatatggccccaaagatgtacaaagtttttaaattggcagaaaatgaaatggaaaatggagtaggtggttgtggtgatgttgatggagaagaaaatccttatgtgctttcaacattggcaccacgtttgtggccctttatgaggcacagtatcacatctgttcgttattctgcgatacggactttggagaggctacttgaagctggatataagagaagcatgtctgagttgtctagtgtttcgttctggccctcttttatatttggagatacccttagaattgtcttccagaatcttctattggaaacaaatgaggatattttgcgatgttccgagagagtttggagtctccttgttcagaggccaaaagaagatttatgtcttgttgtttcacattctgttagctctatgtga

SEQ ID NO: 71801 - DNA, 255 bp, Glycine max
  Peptide Sequence Number=SeqID_188579
atgcccacatcttcaaaggcgtaccttagccatttagtttgtgtaatgggggtaggatcaggtttgtggcttctctttggtggtgctctcctcatggttgtttttgggagcaagttcaacaatccagggcgagtaaaaatggattgcgaagagctggatacacctagggaaaaacacgtgactatagaaattgaaaggaaaaggcaaacagatcgtgagtttggattggctccattgttttataccgagaaataa

SEQ ID NO: 71802 - DNA, 1896 bp, Glycine max
  Peptide Sequence Number=SeqID_188580
atgattcgatcgcaaattccgttcgggaggaagtcgatgctggaggcttatggggatattctgtttcgggcgtggcgagctgcgcaaggggagtcgaggactgagattgagaatgggttcttgcaggaaatgattgaggctgccatacacgctggttccggagcttttgcttcgtatattaggagggttttggaagcttttattaaccagaggaccaccgatggggttgagaaaatgctttatcgactcgccgagcctgtcatatttaggtctctacaggttgcaaactcaaatgttcgtcaaaatgctttgcatctacttctggacatgttcccccttgaagatcccgatgccacaaaagaggagaaagatacattgcttgataagcagttctttttattagaaaggctacttacagatgattgtccggaagtgagaacaattgctgttgagggttcttgtcgcgtccttcatctgttttgggaagttattccttcaccaatcataacaaagatgataacaaaaatagttgatgatatatcacatgatggatgcaatgaggttaggctttctatgttgaatggcatcatttatttacttggcaacccccactctcacgaaattcttaaggtgctgttgccaagacttcggcacctaatgctggacaaggtcctagcaatacgagttgctgcagtggatctcttactccatctaaaggatgttcgagattttcagttcaacaaggtggtggagctagatgtgctattgtctgcgcttgcaagtgatcaacctcccgtagctcagaagataacaaaattacttctaccttcgtactttccctcaaaagtacctattgaggaggcatgtaatcgctgtgttacacttgtaaaaagggctccaatggctggcgcaagattttgccagtttgctatcttggaaggagcatctaaatctcatcttatggaactggtcaaagtatttctgagtttgattttgtcaccagataagctagatgcaaatcagattgagggtttccttgttgctactagctatgtttgtgatagcttggcttgtgagccatgctatataaatgctctcaaagagttactcgatggagagaaaatgaaaggtttactaactctggcatctaaaggccaagcccaatcttctttattcaacattgtttccaatgtccgtccagatgatgttgctggaattcttgaagaatgcatgagtgttgtcacaaactgcagtggtttacccgaggatgttgatcgacaaactgaaatcaggtctgcacacaagttgttgctttcactgggtggttttgatgacttgattgaagccttaacggccttcttgcataaggctgcctatcgttgccacattaaatttggtgtagacatgccatctcatagtgtttcatttgctaaaagaaagaaatctaagtcctctggaaaattttcaattaaatcaaagataattaacagaaaacaatcgtttgaggatgattatttagtagctgttggggtgacatggcaagttagagatttgcttctgcaagaagataccagaaaagctattttggaatctccgagtttagagatgttgtttgtttctcttaaggtgatttctgaggtcagcattgtgcattgcgggcaccacgaatacatagacatatgtcctgttttggcatatgttgcctttgctctccaaatgactgttgataatgttggcagaagtagcatacacaacagtgatacaaagaggaagaaaactaagattgattcttctacattattgtcagaggcaaaatatcttggagctgacaatagagcatgtgctcaactgtttagaaaaactatttggagctggtggcatcatgaaaaatcatga

SEQ ID NO: 71803 - DNA, 330 bp, Glycine max
  Peptide Sequence Number=SeqID_188581
atgtctcttccccggtttctaaacagggtactaatagcagaacaagtaatagcaccctttcttggaagtttggcaccaccaacttctttgaatggaatttcgtggaaagagaccaagagaggaagaaaatgctctattattaatgtcagtaatcaatcatgcatcagaacgcgtaaagatattttcaagataaagaaacacaaaaaacctaaaaggagtccaatgactcggtaccttatggcccctcttaaaggccatgaacgtcaccaaagaggcaaagacgagtcttttgggtcactacgggctgtgtttagtttcaaagagaaataa

SEQ ID NO: 71804 - DNA, 732 bp, Glycine max
  Peptide Sequence Number=SeqID_188582
atgtcgtgcaagatattgaatgaagaagttgattcccatgcctctcaacaagacaaaaatagcatggagggaaaaacaacaaatgatgaagcaaaattagcaagagaaacaacgattgaaaaggttatagaggaagaagttgatccatcaacaaagagggagaagcacaaggaaaatagtgtgacgaatgtggactgcgaagacaattttcttgataacccaataacaaatttgatcaaaaaggaagtcgaagttggtgatgcaaccgagcctcattcttttcaagattcaaatatccataaaaaagattgctatgatgaaacaaaaatcactctcggaccaaaattcgatcatgaaggtggttggaacatcaatgacattggaatcatggaatttcaacttgctggctcagcaatggagctaaggcaaaaggaatatattgagtcggtcatggtgattaaagttatatggaatccacccttgtctctcccaccatcgaagccgccagacctcaatttgcatgcaggggcagtgagtgggtcgttcctagttaagctacaaggggtgcagttgtcttccagcaatcagagaaaacttgagaaagtttcaacatgcaattctaattttcaaattccaaccttgtggacaaggttgacttttaggagaggtgtattgttaggatataaggagaagggagaattagttaatatagttagactactaatgagttag

SEQ ID NO: 71805 - DNA, 864 bp, Glycine max
  Peptide Sequence Number=SeqID_188583
atgatcattgaatgtttgtgttctggaggcaaggttttagaagctgaggcgtattttaacagtctggaagatacgaatattgaaatctactctgccatggtgaatggcttttgcgaagcagacctcgtcaaaacatcatatgaagttttccttaagctgtcaaaccaaggagatatggctaaagaagcttcctgttttaagctacttaataaactctgcatgacagctgcactgtgccaggctggggatatgaagaatgctcgcactttgtttgatgttttcgttaatagaggattcactcctgatgttgatgaattgcttgctgggagcttaaaagcatatttacataaacgtttctctcctcatggaaaaggaaagacaacatcactttatgtttccaccatcttgagagatatggagcaaatggaaataaatccggatgttgtttgttacactgtgttgattgatggactcatgaagacagataactttcaacaagcagtaagcctctttgataaaatgattgagagtggactagaaccagatactgtaacatacattgctttggtctctggcttatgtaacagagggcacatggagaaagctgttacactgcttaatgaaatgtcttctaagggaatgataccagatgctacacatcaatgcaggaaccagaagaagaagaagaacaagaagatgaatatgcttcggattggacattacgacaatggaatcttctcaatttgggatttgaggccaaaacaaaataggaattgttttagtatggaatcggaatcaatcaaaacgacaagcaacgagacctgccgcgaactcaaaacggagaaatgcataactaacggttaa

SEQ ID NO: 71806 - DNA, 372 bp, Glycine max
  Peptide Sequence Number=SeqID_188584
atgagttgtggggagtttgagggatatgagcggcagtattgcgagctttcagcaaatctatcaaaagcatgcattgataatgtagctgctcctcttaatggagagctaaagaaacaaaaaaaatctgaaataaaggagggaattgaggagggagaagctttgattcgaaaaatggaccttgatgcaagaagtttacagccagacttgaaggctgtgcttcttgctaaggtgagggagtacaaagcagatctgaacaacattaaaagagaagtgaagaaaattatatctgctgacttaaacccttcttctgcaagggatgagttgttggaatcgaccatgacaaatgctatgatgaagctattcgaggagtaa

SEQ ID NO: 71807 - DNA, 564 bp, Glycine max
  Peptide Sequence Number=SeqID_188585
atggccatttctagacaacccagccgccagtacatatcatgttttaaaccctttcccttaatttccttaaacatgctaaacacagtaacaaagatcatcctaaaggcagtacacattgataagcgtcgtgtagtgcttaacatccaaacccaagcacttactcttcatctcctccaccatctctaccgcatcctccactttccccaacttacacaaagcatcaaacacattgtgttaggccacctcatcgagaaacatcccggattccttaaactgatccaccacctccaaagaagaggagggcggtggtggtggttgatgaggtggagaaagagggtgtctagttggcgttatggggacgtaggtgtggatggtgtgagagaaaccggtgtggcggaggtgtgtgaagaaggagagagcgtgggagggggtgttgtggagatggtttggagaacatcgaaggtggagaaagaagaggaaggtgtgaaaggggtgttggagtgggcgagtgcggtggaggcaaatgggtgccaaagggtggtcaaggtgggcttgtgtttgtga

SEQ ID NO: 71808 - DNA, 156 bp, Glycine max
  Peptide Sequence Number=SeqID_188586
atggcttcacttgtaactaacaaggtagagtctaggaaatggtctgttgatgctataaggcaatgttaccttcagcttctcacttgtttcagattatatttgattatcctctgtgctgcatgtcctcttgatatccgcatgaattccagcccttct

SEQ ID NO: 71809 - DNA, 360 bp, Glycine max
  Peptide Sequence Number=SeqID_188587
atgaaaactaaaatacctgaatatccgcccatatcaaatccttctgagcaacagggacttacatccaattctcgatcgacgtggaccactggtctctctgccccagctggtctagttgccaatgatcttagtcgcctggcttttcttgtccacttcaagctaagcgaggcttgtgcgcttagcgagaatcatgcgctaagcgaggcactcagcccacttagcgagttgggagaatttggaggagaatctgagaagcatttgtgcgctcagtgcgtcattagctcgctctgcaaggagtctgtctcttcccattctaagcgcgcccagctcgctcaacagatattcactaactcgggctaa

SEQ ID NO: 71810 - DNA, 273 bp, Glycine max
  Peptide Sequence Number=SeqID_188588
atgtctcttgccactctctttgggaaacttcaagaacatgaaatggaatttatgagactctatcaacacgaagagaatgaaaaaaagaggaaaggaattgcactcaaaacttcatcttcttctattcatgaggaaaatatcaaaaaagactcaaatgaaaagaacttagaagaagatgatgatttcaatctctttgtgaagagattcaataaatttctgaaaaacaaaggaaatcaaaagagatcaaacttcaatccaaaaaggaaaggataa

SEQ ID NO: 71811 - DNA, 255 bp, Glycine max
  Peptide Sequence Number=SeqID_188589
aataagttgctttctaagcaacttgagattttaatagaaacacttggttacaggttgtaccatctgacaagggtatactcaaggagcagcagggtccttataatcaacaataacagtggaggtcacaccctggcaacaatatcaaatcataaaagcactaagtcagcactgaagaaccttcaggtccaggtgggacaactggccaagcagatagctgacaagtcatccaacagttttgtggcaaatacagaataa

SEQ ID NO: 71812 - DNA, 240 bp, Glycine max
  Peptide Sequence Number=SeqID_188590
atggatgagtttgacctgcaggtggcctggctaggagcccagccttctccttttggagggggtggggcctccgcagcccaggagcttgttcctgaggagccagcaacagcaacaacagagggggaggatgagctcacccttcctgagcccttttattttgatgctcatgagaaccctaaggccttctcttgcatctatggcccgatcttcttggagtcttctatccaatgcccttgcggg

SEQ ID NO: 71813 - DNA, 1107 bp, Glycine max
  Peptide Sequence Number=SeqID_188591
atggcctgtgcagtccagcggcgcttgtcagccacgcaggcgatcagcgggtcggtagcctgcgggcagtccatcatgtcgcgggtgccggtaatgccattggccagcatcagtgcgaactgcagttgcggtgacagctgctgtgcatgggtatgcatgtcccagaagccgggcaccagcctgcggccaccggcatcgagcactggcaatgtggtgtcccgtggagctttgccaatggcagtgatcgtgccgtcgcgcactgtcactgtggtgggggcgctgacctggccacgcgcgacgtccaccacccgcgcgttgactatcacgcggctgttgcccggctcgggcaacggcggtgccgacagcggccagagcagagcggcggcgaacagcaatggcggtgccagcaggaggatggccagaacgatcggccatcgccgacggtgggcggaacggggcaacgcaacgtgctgcatccatgatccggcattccttgcattgggtcgtccgcagggtgctgcaagccggacacgggcgccagtgaccatcggcatctggccctgcctggctccggggcggttaccctgtgcggtggaactcctgatcacgccctgccatgtccatcgtcctgaccgatttcgcccgtccccgcctgttcccgcgcgtgccgcgcggcaacaccatccaggactgcactgccaagcattgttcgtctatgagaactggaccagcacgcgctgcctgacggtgccggtcaccgaggccaaccgccatctgctgcgcagcggctacgaagcgcgcaaccgtgaggaactgccggtactggtgcgctggttcgagggtgtggagtccccgcgcgcgaactacctggtggtgatcctgtacagcgccgggcagctggcgaaggaaggttcaccgatcgaggccgactggggcatcgtcggctgcatctacaccgccgaaccggaagaggtgccgatggcgccgatcacgatgatgcgcaatgcgctgggcgtggaggagggcggttccggtgtgccgctggaccgggaggcctaccggcgctcggtggagttctgggagaacaacgccaactggcggccctga

SEQ ID NO: 71814 - DNA, 347 bp, Glycine max
  Peptide Sequence Number=SeqID_188592
atggatgttcgacgttggatgccgtttgcatgggtcgccgcaggcctgttggccgcaagtgaaagctcggcagcaaagtacgatgcaggcgctgcctgtggggccctgtccgacgtgacgcagatccgcgacgcgggcgtggggtcactgcaggctcaggcaacctcggggcgttgcacgttccatgtggaagcggatgacgcagcagcgctttcgcgtcagcagtcattgctccagagcgtgtcggcgattgcctgtggtgggccagccaccacccggccttcgcaaggggctgcgggcttcgacctgcagatgcctgcgcgttgcccgctctcttccagcacgcc

SEQ ID NO: 71815 - DNA, 1152 bp, Glycine max
  Peptide Sequence Number=SeqID_188593
atggagcactcagatacacctcacatattagctataccctttccagcagaaggacacatcaaacccatgtttaatttagccaaacttctttcccatagaggccacagaatcaccttcgtgaacacacatcacaaccacaatcgcctcctccaattcacagatttaccctcattccacactcaatttcccgatttcctctttgcatccatcactgatggcataccctctgacgatcctagaaaaggtgccctactaaactaccttccaatgcttatcactcctagcgccagatccttagttgccaaagagttccgagaattgttcttaagacttctcgagaaaaatggtgatcggtggcagcaaccatcttgcatcatagttgatggactaatgtcaacgattgtcatgggagttgcacaagagtttaggattccagtgattgctttccgaacctacagtgccacttgcacttgggtcacaatcttcatgagtaaacttgctcaggagggagcacaactgcttcggagtaatcaaggattagagaatttattgagaaactgtgactttccctatcccggcgggatgagggacttaattgtcgaagaaaccttagccatgacccaagcttcagctattatactcaatacttttgagcaacttgaaccctccattatcactaagcttgctactatatttcccaaagtgtattctattggtcctattcacactctctgcaagaccatgatcacaaccaatagtaattcatcaccccacaaagatggtcgtttgagaaaagaagatagaagctgcataacttggctggaccaccaaaaagcaaagtcagttttgtatgttagctttggtactgtggtgaagctatcacatgagcaattaatggagttttggcatggtttggtgaacagtttgaagcctttcttgttggtactccaaaaggacttaataatccaaaaaaatgtacctatagagcttgagatagggactaaagaaaggggttttttgtggaagattggtctcaatatgaatgggtcgtgtgatagattctttgtagaaaagatggtgagagatataatggagaatgaagatctcatgagattagcaaatgatgttgctaaaaaagctcttcatggttaa

SEQ ID NO: 71816 - DNA, 516 bp, Glycine max
  Peptide Sequence Number=SeqID_188594
atggagcctgtcaaggtagttatgagaaaaactaataacagaaagattcctattatctctactgaatctggaaattcaagaacttcgggatctcgctttgatgttatttctgataatgggaaacaagtttttgaatccacaaattatgttgacattgaagcagcatttaattcaaagtgtagggtccatggaggggataattcaggaatctttggctgcatcaggaagcaaaaagaatatggccctacattagcatctcgaattatgcaagctaatttcaaaggagataatgagaaacaggtcaaggtttggaatgtatttggcaggaagaatccacaaagaggaaaaggaaaagaacttaataaagaagggaaggcaaattttaaaaagaataatactcctaaaataaaatataaggagcaggtgggtgttgtgataaaagtcacagtgagtgcgaaagaagtaccagttgaggaaaagaagaaacgaaactatgacgaaatctttaacttctaa

SEQ ID NO: 71817 - DNA, 675 bp, Glycine max
  Peptide Sequence Number=SeqID_188595
atgggtctatctcctaaagatgccacttgggaaaggtgggatgagctttcacaatcttttcaccttgaggacaaggtgattttcccaagggatggcaatgatagtgcgactaaccacaccgaggctaccaacaatgacaatttaacagacgaagggaaggaggaaatcaattacagtaggcccaagaggaaccaatatgtttcaaggattagaaatagagcagtggagaaaatcctcaatgggattggagtaggttgggcatgcagcattattggccatgttgcgtctaaatcccactgcattggtgggcaaagagttatgaaggatcaactagatcattatgtgaatctttcttgggactttaagcttctagagccatttaaaagatgcatagtggtcagctgtagagctggggagggacatctccacaaaattccgagggactcgagtgtgaaggtcgtttatgttccaatggccctcatgaatgaggttcttgagacacagatcaatgtcttcaatgacaaaactaactttttggcacataatccagcagcagatcagttattgaaccacaaagaggtctcccccgagtctagtcgaaacttgaatccttcaagatgcgtcatttactctgagcaaaagcaattccaactgccggaaaaaaaaataccgtga

SEQ ID NO: 71818 - DNA, 882 bp, Glycine max
  Peptide Sequence Number=SeqID_188596
atgcgttttaatccgattatcaccggactgctggccgcgacactgttcagtgcgccatttgtgcaggccaaagaactgaaatccatcggcgtgacggtgggcgatttggctaacccgttcttcgtccagatcaccaaaggggcggagctcaaggcgcgtcagctggcgggcgataaggtcaacgtgacgctggtctccagcggctatgatcttggccagcaggtagcgcagattgacaacttcattgccgctaaagtggacatgatcatcctcaacgctgccgactccaaaggcatcgcgccggcggtgaagcgtgcgcgtgatgccggcatcgtggtagtggcggtggacgtggccgcggacggtgccaatgccaccatcacctctgacaacacccaggccggggccatggcctgtaaatacatctccgaccgcctgaaagccaaaggcaacgtggtcatcatcaacggaccaccggtgtcagcggtgcagaaccgcgtggaaggctgcatgaatgagctgaaaacccacccggatatcaaactgctctcttacaaccagaacgccaaaggcagtcgcgaaggcggactggaagtgatgaccggtctgctgtcggccaatccgaagatagatgccgtgttcgccatcaacgatcctaccgctatcggtgccgatctggcggcgaaacaggcgcagcgtagcgaattctttatcgtcggcgtcgatggatcgccagacggcgaagaggcgctgaagcgcaaaggctcgctgtttgtcgcaacgcctgcccaggatccgcaggtgatggcggccaaagcagttgagattggctatgacatcctgcagggcaagccagcgccggataagccggtgctgattccg

SEQ ID NO: 71819 - DNA, 365 bp, Glycine max
  Peptide Sequence Number=SeqID_188597
atggggaagacacatgaaataccccaccacaatctagccaactttgagccttgccttggatacgccactaaagggcaagcagttggtggtgtacccctgccaaacagacatatgagcaacttgagtattcaccctggtgctaccaagatgtatcaggatctcaaaacgatgttttggtggtccaacatgaagataaaggttagtgaactcatcttctccttgaagtggcatctccaatcatctttcttccttctccattccactgccattgatcttcaagaagcaaaagactacattgatgaagaacatctaaggcctacaagttccacatggagctacgtcatgtgcttaggtgcattaggcat

SEQ ID NO: 71820 - DNA, 294 bp, Glycine max
  Peptide Sequence Number=SeqID_188598
atgtggtgggttgctcttgagtccactatccaatctgagggattgaatgaggattacttctttgtatttctatccaatatcatcgagagtgtgaatgacgagattgacatcatccatgggagtgatgacattggcaagttcatttgcaatggatttgataccttgaaggaattcagtgatagatctgatgatgtagctccatgtggagcttgtaggccttggatcttcttaatcaatggagtcctttgcttcttgaagatgaatggcagtgcaatggagaaggaagaaagatga

SEQ ID NO: 71821 - DNA, 318 bp, Glycine max
  Peptide Sequence Number=SeqID_188599
atgacccctactcgtgatgtcctgctatattacaatgggaggtggaacatgtcacgccaaaatgagtttgttggttactcgttcacaggaaaaaatcccaaaaagtttgacattcccaccggatgtaccatggatgaactgaaggatttgatcaagcaagttgcacctcctgggattcccccttatggtattgatgaaacacaaatggtgttgactaagtctaactactggaaaaagattgggccaatagaaattttagctgttttcagtaaacttgtaccggaaatggaagacgagttgtccttgtcgcaaaattag

SEQ ID NO: 71822 - DNA, 828 bp, Glycine max
  Peptide Sequence Number=SeqID_188600
atgtacgcctgggtaacgctgttaacgcagccggaatattatgtcggggtgaaagcgctgcatcgctcactcaaacgcagcgaaacgcgctggccgctgattgtgatggtcaccgatgccatcgacctgagcatgcgcgaagcattacaggcgctgggctgcgtgatccatccggtccagccgctgatgccggacgccgcgctggagcagcattatgcctcggcacagtttggtgaagtgtggagcaaactgcgcgcctgggagctgaccggctgcgagcgcgtggtgtttcttgatgccgatatgctggtgctgcgcaacatggatgagctatttaccctcgacctcggcaagcatgcgctggcggcctgtcacgcctgccgctgcaatccgaatcaaatcgccagctatcctgaaagctggcagccggagcattgtcactacacctggcaggcgcgcggtgaaacgcctcccgccgatcttgataactatctcaacggcggctttctggtgctgcagccggatcaggcggttttcgactggctgcagcagaaagtggctgagattggcgacctgcgccgctatccgttctctgaacaggatttgctcaatgaagtgtttgccgggcgctggctgccgctgccgtacatttataacgcgctgaaaaccctgccgttccagcatgccggcttatggcatgacgatgaggtgaagaatctgcactacattctcgccaagccgtggaaacgcgacctgaaccagccagaggcgcagcgcgaccgttattacgcgctggataagctgtggtgggaattgggcgcggattaa

SEQ ID NO: 71823 - DNA, 587 bp, Glycine max
  Peptide Sequence Number=SeqID_188601
accgtgcgcgctggaagctaccccatgcatcaccggtagcagccagcttcaatagcagccataaactgagcagatcgctgctggagtgctggacgcagatcctgcgcgaggcgcctgatgcactcttgctggtctgcctggcaccacaggcacaccgcggattcctgcaatcgtgggacctgctcgggggagaccgcgaccggcttcgcctgctgtcgccgatgccggccgagcaatacctggaatgcatggcgtcatgcgatctgttccttgatgcattcaattaccaggccggtgcgactgcgattgatgcagcatcggcagggttgccactactgacctgccccggagagctgccgctttcgcgactggggagcagtgtgaacaggcaactgggaatgcccgaactgatctgcaacggacaccatgattatgtgcagcgcgcagtgacactgctccgtaacccggctgcgctttcagaactccgccagcgggtcaccgtccgcaacaaggacagtgcgttgcattcggcagcacgtgcggctaccgatcttcaagcgctttatcaagacctgctgggggagtga

SEQ ID NO: 71824 - DNA, 633 bp, Glycine max
  Peptide Sequence Number=SeqID_188602
atggtattggaagcctcgcaactttcccgctacgcggatgagttgaaaacgaccggcagtacgttgatcccgatgggcgttgtgtttgacgcctcgacattgaaagagcttgaaaggctccagtcgttgctgcctgaagaggccgtcacgcagggcgacgcaggcgacacgcacgacatctacgtgcgtcgcatcatggttgatcggcaaggcgaggttccgcaggtggtcaatcgcccgcacgcagaccagatcctggggatcctcaaccgggaggagtgccggaacgcgattgcagaactgttccagtcacaggatgccttccatatccgtcgggcacagatgaaccgcatgacggcgggttccttcatcggcctgcatctggatgctgccagcaatccggactatgactactcgatgatcatccagttggggcacgatttcgcaggcggtgattttgtcgtccacgacgatgccggtgcgcgccatgcctatgcggcgacctacggcacggtgctgcttacgacctgcaagttgcggcacgaggtggcacgggtgacggccggcgagcgcaatgcgctggtctatttctattcgcggcacgatggcgccaatcgtcgccacgacgcctga

SEQ ID NO: 71825 - DNA, 267 bp, Glycine max
  Peptide Sequence Number=SeqID_188603
gccgctggcctgcctgaattcggctgcacgttgtcgcgtcgtggctggggacgcggcatcgcccaggaggccactgccggcgtgctggaatggatggatcgcgttgctcggatcgaagccacttcagcgattaccgatctccgcaaccgatcggcgctggcgttggccaacgccgtcggctatagcatcgtcgaggaaatggattttgaaggcaatccattcgcagtgctcacacgcacctccagcctcacgacgctcacttcatga

SEQ ID NO: 71826 - DNA, 147 bp, Glycine max
  Peptide Sequence Number=SeqID_188604
atggccagtattgccaccgttgttgctgttgtggtagagcttcccagttatcttgtatcagaatatcagcctaatgtgcctggaataagtgatcgtcagacagttatacaatgtaatgctctgctagttcttcctatgattgtataa

SEQ ID NO: 71827 - DNA, 1302 bp, Glycine max
  Peptide Sequence Number=SeqID_188605
atgactatggcattgaaagaggctattaaaatagagttgtcacataaaggatccctagagtcactaataattcagccggaactacaacaattaggcgcgcgtgtcagcactaagggaagtaatgctcaaagcaatgcccagccttcacgggaatatgatggtgatgtgataccaaagatgggactgtatgtgcaacgtaaggatggtacactagggttggtggccatggggagaataatggatagggattcagtgatacgcactgtggcttatgcagatgatgttgtaagggtaagtgtggatacagttatcgatcctgacgctgagatcccctatgccacctcagaaattcaatatgtgaagcagacccttcatacatttgtagcttggcccacagaccttgttaaacttgtattagatgaggatgaagtaattattccgcacaaagtggatgcacatggagataagccgactaatgtggaagcagatgatccaatgcgtggcctgataaagtacagctttgatatttacaacaacccagtggaattcaaatttgatgggagtaaatttggaattgtagatgcacctacatcgatattcctaacatattctgatgttagtgaaataatagcaggagacaaaagtttgaacatatctgtacaacaattatggttgatgtatatgcatgagtggagtgaaaccttgggtcaaggttccaactatgcattccttgagccacagtcgttggtggtttcaaaggatacacatggcgaatgcgaaaaatatcttgaaagatggctgaaggaatctgaccgagaggtgtacattggaccttacttccatcatgtaatgaccaaattaaagacgggtttgtctcctgaaagtaaggcagctgcacctaagtggattgaagttaagagtcacattcaaatcggattttatgaatgtggatattacgtgatgcattggatgtggaacatcataaccagcgacatcaagagtgattggtccatgtggtttggtgatgagacaccattggacaaggacaacatcacaacaattcgaaagaaatggacaagatattttttaaagactgcgtatgacatgatcactattggaacctccttcattacagaagaggttccaggatactcttcattgcgcagaaatctattgcatcttgcaccaagctttctacagtggcaaataacttatgctgcttctatctaccctgaattcataggtataattttggttggagtcatgggaaagagaaacttgaatttgggaagccaaccttaa

SEQ ID NO: 71828 - DNA, 132 bp, Glycine max
  Peptide Sequence Number=SeqID_188606
atgggaatcatgggtgtagtgttcgtgcaaaattcaacattaggaatgggagatcgaggaaagcacgaggatttgcaaatgacgatttggacgggcatgcaacacatgacactagagccatttaagaagtga

SEQ ID NO: 71829 - DNA, 126 bp, Glycine max
  Peptide Sequence Number=SeqID_188607
atggactcattaaggagacatgaagcaaatctcaccaagagattgtcaaccgggaatggtgttgtggcggtagtggtgcggcggagcaatggtggtggtgtggcagagcaggattggcggagagag

SEQ ID NO: 71830 - DNA, 198 bp, Glycine max
  Peptide Sequence Number=SeqID_188608
atgagttcaagtcattgggtagtaattgaatgttgcctacagctaagacatgggcatcgaattctgtcaacaactgacagagaggttactatagatgcagcaactgaaaggaaacaagttgagaggagcagaatagaccttaacatgttggtcattacttacacgtcagaccacaaccatccatggccaacacactaa

SEQ ID NO: 71831 - DNA, 369 bp, Glycine max
  Peptide Sequence Number=SeqID_188609
atgggagaaatcaaggaagagtgcacgagccccgacaagaggaaggtggcgttgtactcgagcggggagagcaaggcaatcgcgagtgcgtgcgaaacggcgtcatcgcttggaagcatcggccccgaactatcgcatctcaggtgggggatgtggtacaagctccgagaactcgaagccgccactaatgggttgtgcgaagagaacgtcaacggcgaaggtggctacggaagtgtgtaccgtggcttgtttcccaatggcaccaaggttgctggagacctggatctgatttgcccaaaggaaggatacttcttcttgttcttatttttaatcgatttcaccttgatacattctgtcagcagcccataa

SEQ ID NO: 71832 - DNA, 249 bp, Glycine max
  Peptide Sequence Number=SeqID_188610
atggcaaggaatacaactgacaatttgcaatacaaaacaaaaaaccaaaaacatcgacaaccttaccttcacgaacagttgcaagtggcaacaccactcaaaagggcacgacttcggctacgtggcggtggtgggaacagcacgaggttcggaggtcggaaaacgcgacaatgtagggttccttttgtggaggtcagggaaagggcacaatgtcagggtggtgcgagggacacagtcgacgggagctga

SEQ ID NO: 71833 - DNA, 185 bp, Glycine max
  Peptide Sequence Number=SeqID_188611
agagtgctcatcgcccccaagaaggtcatcaggcccctattaacagggctttcatcaagaagtactacgcccctaggcaggcacagggtgaaacaccacagcagcctagggatggccagcagcgggcaataagcgcgccgccaccacctctagagttcacctcagctcatccacaaaaaggttag

SEQ ID NO: 71834 - DNA, 591 bp, Glycine max
  Peptide Sequence Number=SeqID_188612
atggctagaatcatgagtgagatagaggaagttcaagaacagatgaaggccaacatcgaggccatgaaagatcaaatcaccaccatgatgaaggccatgatgagtatgaggaaaattatgaaagtcaacgcggttgcagtcgctactacaagtgtcgccgtggaggtggacccgactcacccatttggcattaatcaagtaaatcgcccagtccccgatatggtaggtcagggaggcaaagcattgggaagtatgggcgacccccatttagtgcaggtcccgagaaagcatcccttcccaccgtatgccctgcctcccaactatgcaccacctaatgttgtacatctgcccgatgagaacgttgaccactccgctcctataccccttgagagccaacaaccccagtctggccatgcacatgtctttcaacccatgtgggagacacccaaagttcctcgagaccacactctagccgacttcgagcctcacctcggatgtgccagtgaggggcaagcatttggtggcgtaccccagccaaacactttggggggctccttagtatcgcccacaaccctttacattttgtggtag

SEQ ID NO: 71835 - DNA, 326 bp, Glycine max
  Peptide Sequence Number=SeqID_188613
ttgtcgaggaacgcctacgaagcattgggaaggctagtggtggtaccattggtatccttgaggatttacatatgtgtgaatccacatcaagccggagctattacaaactccatgttgtggtggtgacccccacatacatatttcctaacgatgccccaattactctgagatcatatctagtgtcaccccaatggtttttctttgacatgtttcattttgcggatttgccgtgttgttgctgctgcaccatgcttaagagacacgtcaaacggattcatccacatgttggagatctccatggagttgagtctacttatatggcataa

SEQ ID NO: 71836 - DNA, 150 bp, Glycine max
  Peptide Sequence Number=SeqID_188614
atgggtgaatacaaccaactatcattaagaatctcatccttataccaaaaacaggcaaaaggtggaataccgcaaagagaaagcgtacccactaaaaaggaagtttttgtaattgctggagaatatccgacaagagcttccattgaatga

SEQ ID NO: 71837 - DNA, 546 bp, Glycine max
  Peptide Sequence Number=SeqID_188615
atgggttttcattcttacctccacattgataatgctctcattgccatgtattccaaatgtagggcaattgatgatgccttgtacatatttgaaaatatggtgagcagggatgttgtcacatggaacactatgatcagtggctatccacaacatgggcttgcacaagaggcaattatactctttgaagagatgataaagcaaggttttaatccacatgctgttacttaccatggtgttttatcctcgtgtcggcatggaggtcttccagagctagatgattattctcgcattgcagatcatcttggttgggctggtttacttctggagactcgtgatttcgtcgaaaatatgcctatttctcccaatgctgtaatatggggatcactgtttttttcctctaggcttcatggaagtgttcagtttggcatccaggcagcagaggataaggcggttaggctcatccttcaaacccattgtttgttgcttggtccacatcaaaataaaatccctgcaagcttcaatgacaacaggggtgctactaaatga

SEQ ID NO: 71838 - DNA, 561 bp, Glycine max
  Peptide Sequence Number=SeqID_188616
atgtatgccatcatttgccatttacagagtgttgttagtagcataaggcctatcttgagaccaatattagataatcgctcctccagatcatcacttgtagatggttttgatagtctggaggagggtggtctaagggcttcttcttcttactcacgtgaaattaatgagcatgataatgataaagccatagagagtttggaggacagagtttcgtttctgaaacgattaaccggtgatatacatgaggaggttgagagtcataaccagttgcttgatcgggtgggaatcaaaatggatggatcaaggggtatgatgatgggaaccatggatcgattcaagaatgtttttgagaagaaatcagcaaggaaaacatgctcacttgtggttatgcctttcacgctttgccctgacatgactgaaataactatctatggagacaaaaatcttggcccttttagatgtttatactttggtagattcataaacaaggtagtctttaagaaaaatcaaactatcaggcattttttcttgtgcttatccttgagcttgaatactgcttag

SEQ ID NO: 71839 - DNA, 234 bp, Glycine max
  Peptide Sequence Number=SeqID_188617
atggggaaaacgcggcagacctggaacgtttggttcttccgaaagaacctcttccggaaagtttccggaagaaccacatcttctataacttccggaagaagttgttccggaaactttctggaagaggctcttttggaagaaccaaagggtcatccggaagaaccacttcttccggaaactttccggaacaacttcttctggaaagtttctggaagaagtggttcttctggatga

SEQ ID NO: 71840 - DNA, 527 bp, Glycine max
  Peptide Sequence Number=SeqID_188618
aatacgctcagcgttggagagacctagtagcgcaagttgcccctcccatggtcgagagagaaatggttactatgatagtggataccttgcctgtattctactatgagaaattagtgggctacatgccctcctgcttcgcggacttggtattcgccagagaaaggatcgatgtaggtttgaagaggggaaagtttgattacgtctcccccgtaggtaccaacggctcacgccgggggctcttccgacatagcgctcgcccagccaagggcacccatgcctccacagggggggctcctcaggctccggctccaacccagcctcacccggccaacaatgcccaagcgggctcagaacttcaccccgatcccaatgacatacaaggacctcttgccatctctcattgccaaccaattggacatggtgattccgggaatgatcttccagtcttcgctcccgaagtggacgggcccaacataaagacaaacccactttccaatcatggagggggagctgttaatgccatcgag

SEQ ID NO: 71841 - DNA, 513 bp, Glycine max
  Peptide Sequence Number=SeqID_188619
atgggcaattacatttcttgcactttggctcctcctttgatgaagaacacaagggcaaagcgcgtgatcttccctacgggcgaagtgaagcaatacaaggagcaagtgatcaatgccgcggaactcatgctggagtgccctactcacttcttaaccaattccaagtctctacacatcggacgccggttttcgcctcttggcgctgacgaggagttggagtgtggcaacgtctacatcttcttccccatgagaagactcaattccatggtcaccgccgctgacgtggcggtgctcttcatggccgccaacatggccacaaagcgaatatctagtcgagaagatttaatatcacgtgatcactcaattgatgttattggaataaatgatgaagtcccaaggttgagcttggaagggcttgaggttgagtcagggtttcggaataggttaagttattgtaggtcaaggaagcctgtgttggaaaccatcaacgaggaacccatttggttaaagtga

SEQ ID NO: 71842 - DNA, 177 bp, Glycine max
  Peptide Sequence Number=SeqID_188620
atggataaatacttcagcaagatgtctcatgacattgatatgcatgagggcacggatatcaatatgacaatggatgaagatataaggatgcaatgcttgacattaaaaaattatgattgtagcgaatttcttgcaattatgaagtttttttatactcaagatgagttattgaaatga

SEQ ID NO: 71843 - DNA, 303 bp, Glycine max
  Peptide Sequence Number=SeqID_188621
atggtggtagcggttaataatcatggtggtggttgcggtggtggtcatgacaattgtggcgaaaacggtcatgataatggtggtagtcatgtggaagttgagaggatatcttggagagataacagtttgacaaggaaaaggaaggcgcttgaaaggctagctaggaaacaacctaattcacctgttttgccaaatcttcctcttccatctattcaagaggaagaagaaatcatcatggcggaagaagagcaaggaaatccatccaccaccatcaagagtactaaatgcattaaaaatggataa

SEQ ID NO: 71844 - DNA, 375 bp, Glycine max
  Peptide Sequence Number=SeqID_188622
atggtgataggactattgaaaaagtcctacaatcctgtttcttttggccaacctaatgtagctccatgtaggacttgtaggtcttggatcttcttcattgctggagtcctttgcttcttgaagatcaatggcagcggaatggaaaaggtggaaaggatgtggcaatggggtgtagcaaataaatgcctactgtcgcaacctacccttttcgggcgagcgacgtggggctcacgggtcgacaaaagcagggctcttgctcctacgtaccctccatcgaagaggaaatcagacctacgtagttctttcaaaaggggcgaatcaagcgattctttttacttgcaaggtggtcatttaaggtgttggaccttaaaatga

SEQ ID NO: 71845 - DNA, 595 bp, Glycine max
  Peptide Sequence Number=SeqID_188623
gtggtctttgattgctggacggcttccaggacgaacagacaatgaaatcaagaattattggaacaccaacattgggaggaaacttcaaaatggtggtgcaggaaccactttaaacacacttcaacaagaagatcaaaacgttaaagaacaagagtggcactatgataagggttcgtgtcttgttcagacaaaagcaacaaggtggactaaggtcacagtcaccaatgaaattagtcaacccaatgaagggattacaattaagagcaatgttggtgataacaaaatgaagggttttctagtgtctccatctaaagagagtaacaatgattcagtgttgttggatttcatggcagattttgagatggatggaaacttcttctcggagctccttaagatggatttgcccgaatcatcttgtaaggaaaataagatactcggagataatggtaaccctagcacggttgataaagtctatttatctccaaaatcatcctgtgataccgcccacttcccttggggtgattcattctatgatacaaattttgattttctaccagtgacaatttttatggagtccggatttgattggctctga

SEQ ID NO: 71846 - DNA, 483 bp, Glycine max
  Peptide Sequence Number=SeqID_188624
atgtgggccatcatcgatgagtacaaagagaagctgaacctagcagcgactcacgagcaaaggctagaggatgagtacaccaagatatcagcggaaagggaagcaagggaaagggtaatcaactcattacacagaggggcaatggtgtggatggacagattcgcctttactttgaatggaagtcaagagcttccccgactgctagctaaggccaaagcaatggcggatgtgtactcggcccccgaagaaattcatgggctcctcaactattgccagcacatgattgatctagtggctcacataattaggagccggagtaacaccataactaagcacactccaaggcacccctatcgaacccgttctgaatctagggctatgtgtgacgtagaggaggtgcaagaacagatgaaagccaacatgttgactctgaaagatcaaatggcttccatgatggaagccatgctaggtgtcataccctaa

SEQ ID NO: 71847 - DNA, 241 bp, Glycine max
  misc_feature (127)..(127): n is a, c, g, or t
  Peptide Sequence Number=SeqID_188625
atggtcgaaagaaaaaatccctatttgacaaggcttcttactatacctatgaattccattggacccaaaaatgatacattggaagaatcatctgagtcttccaatatcaataggttgattgttccgntcctgtatcttccaaaaggaacaaagatctctgagagctatttcctggatccgaaagagagtactcgggttctcccaataactaacaagtatatcatgcctgaatctaactggg

SEQ ID NO: 71848 - DNA, 414 bp, Glycine max
  Peptide Sequence Number=SeqID_188626
atggcctctggtaatcgattaccaggcttgaaaacaaggcttcaaaaagggaactgggagattgtggaggcctttggtaatcgattaccagtctgtgtaatcgattacacagaggaatgggtcactggtaatcgattaccaggttttcatgtcctgaagctgtgtaattcgagttggcccctgatcgtgatggcggcgcagctaatccatgatcgagtggagatggagtgcctagagggagcttgggagaccctcgaaggcaacacgaggtgccgatttcggggcacgatccgattcacgactacttcattggtgtatccagatgaacccgcgcgtacacttcagcgcactgtggagtggatactaccctcgcctacaccatatcgtctagtggagccagtccaagtgatcgag

SEQ ID NO: 71849 - DNA, 333 bp, Glycine max
  Peptide Sequence Number=SeqID_188627
atggcttctccacctgcctcacctcctcctcctcctcctccttcagacacattagcttcaccgtctgccgtgaagcggacatgcaaagccacatgtctacgatcgttgtctactagaccacctggtgctgagagactagtggtccacattgatcctgctaccggcaaggccgatggtccccacaggaagaaattaagaacatatttaggggttgtggcgcgtgataaggtggacgtcacgtatgagaactggaaggaggtggaatttgaaatcccagaggcttctgacaataggacgaaaaagaagttacttaagactgtcgacgagagatag

SEQ ID NO: 71850 - DNA, 123 bp, Glycine max
  Peptide Sequence Number=SeqID_188628
atggacgacactgtctgtgagaaatacgacataatcaagaagaaatgggcccaattttgccagactcgcaaagacccttcttgggaggatgtgcggaaaaagggacaggccatccagaaatag

SEQ ID NO: 71851 - DNA, 204 bp, Glycine max
  Peptide Sequence Number=SeqID_188629
ggttaccttatggttacccgcacctttcgtcaaccaggggaaaacgagcccgttgacgcacaacgactaacattgtctcctgcaccttttgtcgtcctgacccgtgaagccagggacagcgagtcaggtggtaggttgagatgccttatggtcatccgcgcctttcgtcaaccgaggggaacgaattcggcggtatcaggatga

SEQ ID NO: 71852 - DNA, 2724 bp, Glycine max
  Peptide Sequence Number=SeqID_188630
atgctgcagtggcttactcctcggacaacgaaggcggtgcaaatttttctcgggcttccggagttctatcgaaggttcatccagaagtatgccaccattgcagcccctttgatcaaagcaacgaccaaggaacctctccgatggaccacggagacacaggaagcttttgatacgttgaagcgtgccttgtcaactgctccggtgttgactttgcccaatttcgacctgcccttcacagtagagacagatgcctcaggcgtagggatgggtgctgtgttatcccagcaaggacatcctatagcatttttcagcagaccatttagcccaaagcttctctgttcatccacttgcgtccacgaattgttcgcgattactgtggccattaaaaaatggcgtcaatatccgcttggtcatcaatttatcatcctcaccgatcaccaaagtttgaaggagttgcttactcaggtcattcaaacacctgagcaacatatgtacttagctcggctcctgggctatgactatcagatacattatcgttctggtgttcataatcaggctgcagacgcgttatcacgactacctgagcaagaacctacgttcaccatgcttctttcgcgcgcagcgatcaaagagaaccccgctagtcactctgacttctccattgccaataacctgatccttcaccgaggctgcatttggctccccaaggatcatccaatgatccccactctactcaaggagtaccacgccacaccaaccggaggacatgtcggcattgccaaaacaattatcaggatttccgagaacttctactggcctggtcttcccagtgatgttacgcagttcattgccacgtgtcttgattgtcagtgcacgaaatataaaacaaagaaattcgcggggctgctgtgtcccctgccagtgcctcaccgcccatgggaggacctctcccttgatttcatcaccggacttcccccttaccacgacaactctgttattctggtcgtggttgatcgtttctccaagggagtgcatctaggaatgttatctatggcgcatactgctcatactatggcttctttgtttgtagaacttgtggagctgtttcgcttaagtggcactcagttgaagatgacttcagcctttcatcctcagagcgatggccagactaaggttctgaacagagttgttgaacaatatttacgatcttttgttcatcatcaacctttgacttggggcaaattcttggcttgggcagagtactcccataatacatcctggaactccgctaccggcactacgccgtatgaggttgcttttggtcgcaagccattttcttatccagaatacattgctagaacttcacaccttgatgttgtggacaccatattgactgatagagatgaagtgttccaattcattcgtaggaaattgattaaggctcaagcctccatgaaggatcaagcaaaccacaaacgtcgcgatgtgtcctatcaacctggggactgggtgttgctgaaacttcgtccttatcggcaatccactgccaagggctctcaatcattctcgggcaaattggctaagaggttttacgacccttttaagatccttgagcacattggtaaagtagcatattgtttagaactaccagctgaggctaagattcgttcagtttttcattgttctatgttgaagccatttcggggggatccaatagatagcacatttgagttaccaaactacatattaaaccatcaacctgtcatcgttccaatggaaaatttagactatcgcagaaccaactcacctaatgcaacatgggaggtgttagttcaatggcaaggattgtcaccagatgacacctcttgggagaattggtcccagcttcaacaggcatatcaccttgaggacaagctcgctctcacggtcatcatgaaacacactgcactgtcgccgtcgtttcagtttctcgaaagcctttcacacgcgagggatgagtcgtttagggttcaagcacgagattatgcctgcaatacaaaggtaggctccgccatggatgtagaccattgccaacaaaaggaggaggaagaagagcaagaagatcctttcctcaaattcgtggattacgcaagatctaagctattatcgctggaaggcgatcgaaacaaagacgatgacgatgccgatggacttggatggagttggatcgtttctcgtatcctcaagacttgcattgcttattcaagcggtgtcactcccgcgatcttgctctctgaactctctctcagaaaaatccttgatgctccgtctgaagctgatgctggaccaacaacagccattagttgtccacatggtcaatcgatgcctgagcaagctcctggtgctaagctggtgcttattcctgagtgcttttggctcttcttaacgcctgatgatcctttgggtggcccaactttttcttcagattctgaagagtgttcccaatgcagtaatgaattatctgaagaagcatgcttggaggactccttgagcactcagctgattgaaagacctcctaaattggttttcaaacgtggtgctataatccagagggaatcttctgaaggttgcttaaccatcgtgtctgagaatgattggaaatgcttctgtgaagaatggggtggtattgagaccaaaggaatgtcagcaacaattgatcatgttagttggccatggatcagttga

SEQ ID NO: 71853 - DNA, 609 bp, Glycine max
  Peptide Sequence Number=SeqID_188631
atgcttgggcgagatgagaggtggagatcaagacattatttacaaataagcatcagttttgacgtgttaccccatattaagtgcagtagaaagcacaaacatccacatgcttacattaggggattattggagttccaatatcatagatgtttatctacaccgcagacaacaattggttgcaaacggataagaaatatgtgtacagaaatcctccccagccacagctactccttagatctcatcataaacccccctctacagaaacagaagcagaacccaagagcagagaagaatcagagaatggcaactatgactggtgtgagcctttcatgccccagggttttcttcaacgcatcaggctcaccgcaaaacgcgcatgctgtaaaattctatgacttgacaggactgcagaatggaattctgaagcgagggagagagattttcctcactggttgctacctccgaactcccactggaggttctggacattcacgtcttttgccaacagagtatcttgtgattctattggatgaagtaatggtcaaagattttttaattttaaatttgtccactgtgaagtttaattgggctaacaagaggagtgagtga

SEQ ID NO: 71854 - DNA, 453 bp, Glycine max
  Peptide Sequence Number=SeqID_188632
atgagcaggtcagggcaaccacaggatttgaagaactttgagcaaatgccatattggcagtgtctcttgcaatctgaaaagctgagttacaaggatgtgtttacaaaattggctcactctacggtggctcactcaagcttgaggatagagactttccaagctatttatcttctctctcagagaggcttactcaagcttgaggatagagacttcccaagctatgacttcccaagctatttatcttctctctcagagaggctctctacttggattgactcactctacggtggctcactcaagcttgaggatagagacttcccaagctatttatcttctctctcagagaggctctctacttggattgactcaccctatggtggctcactcaagcttgaggatatagacttcccaacctatttatcttctctctcaaagaagcttactcaagcttga

SEQ ID NO: 71855 - DNA, 378 bp, Glycine max
  Peptide Sequence Number=SeqID_188633
atgcatgctttgttagggtcattcaacagtggaaactggtttgactctaaagtccttgatagtgcagggatgagttgtcgtgctttcacaaggaatcaagtaagttcttcatttaatgttgctggcttgactccatttgttgtaagtgatgattttgaacatttgagggaaaatgctttccaagaaggagggaatgataagaatcctaaaactgctcaaatacaggaacctatgaccaggattaggatcaaacagtcaatggataccctccaacaaatggtagcagacatacttaacaaggttcaagtggagaaggatgaaagcccagaggtagaggcactactaagaatattaattgttgttgaaggcccagactaa

SEQ ID NO: 71856 - DNA, 444 bp, Glycine max
  Peptide Sequence Number=SeqID_188634
tctaacacttctagacttgggttccctgctttgatcaccgcattatgtagggccagaggggttgtctctgacagccttacctttgagtgcctgagcccggcaaggccaactgagcttccttctacttctgcagctcctactccagcatccaccttagcagccccttctgtcccaatggtggcacctccagactctatccctttagtagagcagtttaatgagatggatgagtcatctgaggccaccatcctagggccatttgatataagagaagaggcagaggagacacaagtgagacaggtagttgctgccactcctgagcgatcccttgaggcgaatttagagccttctgcaccaatggtaaacgtaccgtcacctcatcctgcagcagacccctccactcctcttctagagatgccagaggacttactacaccagtcctag

SEQ ID NO: 71857 - DNA, 1206 bp, Glycine max
  Peptide Sequence Number=SeqID_188635
atgaccacgctacctcattcatttactatgattgtaacattaattattgttcttgcccaaacacttgtggtggtgaactcacttcctgaagctgataaaataaccaatttgccggggcagccacatgtcaaatttcagcaatattctggttacattaccgtggatgaccaaaatcagagagctttgttttattactttgttgaagctgaaaaacaccctacttccaagccagtagtcctctggttgaatggaggtcctggttgttcatctattggagttggagctttagttgagcatggccctttcaaaccgggtgacaacaatgttcttgtgaaaaatcattatagttggaacaaagtggcaaatgtgctatacttggaatcaccagctggtgttggattttcatactcaagcaatacatctttctataccttagtgacagatgaaattacagctagagataatcttatttttctacagcgatggttcactgaattccctgagtactcaaaaaacgacttcttcattacaggggagagctatgcaggtcactatgctccacaacttgcacaacttattgttcaaacaaagaccaacttcaatcttaagggggtagcaataggcaatcctctaatggaatttgatactgatttgaactccaaagctgaattcttttggtcccacggactgatttcagattcaacttatgatctcttcaccagagtctgcaactattccacaattaggagacaaacgatacaaggtaatcttagtgacgtttgtgcaaaaataaatggactggtgtttactgaggttagcaactatatagaccaatatgatgtcactcttgatgtgtgtctgtcatcagcaaatcaacaggcttatgtgctgaatcaaatgcaagagacacagaagatagatgtttgtgtggatgataaagcagtcacatacctaaacaggaaagatgtgcagaaggctctccatgctaagcttgttgaagtctccaaatggtcagcttgcagcagagttctccattatgaccgtcggaatctagagataccaaccgtttctattctaggctcacttgttaattccaacatcagagttctgtggagatcaagattcagttatcccattactgggatctcggtctctggtgaatggattagccaaggaacttggactgaatacaacagtggcatatag

SEQ ID NO: 71858 - DNA, 784 bp, Glycine max
  Peptide Sequence Number=SeqID_188636
cattaattattattcttgcgcaaacacttatggggtgaattctgttcctgaagctgataaaataagcaatttgctggtgcagccacatgtcaaatttcagcagtattctggttacattacagtggataaccaaaatcagagagctttgttttattactttgttgaagctgaaacagaccctacttccaagccagttgtcctctggttgaatggaggtcctggttgttcatttattggtgctggagctttagttgagcatggcccatttaaaccgggtgacgacaatgttctagtgaaaaattattatagttggaacaaagtggcaaatctgatatacttggaatcaccagctggtgttggattttcgtactctagcaatacatctttctataccttagtgacagatgaaattacagctagggataatcttgttttcctgcatcactggttcactgaattccctgcgtactcaaataacgacttctttattacaggggaaagctatgcaggaaaggcgtacaagaggctctccatgctaagcttgttggagtctccaaatggtcaacttgcagcagtgttctccgataatctagagatagcaacaatttctattataggatcacttgttaattctagtatcagggttctgggttctggtatacagtggagatcaagatcattgcttggatcgcgatctctggtgaatggattagccaaggaacttggactgaatacaacagtagcctataaagcctggtttgagggaaagcatgttaatacctaa

SEQ ID NO: 71859 - DNA, 1386 bp, Glycine max
  Peptide Sequence Number=SeqID_188637
atgaccatgctacctcagtcatttactatgattgcaacattaatcattgttcttgcacaaacacttgtgggggtgagttcacttccagaagctgataaaataatcaatttgccagggcagccaaaggtcaaatttcagcaatattctggttatgtcaccgtggatgatcaacatcaaagagctttgttttactactttgttgaagccgaagaagacccttcttccaagccattagtcctatggttgaatggagggcccggttgttcttcgattggaactggagcttttactgagcatggtccgttcagaccgagtgacaacaatcttcttgagaaaaatgattatagttggaacaaagcggcaaatatgttatacttggagtcaccagctggtgttggtttctcttactcacgcaataaatctttctatgccttagtgacagatgaaattacagctagggataatcttcttttcctacaacgatggttcactaaattccctgagtactcaaaaagagacttcttcattacaggggagagctatggaggtcactatgttccacaacttgcacaacttattgttcaaaccaagaccaacttcaatctcaagggaatagcaatagggaatcctcttcttgagtttaatactgatttcaactcaagatctgagtatttttggtcccacggactgatatcagatccaacatacgaagtcttaactagagactgcaacttttcctcaatcaggagacaatggcaaaatgggaatcttagaggggtttgtgaaaaagcaaataagctattggatagtgaggttagctactatgtggatgaatatgatgtcactcttgatgtttgtttgtcaccagtaaatcaacaggcttatgtgctgaatcagctgcaagagacacagaagatagatgtttgtgttggtgataaaacaaccacatacttgaacactaaagaagtccaagaagctctacatgctaatcttgttggagtcgccaaatggtcaacttgcagctcagttctgcattatgactatcagaatctagaagtgccaacaattcctattctagggtcacttgttaagtctagcatcagggttctagtatacagcggagatcaagattcagtgattccattattaggttcgcgatctctagttaacggattagccaaggaaattggactgaatacaacagtggcctatagaccatggtttggagaaaaacaggtggcaggatggacacaagtatatggggacatcttatcatatgccactgtaagaggagcatctcatgaagctcccttttctcaaccacagagatcactagtgcttcttaaagcatttctggaaggaaagccactacctggtgttgtataa

SEQ ID NO: 71860 - DNA, 2386 bp, Glycine max
  Peptide Sequence Number=SeqID_188638
ttcggtatcgacccggtccccaccaactgggcgctgatccagagcgcgatcgcgcgcttcccgttgttcctggtgctgttcgcggtggtactggcaccggcctacgaggagctgctgttccgccgcgtgctgtttgcccgcctgtggaaggccgggcgtccgtggctgggcgtgctgtggctgatctatggcggcatgggtgctgcgttctgctggttgtaccagcgcaccggtacgctctgggccgcgatcgccgcgcacgcgctgaacaacggtgtggcgcttgccgcacttgtgttcttcggggcaacgtaacgccgtgtccgcttgacgaaagattaagccgctacgctacacactgcgcatatgaacacgggggtggatccatgaaacaactgctgctggcccttgtcatcaccaccctggtcagcgcctgcgcgaccacgacctcccctaccggccgccggcagatggtgggcggggtgtcgcaggcgcagctggatcagctcggcgctcaggcgttcgccgaaaccaagcagaaggaaaagatcagcaccgacggccgccagaacggttacgtgcagtgcgtggtcaatgccctggtcgcgcagttgccgcctcaataccgtggcgtacggtgggagacggcggtgttcgtcgacaaggagcccaacgccttcgccctgcccggcggcaaggtcggcgtgaacactggcatcttcaccgtcgccaagaaccaggatcagctggctgccgtaatcggccatgaaatcggccacgtcatcgcccgccaccacgaggagcgcatcacccggcagatgggcgcgcagaccgggctggccgtgctcggtgcgctggccggcgcggcctacggcgaaggcgctgccagcaccgtcaaccagcttggtggcatgggcgcgcagaccgccttcctgctgcccggttcacgcacccaggaaagcgaggccgacgtgatcggccagcgactgatggcccaggccggcttcaacccggcgcaggcgcccacaatggctgtccacccaccccgacccagccaaccggatccaggaactgcgacgcgatgcaccggctctgacgccggtctatcagcaggcgcaggcggccgggctgcggccaaagtgcggatgagtgcgcatttctatgctgtattgcagcacataaaacgatttctcacgccatctgtttctgatacgtttggcggctcagatttttctgacagtccgactttgccgctaaccggcgctgtgctttccgtcctcgtcgcgaccgccctgaccggcgccgtggtcaccgatgccttcgcgcagtcctcgcgttcgtccgagcgtggcaaccgcggcggcaagcaggccaaggccgaagcgctgtacccgaacgcgacccgcgaggagccgaccgtcaaggcatcggccaagctgggcagcaagctgcagaagatgatcgacagctacaacaaggaaaagttcccggagacgcgcacgcaggccgacgcgatcctcgctgacagcgccgcgaacgagtacgacaagtcgctggccgcgcagctggcctcgcaggccgcctaccagaccgacgacacgccggctgccgttgcctacctgaagcaggtcctgcagttcaacggcctggacaacaacggccacttccagtcgatgctgatgctgggccagctgcagctgcaggaagaccagaccgccgaaggcctggcgaccctggacaagtacttcgccgagagcaagtcgaccaagccggaagaactgatcgccaagggccaggcgctgtaccagctggagcgctaccaggaagcgatcccggtgctcaagcaggccatcgccggtgccaccgaaccgaaggacaactggaaccagctgctgatggcggccctcgctgaagccggccagtccggtgaagcggtgaaggaagccgaggcgctggccgccaagaacccgaacgacaagaaggcccagctgaacctggccagcatgtacatgcaggccgaccagatggaaaaggctgccgcggtgatggacaagctgcgcagcagcggccagctcaccgaagagcgcgagtacaagcagctgtactcgatctatgccaacaccgaacacaaggaaaaggacgtcatcgcggtcatcaacgaagggttgcagaagggcatccttaagccggattaccaggtctacctggcgctggcccagtcctactactactccgaccaggtgccgcaggcgatcgatgcgtggcagaaggctgccccgctgtccaaggacggtgagacctacctgaacctggcacgcgtcctgcatgccgaaggtcgcattccggaggccaagcaggccgcccagcaggctgtctggctgaatgg

SEQ ID NO: 71861 - DNA, 468 bp, Glycine max
  Peptide Sequence Number=SeqID_188639
atgaacaatggaatagacaaagtggttcaaaagaatgatggagactacgagagaaaagcctcaatgaaagccctaaatcacatacaacttcttaagagggagttagcaggaaaggatgcagaggaaactgatgagcaaatcaaacaattgcaagacagagtttccattcttcaagatgactttggagaaggtgttgctattgaagatgatgaaggtcatcgtttgatgttgcaagaggagctggaaaaatcagatgatgaaaccagaattgaatccaaaagggtaaaggatgtgaattccatgttgggctctctcatggacaaattccattatgatcagaataattctgaaaagccaaggctccaaagagatttaaaagaaatagcagaaacaaaggacttggaagacattgccagattgactcacaagaaacaggagttggaatttttaaaggagaacattaattaa

SEQ ID NO: 71862 - DNA, 190 bp, Glycine max
  Peptide Sequence Number=SeqID_188640
aggcaattttagaaagaaaggcatccagtgtggattcgaggcagagttgagctgcagcaagtttggccatggcggcctcgaggcagtcctcgcgagtgacagaaagttcggcgtccgccattcgaagtgtgtgctgaaatggaagggaatgtggttgttgatggagggtagtgtggagaggaagcaataa

SEQ ID NO: 71863 - DNA, 138 bp, Glycine max
  Peptide Sequence Number=SeqID_188641
atgacatacgtttactttgttagtcccacattggatagttttagtaaaacacaggcttgtacctctgtatccttgagttctaaggagacaggaacctacgtctggtggatgaatcatgaccgtgtgatcagagcgtga

SEQ ID NO: 71864 - DNA, 1155 bp, Glycine max
  Peptide Sequence Number=SeqID_188642
atgcttcagaccaaccaatgcttcagtctcgtcatgaacagggttctagcatgcgtaaccaatctcgcaggaagcactggcgagattgcctacgtggagcatctcgcagttagcactggcgagattgccctaacccatctcgccaagaagaatggcggcatcagtgcagctctcgcctgtgctgctggcgggactcctttctcgcctgtcctgctggcggcttcacctaaattcgccacaatagacaaggttggacatgggttggggttacctgctatccttccgttggagaagacacgtgctcattgttcattcatttatccatgggttaacgcttggaagggtagatggttggatgacaagtatatcttgagtgagtttgctcctaacctcccttttcatatgcagaatttttgtgttgctgaccttgttgatggccacaagatgggagaattttccgttgcaattgcttacaagctaattgcttatcatcacactgctgaagctgatgacgttaggaaaagaatttggattctccatgtaccaaaatggagtaacaaggatcctgcttgctatcattgtaatgtttctatagagtccattgtgcatgtccatagagattgccctctcgcaatggacaaaagtgatttctttggaagtgttactagagccattatcggccttgggctgaattgtgggctaccatctgctattacctttggacttggaggaataagcagatccttgatccaaattttgttaaaccctttagaccgtggatctatattcgagagaggaaggttggtatgctctgaataccgatggggcagtgaaagggcaccggggtattgcaggttgtggaggttaatcagagattgtgatggtcaatggaaaggtggttttgccaagtgcattgggagagcctttgtgtttatggctgagctttggggagtatgggttgattcaaaagcagtgcctactgccattaaaggaaacaagcttggggaggggaatttttgtgcatacaagctgactgattatgctagttctgatgggtgtaaacttgtgattttcgagcattatccttcatttctgaaggatctgatttttgatgatgctagaggaatttactttccccgtgtaattgctgtttag

SEQ ID NO: 71865 - DNA, 1086 bp, Glycine max
  Peptide Sequence Number=SeqID_188643
atgtttccccagccatggatcttcttgatagctaccatcattgcaatttcactgttcatgtcctcactggttgagtcatttccagtagctgataaggtcaaatccttgcctgaacagtcacctgtttccttccaacaatttgctggctttgtacccgttgatgacaagaaccagagagctcttttttactactttgttgaagcagaaaccaaccctgcttcaaagcctctagttctctggctcaatggagggcctggttgtacatctgtaggagttggagccttcacagaacatggtccttttgttacaaatcaaggagaagctattgagaaaaatcagtatagttggaacaaagaggcaaacattttgtacctagagtcaccagcaggcgttggattctcttactctctcaatttgtcattttataaaacactgaacgatgaaatcacagcccgagacagtctggttttcctgcggcgctggtttgccaagttcccagaatacaagaatagagatttttatataacgggagagagttatggaggtcactatgtacctcaacttgctgaactcataattaagagtaaagtgaatttcaacctaaagggcatagcaataggaaaccctcttctggatttcgacactgatatgaatgcagtcgatgaatattactggtctcatggaataataagtgattatgcatacaaaatcaggacctctctatgtaactcgtctagagtattaagagaatacttcagtggccaaatttccaaagattgtcttgttgcagctcaaaaagtctcagaagaatattcttttacaaatttcatcgacccatattacgttgttggggagaaatgtctttcttacaatgtttctcaggcaggttttcttagggagacgctaaattcagggatgtttcagtttaggaactctcattatgtgcttcaaacagaagaacctgaccagcaagttgatgagtgtaatttgaaatattcagagatgtacttgaacaggaaagatgtgcagaaggctctccatgcccggctggagggaaccaccaaatatcgtttgtgcagcaagtaa

SEQ ID NO: 71866 - DNA, 267 bp, Glycine max
  Peptide Sequence Number=SeqID_188644
atggcaaacaataaagctgaaagtgaggtaaccatttctgattcagaagatgatgataattatgttcagctactagatgctttcaatgaaatgcatcaagaagaaaaaaagttggccattgcaaataatcttctaaaaggatgtaaagttttagaagtaaaggttgaatacttaataaaaaaaatatccaagttcactatggggagagataatttggaagcattacttgcacaacaaaaatatgctatcgaaaaggctagggtttag

SEQ ID NO: 71867 - DNA, 327 bp, Glycine max
  Peptide Sequence Number=SeqID_188645
atgcctcctcctcaatgggatatccgaggtgaggctcaaagtcggctagagtgtggcctcagggtacttcatgtgtctcctccgtgggttgagagacatatgcatgatcagatgggggttgttggctctcaatgggtatgggtgcggagttgccgacattctcatccggagcatgtacaacattgggtggtgtatagttgggaggcaatccacatggtgggaaggaatgcttgttctgaacctacacaaaatgagggtcgatcgcacttcccaacgcattgcctccctgacctaccatatgcgaggctagatgatttacttgattaa

SEQ ID NO: 71868 - DNA, 159 bp, Glycine max
  Peptide Sequence Number=SeqID_188646
atggagaacgagcaatttctgattgaacagacttggagatcaactcaggagtgcaggcttcttttctggaaaattccttccctggttggtgttttgattggtattaagggtggtgtttggtcttggatgtacatcgggtggattttgtggccgatttag

SEQ ID NO: 71869 - DNA, 837 bp, Glycine max
  Peptide Sequence Number=SeqID_188647
atgcaagggattggtagtttactcaaggggcataggctcttcttaagctcaattgatcttttatttttcgacccagaagttgagaggatagttaggagaaacaacagtttgaaaaagaaaaggaaaacactagagaggctagctagactagagcccaattcacttgttttgccaaacatgagtggtggctcacaatgtggaaataagggcatctctcattggattggtccaacaaaacaaatcaatcaaaagaagccagtgattgctactttcactcaaggagttgatgagcccctttgtgaagcttgggagtggtttaatagtctatttaaacaatgtctagctcatggccttgatgatggaggtcaaattaacactttcttggtggggttgagaccccaaactaaacttatgcttaatgcttcaactagaagaaaaattatgtacaagacaccagatgaagccaaggagatcattgagaataacacctcaaatgactacgaggttcttcatgatagaattcttactcccacacaaaatggaggagttcttgaacaaccacctcatggtaatcaagctcaacaaggccatccatataaacctcttcatcaagactatacttctaagttagaagacactcttaatcaattcatgcaaatctctgtcaccaaccaaaagaataaggatgcttctagcaagaaccttgaggtacaaatgggacaaattgccaaggaagtgatagagcataaaagtaggcctcttgtcaccaatactcaaactaatcctatggagcaatacaaggccattactacaaaggaaatgtacattggtaggtga

SEQ ID NO: 71870 - DNA, 147 bp, Glycine max
  Peptide Sequence Number=SeqID_188648
atggaggttgaggaaccttggcaggggttatggctaccattgcattatcaagctttttgctgcaaaattccttccttggttggtgttttggcactagatatgcggcgggcaggctttgtggttgatttagggatggcctttgtgtga

SEQ ID NO: 71871 - DNA, 312 bp, Glycine max
  Peptide Sequence Number=SeqID_188649
atgaaggattccatcaaatcgaagattaactattggggagcacaactagtcccttgggtacgatatttggacttaggcatattgttactactgtgtagcgtacacttgcccttgtgcgtacatattttatgcatcactaggcatcacccaagtgtagggaggaaagaccctctcagaaaggatcctagaaagggcatgagaaattggaaagaaagagacaatacctctgctctagctctaggccacatggtaaatgatcatcctgagagtttgcttcaaaaagggaacatcaccctcatcgagggcggttga

SEQ ID NO: 71872 - DNA, 483 bp, Glycine max
  Peptide Sequence Number=SeqID_188650
atgggaaatcataaagggagagcacgcataagagggagatgtggatctgggttcttgagggtggcaacatgtggttgtggtggtggttgcgtgtatctgggtttgtggggtcgagggtggaaatgtgttgttgttgtgatgcttggtattggtggttgcatgcttcagagtggtggtgtatttggggcggaggtggtgggtcacagtatggatataggatggcatgatggtgttgtttggtggatggaacttgcgaatttgggttttttgttgatgatgacttgtgtctccggtcccgaagatcacctacctccacaaacacaaacaaatgggagtatgacactcgaatatgacgtaatcgtggcggagaggaatgtgggacgctacttccgcgaagtggtaaacacgcacgagccactgactctgggtgcctttcaaatgacgccgttaacttcaattatcaaagacttccagaagccttaa

SEQ ID NO: 71873 - DNA, 186 bp, Glycine max
  Peptide Sequence Number=SeqID_188651
atgtgcccgatgtatgtatttaagaaggtgacacggaccctccgttggtttgccaaagagaggggatcaagacagaaccccctgtccgctccgtgcccctattcaagggacctatatgggagggagcttaacaaggcttttagtgataattcccaaggtggtcatatctctcttgatggtctctag

SEQ ID NO: 71874 - DNA, 1929 bp, Glycine max
  Peptide Sequence Number=SeqID_188652
atgatgctgagcactgaatttatgttaaagcctcgcccgttcctgctgttgttgttattgctgtttggtttgcaactgacgccgttcggcgccgtcgccgccgcccaggatgatcccgccgccgaaagcgcgcccgatcccgctacgcagctgaaagccgcgcaaaagcagttggacagcatgaagcagctggtttccaaagcgaccaccgataaccagctcagcaaactgcggctggcgaccgacgatctggtcgccagcatggaaaagctcgccaccgatctgcagcccgagcaggacaaactgaaagcgcagctggacgtcctggggccggccccggcggccggcgcgctgcctgaaaccccggcggtggcccagcagcgcaacgcgctgaacaacagcaagaaacagctggacgatgcggtaaaacgcgctcaggccatcaagaccagcgccttcgagctcgggcaacagatcggcgatctgcgccgggtggcgtttaaaacccagctggcgctgaataccggcagcattctgggcatcaaattctgggcgccggtgctgcagccgtccgaaaatgacgtgcagcggctggatcagttcaacgccgagatgaaagcggcctgggatgccagttggcaggacgagtggcgttacagcacgctggcgttgttggcgctggcggtgattgtctggtcctgggggcgctatttctccgagcgtttcctcgcctgggccagcatccgtttcctgccggacgggcgtctgcgccgcagctttatggcgctcgtcaccgtggtggtgacggtgatcaccacctctatcgcgctgaacctgctgtattacgtctttgttcgcgtgcagccgctgccggtgatgctggaggacttcgccgaaggctttaaccgtctggggattttctgcgcgctgatcgccgggctggggcgtgcggcgctgtcgctgaatcgcccgtcgtggcgcttggcttccatggataacgaggtggccgccgggctgcgttacttctcgccgctgctggccggcctggcgttggcgttcggcaccgtggagctgatcaacaacgtcgtcagcgcctcattggccaccaccatcttcggcaacggcctggtggcggggctgatcggcatggtgctgctggcggcgccgctgcgcggccagcgcattcggcgccggctggaacagcagggcgcgcacctggaaaaacgcacgctggtcagcgggctggtgcacctcgtcaccctggtctgttcggtggtgatcctgttttccctgcttatcggctacatcgccttcgcccgcttcctgacctaccaactgatctgggtggtgctggtgctgatggcgttctattttatggtgctgttcgccaccgatttgtgcgccgcgctgttttcgccgcagaccgtcagcggcaagatgctgaaaaaaacgctcagcttcaaggatcgccatttggagcagatggcgatcatcaccaccgctctggccaaatgttcgctgttgctattgatgattgtctcgctgttcaacggctcgttcggtagcaccacgccgggttcgctgatggagaaaatcgtctccatcctgaccggtgaaggcttgcagcgtttcaacatcgtgcccggcaacctgctcaacgccgtgatctgcctggcgatcggcatctatattctgcgcgcggtgcggcgctggctgggatctgaactgctgccgaaaaccatctcggacgtcggcatccgcgcctcgctggtgacgctgttcagcaatatcggctatgtgctggtgatactgatcaccctggcggcgctgggcatccagtggagcaacctggcgtggatcgtcagcgccctgtcggtcggcatcggtttcggtttgcaggagatcgtgaagactttatttccggcctga

SEQ ID NO: 71875 - DNA, 207 bp, Glycine max
  Peptide Sequence Number=SeqID_188653
atggagggattgggtggtgcggtagagtcactggaagtgttgtggtggcgttggcctgcagcggtggtggttgaagttgaacctttgtgcttcttagatgattttttcatttggatttggttaagaaacgagaaagggagggcaccgccaaggaaagaaggaggaagaggattctgcataaggagagaaaaaaagttgtatttatag

SEQ ID NO: 71876 - DNA, 357 bp, Glycine max
  Peptide Sequence Number=SeqID_188654
atgtttttggttgctcatgccaagttgattgaaaatgagttggagcagcctagcagcccatcagttaagaagtcagaagagaaaggtgtagtagttgtacatgaagtaaagtgcaagctttatgtgaagtcaagtgatccaggagataaagatgcatggaaagataaaggaatgggccaactgtctattaaatgcaaagagggtgtcagcaaggctaccaaagagtccaaacctacaattgttgttcgaaatgaggtaggaaaagttcttctcaacgccctgttgtatccaggaatcaaaacaaatctgcagaagaactctcttgttgcaatattccatacttcggtaaggcactga

SEQ ID NO: 71877 - DNA, 195 bp, Glycine max
  Peptide Sequence Number=SeqID_188655
atggcttccaaatcgacatttagtattggctcacaggtgcttaacaaatatcgaactaggcttcttggtgataatgtgcaagccttgatatgtactaaaaattggttactaggatttgatgagcaaggtggtccttacgcagggcaggccagcccgcttacccaccccttcatgggtgtcacaagtcgtgcctag

SEQ ID NO: 71878 - DNA, 213 bp, Glycine max
  Peptide Sequence Number=SeqID_188656
atgcaagctgatgaggatgttggaaagatagcactcgctgtgcctgttttagtttgctgctggttgtttgtttgtcatatacatgttgttgacattgctcttgaatgcattacagctaaagctctagaactatttttgcaagatctttgtgaccgcacttatgaaataactcttcaaagaggagcaaagaccatgaattcattgcatttgtaa

SEQ ID NO: 71879 - DNA, 546 bp, Glycine max
  Peptide Sequence Number=SeqID_188657
atgcccaccaccttgcccccgagttcctcctctagcatgcctcccttgtcgcctccttctcccatcaatttgttcacaaaatcacaaaacatactaatcatgccactaccatctttaagcttgttgcctaaagtagatgacgaagcaaatcttaagacagacatggatggattaacgggggtaaatgaagtgaatgttttcataccaagtgacaaaattgtatttgttaccattggattcaatgttcaaaagtgtcattcaaataaaccaaagcaaaactgccaattcatgcacaatgggatgatggcagccgaaatgaagaacgtaagttttgaatggacatttgctatcacagtgggtgtggttggtgatgtatgtagaggcttcgaggagaaaagtggtgcagaactcgctgcagatatatatgctgctgatgacaatatgacagaatacactaattgtttgacaaatggaattctagaggcatactcagggatcttagaaggatttaaaggttccccaaagacccaatttctaatgtcttaa

SEQ ID NO: 71880 - DNA, 759 bp, Glycine max
  Peptide Sequence Number=SeqID_188658
atggccacggccgaaaccaaaatcaaaggcatgaaaatagaacatccaaaacccaaaacctccctttgtctatgttgcttcggatcatttcacagtaaaactccaacaacaggatctgaacacaaggcaaaacaaaagagtggaagcagtagctggtttccatggcaaaggattagatttcgagtgaagaactcaatggccaaaacagttccccttgaaggctctgagtttcatgagatagacaagctcaagctcaagctcaaactcaaagataacaaagttcattcatcaaggtggaagtggaagtcaaagtcaaagtcagacttactcagcaagagtcaaagcaactccacacccagtcaaacaccctcaaagtcacagaaaaacagaggaaacaatatagcgggttacacgcgtcaacaaagtaagacatcatctcccggaaaagttgtcccacacgcggtttctctccaagcttggacatggaaacagggcaaacacaaacagcttcagaacgcagagaggtataatcctgtgattgttgctgcgtcgttggttgtgataactttggtttcaatgatagtgtggggtcgtttgtgttccatcatttgcaccaccgcttggccctatctcatccccaccttggctaaactgctcaaaacgacaagcaggattccattagtgtttcaaacgacttggttttggattccaacatggacaagaataaagtcatcccatgatgtagcaatttcactttaa

SEQ ID NO: 71881 - DNA, 543 bp, Glycine max
  Peptide Sequence Number=SeqID_188659
atggaaatagagaggctaagaagaaatgcagaggcgctggttgagaagaccatgaaagggaacgatgcttctcatgatgctgctcatgtttggagagttcgtgatcttgctctctcccttgccaaagaggaaggcctctcttccaatccccactccatggaaattgttgagcttgctgcgcttctccatgacatagctgactacaaatacctcagggacccatctgaggaaaaaattgttgagaattttctcgatgaagagggagttcaggaggacaacaagttcaaaattttgaagatcatcaaaggaatgggtttcaaggaagaagtgtcaggaagtggaaatagtgaagggtttccagaatttggagttgtgcaagatgctgatcgacttgatgctattggtgctatagtaactgggatattgaagcaccctattgggttgcttatacccttagagagacagacagacagagagatagagagagagagagagagagaggcattagaagataagagaaaaagtgatagatgtgataagtga

SEQ ID NO: 71882 - DNA, 265 bp, Glycine max
  Peptide Sequence Number=SeqID_188660
atgctgctcactttctggaccctgcttttttccttcctcctaaccactgcctccgccgctgccggaagggaatattccggcgaagaggcgccacagcaggaggctgacagagtgaagaacttgccaggacaaccgccggtgaaattcagacactacgctggttatgtcaagctaaggccaaatgaagagaaggcattgttctactggttcttcgaagctcaagaagatccctcacaaaagcctcttgtactttggcttaacggag

SEQ ID NO: 71883 - DNA, 1164 bp, Glycine max
  Peptide Sequence Number=SeqID_188661
atgcaacaaggacctggttgctcgtccattgcctttggagcagcacgagagattggtccatttcttgtccaagacaaagaacgcgtcaaacttaacaaattctcttggaacagagttgcaaacatcatattcttggaggcaccgattggtgtcgggttttcttacactaacaattccaaagatttacatgaacttggggatcgagtttctgccattgataactatgccttcttgattggttggttcaaaaggttccctaacttcagatcccacgacttttatattacaggagagagctatgcagggcattatgttccacagctcgccgaccttatctatgaaggaaacaaagataccaaaaaaggctcttacataaatatcaagggattcatggtgggaaatgctgtgattaatgatattacagatatagtgggtttggttgattatgcttggagccacgccatcatctcaaaccaagtatttgctgggttaacgagagattgtaattttagtgtagagaaccaaacaaggagttgcgatttgcaaattgctaagttattgggagcttacagcgatattgacatatacagcatttactcgcccatttgcctctatgactaccaaagaccactttcagccaaacttgtcgttgctccccatcttcttacacgtcatgacctgtggcgtacactaccatcaggatacgatccctgtgcagaagatcttgtaggcaaatatttcaataataaggatgttcagaaggccctccatgcaaacatcaccaacttgtcgtacccctatagcctttgcagctcggtaattgagaaatggaatgactcgccaaagacaattctgccagttattcagaagctcctacgtgccggtttacgcatttggatatacagtggggatgcggatggtcgagttccagtgacatcaacaagatacagcatagagaagatgagactgaaagtaaagaaagagtggagagcttggtttgtgaagagtcaagtggcagggtggacggaggagtacgagggtggcctcacctttgctaccattagaggtgctggccaccaggttcctgtctttgcaccagagcaagctctttctcttttcacacatttcctctcttctcaaaccctcccatcttctcgcttctag

SEQ ID NO: 71884 - DNA, 411 bp, Glycine max
  Peptide Sequence Number=SeqID_188662
atggatcaggttcaatgtcaatcttttagcaaggtatatggaaagatttgggatctagcaatgatagaagtgtcagttgaagtcattgcagctcttacccaatactatgaccaaccgctcagatgcttcactttttgggactttcaattggcaccaaccatagaggagttcgaggggatcttaggatgcccgataggaggaaggaagccataccttttttttgggtactacccttctgtggcaaaagtggcaagagtagtcaaaatctcggaacgagagttagatcgagtcaagcagagtaggaatggagtagtcggtataccgaggaagttcttggaggagaagacggaaaccctgacaagccaaggagagttggaatcattcatggatgtattagcactactagtgtag

SEQ ID NO: 71885 - DNA, 288 bp, Glycine max
  Peptide Sequence Number=SeqID_188663
atggatgagttatgcaaaggtggcaggcagagcccagcttctccttctggagggggtggggcttcgcagctagagcctgaccaaggagccaacaacagtaatgtacacagggctcaggaggaggagactggcacagaccagattccaaagccatctccagcatccatacctgatgattccatgccatctacaccagcatccgagttagagcagcctatctctcaagattcactagttgctcaggtgttagatcttaatgagcatgcacaggaggaatcacaggagtag

SEQ ID NO: 71886 - DNA, 315 bp, Glycine max
  Peptide Sequence Number=SeqID_188664
atgagtagagaaacaaatgaagtagaattcatgggtttaggtgctactgctactatagacgtagaagaaccaagctctaatacaaaaggaaaaagacaaggttcaacttcttctggtacacattctcacaagatcgaagaaaaagaaggaataacaacttctttggataaaatggccaactcttttgaccggatggtagaaaaaatggatggtaaagtcaatgatgaagatattcaagaagtattacgtgagacaactttgataccagatcttaatagacaacaatgggctaaagctattaaatggttattgtga

SEQ ID NO: 71887 - DNA, 345 bp, Glycine max
  Peptide Sequence Number=SeqID_188665
atgaagatcttaaaagggtataccaagaatctacatcgtccggaagcatctattgttgaaaggtacattgcagaagaagccattgaaatttgttcatactacattgaaaaggctaaacctgttggccttcctgagtctcgccgtgatgactctgcctctagaatatttccattggatttaatgatgaaatctacgcaatttcaggttaaaaagaggctaagtcatgaagtgctaaaagtgacagttgagctcagctcatcagtggggctaagcgctcatctattgctaagcacagcttcagtgcgctttgcgcaacagaagaatatgtcagagcatcaatattaa

SEQ ID NO: 71888 - DNA, 252 bp, Glycine max
  Peptide Sequence Number=SeqID_188666
atgacagtgttgacggtatatctgacacagacgatgaagtcaccaacattccgtcaggcagtaagaattgtcacccagcagaaggtgcacaacgaattgaaaatccattttggaatgatgcctcacattataacaatatcaactggacttatcctgatgaggaggacatttgcggtttggagatgccgtcaacctttaatgttggccaagaattatatgttggcatggaatttgatagtaaagatgcggtaa

SEQ ID NO: 71889 - DNA, 312 bp, Glycine max
  Peptide Sequence Number=SeqID_188667
atggagctggatgatgtagctccatgtggagcttgtaggccttggatcttctttatcaatggagtccttttctttttgaattttaatggcagcggaatgcatacgccaatatatgctaaattcatgaaggatttgcttgcaaagaagagaaggattatggatgatgaaatatctttattcgtgaattatgtttttgaatgtataatctattttgctagagctatcattgcatggcctgaggacagacctaactttcaagaggaggatgaagacatggtagatcttgttgattatttcattggaggagattga

SEQ ID NO: 71890 - DNA, 288 bp, Glycine max
  Peptide Sequence Number=SeqID_188668
atggctagaagtagcaggatagaatacttgctttgtaatcaaagttggcatcagagctcggcattacgggttgagtatttaacaacactatggaaaatatccagcaaatcaaagaaaaaaatggaagaaggattctccaccaacaaactacccatgttcaaaagtgtaaaatatgactactggatagaatctccatgtagagcttgtaggccttggatcttcttcatcaatggagtcctttgtttcttaaagatcaatggaagtggaatggagaaggaggaaaggtga

SEQ ID NO: 71891 - DNA, 210 bp, Glycine max
  Peptide Sequence Number=SeqID_188669
atggcaacacggttggggatgaagaccttaatgagaaagagtgctaaagtcactacatctgttcatccaactagaagtagggaacttgaatgtcttatgtgttctggaatagggcacatggcttgtcaatgcccaaggtggaagacattgacaaatgagttaaaagaaaaagagatgaaagaagatgagttgagagaaaatgagatgtga

SEQ ID NO: 71892 - DNA, 570 bp, Glycine max
  Peptide Sequence Number=SeqID_188670
atgatggaggtagtaaagggagaggtgagtcctatgcaatgtgtcccaaagaaatggggcacgactgttatgcaaaatgagcaacatgagctcatagctgttaggaaacttaatgaggccccccgaaaagatcactttccctttcctttatcgagcaaatgcttgaaaaatggctattcgggctatttgcaaattctagttgctgaaagggaccaagggaaaactacttttacatgtccttatggaacatttgcatataggggaatgccatttgggctttgcaatgcacttactactttccaaagggtgtcccatgcgagcattgagcttaaccctgctaaagtggaagtgattgcagaattcttccttaaattgtattacttggtattgtctaagattgttgtttttattgatcactttactattaagtttctcttatctaagcaggaggctaagccttggttgatccggtggatattgttgctgcaagaatctaacatggagattaagggcaaaaaggggcccaaaaatttggaccctcaatctcatagcctgcagatgatgggataa

SEQ ID NO: 71893 - DNA, 300 bp, Glycine max
  Peptide Sequence Number=SeqID_188671
atggccaaaggtgcaagagaaggccttagggtagatttgggcccatgggctaatggtgtctcctctcacctcttctccttctccattccgctgccattaaacttcaagaagcaatggactccattgatgaagaagatccaaggcctactagctccacaggagctacatcacaatcttgacaaattgttaagatatagtaaatgtcccttggatagatctagtaatggatatgagggaaatgtctatgttcaagatgaagacactattatttgttatttctatggtaaagttggacattga

SEQ ID NO: 71894 - DNA, 432 bp, Glycine max
  Peptide Sequence Number=SeqID_188672
atggctactccacctgtctcgtctcctcctccttctcctcctcctcctcctcctccttcagacgcatcagcatctccgtctaccatgaagcggacacgcaaagcgacacggctacgatcattggccactagaccacctggtgtagagagactagtggtcaacgtttatcctgctatcggcaaggccgacggtccccaaaagaagaaattaagaacatatttggggattgtcgcgcgtgataagccgaccaagacggtgtggatcacactatttgtgaaaaatacagcattagcaaggagaaataggcccagttttgttagacacgcagagacccttcttggatgtgcggaaaaaggcacaggccatccagaagcaaaacactgcccccccccccccccccccggttggtcccggggggtttttaaaatttaa

SEQ ID NO: 71895 - DNA, 618 bp, Glycine max
  Peptide Sequence Number=SeqID_188673
ggatccacagcggttcacaacatccctttgtcgcatggccaagtgaaggttggtgttgaggatgttaaagatgtagaggctctcgttcctgtacccactgatgaggttaccttagtggggcaggcacttaacaccttccttgcttggctggcacatctcgtgaagttatcagaacaggtagctgtgtctccagcaaaacctccagaaaggtcaaatcctgaggtcgatgatccgttgtatctgatgacattgaccatcccaaagctatttttgaagcctttgcaggttatgtgggatgctaccgtgttcggggtgttcaatcaagacttcccgttgtacataaagcacgaagatctctctaaaattgcacacggtggtcaatgtctcaacatatcttccattcagagatctgggcaatcgcaatttgattcggaaagttacatcaagagttggatgcagagttcaaaacgtgatgtctaccttggagcctacctgaatggacactggcaaatggtcgtcattctgcccaaggaaaaccttgttgtctgtgcattgaaaggacttaatgatactccacagcctaaatccaaggctgttgctaggtggattgttgttaat

SEQ ID NO: 71896 - DNA, 200 bp, Glycine max
  Peptide Sequence Number=SeqID_188674
aatgtttatacggataaccactcgggtatttccgcccgtcagcatgactcaaaagtcagtatgacagatcgtgtaagtgcggaagatgatgtaaatctccgcgtgtcaacgggcttgtcggccgcgattgacgaagggtgcagaatgaccacattggccgctgcttatcatcgggctcgccgcctctggatgacaaaagg

SEQ ID NO: 71897 - DNA, 258 bp, Glycine max
  Peptide Sequence Number=SeqID_188675
atggggttcatggggtcacacctggtggatgagttgattgcgataggggacaacatgattgtggtggacaatttcttcatgggaagaaaagagaacatgatgcaccattttggcaaccctagatttgagctcatccaacatgatgtcattgaacattccacccgatgtagagttttggaagacacccttgttcctcttgatcctgagattaagaagaagtatcggtacaacaatgacttgcgaaagaaacaaaaataa

SEQ ID NO: 71898 - DNA, 411 bp, Glycine max
  Peptide Sequence Number=SeqID_188676
atggcgaagcagcaaacacacaaaatcaatgcaagcactaacaataacattagcacaactaacactgtcaccgccaaggtgaaacgaacaaggagaagcgtccctagagattccccacctcaacgcagctcaatatacagaggagtcactagatcaggcaccgatggactggccgatacgaagctcatttgtgggacaagaattgctggaatgagtcacagaacaagaaaggacgacaagtttcctttccttgtgttgtggcaatggttcttcacataccatacatcagtctacctcggtgcttatgacgatgaagaggcggcagcacatgcttacgatctagcagcattgaaatactggggtcaagataccattcttaattttccggtcaaattttaccaaacctattga

SEQ ID NO: 71899 - DNA, 249 bp, Glycine max
  Peptide Sequence Number=SeqID_188677
atgattggaggtggttcgacggtaatcaacaacgactcgtggtggtcaccgatggtcaacggtggtggaggaggagattgggggtgttgggtgagggtttgggggagaaaaggggagaaaaatgtgtgttttacactgctggacatatttataacttgcaagactcactcgggcgagctggcccaactcaaattcgcctgggcgagttctgggagaatcatgctcaaacatattttactacttttgtga

SEQ ID NO: 71900 - DNA, 690 bp, Glycine max
  Peptide Sequence Number=SeqID_188678
atggagggtcaatctagggaagagtatattggatcactaaggaggaaaagcagcggtttttctcgtggagtttctaaatacagaggtgttgcaagacaccatcataacggaagatgggaggctcggattggcagggttttcggcaacaaatatctttacctcggaacttacgcaacccaagaagaagctgccacagcatatgacatggcagctattgaatatcgaggagtcaacgctgtgaccaatttcgacctcagccgctatatcaagtggcttaagcccaataataacaacaccacagtcaactctaatcttattgactctaaccctaattgtgagacgaactttacctcaaactctaatcaacaacaaggattcaattttttcaacagacaagagtcattcaataatgaagaagcggcaatgactcagcctcggccagctgttgccacgtcagccctaggacttttgcttcagtcatccaagtttaaggaaatgatggagatgacttctgctacagatttgtcaacaccgccgtcggagtctgagttgccgtcatgcacatttcccgatgacattcaaacatattttgagtgtgaagattcccatagatatggagaaggggatgatattatgttcagcgtgctcaacggctttgtgccccctatgttccattgtgatgacttttga

SEQ ID NO: 71901 - DNA, 426 bp, Glycine max
  Peptide Sequence Number=SeqID_188679
atgaaggactctttcttgttgatcagaatcttagttgaagattatcctgtaacatgtcaccgaggctcttggttttcagcgggtaagatttctccaattttcaagtctatcatgaatgagtatgctcataaactgcatgtagaacaacctacatacaacaatgataagcaactgctaggaggggtgcttcctgcttttataacttctttggttttcaatggtacaagttacactggtggtccagctggaacaaaaaaggatgttgagcagtcagccgcaaaggctgcaattctttcaattatgggtatccttccgtgtgattctagctcgggaacttcacttgccgagattattaggtcaaagtctatattttacgatgcagtgttatccgatatacaagattttaatcatgtttcaaacatgtag

SEQ ID NO: 71902 - DNA, 180 bp, Glycine max
  Peptide Sequence Number=SeqID_188680
atgcaggatgatgccgcaaccacaacaatgatagcagccgcaatagccgatggagtcacaatcgtgggtttccatggtaactgccatagaggactaaatggtttgcaagagaatgaagaagtgaaaaggaaaaacaaagtgcaattgacatcacttggtactaccaagaagcaaccataa

SEQ ID NO: 71903 - DNA, 354 bp, Glycine max
  Peptide Sequence Number=SeqID_188681
atgagagtgagattggcgtcgttcttcactggggctgccgcggcgtcgtttctggggctctacaccctccacaaggattacaaggtcgcgcaccaatcctttactcaacagatgaatatattagaaatgccaataatacatgtaagaatgcttcaattgattgtggcttctgtttgcctcgtaaatatggtcccttgttgttgctatgttgatgtcttctgcaatggttatagtagtgctgtgttgtggcttctttttaaaagctattctactgatccagagctagaaaatggtgggaagatggccttttctgcttgttaccgtttagatgtgcatatttcgtcttttgattga

SEQ ID NO: 71904 - DNA, 123 bp, Glycine max
  Peptide Sequence Number=SeqID_188682
atgttcaacgctgatccttcatttcctaatgtccctaccctcatcactgaacagattcaaaaggaatgcggggtgtggggaggtgtattagatgaatgcattttggtgtcaaaagttagatga

SEQ ID NO: 71905 - DNA, 246 bp, Glycine max
  Peptide Sequence Number=SeqID_188683
atggagttagagcaacttgatgtcaaaactaccgttctctatggaagactggagaaagacattttgatgcaacaacctaaaggttttgaggtggaaggaaaggaaaattttgcctatagattgaagagtctttatcaccgactgaagaatctaattagcagtcttgggtttctagaagaaaaggctatcgccacatcatccatatgcagccacaaacaccctgtgggctcatcagacgatgaatga

SEQ ID NO: 71906 - DNA, 1083 bp, Glycine max
  Peptide Sequence Number=SeqID_188684
atggcgagctcggtggagaaggagagtggcgcgagcgaggaaactttctctttggagctgcctgctccaccaggttggaagaagcaggagcccccttctatgctgcagattgtgacggagtgggatctcagtggcatcgcaatattccttgctcaatcgtgggatcagcagtcacctgcaactcttgaggcacttgtttttggagcgcctggccctcccgctgccatttgtggcaaaaatcatggtgtcttgcagctgctcatccgtttgcaccattgccggacagccgctttcatcccaaagaaagctggtaccccaaagaaaaatgagattgtgttcactgcaccaacaggagaggagatcaataacaggaaacagctggaaaaatatttgaaagcacaccctggtggtccagctgtatcagaatttgactggggcactggtgagaccccaagaagatctacaagaatcagtgagaaggcaaaggcaactcctccaacagaaagcgagcccccaaagaaacgtactaaaagatcgtcagcttcacaaaaggaaacttcccaggaagaaaaagaagaggagacaaaggaagcagaaatgcaagaagttgatgacaccactaaggatgataatgatatagagaaggaaaaggatgttgtaatggaaaatcaagatggcaagagtgtggaagatacagatgtcaacaaatccactcattctggagaagctaaagctggagaatatgttgaggtacctattgaagaggaaaaatccaatgctgctgatggagaactacctgcattgaaagataaagttgatgacaaagtttttctgagaaaggatgaagaaaagattgagcaaccacaggaagagacaaaagaatatcgcagaactggggtgccagagaaatcagaaacatgcactaccgcagacaaaacggttgaagtggaaggagtgaataaagaagtcagaagtactcgtcaatttgaagttgggataatagaaggaacaaaagtgaacagtgatcagataaacaagaaggctgaggcagagttgactgtgaatggcaatcttgggagctga

SEQ ID NO: 71907 - DNA, 303 bp, Glycine max
  Peptide Sequence Number=SeqID_188685
atgaataagaacttgggatccctcatctcaagtcagatttctctcatcgcacaacatgactcctcgaggctaggttttctagcccttattactgctttatgcaaggcccgaggagtcacatctgattctctgacctttgaatccctgagcccaaccattaatttggcttatattaaaaagaatttctggaacctagatgatccttcggtcacttttcgaggaacccagcctacatcagggccagctcctgatcatgcagagcttgcggaatgtggtccactagcggctggttatgagcgttga

SEQ ID NO: 71908 - DNA, 267 bp, Glycine max
  Peptide Sequence Number=SeqID_188686
atgggtgcaagggatgaatcaatcatgcacaagggaaataaaaatcctgatcctgtcaatgatcctgtgcatgctcattcaggtccagtgctggtgcagatgatggatcctgtgaaagaggcaggtccgaaactagtgcagatggctcaggctctgtggcctctggaatgtcctcctgttgatcctgctgaggctcctgggctacggaggcctcaccccctcccaaaggagaaggctggactcctggctaggccatctactgaataa

SEQ ID NO: 71909 - DNA, 456 bp, Glycine max
  Peptide Sequence Number=SeqID_188687
atgaccatatttgtctttgcgggtcaacgagctcgcttgcctctgactcgattgtttctggatagcaaaaagggtgcgaatgaccatatttgtctccgcatgccatcagacttgattgtctgtctctggatgacaaggactttgagtcatatgaaagataaagtgaggactttgagtcctatgaaagataaagtgaggactttgagtcctaagaaagataaagactttgatccctctaaaggcgaggactttgagtcctctgaaggcgaggactttgagtcctctgaaggcgagaactttgagccctctaaaggcaaggactttgagcactctgaaggcgagaactttgagtcctctgatgatgaggactttgagccctctaaagatgagaactttgagtcatctaatggtgaggactttgagccctctaaaggcgaggagtttgagtcctcttaa

SEQ ID NO: 71910 - DNA, 318 bp, Glycine max
  Peptide Sequence Number=SeqID_188688
atgaaggtgggttcatcatcttcctccgactcattctcagattcatcatcagaggagtcttccaaacttagaggttggggcaagcttctagacgcagactttgaggatgactccttggaagcgaccaacatacaatgtatgtcctcaccttcctccatagtaaacaactcatacttacatgtgaggagacttagtgatgcaataatccctaggaagggaccagtcactagagccataagcaagaggctccaagaggattgggctagagctgctgaagaaggccctagggttctcatgaacctcagggtagatttctga

SEQ ID NO: 71911 - DNA, 203 bp, Glycine max
  Peptide Sequence Number=SeqID_188689
gaagggctaaggatagggaaggtaagcaggtaggggtttcaaggatttctacctcaaatgatgatgaaggagatttaggttgggaaggctttttgggtttatgtgcatggtttgagtcagagtctgatccctttctctttttagggtcagatgatggtttggcttctccccctgcgtttgatgagatggcactccaaacttaa

SEQ ID NO: 71912 - DNA, 318 bp, Glycine max
  Peptide Sequence Number=SeqID_188690
atggaaccatcgtctagagtcactcagctcaaaggggcaacctttgtgaagatgggaattgctaacaatttcctaaatgccatctcatcaaacgcagggggagaagccaaacctaaacgtagccaacccagaaacaagctacccacaaaaacaaaagacccacctccatcttctgacccaaaaccttataccttagccaaaaagcctaagaaccaaccatcatctgaccctaaaaagagaaagggatcagactctgactcaaaccatgcacataaacccaaaaagcctaccatcagaatcaaacccttcttgccctaa

SEQ ID NO: 71913 - DNA, 213 bp, Glycine max
  Peptide Sequence Number=SeqID_188691
atggcggtttccaaactcggaatgatgcaaagggttcctctcagtgtggggtttcaacggagaacaatggcggtttatggtggctactggtggctgtgggtgatggagaaagttcttggggcattggaaatggttttggaagaaaggaggagaagaaatggcatttttccaaagctaattggactacaaggctcaaaatgcacaagtgattga

SEQ ID NO: 71914 - DNA, 156 bp, Glycine max
  Peptide Sequence Number=SeqID_188692
atggaaaggaatgaaattgaggctgaacttgaaaatagcaggaagtctttaactgataaaatgatgcttgatgcttcacatattcagaaaaaggattctagcattcttggtgatctgaaccacttccttatagctcaagaagaagagatgagttag

SEQ ID NO: 71915 - DNA, 948 bp, Glycine max
  Peptide Sequence Number=SeqID_188693
atgaaacctcattggatgataagtgggactcaacagaccacttgtccatcctctgaaagcagagaagagcctaaaaagaagaagctgacaagtagtgatgattcctttaaaaaaactttcaatgctatacctcaacaaatcatcagaatggatccatcacagaagaatttgtccctttgggttcaatggtcaaggaatgtcaacattttcactttcattacaaggtttctacctagcaattttgttgatctcaatccttccaagattgagttagacatgatagatgcatatccaccacacctgcatatcaggagatcaactaatatcaaaatagtgtatgaccgaaattgtccaagtttaccagtttgcaatgaaggcaagaaaaagaacttcaatttggtacaattcaccaactacaaaagggattggaagaacttgttaaaaaacaataagttgataaaaagaaagctagatagccacgatgctcacgcttcatggaaccaaactatctggtttgataccaagaaatcatccatttctaattctggagatgttccaattgatgatcacaaggattcaatagaagtattgtgtccaaccaaggtttatcattttgatgataccttcgcatgctttataaaaaatcctgaagatggatttatatcaagattggcaaagctccccattattttcaacaagactatcttcgatcagaacaagatgggtgaagaagagttcactgcctgtgacatgcatcaatctaaagatattgcacctatcaactacattgctcttgctgttgtgacaaaagaacaaattcaagaaatgatggctcaggccttgctgaagcaacaagaagagacaaaacaggagttgcttaaagaaagaaaaaagacaaaactatatctgcaagcctttgctgaacaacaacagtttgagaataagtag

SEQ ID NO: 71916 - DNA, 969 bp, Glycine max
  Peptide Sequence Number=SeqID_188694
atggtggtggtggaggcggtggcggctttggaagtggtggtggatgtggcgacgggcattgacaatgatgtcattgtcgtagaggatctcgcagtaacggcggtggtcggtgcagagtggcaaaggcagcagttggttgggctggaagtggcggttgatgtcgacacagtggggctgccacacgctgacggggaagtaggtggtgccgaaatcaatttcgctagcaggaccatctccttttccagctatgggaagcggagtctggatgggtgtggggctttgttgcctagtttgggttgccttattcctgaggataaagctgaggaggaacgtgggagtatggagctggcgacgacggtggtggctgcaccgaagaaggtgcggggagcattggcggaaaatcatggtatccagtttcaggctaatgagatcgaatcagaatccatggaagcttgggctgtggcgaggttggcttgggctgcggcgaggttggcttgggctgcggcgaggttgtccatggcggcctcgaggcggtctaggctggccgcggaaggttcgccatctgccattgaagagcgacaaagaaggggcatccagtccacctttgtcaataaacgcaccgaagctctcatccttgaactgcatggtggtcatgtccatgatgcgccatcacatgagggaacagtcgtgaacgtcgcggcggagcatatcggagatgacgatcttggagaagtcaatgttggtgatggtggtgtggccgacgtcgtagaggtgctcggagaggcgggagttgccgcagcctgggatgaggagctaaagcgggagaggagcggtctcctagggtttccagaatgtcttccgggggacggccatggcggtgagaacgtcaacgaccttaatggaagccttgtagagaacgttttcggagacattgccttggtccctctcacaaaggctatggaaacctaa

SEQ ID NO: 71917 - DNA, 762 bp, Glycine max
  Peptide Sequence Number=SeqID_188695
atgtacagacgcaaccaagccattacatatccacctggaccacatatcagcagggccactgatatcaagatagtggttgataaagtgtgccctcgtattcccttgagggatgaaggaaagaagagagaatttaagatctatcattatgcagaaatgccaagcagaagcacaaaggtggaagtagaaactacccaaggaattggagttctttatttagtggcaaaaggcatcaacaacgttgaccagcaggactttattcaagtgttgcatctagtaaagatgtatccctttgatgatgcccgcatgtgtttcaccgaggacattgaagattatgacttcgttgacaggttgaagaaccatcccatcgtcttcaatgaaattgtttatgatctaacaaagatgaaaaggacttcaaatattataaaagtttttgaaagagatgaaaaagagaaaggaattgaagtacaagctgaagttgttgcaacaataacaaaggttgtggacgacgccattgttaatgaggtcatcatcgatctcactaacactgcggtaatggaagaagaatcatcgtccaatgcagacaaagctaataagatgtccatgttaggagttgttgatgcacctaaagtccgtccacctccatctgtccaacagccacctgtaattgaacaaccactaacaacaaatgttccatcttcccctactaaaccactaccaccaccagcagatcaaccacctccacctccagcagttcaagagtga

SEQ ID NO: 71918 - DNA, 261 bp, Glycine max
  Peptide Sequence Number=SeqID_188696
atgcccccaaggagactcttgtctcactataaggtcgattctagaagaaacaggctactcactgtgtcatgcaatgcagaagacatgttgcttccacgcagtaattttacattttccgaatatgactcaaattttaatgtagtacagaagcaagttttcagaatcccagatcacttgatgatccatgattgggcattcacggatacccactacatagtatttgccaatcgcataaaacttgatgtactgggtaagaattga

SEQ ID NO: 71919 - DNA, 549 bp, Glycine max
  Peptide Sequence Number=SeqID_188697
atgtgccaggcaatgtggggggatacaacagtctcttgggaggtgcaaccagcaattaattctacagggggactgctatgtatgtggactgaaaatagattcacattacaaaggaaagtagcggggaatggcttcatttgcttaacaggcctatggattaagaaggcattgcagcttcatattgtaaatatatactcaccatgtgacatgcaaagtaagagaatattatgggaaaacatcaaacaactgaaaatagccaaccaggggggactatggtgcattatgggggattttaacaacatcaaagatccggtggaaaggatgggagtctgtcaaaggggggtggaggggagcagtatcagggagtttaatgaatggattgatgatatggaggtggtggaagcgccatggattggaagaaaatttacatggtcaaagtttgtagattggggtccaaagccattccagattcttgattgttggctcctagacaaatctttcaagtcaatagtgaaggaatgttggctgtcccaacagcagagtgggtag

SEQ ID NO: 71920 - DNA, 564 bp, Glycine max
  Peptide Sequence Number=SeqID_188698
atgcctataaatatagctttttctctctccttgtgcaaaactttcttcctccctttctccttgacacgccctccattccaaaatcttcaaaccctcataactttctcatttcttacccaaatcctttcaaacaaagtgcaaacttcatcttttttcaattctctacaaaccccactgatcaaaatctaccaaaaatgcatcaaatggcagactcatctaagaagcgcaagagttcaacttcaaccaccaccgctacaggccaaatgccaccacgacacttccggtgactctctcgcaccacccaatccctccatttcctccccacgttccttaactttattttcctctgacgaacaacgtcaaagggtccctaacccctatgtggacatgccacatgtagcggaaaacaaggagcaggaagcaaaaatgatatgggaaatagcaaataatttgggagtaactgggattgaggaacagggaaggatagtggagaaattcatgcaaatgggggatagagacaaaaaagaggcagagaaagtggggaatagaagccataactcatga

SEQ ID NO: 71921 - DNA, 282 bp, Glycine max
  Peptide Sequence Number=SeqID_188699
atggaagaatccaatcgggaaaataacaaagatcacatttcccagtcaagagggtccgctcttgacggtgaagaacacattggagaatggaggaatccaatcgggaaaataacaatgatcacatttgccagtcaagagggtccgctcttgacggtgaagaccacattggagaatggaggattccatcgggaaaataaccaagataacatttcccagtccagagggttccctcctgaccgggaaaaacacgttggaaaacggaagattccatcgggaaaataa

SEQ ID NO: 71922 - DNA, 549 bp, Glycine max
  Peptide Sequence Number=SeqID_188700
gaacgagaaacagggaaaccgattatcaccgggaggcacaagggtgacttctatgttctctcccctatgccagaatcatatttttctaatcgtttcaaattcggatcagcaaacatttggcatcaacatctaggacatcctcaaataaaggaattaagggagtcaattgaactacctctgatgaatcctgagctctttcttcaatttggaattaaacctccaaagggtgttctcctttacgggcctcctggtactggtaaaacattgttagccgggctattgccagttgtttccagtgccataattgacaagtacattggagaaagtgccaggttaatcagagagatgtttggttatgcacgtgatcaccagtcgtgcatcatttttatggatgagattgatgccattggaggtctccgtttctgtgagggaacaagtgcagatcgtgagattcagagaatgctaatggagctgcttaatcaacttgatggatttgatcaacttggaaaggtatattttattccagaatcccatttaacttggagttaa

SEQ ID NO: 71923 - DNA, 420 bp, Glycine max
  Peptide Sequence Number=SeqID_188701
atggatcgtctagtgtctaacataaagtccttcaatagaacttggcaaccaaaggtctcgacaatctttgagtctaaaaatcttacatcaatcactcatgctaaactatttagaaagttatgggaatacgagatggacatgactaggatgggcgaacatgaggctaaggagaaaaagagtagagacttagcactaaaatcctccataccatctagttgtgagagtgatgaagtaaatgcaaaaggttccgagatgttcttttattctggggcacttagaacgatgctcagaaaagtttacagaactgttgttagagttgagaactcggaagaattcttgaagcccatcagaatgatgaagtttactccttttgagtacttagttcttggaaaaatactgaaaaacatggcctctacatag

SEQ ID NO: 71924 - DNA, 636 bp, Glycine max
  Peptide Sequence Number=SeqID_188702
atgttattaaatatttcatctgtggagaagttatggagtttaggtttgagagtagggtggagttgggagaaaggggttgagaggtggagggaggatgctaaagccattgtgatgatatgtggaggagaagaacaacaacaactatttttcaatgattacaataatgtctacaaggcaaccatttttcctcacaatgttgggctaggagttactaggcaaaccttggtttttcaaatgctaatgctgttatatgcagttgaatatttcaatatgctaacattggatttatcactagacccctcaattaattatccttcattcaatatgctagcattggagagaattgaaaaggagaaagaagaagccttcaagatacatgagcaaaagatattgcaactccaatctgactatgaaaaggaggttgaaaagttaattaggcaaattagcaaaagtgttgttttcaccttcttgctaagccaatctgttgacttcgcgagtgtcgcaacgtgcccttttgcgggcgagcgaggcgaggctcacgggtgcgctttccaaaggagaaaaaatgcgcggagtcgccaccaacgtttatttgtggaaaacgtcggaaaaatcgaaggaaaccggtcaaaatga

SEQ ID NO: 71925 - DNA, 726 bp, Glycine max
  Peptide Sequence Number=SeqID_188703
atgtgggacacactagctttaacatatgaaggatcgtcacaggccaaagcatcctcaacacccaaggaatcctcatctagacatgtgtccagaagctcatccaaagcagtcaatgttgacatacctaatgatgagttcaatgatgaaggatcaaataaagatgatcaattagccctcatctcaaggaagataaagaacatgtggaagaaaaggagtggatcaaattggaaaggatccaagaaattacatagagaaagaaaggagaagaagaaaagttccatcatatgctatgagcgcaaaaaaccagggcacttcaaaacaaaatgtccaaatcttgacaaatcagctcacaagaaaagatacttcaaaccaaaagataggaaagtattgataagcacgtgggcatacctggacgacacattgttcgatgaggaaacaaaagaggaagaagaagcctaccattgtctaatggcagacataacattagaaggatcagattcagaatcagatgaagagttaaagacaacaaagcttcaccttgagaatgaggaaatttgtaaagaaagatctagtctattggaagaccttcagagattgaaaaatcaacttgaaggtttacaaattgtgtataccacacttaataaacttcatgatcacctaattaaggaaagatgcaatctatttgaaagaatgttcatagtgaataccctgaaatttccttcttaa

SEQ ID NO: 71926 - DNA, 300 bp, Glycine max
  Peptide Sequence Number=SeqID_188704
atgttatctcctactatgcctactttggatttgagcgatggaacaaccctttgcgattcttacagcaattctttaggcatgacgctaatagaatgcctattagatctaccttctctcacaatacggccaccgaggtccatgaggatctgggagattttagagatgatgaggatctcacgccatccgagattgctttctactgggatgtttgcaatgaagagatatttaagggagagatggtttcatccgatgaggaatgagattcctcaggagatgaaagcgaccttttcgaggatatga

SEQ ID NO: 71927 - DNA, 402 bp, Glycine max
  Peptide Sequence Number=SeqID_188705
atgggacattattttattttggacttcccacaccctattattcctcccgttatgatacaccctttacatcaaatcactccaaggacccctcaaccacctccgaagacaacgatgtcttccccgcctgcagttgcttcgtccgttgagcctccatcgtcttctagaaatcataggactggtgttgttgcagcagggacagcagttgttcgatggaatgatctagtgacgccgattaatttgtttgagtatgggcttgcgttcctcggtgtggcatattataagcattcaaagttgcaagcgctgaaagcaaaggaggcacagaagaagaccgcacaggcagatgaggaggaagggaggttgctcgaggacaaagatgacaagaggaatgaccaacaaaattaa

SEQ ID NO: 71928 - DNA, 255 bp, Glycine max
  Peptide Sequence Number=SeqID_188706
atggcaccagaggtgatccgatgtaaaccttataatgaaaagtgtgatgtgtacaattttggggttatattgaacgagcttttaactggaaattacctatacgttgagacaaaatatggtcccaccaagattgtcatggaagttgtggagggtaagctgcgacctaagctttcgtgtgatgatgttggccaacttgaaaccagagagattgaaggcgctttgcatcctgtggacaaaatactatttgaaagttaa

SEQ ID NO: 71929 - DNA, 612 bp, Glycine max
  Peptide Sequence Number=SeqID_188707
atgactactcaagatggacatgggttatgttccttgctcacaagaatgagtcctttgaggtcttctttaaattttgtaagaggattcaaaatgaaaaagaagtatgcattacttcaattagaagtgatcatggtggagagtttgaaaatgagagttttcatctattttgtgaagagaatgaaattcttcataatttctctattgctagaacacctcaataaaatggtgttgttgagagaaagagtaggtcattgcaagaaattaccagaaccatgctcaatgataactctacacctaaacatttatgggttgaaatttaagactggacgaaggcattggaccactgatagaataatctacaaaagcaaatgtgcccagtcaagtaatagaatagactcaagaagaaagagaacctacttgacggattcaaaggaagaattacctagaagtcaaatcattagagatccttcaaccaaagtcaaaaaaagaggatctcttagacaacagggttatacatctctcatttcaaaagtggaacccaagcatattaatgatgtaatggaagacgaaaactgggtcaaagccacccaagaggaacttgaacaattctag

SEQ ID NO: 71930 - DNA, 765 bp, Glycine max
  Peptide Sequence Number=SeqID_188708
atggatatggcatgtatatatacgaataattgcagtatgaataacaacaaatcagaagttgataacactgaagtgttgttgtttggcgataaaggtacatttgttgatgatggactacttggtgtcctcatccattcattcgaagacgaggaagacttagtatttgtagaggagtttgttgatgatggcaacatagtagatgtcgtccactcctctcagagtcttcatgttcctcggaatgttgatgtattattgaaccttcttcttcccatctgtctccttgagattcctccaatagagagcttttggaacatgactcttatagggcttctcccaatcgtcttggtatgtgtttcattccctgatgcaccctacgacttatgcaatagaatccatggacaacactacttctttgccaaaaaccttggacacaatggtcttctagtccttgaggtcaagtccttccaacatttcaatgtcgaagaagtgttcaatgagaatagtgagctcttcttgagtgtagatgttggtggcgtctgtggtgatgatgaacatggcaagagcagtgttttctctagagcttgtcatgctttgtcgttcgtcttgccggtgagcttcatggtcgccgacgagctcgcgccaccattgtggtgcctcttccgtgccaccgccgctgctatggtggcctctcgtcgcagtaccatgcaccagtggcaccagggaggcgcgccaccctccgtggtggcttctcatattgcgtcctaa

SEQ ID NO: 71931 - DNA, 1347 bp, Glycine max
  Peptide Sequence Number=SeqID_188709
atgagggcatgtgggtggggttggtgtatgagggactgctttttactttggttatacatcatagtggctgtagatgttgatgcatatagcaatttggacaatgacacttggtcttactatgaagctcttgcattggttatttgcttgggttaccaatgtagccaattaaggttgtggtggaagctgatagaagtcaactttgaagatggattaaagcagtttagtgatgacaagcatgcattggaattggaagaatatgcagtgaataacaatggtgaagcaaatttgtatgttgaacacttgtctgtcaatcaacctcaatatatatcatatgaggagttgctccagcttgcacatgcttttctggatgaggacgaaggtgaaaggaatggtgcacatgttgatgaaaatgatggtgctgaagttggtcatgaggatgttcaacatgtggtccaaatgctgaagttggtgttgaggtggaggggggaggaagctccaaagggaggaactgatggaggggtgggtccttatgaaaatgatgtagttgatgatggagggagtcaaaatgttgtcaatgaaagtggggatgttgtttgtcataatgaaaatggtgcagataatgtcatgtcaactgggcaatttgaagatgaggatgattcattctctccaagtacctcaaaagccagtgatgaagatattgatgatgatactgaatttgtggatgacatgggcagtgctgacaatactggagcttgtttggctcattttgcatttgatttacctaacatggatgatgttggagatgatgtagatgctaactacatgtctgaggagttggacaatgggagtaagtcagatgaggatggcaactttaggcccagaaggagtatcgggtttggacctcatgaactgtgtaaggagtttaagttcaggcttcacatgcaatttagttcactcacccagttcaaggaagcaataatggaacattttgtcttaaatgagaaagaagtcatattcattaagaatattaaaaaaggggctagggttgtttgctcacaaaagtgtggttttctatgtttggtaagcagagttgggagaactgaaacattcgaggtaaagactttgaccgatgaacatacatgtcccagagtgtttaacaagaagaatgctaagtctaaatgggttgcaaggcagattttggacaggctaaagtccaatcctcatatgactatgaatgaagtggttgatgacattaggagtagatatgcaactagtattacatcagtaacttcttataaagctagacaaattgcattagccattgtggaaggggatgcaataaagtaa

SEQ ID NO: 71932 - DNA, 324 bp, Glycine max
  Peptide Sequence Number=SeqID_188710
atgaaaggcataacagagggagtgaacaacatcaacatcgctgattcttataagaagaatcgtattcaggtctctaacaccatgaatcccctcctccaggacattggatttgatctctgtttttcgaaacgtgagcttcctctccctcaccttttcccgacattgcttccttcgtatagtggaagtattaacttgtttggattgagtttgtgcttattaaaattcttagttgttgcagtgaaggtgttattgattgagagggtgaggagtgttgaaaacgagcatgcaatggaagcaggaggggcaggggaaagggggaactaa

SEQ ID NO: 71933 - DNA, 255 bp, Glycine max
  Peptide Sequence Number=SeqID_188711
atggggatgcctgctaggttgcgttccccatttccggtactgcacggggatgagacgggtacgaccatgagacaaccagaggatggcgttgacttattgtgtacggctagccaagacggggatgacgacttcattttgtggggacgtattggggacgacaatggcctacacggaaaagccagcggttttgaggaagctggagaggaactagagatgtatcatgaagggtccaccgaaggtgccgatagtgagtaa

SEQ ID NO: 71934 - DNA, 426 bp, Glycine max
  Peptide Sequence Number=SeqID_188712
atgggtatattgaggtctttgggggaagaaaagagagtcaaaggagatagcagagacctgtgtctgttctgggatggggcacaagacaatcaagtcgcataccagtctttgaagttcttagaagaattggatggaaaaatcccaatagttcatgttgaagatgtctgtgaagctcacatcttttgcgcggagaattggtcaattaatggaagattcttagttgcaagctcatatgcatcatccgtagatattgcaaattattatcttcaagcctatcccgaattccatttgaaccacaagtccaaaaagggatataatatgggcatcaacgaagttgacagacaatgggtgtttatgtacaaatatgacttgaagatgatattggatgattgtatcagatgcacaagaaggataggcaacctctag

SEQ ID NO: 71935 - DNA, 201 bp, Glycine max
  Peptide Sequence Number=SeqID_188713
atgttgcggcaagtttgtggattttatgtgcaaatgagtaacttcacaaaggaggagtttgtgcatattttacggcgacagtgcactgcaaaggaaggtggtagaggaccaagtgtatgggatacctttacccataaatatccagataagatcaaggatggaagtaacagcgacatagcgattggctcctaccaccactag

SEQ ID NO: 71936 - DNA, 273 bp, Glycine max
  Peptide Sequence Number=SeqID_188714
atgagaggatttaacggcaaaaagaaggatttaattgccaatatttatggcttggacaaattctgggaatcaatggcaatggcaatgacaatggtgttggcatccaagattttttgttcggacgaagattttgtttgtcaattggagaaaattttctccactattgtacatttaatttcgatccggattcacaagacttatggagttggagcctatttttgtggtgtgtctatatacggtttggagtttgtcaagttcaacatcaagagctag

SEQ ID NO: 71937 - DNA, 462 bp, Glycine max
  Peptide Sequence Number=SeqID_188715
gaaagacgcagcgaatgcgaacaatatcttctaagatggcttaaggaatctgaccgagaggtgtacattggaccttacttccatcaggcacattggcaactcgtagttttgtgtcctaggcaacatgttgttgtttggttctgttccttgcgtaggaaacctgatatgcatatcaaagctacaattaatagcagtgtaatgacgaaattgaagacgaccttgtctcctgaaactaaggcagttgcacctaagtggattgaagtaaagagtcacgttcaaaccggctgttatgaatgtggatattatgtaatgcattggatctggaacatcatagccagcgacataaagagtgactggtccatgcaacaattaagtgcagctatagtaccaccaagcttggcactacagcagttaactgaacaaatgaagtgtccacagtcattggatggttgcctggtagag

SEQ ID NO: 71938 - DNA, 500 bp, Glycine max
  Peptide Sequence Number=SeqID_188716
ttcctgacaaggtcacacaagtttctaaatcagagaaagcagagtccagattctcttatgaggagtatcaggagtatttgaagctcaaatccgagaagcccagcaatcaagcacaaccatcgtccgtaccatgtttttcaataacgtgtatctctcaatccattgaaggtcgcaacccttggatactcgactcaggtgcctctgatcatattttttgtaataagtcctccttctcatccttttctcttccaaaaattcctcacctcgttactgtagctaatggctccaaggaacatgggacggggcgactgattggagaaggacatgaatcacgagggctttattactttgaatccagtccacctgggtcttgttttgctacctctagacccaaacttttgcatgatcgtctgggtcacccaagtttaccaaaattgaagattatggttcctagtcttaagaatcttcgagtcttagattatgtacttgggtttatttaa

SEQ ID NO: 71939 - DNA, 486 bp, Glycine max
  Peptide Sequence Number=SeqID_188717
atggtctttctcaaaattcatgatcttttgtttcttttcacaggaaaaaagaacgaggactgctcagaaaagagcgtttcaaaaacgcggcagagaagcagcgtgcaacagcaggaacggtgtgcgctggtcgacatatcgaacgattcaccgatcgcggggctggcgaacgggaaggacatcattgagacgccgttgtcgtcgatggcgaagaagaagagggtgaagaagacgatgaagactccggggtcgggagaggctctgctgaggggccaggtgaagaccctcttgcagagggtggaggaagaggctgtgatttcgaagctatcgatggaaattgttgcaccctttctgaaacttgcgaattcttctccaatgtcgcttcttgcgcccactcccgcaaacacaccacaagtccccaatctttctgaagtggctttggtgtctccaccttctagtgtggttgaagaacaattgatctctcgg

SEQ ID NO: 71940 - DNA, 507 bp, Glycine max
  Peptide Sequence Number=SeqID_188718
atgaaaagatggatcaaagaagagagagacccgtcaattaaatttattgttgttcatgcaccagaaagaggaattgcaaggtgtatccaacatatccaacatgaatatctatgtgtacgaaacagtctaaagtctagaaaaaaaagacaaggagggtggcttggccttggcgtgatgcctcttgcggatggtggcacaatggcgacccgcgatgagcgtgcgagaatcgtaggatctaaacgtgcgagtcacgtaacgctcaactttttcttcattgtcttgaaagatgttgcaaagggcactcaaggaatggctaatggcgcgaaaggcgtctctgcatacgatgcgacccaaatcaaaggttggaggagagcgttttggtggtggaggagctggattcaaaagcagcctcaggcagtgttctatgctgctcggtgtggcaaccacacttgttgttgtcatcagaggcaaaagaaccatcagaacaacaaccattctagttcctga

SEQ ID NO: 71941 - DNA, 996 bp, Glycine max
  Peptide Sequence Number=SeqID_188719
atggtagcaataatgttggtgatatcggtgacgatgatggtggtggtagtggtgtttgtggtcgtggtggtggcagccagctatggcagtgaaaacgatggtaatggtggcagtggtgtggtggtgacaatgacaaagatagtattgatggtggtggcattggtagtaatgatggtggtggtggtggcaatgatgatcgcggagttggaaggacaaaaagtaaatatggtaggagtgaaaaattcttataaggtatcactacagtgcaagaaagcgcctattctcatggaaggatcatcaggtgtaaggaaaggcgcatggagtcaaattgaagataaccttctcagagattgcgtgaaccttcatggggaaggaaaatggcaccttgttcctaaaagagcagggttgaacagatgccgcaagagttgtagattgagatggttgaactatcttaaaccaaatatcaagcggggagattttagtgaagatgaggttgatttgatgatcagattgcacaagcttttgggaaacagatggtccctaattgcagggagacttccaggaagaacttcaaacgatgtgaagaattactggaacacctacatgcgccgtaaagtacactctcacaagaaagacaacaacatagagaagcaagctgatgaggccaaaccaatagtgaaacatcacgaagttataaaacctgttcctcgaactctatcaaaaacatctccatggttgcaagggaaatttgttaatagttccaaagttggtgttagtgaagaaggtgcaacttcaatatcagggtctgctgggaattggtgggaaactttgttagatgacaaagaagacaatgcagttaataacaacaacacgtgcttctttggtggggcagatggagagtttaacctttggagtgaagagcttacttcaattgattgtgattttgttacacaaggtgaatcttggagtgattttcttcttgacctacaaggctag

SEQ ID NO: 71942 - DNA, 351 bp, Glycine max
  Peptide Sequence Number=SeqID_188720
atggaaggatcatcagtgaaatacaacaacgtagagaagcaagctgacgaggccaaatcaacagtgaaacaacacgaagttataaagcccgtacctcgaactctatcaaaagcatacccatggttgcaagggaagttaatcaatagttccaaagttggtgttagtgaagaaggtgcaacttcaatatcagggtctgggaatttgtgggaaactttgtcagatgacaaggaagacagtgaagaaggtaacaacaacaaatgcttctttggtggggaagatggagcacttgacctttggggtgaagagcttaattcaattgcttgtgactttcttacacaaggtgaaacttga

SEQ ID NO: 71943 - DNA, 1937 bp, Glycine max
  Peptide Sequence Number=SeqID_188721
gtgaatgcgaagcacaattgagcgatccccagagtgtaacaatggctgggaaaactcaaactcactactttcttctcttgtttctcttcttaatctccatcaacgccaaacttgatctctacccttcagactacaaggcactcctaactctgcagaaggacctcggagtcaacggtcaagtctccgcaactctggcttgcgaaacagagggcgtgttctgcgagcggaggaagctctccggcaaggaaacctacgccctccgaatcaccagactcgtcttcaaatccaacaacctcaacggtgttctgtccccttccattggacgcctcacggagctcaaagaactctctctctccgacaacaacctctttggccgactccctccccaaatctttgactgcagaaagctccaaatcctcgacctcgccaacaacctcttctccggcccagtccccccagagctctcctccctcacgcgcctccgcgtgctggacatctccaccaacaggctctccggcaacctcaatttcctcaaatactttcccaatttggaaactctctccgtcgccgacaacctcttcaccggaagagtccctccctccgtccgctccttccgtaacctccgccaattcaacttctccggtaaccgcttcctcgagccctctctacaatcatcctcaccagaaacaattctctccagacgttttctgttagacggcgacggtgatgttcctgctcctgctcctgcacctgcacctaataactcaaacaagaagaaaaaatccaatgcttcttctggtgctgctgctgcaccaggtcccgcaccgaacaaccacaagcacaagaaaagtaggagaaaactcttagggtggattctggggtttgtggcaggggcagtggcgggaatcttagcaggattcgtgttttctctaatgttcaagctggctctggcgttgataaaaggaagaggaaggaaagcggggcctgatatctacagtccattgataaagaaagcagaggatttggccttcttggagaaagaagaaggaatggcatcgttggaaatcatcgggcgaggtggctgcggagaggtttacaaggccgagttaccgggaagcaacgggaaaatgatcgctataaagaaaataattcagcctcccaaagagggtgctgagttagcagaagaggacagcaaggttctgaacaagaaaatgaggcaaattcgatctgagatcactacagtgggacaaatcaggcaccgaaaccttcttcctttgctggcccacgtgtctaggccgggatgccactaccttgtttacgagttcatgaagaatggcagcttgcatgacaccctgagcaaggttgaggtgggcgagttcgagttggattggttgtcaaggcacaagatcgctctcggtgtggccgctggactcgaataccttcacttgaatcacaaccctcggatcattcatagggatctcaagcctgctaacattcttcttgatgatgacatggaggcccgaattgctgatttcggcctcgccaaggccatgcctgattacaagactcacattacaacctccaatgtggctggaactgtgggctatattgctcctgagtatcatcagatactcaagttcactgataagtgtgatatttacagctttggcgtcatacttggggtgttggtcattgggaagcttccttctcatgagttttttcagcacactgaagagatgagtttggtcaagtggatgaggaagattttgagttccgagaatcccaaggaggctattgatacaaagctgctggggaatgggtatgaggaccagatgcttcttgttttgaagattgcatgcttttgcactatggatgatccaaaggaaaggcctaacagtaaggatgtttggtgcatgctgtcacagattaagcactga

SEQ ID NO: 71944 - DNA, 1774 bp, Glycine max
  Peptide Sequence Number=SeqID_188722
gtggagatgcacattcctcaacaatggtgttactgaattacatctctagctatgcatggcatgcgaaagttgtgctaaccttagcagcctttgccgttatttttggagagttttggcttgttgctcagttgagtgctgaaaacacgcttgccaagtctgtggccctccttaagcaactgcctgacattgctgagaatttcatgtccatgaaacctcattttgaagcactcattaggctcgtgaaggcggcgatggatgtaaccatgtgcattgttgaattcaaggagctaccatctgaatacatctctgaggatactcctcctatgtctgttgcaagtactcacattcctattgcttcctattgggtcatcagaagtattgtggcttgttcctcacaaatttctagtttcataggcatgagaaatgagtccatttcatcaaccacagaggcatgggaattatctagtctggctcacaaagttagtagtatatatgagcacctcaagaaccaactggttctttgctaccaatatatagatgacaagaggcatatagaggccttccataatctgatacgtcttttcgagacagtccatgtagacaacatgaaaattctcagagcactgatatatgcaaaggatgatgttcttccacttgtagatggaactgcaaaatcaagggttagtctcgaggtactaaggaggaaacatgtgttgctgctaatatcagatcttgatctttcacaagaagagatcctggtacttgacaatttgtacaaggatgcgcgagcaaggggcgacacgcaatacgagatggtatggatcccaattgtggacaaagcaacctggaatgacatgagcaaacagaagtttgagtatttgcaatcattgatggcatggtacagtgtctatgatcctttcatcattgaaccatcagcagttaagtacatcaaagaagtgtggaatttctcaaagaaagctattctagtggcccttgatccacaaggcagattgtcctcccctaatgctgtgcacatgatatggatttggggaaatttggccttccccttcacaagtgagaaagaagaatccttgtggaagcaagagatttggagccttgagctgcttgttgatggcattgatcctacagttttagaatggatgacagaaggcaaactgatatgcctgtatggaggagaagacctggaatggattgaaaaattcacagccactgcaataagcgttgcaaaagcaggcaagttcgagctagagatggcgtacgcggggaagagcaacgcgaaggagcgtatgcagaagatgatcaagacattcaccacaagaaagttcagctacttctggccaaacgtgacatcgatatggttcttctggacgaggctggagagcatgctgtactcgaagctgctgcacgggaggacggtggagaaggacgagatcatgagcgaagtcatgacggtcctaagctttgacggcagcgaccgagggtgggcgatcttctgcagaggcgccaccgagatggccagagccaagggtgacagtgctctcagatgcttgcaggattttgataagtggaagggaagaattgaggaagacggtgtggtgcatgcaatcaatgattatctcaacaaaaacaaaccaccgcatcactgcaaccgcctgatccttcccgggagcactggtggcataccacagaaggttgtttgtgctgagtgtggacgccaaatggagaagtacttcatgtatcgttgttgtgtgga

SEQ ID NO: 71945 - DNA, 1560 bp, Glycine max
  Peptide Sequence Number=SeqID_188723
atggaaatcctctcatatggatctggaccatgcagtcaagcagtggattcgaagtggaaattggttgacaaatgcttgaattcacgtcaatcaaggtttcccagtgttggaaatggtggagtttattataccaataccatttctagaagcgggtcagtgagatttcatgatactaataaggagcttcaaagagattttgggtctctgagtgctcttgaagggtccaaaagaaccaattgcaaggcctatagtgaaagttgcgatggctatgtgattggtggtgaagaggatgtagcagatattgcaggggtagaagaacctgctactaacaaagttgtcattccaggtctgccagatgggtcaaatggtgctccaataagtagttgcttttgggaatggaagcctaagcttaacgtgtactatgagaaggcagggtgtgagaacgtggattccccacatgttctctttcttcctggttttggtgttggctctttccattatgagaagcaactgagagatttggggcgtgacactagagtatgggcactggatttcctaggccagggattgtccttgccttttgaagatccggctcctcactacaataaggaaggggttacatcagatggaaatgcttcttcatggggcttcggagatgaaacggaaccatgggccactaagcttgtatactctattgatttatggcaagatcaagttcggtacttcatagaagaggtcattggtgaaccagtctacattgtgggcaactcattgggaggatatgttgcattgtattctgcggcacgtaaccctcatttagtgaaaggtgtcacactgcttaatgcaactcctttttgggggtttcttcctaatccaattaagagtcctggtctagcaaaattttttccatgggctggaacatttccactacctactaatgtaaagagactaacagagttggtgtgggagaaaattagtgatcctgcaagtattgctgaggtacttaatcaggtttatgcagagaattcaacaaatgtagatagtgtattttcacgcataattgaaaccacaaggcatcctgcagcagcagcagcatttgcttcaattatgtttgctccccgggccgaattatctttcagtgaagcgttatcaggatgtcgaaaaagcaatgtgccaatttgcctaatgtatggaaaagaagatccctgggtaaggccactttggggacaccaggttaaaaggcaggtgcctgaagcttcatattatcaaattagccctgctggtcactgtcctcatgatgaagtccctgaggtcataaatttcttgctacgtgggtggatcagaaatctagagtctgagggttctatctcattgccactgcttgagggcctagacagtctgaaacaagctaatgccagggagttagaatttatcagagaaggttcaacaaaatcagtgatggtcagattttacgaatccacattctccctttgggacaggataagatcttacatcaaccatcgatctaagttgagaaattcggcaaccaaatctcaatga

SEQ ID NO: 71946 - DNA, 210 bp, Glycine max
  Peptide Sequence Number=SeqID_188724
atgtcagagataagcaccaagataagaaggggtagggttcagatgaagaaaaaccaaattatattgatgtcgcacagaaggtacaatgctaagctaagcgccgcatcctacaaggaggggtttgttaagtacaattacatagtttccggaaatctctttatggttgaaaaaggagtgggaaggcttatactaggagaactggagaagtga

SEQ ID NO: 71947 - DNA, 150 bp, Glycine max
  Peptide Sequence Number=SeqID_188725
atgatggtcgtcatctggtggccatcgaatgacgactccgtgaagggtttgggtgaatgggtttgtgtggttgtggcgatgccagctaggaggagtgattcttcagtggtggctggtagttggagaaaggaaccgtgggttggggcttga

SEQ ID NO: 71948 - DNA, 327 bp, Glycine max
  Peptide Sequence Number=SeqID_188726
atggcttcgaggcttgagattcttcaatatctcttaggcaagacagtgtgtgggttactgtatgactctttggctggatttgatgatggatatgaggaagtgcaagcagtagtcatgtcagatgaagggactgagtttcgatacatcaacagaagattggaagatgatgtagaattggagcaatgcgctcagcgcgccattgcacgctcagtgcgagaagccaagttgggagccaacattatcatgcaagggcacttagtgcacatcaggaggcttagcgcatggtctcttaagctagctgtactatgcatgtacgctaagcgttag

SEQ ID NO: 71949 - DNA, 1650 bp, Glycine max
  Peptide Sequence Number=SeqID_188727
atgaattccgacttccgatcctttgcagcgcaataccctttacagcctatctgcagtagctttgtagaccgttggatgtatcaaagggttgacaataaaaaccaaccaagtcaaacaattaatttctatctcaagctctctcaaaacaaaactgttttggctaatggcttttccatgactggtaataatgttccagaggcaccccttggaggtaaaacatatgcatcattggttgaaacatggcatgtttcattttctgtgcttatcatatttgaggagaaccatttcatttgccgattaagaataggtcatgcatgttttcagcaacaggtgtatatagccgatgtgcaagttaaacgaaaccaatctttatatataggtataaagaaagcgacaatagtcgattatgtaatcagccttgaaatcattcgaaacttcaaaaaagtgacaatcattaattggcaatatcacgcagcaaattacgaaaagccggaacagtttgttaattatgggaggagattgaaagagaaggatgatttgacttggttaattcacttttgttttcataaagctgcgaggctggagagggaaattgttatggaaggtgacatgatgaatctgatcaaggtgtgcccctcagttgtcatatctttatgctactgttattggatccgcaaattggtccctccaggaataaaaagacttgtgtttcttcttcccatcatatgcttgtacattttcattcctctcagcttttcttctgtacacttgactggcaccataggtttcttcctcgcctggctagcaaacttcaaactcttactctttgctttcgatatgggacctttgtcctctcacccattaatctctcttccacgttttgttgctgttgcgtgcttccctatcaagatccaacaaaatcaacctcgtcaaaatggtaaaaccccacatccaaatccatcttcaatgatacggtatgccatagagggtcttgctttgggcgttttgctgaaaatctatgactacagtgatcgtattcatccgaaagcgataatgtgtatgtactgtttccacatctactttttgttggaaataatcttagccatggttgcagccatggctcgaagcatgatggggttggagctggagccacagttcaatgatccactgagctcaacctcactgcaagacttctgggggagaagatggaacctcatggtcaccagcatcctgcgaccaacggtgtacgatcccacattgaaagctgcagtgaatgtcgtgggtcccaagtgggccccactaccagcggtgtttggaacctttgtggtttctggtttgatgcatgagttgatactgttctacatggggaggttgcagcccaccttctggatgacgtggttctttgtcctacatgggatcttcctgacggtggagattgcgttcaagagggccctcacagccaggtgccggttgccgaggtttgtgtcggggccattgaccgtcggatttgtcttagccaccggcattagcctgttcctgccggagttcatacggtgtcagattgatgttaaggcgtttcaggaatacgctgagttagggcagcttctaaacaatctcacttgcggcatctttcataatagtaatctttag

SEQ ID NO: 71950 - DNA, 408 bp, Glycine max
  Peptide Sequence Number=SeqID_188728
atggaggagttttctttgcaggtgggctggccaggagtccaaccttcttctcatggaggaggtgatgtcgcaacctacccttcggcgggagggcgacacggggctcacggggctcacggggctcacggatgcatcttccatgggaggaaaatgcgcggagtcgccaccaacgtttattcgaggaaaacgtcggaaaatccggaaaggtatggtctacgaactttaagtgtgaaaggttcaggagttgtatttacgcacggggaaggaaatagagggaggagcttgccgcccaactcgcccaggcgagctaggttgcttcctccagaagcaaccctgcctcgaaaatactctggaaggcccaaattcaaaattccaaaattgctatttgcaccccctctatttcgataa

SEQ ID NO: 71951 - DNA, 351 bp, Glycine max
  Peptide Sequence Number=SeqID_188729
atggagaaaacgagtgggggttgccaccaatgtttattcaagaaaaatgttagaaaaaccaaaagaggtctgcgaattttgaaaagaagggttcgggagttgtttacgcatagggaaggaaaaggccatttggtgcaggggaagctcacccaggcgagccaattgcttaggcttgaaggtaccagctcgccctggcgagctgattgcttaaggctaaagctttcccatggcccaagcaagccagatgctagaatgggcgagtttaggtctcgaaagttccaaaaaatgaccattttgcccctttccttgtggcttttgtttccggatctaacaatcaaacatcaaccctga

SEQ ID NO: 71952 - DNA, 156 bp, Glycine max
  Peptide Sequence Number=SeqID_188730
atgggtaggccatggtgcccaaggtccctatgtggagcatcagcttcatcagcctatgcatctaggttcagagcctcaccccccctcccccccgaacaagggaagtctagactccgggccaggccacctgctctaggaaatcccgaagagttatga

SEQ ID NO: 71953 - DNA, 354 bp, Glycine max
  Peptide Sequence Number=SeqID_188731
cgcgtggctttgatgctgatgctctgtcagattctccttagcactaaacgcgctgaagctacgcttagcgatgtgatcggagctattgagcccaaggcttcaaatggacatcctttcatcttagtcgccattgactacttcaccaaatgcgtcgaagcagcttcgtacgctagtttgatgaggagtgtggtgattaggttcatcaaaaaggagataatttgccgatatgggttgcccaggaagattatcattgataatgccaccaatctgaacaacaagatggtgagggaaatgtgtgaggatttcaagatccaacaccacaattatatgccttacagacccaagatgaatggg

SEQ ID NO: 71954 - DNA, 387 bp, Glycine max
  Peptide Sequence Number=SeqID_188732
atgtgtaccttctatgttgcatcaacaattgatgttctacgaaagggaccaacatcatttgtcactgaaggtaggatagctagatcagctatggtggatgcacaagatgaattaaaacatgaagaaagggtgttacctatcaagaagaaatcccttagttttgaagcacaagattccttgaaagagatcaacctaggaaccaacgataggccgagaacgaccaaagcgagtgggttgttagtcgagaaagataaaaatcacattgtcaagataattacgaagtataatgatttttttgcttgggattaccatgaaatgctaggattatcaagagatttggtagagcatgaattttcaattagagaaggatttaagccacatcgatag

SEQ ID NO: 71955 - DNA, 423 bp, Glycine max
  Peptide Sequence Number=SeqID_188733
atggaacaattcatgttaggagacattccttttgaccctgctatgttgatgtcagtttggctatctttggccaaattagccagagaccccactgtttttgacactagccgccaactcttgaatcatatcatggaacaactagctgacttagttgaacatgaacatctcaacaaaagagttgtagatctgataactgaacttgggcgtatcaagaaagaactagccgagttgaatcccaagattacccttctaaactccaaactcaagggcagtttacatcaacttgttcaactttatgctttggtaaactctcttgatctcaacaacaaccatatacttcatcaacaaaaagggttgtggaaagatcttaatgcaagtgaaacaagtatcactgaagataggaaagaaggagatgacttgtag

SEQ ID NO: 71956 - DNA, 345 bp, Glycine max
  Peptide Sequence Number=SeqID_188734
atgaggaagtattttggcattcagttgaaaccaatggagacacctatgtacaagaaaccatatcaagaatgggtggatcatatgatgatgcctttgccgaaggggtataaaacactagatttttccactttttcagtcgatttgatgaacatgaggaaaatggttgacaaattgacaatagacttcatagaaaggtttagaaaggccaaaagtcgttgtttagtgcaattactagaagtggagtgtgcggctatggcagccatggctatcaaaatctcaagttatcttgctaactcttacgagtttacgagtccacttatcctctgcgagttgactcttgagtaa

SEQ ID NO: 71957 - DNA, 732 bp, Glycine max
  Peptide Sequence Number=SeqID_188735
atggcagctgataatatgcatcctcagttgaaagaaaaactagtggctcaagagtatgttaatgttgatgaggagaatgtggaggcctttgaagaggaagccaaaatcatagttgctgagatattatgggggaagccttattcatgccactttaagctagttggtaaaggcgcaaccgaaatggtagtagatacaggtccttccccaaagaaaccaaaggatccatcacaaggacttccgtatttgaaaggttgtagtccccaaaaccaacaagaggtgccagagattgatgataatccaatcccacatagtaaaagaaaggtggttgagttcaatgtcaagaatggaataaaaaccttacgaaacactattaacaatgagggaaacaacccatctagaatgattaagccatctacaaaaatagaggagagaaaagtattgcccaagaagaaccaacagatagaagattcattgttggaggcttggttggatgatgatgagttactaggttctgaaattaatgtcataagtcttacccctagtgatttctgggcgagttctagtcagaatgagagattagatggagatgttttttatgaggaaattgaaggggccaccattggagattcagaggccaataaaagaattgtcattactttcaatcaacctacactagagatgaccaagctcttgaaacctttgtatgttaaagcctacataaatgttgtctag

SEQ ID NO: 71958 - DNA, 171 bp, Glycine max
  Peptide Sequence Number=SeqID_188736
atgagtttgggtgtccccgtttgtaaacaaactgtgaattggtatattgaaccacttcctgcagggtcatcaactaagtttgaatttgaaaacttgcttgttggtcaagctattccatcaaattttatccctgcaattgagaagggtttcaaagaagctgccaactcgtga

SEQ ID NO: 71959 - DNA, 456 bp, Glycine max
  Peptide Sequence Number=SeqID_188737
atggcctacgtcaagaaggaagcttccaagctatctcttattggagttttcttctacaaaaagttgactagatggaagcctcccaaaacccccactcctccaggaagctttataaagaggatgttgtggaagcaaagcttccaagcttattttgatgatgccaaaaactcaagtcaagaatcaagattcaagtcttctttgataaacactggactcaaaagactaaccgcttttgggttcattgcaagaagtggatttgcttcttggttgatcactggacttaaaagactaaccgattttgggttcattgcaagaagtgggtacaacttcttggttgttatcactggactcaaaagactaaccacttttgggttcattgcaagaagtgggcataacttcttggttgtaatcactgaagacaaaggaggggattcctttgtggttcattgcttgtaa

SEQ ID NO: 71960 - DNA, 627 bp, Glycine max
  Peptide Sequence Number=SeqID_188738
atggtgttagggaccttccctcatcatcccacgcccgcttttatagccaaaatggggaggagcttgccgcccagctcgcccaggcgagcaagttgcttcctgacgaaggttacggaagcccccctatgtcattttatagcaaaatgggggaggtggttgccgcccaactcgcccaggcaagctgggttgcttccacctgaagcaacaaaatgcccagaatcttctagatgggcccagatgggcgcaatgctagttgtcgcaacctacccttttacgagcgagcgaggcgaggctcacaggcgagaaaacaacttaaatgatcggttaaagctcgtcaaaaatggaagaaaagaaactgaaattgaacaaaataaaaatgaaagccaagaaacaagaaatgaattaaaagtctcggatttggaaacttacccgttgaagaatgaagaacggatgaagaacggaggaaaaccttcacggatttgcttacggaaacgtcttggaagcattacggaagcacctcggcttggattttcttcacggaaacaatttttttcacccaaaacagctgaaatacatcaccagggtgatccgggacccttagaacaacccccttcagcctatttatag

SEQ ID NO: 71961 - DNA, 360 bp, Glycine max
  Peptide Sequence Number=SeqID_188739
atggtgattcctctaggctttgaagtggctcgtacatctaccggtatcaatctttgccagagaaagtatgcattagatgttcttactaatactggcatgttgggttctaaaccagtatccacttcatttgattacactactgggttgtatcaacattatggttttcctctctcagctgaagatgcctcttcttacaggagattgatagctcatcaacaagctgcttcccaaattctaagatacatcaaagggtctctaggtgcaggcattttctttccgacaaatagttctatccaattgaaaggctttagtgattcaaactgggctgactacattgacactaaaagatctattacatga

SEQ ID NO: 71962 - DNA, 549 bp, Glycine max
  Peptide Sequence Number=SeqID_188740
atgttgacaaggttcatatctaaatctctccaacatgcattgcctttcttcaagctcaaaagaaagggcaccaagttgaaatgggatgagaaatgtgaagcaactttccaaaaagtgaaagaaaagttaccgccaccacctatgctcgtaaggctagaagttggcgaaacactttatctttatctcgttgtggcaaacaaggcaataagtgttgccttgagtccgagaaacattggtgctatagttctcttggaatccttgtacgggttgatcattgagcaagcattgacttttgctttcccaacaaccaacaaccaagcggagtatgaagcttgtatttccagaatgcggttagaagaaggcctaggtgcaaaaaagataaagagttggatgaatccaattgcaacatatctcgtggatgggaagttaccctcagacaacaagaaagccaggaaattacaaatgatgacacttgcatactggcagaagttcactagggaagctgtggacatcacttgggtggaaagtctttggtcagaaaagcattaa

SEQ ID NO: 71963 - DNA, 1287 bp, Glycine max
  Peptide Sequence Number=SeqID_188741
atggagaaatctgaaaagaaaaattttagtgaaaagaaaatgaagaaagcgtacatcacatgggatgacaatgatatggaatcttctgaagattcagaaaatgaagagataaacctctgtctaatggctaaaagttatgaaagtgatgaagagcctcactctcgttctcgtgcctccttcatccctaatcttcaaattctcatatcttcctcaattcttcaccaaaacacgtcccgtaaagcccaatcttcctcattttcactcctctttcgattccaccgattgaaattcactaaaacttcctcaaatggtagaatcatcgaagaagagaaagggattatcctccaccaccaccacggaccatctgaagcacccacaacacctatccatcctcccttatcatctccaagatcatccactctgttttcttccaatgatcaacgtctacggtacctttctcaattctcttctaagattatcttagaccctaagtacctagacatagatttcttcaatgatgagacatttaattgttatcaagtgtttcaaaattctggcttggttgatttcatgtctttaaaattgccttattatcctgaacttgtcaaagtcttttactgcaatttaaaaattcaggatgacattatttcttctgaggtgcatggtatttccatgatcattgatcaatcattgttcttttctttgactaaattacccaatcaaggtgcatcttttgagggaaccattgttgatgactggaaatttgattattctagttatgatgcttgtcgtatggtttgtaatgaccaggctgaaatgaccggtagattgctggccagatcattgacctttgataatcgcatcatgcactacattattgttagaattttgcttccccagtcttcaaatttggctcaagcctctgaggaggacttgattttgatgtgggctttccttatcggccgtcaaatcgactgggctcacttggttcggtaccgaatgcataaggcattacgggccaatgcacctctcccttaccctcaattggtcactctatttctctgtcattttcaaattccgcttgatgatgaaccatttgttcaagtcaagcgttcctttgctattggtgttgatgagcgtattccctctcctcctactcagcgagatgattcagccctcatgactgaagttctatccgtcttacggggtcttcgtacttatgttgaagaagatgtggggtatattcgccagagcttcgatcttccaccaccacctccaccttcttag

SEQ ID NO: 71964 - DNA, 501 bp, Glycine max
  Peptide Sequence Number=SeqID_188742
atggatggtggctttcagtcttccattgctgataagggcctatctcatataagtagtagtcctgctcaccggaggtggtatcgttcttcagaggttaatcgtcgttttaaccccatcgtcaaatcttgtcctacccctgaagcaattctaggaaaaaataggaagaaaccacctacaactagtcatgttggtggtcctccgctgttgatgttcctaaattgtgggaaatggaggttcttgagaagctattgtcggtctctcactaaagaagaattcttgaaaattcaagttgatctggctacaactagagcttatacaagcctagaagttgttgaggagcacaaaaaagtttttcattggtttcgttcttataacgtgatgacgacttctaatagtgacaattcttcttttgacaaggatagcatctggaccatgagcggagaggctagtgaaccaacttacaacatgataattcctcccattccccttaggatggaatag

SEQ ID NO: 71965 - DNA, 564 bp, Glycine max
  Peptide Sequence Number=SeqID_188743
atgccaaagcttgatgaatcttttatagatataagactggacgaaggcattggaccactgatagaacaatatccagaaacagacgtgtctaatcaagtaacagaacaacctcaagaagaaagagaaccaactagattaattctaaggaagaaccatccagagtgtcaaatcattagagatccctcaacccctcaaccaaagtccaaacaaaaggatctctcagaaaacaagcttgtagaactaccacaaggaaagaaagcagtgggtggtaaatgggtgttcagaaacaagctagacaaggcagctaaggttgtgagaaacaaggcaagattggttgtcaaaggttacttacaagaggaagctcataaaaaattgagaccatatcaaatggacgtaaaaagtgcattcctcaatggagtaatacaagaagaagtctatgtagaacaccccctaggtttgagagtaacacttttccacaccatgttttcaaactctacaaagcattgtatagacataagcaagctcccaaagattggtatgaacatcttagttcatttcttgtaa

SEQ ID NO: 71966 - DNA, 1236 bp, Glycine max
  Peptide Sequence Number=SeqID_188744
atgaagggcatcattgttgatcctgagtgggtggtattggtggttaagatggcgatgggtggtttggtggtggggttggaagagtgggtggaacacttactagtggttgaggttggagttagaggagttggctcctttggtgtcatatcccaccatctaattccaagagtagagcttgaagccctttttcttcctttcatcatagatgggcagtcttgggaaaactctgttaggcaccatcttgatgtcagtgcatctactaatgtggagtccaatgggataagttgggatacattggtctcgtctaagaaagggtatccagagctactatggcatctgggggcagagccgcatattcaacaaatgaagtatggatgtgattgtacttcatccatcgaggttaagtcactagctcatgttgtctttggatggggtctccagcttcttctccatgtggatccaagtaatggaaacttggatgtgttgattggggagagaggcttcttagtttgcactagtggtggattggatggacttgcgtctaactcttgtcttcctcttctatggaaaggacaaggggatgattggctaatcatgcctctgcttcttttggacaacaagaatgggcttgttccttctgatgtcaactttcattaccttcaggttgacaacactaaagtgttgttgtttggcaacaaaagttcccttgctgatgatggagtgcttggagtccttgtccagtctttcaaagacatggaatacttggtgttcccagaggagtttgttcatgagggtggcatagtatatgtcatcactccgcccaaggtcttcatgttctttggtcttcttctagtcttcttagtatgtgcttcctttccttctgcacctagtgacttgtgcgatggtctccatggacaacacaacttcctttctaagaaccttggacacaatggtcttccagtccttaagttgagcgttcctctagaacatcctaatgagttttgggtatatcagttgtggatcgttgaagtagccacaaatttcacaaagaagcagagccaagaccttccagcatacaatgttgaagaagtgttcaatgtgaacaataggttctctatcaatgtggatggtaatggtgtctgtggtgttgatggttgtgttcttgcaaggatagtgaagatagactgctgccctaatttctcagagtttataagggaatgtgagcagtttctctag

SEQ ID NO: 71967 - DNA, 531 bp, Glycine max
  Peptide Sequence Number=SeqID_188745
atgattcaaggggagtctaagggttgtgccagaagtgaccttgagaatacttgtaagccaagagtggccttgagaatacttggaaagctacccagtcccaagattgataagaagaggaaacgggacaagaagctactcgatcccgagtttaccaatcccaagaatgctcccatttcgaaggtgcaatctaaggaagagaagaaccctgagggcagtagaatagattctgttgaaatctttaccacttatcaatacgatggtagtaattgggttgagatagagccaaagaccgataagtattctttagactcaaaggaagaagaagctcctcgtctcggagaaaaaccacaagggtcgagaaatgaatatgtcaaccaagctgagaattatgtatgccttttttctgacaaaaatgttgataaagataaggcctacaaggaacaacttggcaacacaaatgttcccactactaagaatgtccttcatcacgacaaagcaattgatatggagaatattgtcattgttgaatga

SEQ ID NO: 71968 - DNA, 270 bp, Glycine max
  Peptide Sequence Number=SeqID_188746
atgttcccgcaaagccagaggtacctctctgctaactctgcttcgcctctgtgctatactgaccgtacacgtggctttatcacaggaaataaacttttaatcaatgaattgggtcccacggcttcagacgccctagaagtgagacctaaaaatatagtatgggacatggtacccaatgtgttgattcaattcttacttcaagaattggcagaacttgtgcacatggctacctatggctatgtagaagatgagacttggcagttttgttga

SEQ ID NO: 71969 - DNA, 202 bp, Glycine max
  Peptide Sequence Number=SeqID_188747
atggataggttcggtcgaattgttgttcagattaggaaccttaaccccgaagtagccctgcactccatgctgctcgtcttacggcctggaaagttcgtagatagtctgtgcaaacaaaaagcctcccaacaacatggacgagtaacacgaacaagccaaaggctacatctaaatggaggagatgtcaaggttcagaaacgag

SEQ ID NO: 71970 - DNA, 159 bp, Glycine max
  Peptide Sequence Number=SeqID_188748
atggttgttgggggaggattggaactctctaaaggtgtctcgcatttgaggctagaccgtgtgctaaccattggtgaaaagagggtgcgggagataatctgtcaccccagtagcccggttgctaatgacaatgcgttcgtgctcctgtatcagagttaa

SEQ ID NO: 71971 - DNA, 168 bp, Glycine max
  Peptide Sequence Number=SeqID_188749
atgtttaggttagggaaggtcatactggcacctgctgtaaaccatttaatagacatcggtactgatcatggagcaattagtggcatcatcaagatatttgaatgggtagttgccaccacaacacagggagtcactcgtgtcgatgcacggactcatattaatatgtga

SEQ ID NO: 71972 - DNA, 234 bp, Glycine max
  Peptide Sequence Number=SeqID_188750
atgggttcgttggcaacggttaggtgcagtgaaggtgaaggtaccggcattgagcgttgcggtggtcggcggcggcaaacaaggtacgcagatggtggtgtgactgtcgcggacgtgtttgagtgtcgagaggatgttttgcggtgggctcgatccgtggctcatgaacacggatttgtggcggtgatttttgttggatcaagtggcctcagaataattaagaaggggggttaa

SEQ ID NO: 71973 - DNA, 309 bp, Glycine max
  Peptide Sequence Number=SeqID_188751
atgatagtagacatgttacaagtgttctactatgagaaaataacgggttacacaccttcaagctttgtggatttagttttcgctggcaaaaggatcgaagtgggtcagaaaagaggcaaatttgatcatcctgctttaacaaataaaaagcctggggcaaatagagaggatgagaaggaggaaggaacccatgctgtgactaccgttcctacatggccaaatctcccaccagctcaacaatgtcattactcagccaatatcagcccttctaattaccaccacacaatcaaccacaaaggccacccctaa

SEQ ID NO: 71974 - DNA, 258 bp, Glycine max
  Peptide Sequence Number=SeqID_188752
atgcagagctccagccagaagcagccagtgctgagcatggaggagttccttagtcaggtggcctggccaggagtccggccttctcctttgggagggggtgaggcctccgcagcccaggaacctgtgccagaggaggacgagcccatccctcctgagccatttttttatgagactgatccagctagtgctcaggaggaggtagcatcaccaaagcccgttcctcagtcatctccagctctagttcttgatgatccatag

SEQ ID NO: 71975 - DNA, 123 bp, Glycine max
  Peptide Sequence Number=SeqID_188753
atgtgtattgactacaccgatctcaacaaggcatgccccaaggatgcatatcctttacccaacatcgacaagttagtcgatagtgcatccaagttccaaagaattataagcaattgggcttga

SEQ ID NO: 71976 - DNA, 243 bp, Glycine max
  Peptide Sequence Number=SeqID_188754
atggaaaaagaagaccaatcaagaatatcttgggatgataaaagtgatttctgtgttttgaagataaatggcatcaaaaccatagtgaaaagctacttgccaatcaaagatgcttatgttcatcttggtatagatggtcttttgaatattctgataaacatgttgtcttatcgtgaaatatcaaaggacttacagttaaggtatatcagcttcacaacgctacatattttaattgatcaataa

SEQ ID NO: 71977 - DNA, 927 bp, Glycine max
  Peptide Sequence Number=SeqID_188755
gctgttaagtcgaaccaccagttgtcgtccaaggtggagaacactgctactgaaaaggacaagctcgccaaggtgattactgacagcgaggcttggttgcaggagtcagaatccaagctggagaagtctgagctcagggtgtcaaaggagaagaaggccaacaaacaactagaggaggagttattggtgttcaagaaggaggttgggttctttgccaaactgcttgacgaagaagaaataactgttgtggaggaggatgctggcgaggagcaaggagatggggccaattttgatttccatttggttgaaggtcttgctaaccagtcgggtggtacctcttatttgaggataagttccttaatctgggcctttggctatactcgttgtagttctaaaggagaaggcttacaagggcgtgccttgggcgaaacttggcaacgaagaggctcaccaagggcagaccttaggtttgacgagctttggactagggacgcgtttgtcctgggttttggcgaggatcttgggtttgtcgagcctttggagaagcgagactcaccaagggtgaaccttgggtttgatgagcctttggagaagcgagactcaccaagggcagaccttgggtttgacgatcctttggagaagagatactcaccaagggcagatcttggggcagaccttgggtttgtcaatcctttgaagaaacaagactcaccatgggcggaccttggaggctcaccaagggcggaccttagctttaacaagcctttggacaagcaagactcaccaagggcagaccttgggtttgacgagcctttggagaaacaagactcactaagggtggaccttgggtttgatgagcctttagagaatcgaccagtgacgtgtctgtcctgggttttgtcgaggctcactaagggcagaccttag

SEQ ID NO: 71978 - DNA, 729 bp, Glycine max
  Peptide Sequence Number=SeqID_188756
atgctggtggaactagagacaaaagacgaagtccaaaagatgaccaaaatcaaggaagaagccaacaagctccgagcatcaaggagatataatacaaaggttcaacctcgagcctttcaacctggcaacctagtatggcgagtccgaggtctgcccttagtgagcctcgacaaaacccaggacagacacgtcactggtcgattctctaaaggctcatcaaacccaaggtccacccttagtgagtcttgtttctccaaaggctcgtcaaacccaaggtctgcccttggtccgcccttggtgagcctctacaaaacccaggacagacgcatcactggtcaattctccaaaggctcgtcaaacccaaggtccgcccatggtgagtcttgtttcttcaaaggattgacaaacccaaggtctgcccttggctcgtcaaacccaagatctgcccttggtgagtatctcttctccaaaggatcgtcaaacccaaggtctgcccttggtgagtctcgcttctccaaaggctcatcaaacccaaggttcacccttggtgagtctcgcttctccaaaggctcgacaaacccaagatcctcgccaaaacccaggacaaacgcgtccctagtccaaagctcgtcaaacctaaggtctgcccttggtgagcctcttcgttgccaagtttcgcctttgcaaaaatctaaggaacacaagaaacccaaggtctgtccttggtaa

SEQ ID NO: 71979 - DNA, 315 bp, Glycine max
  Peptide Sequence Number=SeqID_188757
atgaaggcaagaagtacctccgacagcatgacgcaagcctgtcaacctctcgaaggaggaggactcattatcagaagcctcatcgtgtgtccccttcgaggaggagccgccaatgggaatgacctctcggtctaccagggactgctgaatagagccctagagtcacttccgcccatacccatggtagcccagataacacttgtccagactggagggcttgacaagcttgacaaacctgttcttacacttatcgaagttaccactattagagatagggggagcagcaacatggaacaacctaaggctaaagcttga

SEQ ID NO: 71980 - DNA, 453 bp, Glycine max
  Peptide Sequence Number=SeqID_188758
atgatccttcccccttctgcttctaggggagcaagaaggagtggcggtggggatgttagggtttccccccgtaataagcgtagccacagtgttgtgttgccctcgtcccttcctgttgttgctggctacgagtgggtaagggacaatgtgttgaaatatcgatcctccattacctctgcagtgagcatcgttgctttggagtgccaattgaaattggccaagatggtcatccaatcttgtgggagtgatgattttcctttcttgagggcgacgtcagggaaaataggttgggtgtccctgaacagcgcgtccaagaagttgttcgagtttaactcaaacacgttttgtcacttcaaggaccattttttcaaggtcttggtaactaatgtcgtggttgatggattggcattgatgttcagccaggacgaggaaccccgtttcccattctactag
